United States Patent 11,725,251 (METHYLATION MARKERS AND TARGETED METHYLATION PROBE PANEL) - sequence listing, part 11

SEQ ID NO: 113238 - DNA, 4542 bp, Homo sapiens
  misc_feature 1..4542: note = chr17:35293669-35298211
  misc_feature 1..4542: note = Hyper
  source 1..4542: mol_type = genomic DNA
gacaatggcaacagccgctgaattgcaaagcccagcagtgcaggggagccgcctgggattccggacccggctgcaccccaaccttccacaaggctcggtcttggactacccccactctacagcagaactctggcctccgcctgcgcctattcccgctctctctctgtccctcccatcgaaacccacgccttaccggagcaggagggggcccaggcacggtgctgcccgccgtccgcgccgcgcggggccgcgggtgccgccgccactgatcctctaaacgcggtctccccgcactctcccgggccgggggatgcagaatggtttacagagggaccgcgaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgcggggctgtgcgcccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatgcactttgacttctgacagctctacctcaagccccggagaactcagcggcgctttcctcgcaacccgagctcggcgagtcgtcgtcttcttcttctccgtttttatttatttatttccgttcccgccgccgttctcgctgaccttcactcctccgcgggctctgagcagaagggtcgcattctctcccgcctgagacttcttttcctcgccccgggagctcaggcggcgccgctccagcccggggccccgggactccccggctgcacacttcactgagacgcccccccaggccccgatcagcctcgtttcctccaccctactttgatttcctggtgcgagttttggcttgcacggccgagtgtgtgtcctctttttggagagactggggagctcgtgccgattgtcttcaggagtcatcccctgggctctactttgcccctctctctctctgggcctcatcagaccaaaccaaagaccatggttcactgtgccggctgcaaaaggcccatcctggaccgctttctcttgaacgtgctggacagggcctggcacgtcaagtgcgtccagtgctgtgaatgtaaatgcaacctgaccgagaagtgcttctccagggaaggcaaactctactgcaagaacgacttcttccggtgagtactttcctcccacgcctctgctgctacctccccgcgggcccttcccggccagcttcggatcagaggttagcgtggcctcgctgcccagttaggaactgcttctagagagggcagccaagtcccgcgggcgcccgcctctccgccagctggcgcgctgggagcccgggacgcggccctgcttgcatcctggaaactatgggtctgggtttggctgcatgtgcctgggaagaaagggtctgagcctgactcggcccagaagccccttcaagcttggaagagacagggcagcctcgggcgttgtagcccggactgctgtctttcccggagccaagctctgcagcaactgcattctccaggccttcggggttgtttgccctccaggcagagcccaggctccctcccggccactaccttttccgaccccgagcggtcttggcggtaagctccgagccttttgcgtagagtgtctgggccaactgccctgtcagcggcaggaaagaactcggccttaaagccgatcctgcacgcccgggggtcttccccaaacccggacatgcctccgagtgcagacctggacaaactgctgcactgtagcctgcgaagtgcccggagctttttcctgcttccctggctgccgaagttgtctggtggttcggcttcagccccaggtgactccgactcccacgggctccgctcagtagtcctcctaggaaactgccagccacagccagcaacctccttgatgaaacctgggggaaagccgagacctccagcttgctggtggggagacttctccctaccccccttattcgtttagcattttaattatattatcgtacactcacaattttgccgctccattcacacaaacacacaagtcaacagagaagaacgggcacaaatgcgaattgtaattccaccctacggatgtgaaatatcgcaatttactcggctgacttggtctctgcttttctgagtttgtggtcatagttcaaaccagggagcaggaggaagagggattcaaagccactcagagggccaagacgcgctgtccccagtgccgctccaggactcgtggctggggttgggttgcgtggaaccatgaagcaaagctccgtgctcgctggtatttcgggagaacgcgcaggctgagcctctgagcctccgcgggctgcccggttttcctcaaggactggatcatagcgggagggtggcaaaccgtactcgtacccgctgccagtgggtccctgagcctggcttccacaacccgcggcagagcgcccagagccagctcccgcagctcccgcttttgccaacctgtcccgctttaggcaagagcgtggcggcggccccgctaaggctacggaggggggctctccgcggctatgtttgtttaccaacagcggggctagacatcgccaaccccatgcctatgtgcgggtccttttgcgatgaaggagagaaaagcggcgctccgcgcacgtttatatagagttctaattgtaattcgacttttctgaatctaatcggaaaataagtgccccgttccccccgcccacacaggtcactgccttgccaccttctttagacgatgcatctttcctctgggataacgctgggagtgaggctggggcttggcgggtagcttgggcccctggctctaaccgcgtgtatcccctccctaactcttccctggtgccgcgctctctctcctgctgcctcctcacctgcttaaccggaattctgcctctctttatctctctcttcccttctttctgtgctccattcctcctctcctacttcctccactttttacatcttccctctttctcgctgtcatctttctctccgcctgtctccccttgcccctggctgacccatccccgcccccgccccccacccccacccccccgcaggtgtttcggtaccaaatgcgcaggctgcgctcagggcatctcccctagcgacctggtgcggagagcgcggagcaaagtgtttcacctgaactgcttcacctgcatgatgtgtaacaagcagctctccactggcgaggaactctacatcatcgacgagaataagttcgtctgcaaagaggattacctaagtaacagcagtgttgccaaagagaacagccttcactcgggtgaggccccaattcctggctggctaggtgcaagcgggtcctgggggaggaaggctcgccaaggccccggctcatctgtcctttccctcttagccaccacgggcagtgaccccagtttgtctccggattcccaagacccgtcgcaggacgacgccaaggactcggagagcgccaacgtgtcggacaaggaagcgggtagcaacgagaatgacgaccagaacctgggcgccaagcggcggggaccgcgcaccaccatcaaagccaagcagctggagacgctgaaggccgccttcgctgctacacccaagcccacccgccacatccgcgagcagctggcgcaggagaccggcctcaacatgcgcgtcattcaggtcaggccccggcgcgcctctccatcc

SEQ ID NO: 113239 - DNA, 1993 bp, Homo sapiens
  misc_feature 1..1993: note = chr17:35299152-35301145
  misc_feature 1..1993: note = Hyper
  source 1..1993: mol_type = genomic DNA
attattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccccggggtcgggggtggagtctcggtggcctcaccccgccgccatgtgctgcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggaggtgggtgcgcgccgaatggcggggcacggccaggtcggggcgggcttcgttggaagcgggtggcagcgcgggggggcacgcctcgctctctgtaagccactggagagttggggcgagtagggagaaggctgggagtaaatcaaggggaggcggcgagaccgaggacccaattcacggccctgaataacgggggtagctggtaaggggcagctcccgggcttgcgcccagcctcctccctgcacccaggcccgcgagggctccccgcgatccgcgagttccccgcgtggccttcctcagcccgccgaggtcgcgtcttccctccctttcggtcccgccggcccccggccgggccctgacgtcctgcgccctccccgccgctccgcagattaccagagcgagtactacgggcccgggggcaactacgacttcttcccgcaaggccccccgtcctcgcaggcccagacaccagtggacctacccttcgtgccgtcatctgggccgtccgggacgcccctgggtggcctggagcacccgctgccgggccaccacccgtcgagcgaggcgcagcggtttaccgacatcctggcgcacccacccggggactcgcccagccccgagcccagcctgcccgggcctctgcactccatgtcggccgaggtcttcggacccagcccgcccttctcgtcgctgtcggtcaacggtggggcgagctacggaaaccacctgtcccacccccccgaaatgaacgaggcggccgtgtggtagcggggtctcgcacggtctgcggagttcgtggttgtacagaaatgaacctttatttaagaaaaatagaaaaaaaaaaaaacataaaaagcaagtccccacccccttcctccagcctcgagaaccattctccttctggggagaccggatggaaaagggggacacgaaataggatccaaatcggcctcgaggtgggactgggatccgcgcactggctgtcgacgtgcagaactggggctccccaaaggaaacgcagacctctccccaactcccacctggacccggatccgtagacagaccccgcgggcgtgtgcgcctggcaggcgggcggcgaaaagacgtccagggcagccgcgggtgcgcacagccgttggcgatgccaggagccgtggggagggaggccgtgagcacagccgggtgaaggaagtgaagcggcccagggcgctcccgggccagccaggagggttctagctctgggatatcccttattagtgttgtctcagagttcaacaacagcgacaaaaaactcttatagcttcagaaacgccgacctgccgtgcatcaggtgggactatatatatattttttgtctatctggatttttggtttttgtttttgccaaaattgcaaaattctaaatgtaaagccctccgtatcaactcttctaccttcgcaaaactacacatacacacatacacacgtacacggacacactcggta

SEQ ID NO: 113240 - DNA, 592 bp, Homo sapiens; identical to SEQ ID NO: 80340
  misc_feature 1..592: note = chr17:35303075-35303667
  misc_feature 1..592: note = Hyper
  source 1..592: mol_type = genomic DNA

SEQ ID NO: 113241 - DNA, 30 bp, Homo sapiens; identical to SEQ ID NO: 80343
  misc_feature 1..30: note = chr17:35870444-35870474
  misc_feature 1..30: note = Hypo
  source 1..30: mol_type = genomic DNA

SEQ ID NO: 113242 - DNA, 49 bp, Homo sapiens; identical to SEQ ID NO: 80345
  misc_feature 1..49: note = chr17:36102031-36102080
  misc_feature 1..49: note = Hyper
  source 1..49: mol_type = genomic DNA

SEQ ID NO: 113243 - DNA, 3446 bp, Homo sapiens
  misc_feature 1..3446: note = chr17:36102282-36105728
  misc_feature 1..3446: note = Hyper
  source 1..3446: mol_type = genomic DNA
gagaaaggccagctccggccgggagccggggaccgggaagcgcgcagtcccgaccttcctcccctgcctttctcttccaggaggtttactagaactccaggaactccaaaacgcgacttttctttctctttgcttttcgtcttaagggaacacggtgggcaaaagaagggagtgcgtgtgcccgaggcttgggagccccctgtgcagtgacctaggaaccgctagcgatttcttgaaaaattactttaatcaagtccggcgctcccgggagcgggggaggaaaggcagcacccgctcgggacgggagaaaaaagcctccaggtctgtcccgcgtctccaactcggcgagggtctccggctccccagtccctctccctgccctgctggggcctggggctttggggagggaagagcggggctggggtctaaggaccctgggccgggcctggctctccgccggccgggcctgcgggtgtcggcgacccgggggctccgcgggcggctcgggcgctcacagagcccgcgtcccgcgccagagcggtgaggccgcggggccgcacggggcgcctggctgggtgcgcgctgggagcggcgagcagccccgcgcccgcgttttgatctccttcccccctctaagccgcgtttacaacttcaccaatgaataacccgcctctcttttcaacctaatcacggctctttgtgtatctttctgttgatgatttatagaaataaattaataacaccccaactccacgtgctgcagtttatgttacgtctcagctgcggccagcccggcgcggggctgggtgcggaggggcgccccaggtccttccagcgccgcgctagaaagcgggcgcctgcggccgggtgggagggcctaggccctgtggcccccggtggccggcggtgggagcctggttcatccgccaggtcctgagcgacctccccggcagccctggcgccccagccgctcctaggggccactctctcgacccctcttagcctccgcgactcacaccttccgcctcgcggaactctcttgcaggagttctctcccggtaggggagaaatcacctccgggcgggagagcgacgagggaagaacctcaaacctatgaattataccaaagtgtgtttggggaaaaaaaatctacaagttcccctgattgttttggctagagggcaaaccgccaggccctcggagcacaaattcaaatgcaaggtcatatcccaccccaaaccgccgctgcggacgtgcggccaaggctcagccccgaaatcgcggcgcttcagtgtccgaagccacgcgatgggctctgtcctaaagcggagtggcccgggagcgacgtgctgtctcagggaaccgctcggctccttagataattagtaaccagctgtcaaagtctagggcggtcggggaggacccacaaacgatcccggccctggggatacactgccagccggcctgaactcccggggagaggccgggggtgggcagcgaggtctggaaacgccctcctttctcagactgagaccagatcctctgcgaactgaggtctgagacgcgttcgcccccacaccaccgcgcttcgtttctttggccccgcgcgtgtccacccggaccctgcatggaacatgccctttgcaaatctaaacccgcgttggggatcccggataattccgggccttgcatgggcgcggctaacaagagtgcccaccagggaactcgcctcccagatcccggctccggatgccgcctgtccttcggcaaagaactgcaggtcatcatgcaggtcaatgtgtccgaggccgacatgcggctttccagacccgaggcagcgcgcaggaaaaatgcgcggcctggggcttgcagcggcgcgaggctctgctcccgggaagtcgcagcggtttcactgcacccactcgcaccttcagtcgcgtgggcaaacctcccggcaaagggctccacagctccagttctccccggcccagccccagccccgcggggaaaagcccttgggtctcggacgctggcctgggcctggggagaagaagcccggtgggccgcagggtcgtcccgctaagggattgggaagggtccgggtgttgggagagaagcagagcgccccccgggggacttctctggtgggaaacgggcttggcgagtgtggtcgggcgcagtgtcactcaggcccggggccggggctccaggggttcgggtgggtcccctccacctcgctctgcgcctacctgagcatccggtccacctccgcccgctgctccgccgcctcctcggtgttgagcgcctgcagctccttgaggatgggaggtgtgtcatagtcgtcgccgtcctcggagccctcgtcgccggacaagcggcccttggcgtggccgttggtgagagtatggaagaccggcttggtgtcgggctcggccccgctgccaggggacaggggcagcgtctccagcttcaccccgaagttcggggatggcagcaactcctccaaggcctgaaccagcacctccttggtgaccccggagctcagcagggcgctcaggagttcttgctggagcgacgtgagcttggacaccattttccaaggacggaaaaagaagggggtgagggggtgggtgggtgcgagagaggagggtggaggggagtttcacaagcaaaccccaaatccaggaacccctccacccttcagcctccagacacctgttactccccggggtcccggaggctcctccgaaaggagtcagaaaacttctaacttgccatgatcgccaccattaggccatataagatatgcaaattagtgggaagggcccagctttcggctggatgcaaatgatggtggggagggggaaacccggagagagggagagccggaggggcagacctggagagcagaagacctgggccgggagcggggctttgccagggtccattgtactcacgctggggggctagagaccttcttttactggttctgcttatcagccaaacttcacctaacctttggacttgttaagccagtgccttgcagcctaggcgcggggcttttccaccggttctcagttccgctttagtccagagagaagacactacgcttcggggttcaggtgagagccagaggaagctggggtgctcgtggaagaaggggacgcaggaggaagcgaagagtagagaccctggatgcgtcccggccgacgcaggtggtgggccaggagagcccgcagggcggaagagaaactgaccacttaggaaggggcgccgaggccacgggggaggtgaggcagcgttaggtgtggtgagcatgccctggagggactccatttatttctacctcggttactacctccaggccccagaacctccctggcctggtctggcggtttgggtttgcagaactgcccgccagagagcgtaggcgagggtgaaggagt

SEQ ID NO: 113244 - DNA, 30 bp, Homo sapiens; identical to SEQ ID NO: 80351
  misc_feature 1..30: note = chr17:36149200-36149230
  misc_feature 1..30: note = Hypo
  source 1..30: mol_type = genomic DNA

SEQ ID NO: 113245 - DNA, 94 bp, Homo sapiens; identical to SEQ ID NO: 80352
  misc_feature 1..94: note = chr17:36204447-36204541
  misc_feature 1..94: note = Hyper
  source 1..94: mol_type = genomic DNA

SEQ ID NO: 113246 - DNA, 161 bp, Homo sapiens; identical to SEQ ID NO: 80355
  misc_feature 1..161: note = chr17:36714931-36715092
  misc_feature 1..161: note = Hyper
  source 1..161: mol_type = genomic DNA

SEQ ID NO: 113247 - DNA, 177 bp, Homo sapiens; identical to SEQ ID NO: 80356
  misc_feature 1..177: note = chr17:36729010-36729187
  misc_feature 1..177: note = Hyper
  source 1..177: mol_type = genomic DNA

SEQ ID NO: 113248 - DNA, 74 bp, Homo sapiens; identical to SEQ ID NO: 80357
  misc_feature 1..74: note = chr17:36829977-36830051
  misc_feature 1..74: note = Hyper
  source 1..74: mol_type = genomic DNA

SEQ ID NO: 113249 - DNA, 30 bp, Homo sapiens; identical to SEQ ID NO: 80359
  misc_feature 1..30: note = chr17:36868552-36868582
  misc_feature 1..30: note = Hyper
  source 1..30: mol_type = genomic DNA

SEQ ID NO: 113250 - DNA, 30 bp, Homo sapiens; identical to SEQ ID NO: 80360
  misc_feature 1..30: note = chr17:36874946-36874976
  misc_feature 1..30: note = Hypo
  source 1..30: mol_type = genomic DNA

SEQ ID NO: 113251 - DNA, 458 bp, Homo sapiens; identical to SEQ ID NO: 80361
  misc_feature 1..458: note = chr17:36875921-36876379
  misc_feature 1..458: note = Hypo
  source 1..458: mol_type = genomic DNA

SEQ ID NO: 113252 - DNA, 40 bp, Homo sapiens; identical to SEQ ID NO: 36491
  misc_feature 1..40: note = chr17:36905467-36905507
  misc_feature 1..40: note = Hyper
  source 1..40: mol_type = genomic DNA

SEQ ID NO: 113253 - DNA, 30 bp, Homo sapiens; identical to SEQ ID NO: 80363
  misc_feature 1..30: note = chr17:36996160-36996190
  misc_feature 1..30: note = Hypo
  source 1..30: mol_type = genomic DNA

SEQ ID NO: 113254 - DNA, 30 bp, Homo sapiens; identical to SEQ ID NO: 80364
  misc_feature 1..30: note = chr17:37006691-37006721
  misc_feature 1..30: note = Hypo
  source 1..30: mol_type = genomic DNA

SEQ ID NO: 113255 - DNA, 32 bp, Homo sapiens; identical to SEQ ID NO: 80365
  misc_feature 1..32: note = chr17:37010814-37010846
  misc_feature 1..32: note = Hypo
  source 1..32: mol_type = genomic DNA

SEQ ID NO: 113256 - DNA, 84 bp, Homo sapiens; identical to SEQ ID NO: 80366
  misc_feature 1..84: note = chr17:37011083-37011167
  misc_feature 1..84: note = Hypo
  source 1..84: mol_type = genomic DNA

SEQ ID NO: 113257 - DNA, 30 bp, Homo sapiens; identical to SEQ ID NO: 80367
  misc_feature 1..30: note = chr17:37161944-37161974
  misc_feature 1..30: note = Hypo
  source 1..30: mol_type = genomic DNA

SEQ ID NO: 113258 - DNA, 144 bp, Homo sapiens; identical to SEQ ID NO: 80368
  misc_feature 1..144: note = chr17:37183463-37183607
  misc_feature 1..144: note = Hyper
  source 1..144: mol_type = genomic DNA

SEQ ID NO: 113259 - DNA, 40 bp, Homo sapiens; identical to SEQ ID NO: 80369
  misc_feature 1..40: note = chr17:37192161-37192201
  misc_feature 1..40: note = Hypo
  source 1..40: mol_type = genomic DNA

SEQ ID NO: 113260 - DNA, 30 bp, Homo sapiens; identical to SEQ ID NO: 80370
  misc_feature 1..30: note = chr17:37211142-37211172
  misc_feature 1..30: note = Hypo
  source 1..30: mol_type = genomic DNA

SEQ ID NO: 113261 - DNA, 245 bp, Homo sapiens
  misc_feature 1..245: note = chr17:37307508-37307753
  misc_feature 1..245: note = Hyper
  source 1..245: mol_type = genomic DNA
ccccctcgcggacatcgccaggccgtccacacctgcccatgcccacacctgactgcccgtccctccccgcccccggcccacccgggccggctcccgccagtcctacctgctccgggctgggggctcagcgcccgggcagcctccctgagcaccagcaccaggagccagagctcgcctcgcatggtgggtgcccggacctgcccccggcctgcttgctgccccggtcctgacgagggagggggccc

SEQ ID NO: 113262 - DNA, 35 bp, Homo sapiens; identical to SEQ ID NO: 80373
  misc_feature 1..35: note = chr17:37307992-37308027
  misc_feature 1..35: note = Hyper
  source 1..35: mol_type = genomic DNA

SEQ ID NO: 113263 - DNA, 756 bp, Homo sapiens
  misc_feature 1..756: note = chr17:37321152-37321908
  misc_feature 1..756: note = Hyper
  source 1..756: mol_type = genomic DNA
atttgaatgccagaccgaggagccgcagtactaggaaggtccaagcagcgtgcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcccggggcgcttcggggcttgccaagagacggtgtttagagaaagagcataacgcgaagtcacaatcgcaggaaactcgcagcagccccccatccccgccgctggctccgtttagcggggagaaaggagggtcgcccagctttgcgtcctggggcgcaccgaagcgccgggacccaagaggagcaggcagggacgggggcaggggaggccgcggggcagtcgaggagcgcccatatacgaccctcggagcccgaggtccccccgtgcgtccgaccacagatcaga

SEQ ID NO: 113264 - DNA, 55 bp, Homo sapiens; identical to SEQ ID NO: 80376
  misc_feature 1..55: note = chr17:37331238-37331293
  misc_feature 1..55: note = Hyper
  source 1..55: mol_type = genomic DNA

SEQ ID NO: 113265 - DNA, 625 bp, Homo sapiens; identical to SEQ ID NO: 80377
  misc_feature 1..625: note = chr17:37366040-37366665
  misc_feature 1..625: note = Hyper
  source 1..625: mol_type = genomic DNA

SEQ ID NO: 113266 - DNA, 216 bp, Homo sapiens; identical to SEQ ID NO: 80378
  misc_feature 1..216: note = chr17:37369107-37369323
  misc_feature 1..216: note = Hypo
  source 1..216: mol_type = genomic DNA

SEQ ID NO: 113267 - DNA, 1619 bp, Homo sapiens
  misc_feature 1..1619: note = chr17:37380799-37382418
  misc_feature 1..1619: note = Hyper
  source 1..1619: mol_type = genomic DNA
caggagtctgggctccgcctgccttcgcggggagtaatttattcatggtgactccctcaggagtaacaatcatccataattagggttaatgatgacattcattaattacgatgacttctctttttgcttctacccgctccccctcctctggtcccgctcccgtggtggggcgcggggctgcctgtctttctggtctggagccacaaccgcaggcccccgtcctcgcccgtgaccgacggccggcgctgctgcaggccccctcgcggactccgcagctgcgcacccccggccgcggcctcgcgtccccgagcccaacagggctaggagcggggaatgcaggactgcggaggggcagggagagacgccctgagacgcggagataaacacccggagacgccgggagagacggggagagacgcacacagagacaccaagacacagacacgcaggttgtagagacaaattcagagacacgagcgaggatagaggcgcggactgagcccgggactgggacccggcggccgctggagggtgcgcctcgcacgcacagccgggcgcgtaccccgcccgcaccgctccacgcgcgccctccggcctcgctgcgcccatctctccaacgaagaccagtggccgcctccccagaaggtcgcgatggcgcgcgcgggcgtgcggtgccggtgtgatcgggggctccttgtggcccctcgtcgccaacccactcctacccccgggagcggcgcggagcctcagtggtcacgcgggcctcgcgaccgcgaccctaggacgcccgggcccacaggaggaccccgccgggaagagggcgcccgggcccggggcgcggacaggccttgcgccccccaagttaccttggtttcctggagggcggagacggtccctggggggctgtgggtggccgcgtcatccggttcgttctccttctcgctcatctcggtcatggttcggggagaggggaggagagggtgccgagatccgacggcaggcccaccgcgggcaggctgcgggtggcgggcgtctccgggactctgaagccgttctccagaggctgcccccagttagcccccggcacggcagcccccaacccgcgggagcgggcagagaaagttgccggggtggcgggcgaggggaggccaccacgctgagccgcaggagcgggacgaccccgggcgcgaggaccgagggtctgcagaggatgctgctcgcagcgcggggaggagggaagtggggccgcggggatgagccgagggagggagccaaggagctgtccgtgtccagccggctccgccgtccgctgcgcccgccccccatcccctcccctcccccgccggccccagcccggcacccggcggcccctccgcccagtcctcgccgcccaactttgatttaggaggtcgcctggtcccgccccctgccctacgccgctcccccgcgcagccctgcaaatcaggctctcagctattggctgcctcggtggccaggagggcgaactgggcggagtcttggggggctcgacacgatggggcggggcttggcggggaaagaagcggaggagggagtttcacactgaaaaacccgggatggaggggcgtgaccagattgag

SEQ ID NO: 113268 - DNA, 92 bp, Homo sapiens; identical to SEQ ID NO: 80382
  misc_feature 1..92: note = chr17:37388387-37388479
  misc_feature 1..92: note = Hyper
  source 1..92: mol_type = genomic DNA

SEQ ID NO: 113269 - DNA, 38 bp, Homo sapiens; identical to SEQ ID NO: 80385
  misc_feature 1..38: note = chr17:37606487-37606525
  misc_feature 1..38: note = Hypo
  source 1..38: mol_type = genomic DNA

SEQ ID NO: 113270 - DNA, 30 bp, Homo sapiens; identical to SEQ ID NO: 80387
  misc_feature 1..30: note = chr17:37725131-37725161
  misc_feature 1..30: note = Hypo
  source 1..30: mol_type = genomic DNA

SEQ ID NO: 113271 - DNA, 574 bp, Homo sapiens
  misc_feature 1..574: note = chr17:37752808-37753382
  misc_feature 1..574: note = Hyper
  source 1..574: mol_type = genomic DNA
aatccatcagtggggcggcagctcccgcgcccccaccccctgcccctgctggatcccgcggttgacgccctcctctcctcctccccgcactggccgcgtaggtggcctcgggtgcggaggtcccggcctggcgcaatcagttgcagagcggatggggcgggggcgcccagccttcttgcgcgcggtgtctcctccctgggtgaacagatgtctcggaattttagatgtgctctccgcccctcctcgcaataactccccccaccacccccgcagctggcaccggctgtggcgtggcgccctcctcctcccccaactcccaatagcaaaaccgggtgatggatccgggagcacggctggaggcttgggccaggaggcccgggaggcccgcggcgtggcagtggcggctcccagcgcggagggaaccattgggcgctgttcggacctcttcccttgtgtccttccttcccttctcccgcatccactcactcccatctctccactgtctatgtccttctcgacctctgccccaccctacagcccatcccagccaccgcgtctacgaagatcctctaca

SEQ ID NO: 113272 - DNA, 365 bp, Homo sapiens; identical to SEQ ID NO: 80390
  misc_feature 1..365: note = chr17:37755352-37755717
  misc_feature 1..365: note = Hyper
  source 1..365: mol_type = genomic DNA

SEQ ID NO: 113273 - DNA, 214 bp, Homo sapiens; identical to SEQ ID NO: 80391
  misc_feature 1..214: note = chr17:37756190-37756404
  misc_feature 1..214: note = Hyper
  source 1..214: mol_type = genomic DNA

SEQ ID NO: 113274 - DNA, 184 bp, Homo sapiens; identical to SEQ ID NO: 80392
  misc_feature 1..184: note = chr17:37757101-37757285
  misc_feature 1..184: note = Hyper
  source 1..184: mol_type = genomic DNA

SEQ ID NO: 113275 - DNA, 679 bp, Homo sapiens; identical to SEQ ID NO: 80393
  misc_feature 1..679: note = chr17:37760128-37760807
  misc_feature 1..679: note = Hyper
  source 1..679: mol_type = genomic DNA

SEQ ID NO: 113276 - DNA, 1660 bp, Homo sapiens; identical to SEQ ID NO: 80394
  misc_feature 1..1660: note = chr17:37761179-37762839
  misc_feature 1..1660: note = Hyper
  source 1..1660: mol_type = genomic DNA

SEQ ID NO: 113277 - DNA, 30 bp, Homo sapiens; identical to SEQ ID NO: 80395
  misc_feature 1..30: note = chr17:37763142-37763172
  misc_feature 1..30: note = Hyper
  source 1..30: mol_type = genomic DNA

SEQ ID NO: 113278 - DNA, 49 bp, Homo sapiens; identical to SEQ ID NO: 80396
  misc_feature 1..49: note = chr17:37763437-37763486
  misc_feature 1..49: note = Hyper
  source 1..49: mol_type = genomic DNA

SEQ ID NO: 113279 - DNA, 379 bp, Homo sapiens
  misc_feature 1..379: note = chr17:37763928-37764307
  misc_feature 1..379: note = Hyper
  source 1..379: mol_type = genomic DNA
gcccctcctcccaaccggcgggtcagatctcgctccctttcggacaacttacctcggagaggagtcaaggggagaggggaggggagggggggagggggcaagagagagaggggggagaagagggatcttctcgcttatttcattgttcccccatcttcagggagcgggggcagcggctcctcaaggcggcgggcgccggcgtcttcagagcgccatgcgaaccgcggagcgagtgtggcatctctaccaggcggggtaccagcctctatgccaggccatatgggcttggcacgtcacgggcagcagctatcacatgagagacggtgattggcatgcgtctgcactgggggagagccggctcccccgggacccgccgcca

SEQ ID NO: 113280 - DNA, 30 bp, Homo sapiens; identical to SEQ ID NO: 80399
  misc_feature 1..30: note = chr17:37768957-37768987
  misc_feature 1..30: note = Hypo
  source 1..30: mol_type = genomic DNA

SEQ ID NO: 113281 - DNA, 590 bp, Homo sapiens; identical to SEQ ID NO: 80400
  misc_feature 1..590: note = chr17:37783185-37783775
  misc_feature 1..590: note = Hyper
  source 1..590: mol_type = genomic DNA

SEQ ID NO: 113282 - DNA, 177 bp, Homo sapiens; identical to SEQ ID NO: 80401
  misc_feature 1..177: note = chr17:37794035-37794212
  misc_feature 1..177: note = Hyper
  source 1..177: mol_type = genomic DNA

SEQ ID NO: 113283 - DNA, 147 bp, Homo sapiens; identical to SEQ ID NO: 80402
  misc_feature 1..147: note = chr17:37823798-37823945
  misc_feature 1..147: note = Hyper
  source 1..147: mol_type = genomic DNA

SEQ ID NO: 113284 - DNA, 314 bp, Homo sapiens; identical to SEQ ID NO: 80403
  misc_feature 1..314: note = chr17:37856412-37856726
  misc_feature 1..314: note = Hyper
  source 1..314: mol_type = genomic DNA

SEQ ID NO: 113285 - DNA, 219 bp, Homo sapiens; identical to SEQ ID NO: 80404
  misc_feature 1..219: note = chr17:37857048-37857267
  misc_feature 1..219: note = Hyper
  source 1..219: mol_type = genomic DNA

SEQ ID NO: 113286 - DNA, 121 bp, Homo sapiens; identical to SEQ ID NO: 80405
  misc_feature 1..121: note = chr17:37879785-37879906
  misc_feature 1..121: note = Hypo
  source 1..121: mol_type = genomic DNA

SEQ ID NO: 113287 - DNA, 19 bp, Homo sapiens
  misc_feature 1..19: note = chr17:37887184-37887203
  misc_feature 1..19: note = Hypo
  source 1..19: mol_type = genomic DNA
tttttttttttgagacgga

SEQ ID NO: 113288 - DNA, 17 bp, Homo sapiens
  misc_feature 1..17: note = chr17:37887620-37887637
  misc_feature 1..17: note = Hypo
  source 1..17: mol_type = genomic DNA
cccggtgctgatggcat

SEQ ID NO: 113289 - DNA, 30 bp, Homo sapiens; identical to SEQ ID NO: 80409
  misc_feature 1..30: note = chr17:38179243-38179273
  misc_feature 1..30: note = Hypo
  source 1..30: mol_type = genomic DNA

SEQ ID NO: 113290 - DNA, 44 bp, Homo sapiens; identical to SEQ ID NO: 80410
  misc_feature 1..44: note = chr17:38179589-38179633
  misc_feature 1..44: note = Hypo
  source 1..44: mol_type = genomic DNA

SEQ ID NO: 113291 - DNA, 26 bp, Homo sapiens
  misc_feature 1..26: note = chr17:38237916-38237942
  misc_feature 1..26: note = Hypo
  source 1..26: mol_type = genomic DNA
cctttaaaataaaggcgaggctgggt

SEQ ID NO: 113292 - DNA, 349 bp, Homo sapiens; identical to SEQ ID NO: 80412
  misc_feature 1..349: note = chr17:38264389-38264738
  misc_feature 1..349: note = Hyper
  source 1..349: mol_type = genomic DNA

SEQ ID NO: 113293 - DNA, 554 bp, Homo sapiens
  misc_feature 1..554: note = chr17:38347464-38348018
  misc_feature 1..554: note = Hyper
  source 1..554: mol_type = genomic DNA
cgccctcctgcctttcgctcctcatcgccttgcactgccatcttcccacccactcccctcaccccctggcgccctggccgcccctccgctgccgtgggtgcagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctgtgagtgcggccgtcggcgggatggggggccggaggccggaggcccgcgccgccgcccgcccctgaccccgcctcccacccccgcagctgcaagcagaaccaggacctgctgtctttctacgccgtggtcatggggctggacaacgccgctgtcagccgccttcgactcacctgggaggtgatgagacccctcccgttcctacctgggaatctgggcatcccgggctccccgaagtgcgtcctcccgggacggccgccggcctggagggagt

SEQ ID NO: 113294 - DNA, 30 bp, Homo sapiens; identical to SEQ ID NO: 80415
  misc_feature 1..30: note = chr17:38357434-38357464
  misc_feature 1..30: note = Hypo
  source 1..30: mol_type = genomic DNA

SEQ ID NO: 113295 - DNA, 212 bp, Homo sapiens; identical to SEQ ID NO: 80416
  misc_feature 1..212: note = chr17:38445259-38445471
  misc_feature 1..212: note = Hypo
  source 1..212: mol_type = genomic DNA

SEQ ID NO: 113296 - DNA, 264 bp, Homo sapiens; identical to SEQ ID NO: 80417
  misc_feature 1..264: note = chr17:38478595-38478859
  misc_feature 1..264: note = Hyper
  source 1..264: mol_type = genomic DNA

SEQ ID NO: 113297 - DNA, 133 bp, Homo sapiens; identical to SEQ ID NO: 80418
  misc_feature 1..133: note = chr17:38497512-38497645
  misc_feature 1..133: note = Hyper
  source 1..133: mol_type = genomic DNA

SEQ ID NO: 113298 - DNA, 29 bp, Homo sapiens
  misc_feature 1..29: note = chr17:38498083-38498112
  misc_feature 1..29: note = Hyper
  source 1..29: mol_type = genomic DNA
ggtacaagggaggacgcccgcccctcttc

SEQ ID NO: 113299 - DNA, 48 bp, Homo sapiens; identical to SEQ ID NO: 80419
  misc_feature 1..48: note = chr17:38498548-38498596
  misc_feature 1..48: note = Hyper
  source 1..48: mol_type = genomic DNA

SEQ ID NO: 113300 - DNA, 30 bp, Homo sapiens; identical to SEQ ID NO: 80420
  misc_feature 1..30: note = chr17:38604410-38604440
  misc_feature 1..30: note = Hyper
  source 1..30: mol_type = genomic DNA

SEQ ID NO: 113301 - DNA, 180 bp, Homo sapiens; identical to SEQ ID NO: 80423
  misc_feature 1..180: note = chr17:39682549-39682729
  misc_feature 1..180: note = Hypo
  source 1..180: mol_type = genomic DNA

SEQ ID NO: 113302 - DNA, 30 bp, Homo sapiens; identical to SEQ ID NO: 36515
  misc_feature 1..30: note = chr17:39683809-39683839
  misc_feature 1..30: note = Hyper
  source 1..30: mol_type = genomic DNA

SEQ ID NO: 113303 - DNA, 30 bp, Homo sapiens; identical to SEQ ID NO: 80425
  misc_feature 1..30: note = chr17:39705165-39705195
  misc_feature 1..30: note = Hyper
  source 1..30: mol_type = genomic DNA

SEQ ID NO: 113304 - DNA, 180 bp, Homo sapiens; identical to SEQ ID NO: 80426
  misc_feature 1..180: note = chr17:39768846-39769026
  misc_feature 1..180: note = Hypo
  source 1..180: mol_type = genomic DNA

SEQ ID NO: 113305 - DNA, 30 bp, Homo sapiens; identical to SEQ ID NO: 80427
  misc_feature 1..30: note = chr17:39788206-39788236
  misc_feature 1..30: note = Hypo
  source 1..30: mol_type = genomic DNA

SEQ ID NO: 113306 - DNA, 36 bp, Homo sapiens; identical to SEQ ID NO: 45073
  misc_feature 1..36: note = chr17:39803800-39803836
  misc_feature 1..36: note = Hypo
  source 1..36: mol_type = genomic DNA

SEQ ID NO: 113307 - DNA, 20 bp, Homo sapiens
  misc_feature 1..20: note = chr17:39834139-39834159
  misc_feature 1..20: note = Hypo
  source 1..20: mol_type = genomic DNA
acccctctgataaaacgaga

SEQ ID NO: 113308 - DNA, 30 bp, Homo sapiens; identical to SEQ ID NO: 45074
  misc_feature 1..30: note = chr17:39855665-39855695
  misc_feature 1..30: note = Hypo
  source 1..30: mol_type = genomic DNA

SEQ ID NO: 113309 - DNA, 384 bp, Homo sapiens; identical to SEQ ID NO: 80432
  misc_feature 1..384: note = chr17:40332806-40333190
  misc_feature 1..384: note = Hyper
  source 1..384: mol_type = genomic DNA

SEQ ID NO: 113310 - DNA, 205 bp, Homo sapiens; identical to SEQ ID NO: 80433
  misc_feature 1..205: note = chr17:40400826-40401031
  misc_feature 1..205: note = Hyper
  source 1..205: mol_type = genomic DNA

SEQ ID NO: 113311 - DNA, 30 bp, Homo sapiens; identical to SEQ ID NO: 80434
  misc_feature 1..30: note = chr17:40427458-40427488
  misc_feature 1..30: note = Hyper
  source 1..30: mol_type = genomic DNA

SEQ ID NO: 113312 - DNA, 334 bp, Homo sapiens; identical to SEQ ID NO: 80435
  misc_feature 1..334: note = chr17:40464190-40464524
  misc_feature 1..334: note = Hyper
  source 1..334: mol_type = genomic DNA

SEQ ID NO: 113313 - DNA, 39 bp, Homo sapiens; identical to SEQ ID NO: 80436
  misc_feature 1..39: note = chr17:40477850-40477889
  misc_feature 1..39: note = Hypo
  source 1..39: mol_type = genomic DNA

SEQ ID NO: 113314 - DNA, 24 bp, Homo sapiens
  misc_feature 1..24: note = chr17:40536417-40536441
  misc_feature 1..24: note = Hypo
  source 1..24: mol_type = genomic DNA
gattacaggcgtgagccaccgcgc

SEQ ID NO: 113315 - DNA, 84 bp, Homo sapiens; identical to SEQ ID NO: 80438
  misc_feature 1..84: note = chr17:40573790-40573874
  misc_feature 1..84: note = Hyper
  source 1..84: mol_type = genomic DNA

SEQ ID NO: 113316 - DNA, 350 bp, Homo sapiens; identical to SEQ ID NO: 80439
  misc_feature 1..350: note = chr17:40574086-40574436
  misc_feature 1..350: note = Hyper
  source 1..350: mol_type = genomic DNA

SEQ ID NO: 113317 - DNA, 84 bp, Homo sapiens; identical to SEQ ID NO: 80440
  misc_feature 1..84: note = chr17:40669654-40669738
  misc_feature 1..84: note = Hyper
  source 1..84: mol_type = genomic DNA

SEQ ID NO: 113318 - DNA, 46 bp, Homo sapiens; identical to SEQ ID NO: 80441
  misc_feature 1..46: note = chr17:40689596-40689642
  misc_feature 1..46: note = Hypo
  source 1..46: mol_type = genomic DNA

SEQ ID NO: 113319 - DNA, 123 bp, Homo sapiens; identical to SEQ ID NO: 80442
  misc_feature 1..123: note = chr17:40705905-40706028
  misc_feature 1..123: note = Hypo
  source 1..123: mol_type = genomic DNA

SEQ ID NO: 113320 - DNA, 24 bp, Homo sapiens
  misc_feature 1..24: note = chr17:40801969-40801993
  misc_feature 1..24: note = Hypo
  source 1..24: mol_type = genomic DNA
ctccctctccgaaaaaaaaaaaac

SEQ ID NO: 113321 - DNA, 152 bp, Homo sapiens; identical to SEQ ID NO: 80444
  misc_feature 1..152: note = chr17:40831916-40832068
  misc_feature 1..152: note = Hyper
  source 1..152: mol_type = genomic DNA

SEQ ID NO: 113322 - DNA, 15 bp, Homo sapiens
  misc_feature 1..15: note = chr17:40893475-40893490
  misc_feature 1..15: note = Hypo
  source 1..15: mol_type = genomic DNA
cggcctgctcccaaa

SEQ ID NO: 113323 - DNA, 143 bp, Homo sapiens; identical to SEQ ID NO: 80446
  misc_feature 1..143: note = chr17:40912910-40913053
  misc_feature 1..143: note = Hyper
  source 1..143: mol_type = genomic DNA

SEQ ID NO: 113324 - DNA, 30 bp, Homo sapiens; identical to SEQ ID NO: 80447
  misc_feature 1..30: note = chr17:40921807-40921837
  misc_feature 1..30: note = Hypo
  source 1..30: mol_type = genomic DNA

SEQ ID NO: 113325 - DNA, 426 bp, Homo sapiens
  misc_feature 1..426: note = chr17:40932499-40932925
  misc_feature 1..426: note = Hyper
  source 1..426: mol_type = genomic DNA
gctgctcgcgggatccgcaccgcgggagcagctcggaggggcggccctggggggcaagggcgggccgcggggcggcgacgggggcggggccaggccgagctgggggctggggccgcagccgctcagccggagcgcagcgcacccagcgagtccgtctgtcaggccgcctcctctccggccgtctgattttctacccttcggcgccctgctcttcctcatgttggcatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgct

SEQ ID NO: 113326 - DNA, 40 bp, Homo sapiens; identical to SEQ ID NO: 80450
  misc_feature 1..40: note = chr17:40933234-40933274
  misc_feature 1..40: note = Hyper
  source 1..40: mol_type = genomic DNA

SEQ ID NO: 113327 - DNA, 30 bp, Homo sapiens; identical to SEQ ID NO: 80451
  misc_feature 1..30: note = chr17:40951150-40951180
  misc_feature 1..30: note = Hypo
  source 1..30: mol_type = genomic DNA

SEQ ID NO: 113328 - DNA, 103 bp, Homo sapiens; identical to SEQ ID NO: 16200
  misc_feature 1..103: note = chr17:40975574-40975677
  misc_feature 1..103: note = Hypo
  source 1..103: mol_type = genomic DNA

SEQ ID NO: 113329 - DNA, 34 bp, Homo sapiens; identical to SEQ ID NO: 80453
  misc_feature 1..34: note = chr17:41131532-41131566
  misc_feature 1..34: note = Hypo
  source 1..34: mol_type = genomic DNA

SEQ ID NO: 113330 - DNA, 30 bp, Homo sapiens; identical to SEQ ID NO: 45079
  misc_feature 1..30: note = chr17:41188525-41188555
  misc_feature 1..30: note = Hypo
  source 1..30: mol_type = genomic DNA

SEQ ID NO: 113331 - DNA, 146 bp, Homo sapiens; identical to SEQ ID NO: 80455
  misc_feature 1..146: note = chr17:41278547-41278693
  misc_feature 1..146: note = Hypo
  source 1..146: mol_type = genomic DNA

SEQ ID NO: 113332 - DNA, 35 bp, Homo sapiens; identical to SEQ ID NO: 80456
  misc_feature 1..35: note = chr17:41290312-41290347
  misc_feature 1..35: note = Hypo
  source 1..35: mol_type = genomic DNA

SEQ ID NO: 113333 - DNA, 20 bp, Homo sapiens
  misc_feature 1..20: note = chr17:41416854-41416874
  misc_feature 1..20: note = Hypo
  source 1..20: mol_type = genomic DNA
ccttgcgggatctgcagact

SEQ ID NO: 113334 - DNA, 280 bp, Homo sapiens; identical to SEQ ID NO: 80458
  misc_feature 1..280: note = chr17:41464702-41464982
  misc_feature 1..280: note = Hypo
  source 1..280: mol_type = genomic DNA

SEQ ID NO: 113335 - DNA, 30 bp, Homo sapiens; identical to SEQ ID NO: 80459
  misc_feature 1..30: note = chr17:41651782-41651812
  misc_feature 1..30: note = Hypo
  source 1..30: mol_type = genomic DNA

SEQ ID NO: 113336 - DNA, 80 bp, Homo sapiens; identical to SEQ ID NO: 36525
  misc_feature 1..80: note = chr17:41723454-41723534
  misc_feature 1..80: note = Hyper
  source 1..80: mol_type = genomic DNA

SEQ ID NO: 113337 - DNA, 94 bp, Homo sapiens; identical to SEQ ID NO: 80461
  misc_feature 1..94: note = chr17:41723778-41723872
  misc_feature 1..94: note = Hyper
  source 1..94: mol_type = genomic DNA

SEQ ID NO: 113338 - DNA, 56 bp, Homo sapiens; identical to SEQ ID NO: 80462
  misc_feature 1..56: note = chr17:41791451-41791507
  misc_feature 1..56: note = Hyper
  source 1..56: mol_type = genomic DNA

SEQ ID NO: 113339 - DNA, 32 bp, Homo sapiens; identical to SEQ ID NO: 36527
  misc_feature 1..32: note = chr17:41832619-41832651
  misc_feature 1..32: note = Hyper
  source 1..32: mol_type = genomic DNA

SEQ ID NO: 113340 - DNA, 66 bp, Homo sapiens; identical to SEQ ID NO: 80464
  misc_feature 1..66: note = chr17:41957220-41957286
  misc_feature 1..66: note = Hypo
  source 1..66: mol_type = genomic DNA

SEQ ID NO: 113341 - DNA, 741 bp, Homo sapiens
  misc_feature 1..741: note = chr17:41983831-41984572
  misc_feature 1..741: note = Hyper
  source 1..741: mol_type = genomic DNA
atcacccatagtgtccgcaggcgagcggaccagcagtgaaagggagaggtttcttccaacctcccacccatccctccatccatacacatacaaagaggtgcggagaagaaaggtctgacaaaggcgctttggagagcgagaggtcgcggggaggtctggacagaactgagggccagaggatggggtcgaaaggccaggcggacgtgcatgcttggaccatcagatcacccctgccccaacggacccagccctaacaccctgggcgctaggacctgggggaggggggcgtgttgtgagccatcaaagaaggctctctacgtgcgcgcccgccggagaccagggatgaggtcactaaatgactgccccggccaacccccaccccgtctttatccgcaccgccccccccttaattgacctaactttctaaccctagctcttcgcttctggcaccggtcccctcccaagtctccagaccctaaccctggctcccgacccgccccgctacagcttgggaagcgggagaagcagcgcgcgcccttctgcggaccccctcccagggaagattgtggtgttagctgcctagggggaccagggggccaccgggacccagcgcaacctctgtctcgctccccaacccccggaagcgctaacagcacggttcttacgtaatgccgggcttctaagtacccccaacccgcacagcccccggggaggccgcgcagataccggggcccctcacag

SEQ ID NO: 113342 - DNA, 39 bp, Homo sapiens; identical to SEQ ID NO: 80467
  misc_feature 1..39: note = chr17:41984976-41985015
  misc_feature 1..39: note = Hyper
  source 1..39: mol_type = genomic DNA

SEQ ID NO: 113343 - DNA, 38 bp, Homo sapiens; identical to SEQ ID NO: 80468
  misc_feature 1..38: note = chr17:42015533-42015571
  misc_feature 1..38: note = Hyper
  source 1..38: mol_type = genomic DNA

SEQ ID NO: 113344 - DNA, 465 bp, Homo sapiens
  misc_feature 1..465: note = chr17:42030329-42030794
  misc_feature 1..465: note = Hyper
  source 1..465: mol_type = genomic DNA
caggtctgggccctccgacctgcggaagcgaaggggaaggaattggatctggggaggcgagcctgggagacgtcgttaagtgatgttgccagggtagggccaggccgcgctctcggatgcaggatgtgtggtaacgggcgcttttaccgcgacctgacggggcggtcctcgccgtcggggaagaacgttttggaaagaagcgtgtccgggccgtctcttttcccatacctgggggcggggaagggaagagcgtggtcagatctggccacgcccccaggtggagcggggccgcagggtgagagccccaggggtcccgctccgcgcctgcgctcaccgctgccgggtgaccaggttgaggtagtggcgcagggaggcgtagtagcggttcagctcctccggcgaggcgtcttcgcggggagcctcgggtttgatggggtaggcgtcgaccagcgcccctaggcagac

SEQ ID NO: 113345 - DNA, 187 bp, Homo sapiens; identical to SEQ ID NO: 80471
  misc_feature 1..187: note = chr17:42061233-42061420
  misc_feature 1..187: note = Hyper
  source 1..187: mol_type = genomic DNA

SEQ ID NO: 113346 - DNA, 1570 bp, Homo sapiens; identical to SEQ ID NO: 80472
  misc_feature 1..1570: note = chr17:42082149-42083719
  misc_feature 1..1570: note = Hyper
  source 1..1570: mol_type = genomic DNA

SEQ ID NO: 113347 - DNA, 129 bp, Homo sapiens; identical to SEQ ID NO: 80473
  misc_feature 1..129: note = chr17:42091732-42091861
  misc_feature 1..129: note = Hyper
  source 1..129: mol_type = genomic DNA

SEQ ID NO: 113348 - DNA, 229 bp, Homo sapiens
  misc_feature 1..229: note = chr17:42092128-42092357
  misc_feature 1..229: note = Hyper
  source 1..229: mol_type = genomic DNA
tcttgcccacatcaccgccccctgccgcgtttagcggctgcgtaggcctgctcaccggcgtgcctcagccctctcagcgtacagcatgagctggctgaagcagccccaaaaggggcagcgtgtgagcagcaccgaacccaactgcatgatcagctgcaacatccaccgtctcgaacctatcttcgacgccatcttgggaaagggcagtccgctgcggcctcaccccagt

SEQ ID NO: 113349 - DNA, 89 bp, Homo sapiens; identical to SEQ ID NO: 80476
  misc_feature 1..89: note = chr17:42142826-42142915
  misc_feature 1..89: note = Hypo
  source 1..89: mol_type = genomic DNA

SEQ ID NO: 113350 - DNA, 80 bp, Homo sapiens; identical to SEQ ID NO: 80477
  misc_feature 1..80: note = chr17:42222379-42222459
  misc_feature 1..80: note = Hypo
  source 1..80: mol_type = genomic DNA

SEQ ID NO: 113351 - DNA, 75 bp, Homo sapiens; identical to SEQ ID NO: 80478
  misc_feature 1..75: note = chr17:42287799-42287874
  misc_feature 1..75: note = Hyper
  source 1..75: mol_type = genomic DNA

SEQ ID NO: 113352 - DNA, 120 bp, Homo sapiens; identical to SEQ ID NO: 80479
  misc_feature 1..120: note = chr17:42301918-42302038
  misc_feature 1..120: note = Hypo
  source 1..120: mol_type = genomic DNA

SEQ ID NO: 113353 - DNA, 23 bp, Homo sapiens
  misc_feature 1..23: note = chr17:42329685-42329708
  misc_feature 1..23: note = Hypo
  source 1..23: mol_type = genomic DNA
acaacccccggcctctatcggtc

SEQ ID NO: 113354 - DNA, 325 bp, Homo sapiens; identical to SEQ ID NO: 80481
  misc_feature 1..325: note = chr17:42330572-42330897
  misc_feature 1..325: note = Hypo
  source 1..325: mol_type = genomic DNA

SEQ ID NO: 113355 - DNA, 135 bp, Homo sapiens; identical to SEQ ID NO: 80482
  misc_feature 1..135: note = chr17:42331636-42331771
  misc_feature 1..135: note = Hypo
  source 1..135: mol_type = genomic DNA

SEQ ID NO: 113356 - DNA, 58 bp, Homo sapiens; identical to SEQ ID NO: 80483
  misc_feature 1..58: note = chr17:42335454-42335512
  misc_feature 1..58: note = Hypo
  source 1..58: mol_type = genomic DNA

SEQ ID NO: 113357 - DNA, 30 bp, Homo sapiens; identical to SEQ ID NO: 80484
  misc_feature 1..30: note = chr17:42335968-42335998
  misc_feature 1..30: note = Hypo
  source 1..30: mol_type = genomic DNA

SEQ ID NO: 113358 - DNA, 30 bp, Homo sapiens; identical to SEQ ID NO: 80485
  misc_feature 1..30: note = chr17:42364250-42364280
  misc_feature 1..30: note = Hypo
  source 1..30: mol_type = genomic DNA

SEQ ID NO: 113359 - DNA, 44 bp, Homo sapiens; identical to SEQ ID NO: 80487
  misc_feature 1..44: note = chr17:42390058-42390102
  misc_feature 1..44: note = Hypo
  source 1..44: mol_type = genomic DNA

SEQ ID NO: 113360 - DNA, 664 bp, Homo sapiens
  misc_feature 1..664: note = chr17:42392337-42393001
  misc_feature 1..664: note = Hyper
  source 1..664: mol_type = genomic DNA
tggtcatcgattacacgccctacctaaagttcacgcagaggtgagcggctccatgactgcggcggggcgggggacggggcctcgggacatcctggggacgtcctggtcccaccgccctcagcggccagcgcagacgcgcggggggaggggcgggaccggccgtgcccactgctccctctcccaagctacgactacctgacggacgaggaggagcggcacagcgccgagagcagcacgagcgaggacaactcgcccgagcacccgtacctcccgctcgtcaccgatgaggacagctggtacagcaagtggcacaagatggagcagaagttccgcatcgtctacgcgcagaaggtgcgcgacgccggcgggcccggggggcgggcgggccgggcgggggatccgggcatcccggggcggggcggggatgggggccgcggccgggacgtcctcccagccgcccgggctgagccggcgccccgcagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgtgagcgcacggcctgccctaacc

SEQ ID NO: 113361 - DNA, 155 bp, Homo sapiens; identical to SEQ ID NO: 80491
  misc_feature 1..155: note = chr17:42393420-42393575
  misc_feature 1..155: note = Hyper
  source 1..155: mol_type = genomic DNA

SEQ ID NO: 113362 - DNA, 329 bp, Homo sapiens; identical to SEQ ID NO: 80492
  misc_feature 1..329: note = chr17:42393870-42394199
  misc_feature 1..329: note = Hyper
  source 1..329: mol_type = genomic DNA

SEQ ID NO: 113363 - DNA, 41 bp, Homo sapiens; identical to SEQ ID NO: 16204
  misc_feature 1..41: note = chr17:42395128-42395169
  misc_feature 1..41: note = Hypo
  source 1..41: mol_type = genomic DNA

SEQ ID NO: 113364 - DNA, 30 bp, Homo sapiens; identical to SEQ ID NO: 80494
  misc_feature 1..30: note = chr17:42395520-42395550
  misc_feature 1..30: note = Hypo
  source 1..30: mol_type = genomic DNA

SEQ ID NO: 113365 - DNA, 24 bp, Homo sapiens
  misc_feature 1..24: note = chr17:42401293-42401317
  misc_feature 1..24: note = Hypo
  source 1..24: mol_type = genomic DNA
caccgcacccggcccactgtgaga

SEQ ID NO: 113366 - DNA, 124 bp, Homo sapiens; identical to SEQ ID NO: 80496
  misc_feature 1..124: note = chr17:42402772-42402896
  misc_feature 1..124: note = Hyper
  source 1..124: mol_type = genomic DNA

SEQ ID NO: 113367 - DNA, 20 bp, Homo sapiens
  misc_feature 1..20: note = chr17:42587335-42587355
  misc_feature 1..20: note = Hypo
  source 1..20: mol_type = genomic DNA
ccagacgccttctcaaaaaa

SEQ ID NO: 113368 - DNA, 612 bp, Homo sapiens; identical to SEQ ID NO: 80498
  misc_feature 1..612: note = chr17:42635148-42635760
  misc_feature 1..612: note = Hyper
  source 1..612: mol_type = genomic DNA

SEQ ID NO: 113369 - DNA, 414 bp, Homo sapiens; identical to SEQ ID NO: 80499
  misc_feature 1..414: note = chr17:42733506-42733920
  misc_feature 1..414: note = Hyper
  source 1..414: mol_type = genomic DNA

SEQ ID NO: 113370 - DNA, 43 bp, Homo sapiens; identical to SEQ ID NO: 80500
  misc_feature 1..43: note = chr17:42734191-42734234
  misc_feature 1..43: note = Hyper
  source 1..43: mol_type = genomic DNA

SEQ ID NO: 113371 - DNA, 17 bp, Homo sapiens
  misc_feature 1..17: note = chr17:42737897-42737914
  misc_feature 1..17: note = Hypo
  source 1..17: mol_type = genomic DNA
cccggccagaattacat

SEQ ID NO: 113372 - DNA, 82 bp, Homo sapiens; identical to SEQ ID NO: 45090
  misc_feature 1..82: note = chr17:42787212-42787294
  misc_feature 1..82: note = Hypo
  source 1..82: mol_type = genomic DNA

SEQ ID NO: 113373 - DNA, 82 bp, Homo sapiens; identical to SEQ ID NO: 45091
  misc_feature 1..82: note = chr17:42787534-42787616
  misc_feature 1..82: note = Hypo
  source 1..82: mol_type = genomic DNA

SEQ ID NO: 113374 - DNA, 142 bp, Homo sapiens
  misc_feature 1..142: note = chr17:42835736-42835878
  misc_feature 1..142: note = Hyper
  source 1..142: mol_type = genomic DNA
tggttggagtgacagcgatccctgaagccctcctggaggccggggcatctttggcggggagaaggagccgatgggaaggggtctgtaccgcgggcgtgagaggactccgcagtgacacgacccgtagcgaaggtgcaagaaa

SEQ ID NO: 113375 - DNA, 30 bp, Homo sapiens; identical to SEQ ID NO: 80505
  misc_feature 1..30: note = chr17:42849487-42849517
  misc_feature 1..30: note = Hypo
  source 1..30: mol_type = genomic DNA

SEQ ID NO: 113376 - DNA, 30 bp, Homo sapiens; identical to SEQ ID NO: 80506
  misc_feature 1..30: note = chr17:42865115-42865145
  misc_feature 1..30: note = Hypo
  source 1..30: mol_type = genomic DNA

SEQ ID NO: 113377 - DNA, 1569 bp, Homo sapiens
  misc_feature 1..1569: note = chr17:42906582-42908151
  misc_feature 1..1569: note = Hyper
  source 1..1569: mol_type = genomic DNA
tcccaatcagacaatcgcaaaaaaaagaacaaaatctaaaccatacattcacgtacatcttttcaactcagagctccaaacgcagccgccaaccacacaactgcccacaatcacagcggtagcgcctactcttaattttgaagctagagacttaaggaaacacacacacacacaaaacagttctcaagtttgacaaagtgggggaaaagtcattttaagtaaagacaacgagttaatcaggaggcgatgagcccagtccttccgccccgctttcccgcttccagccctcgaacgaaccctcctctaacccccgggaggcaggagttccagcggggagatgcgggaagcctcagacgagcccgcacgccgccggagacgcagggatcgaggtcggggagacaaagagcagcccgcgaagagcccgggcggcgaggggcggcccggctccgccctgcgcccctaaccgcccgggtagttgtcggcaccgccggggcgccgccgagtgcgcgccgcttctgtccgggctccccgaccgtcgcccgacacctccgcggcccaggacacccccgagccgtttccctcccgatttgggagccgcgcgcctggggacaaagagggagggtgcgccggggacagtggcaggacgcgggccggcgacgcccctccggactcggcgggaacccctcggcggcgcccccctccttctcccgctctggccgcgctcctccccggacctccggaggttctcctcggcccctccccgggctccccaagagttctcccgcctccccctgggaccccgcccctggcccgcttctcctcagccggccctgcggccgcccctcacccggcggcgggttcccccggagccgcctcctccgccgggcctcggcccgtcccgccggtcgcggcctcatgtgccccgcgtcgccatcgccttcaccctcgcctctcctccacctcctccgccgctgccgccttcgcctcagtctccagccgaggcagaagccgctcccgccgctgccgccgccgccgccgcctcccgctcccgccgccgcgacccgcgggaaggcgcctgcgcactgcgcgctgcggtgggggcgggggcgtcccgccgcggcccgggagcggggggcgcgcggcacgtggcgctcgagtgggaggggggcgccccagaacgcgcgggaagcgacgcgagcgccaactttccgcggtcgagtcctcgccgctctctcggatagtccgggacgcggcggaggcgcggcgcgcgtgggagtcacccgcgtggagtctggaccccgggtgggcgcagacttcgctccggacagttcattcttccaagctgattttcgggcgagagtcccccgccagccgcgcctcagtttgagcgggccgctaacggcgccgtgggttctcgccttacctgggtatcctgggttggtttagcgggcccagagttgtcttctgcgcgctccgccgaggccttggtccattgtagcacgggatgctaatgtctcctcccaggttctgctctacaattcctcgaggatctggcgggccctgcgtgga

SEQ ID NO: 113378 - DNA, 200 bp, Homo sapiens; identical to SEQ ID NO: 80509
  misc_feature 1..200: note = chr17:42988598-42988798
  misc_feature 1..200: note = Hyper
  source 1..200: mol_type = genomic DNA

SEQ ID NO: 113379 - DNA, 254 bp, Homo sapiens; identical to SEQ ID NO: 80510
  misc_feature 1..254: note = chr17:43001692-43001946
  misc_feature 1..254: note = Hypo
  source 1..254: mol_type = genomic DNA

SEQ ID NO: 113380 - DNA, 205 bp, Homo sapiens
  misc_feature 1..205: note = chr17:43037484-43037689
  misc_feature 1..205: note = Hyper
  source 1..205: mol_type = genomic DNA
agtcatcgtctgccccgcccggaggggaccccggcgggtgagggacgtgggtggagggagacgtggggagctcagtcggagtagatgatgaagccagagaacgtgctgtatttgttgctgttgccgccgtgtgctttgcctccatccagcttgatgaagacctcgtcgccggcgtccaggtgcaggatcacgctgttgctggcgt

SEQ ID NO: 113381 - DNA, 1021 bp, Homo sapiens
  misc_feature 1..1021: note = chr17:43044508-43045529
  misc_feature 1..1021: note = Hyper
  source 1..1021: mol_type = genomic DNA
ccccaagggcaagtccgtgcacctgggagccctgcgctctgactagttgggttcatttcccgcatttccagtagcgttccagacggtgcccagcagcgtctgtcttggagcgggaacccaggaactgaggatcggcgatgtccgctggctccgaccatccccacacgtgatgaccaagcggggccgctgtggggtgggatctccacctgcgtccgcctggcgcccccgccaactccgatcaggtacccatttgccccgggctccctgggtgccctgggcccagcccagccccatgcccccgcctggcccacctggccattcttgcagaggtctgcccacatactggtgccgtcgccgccgcgcatgaggacatggtaggtgaaaaagtaggtgccgggaatgttgcacgtaaacttgccgctggccgcgtcgtagttgttgcctaggttggtgaccacgtcgtcaaacttgagtacctcgtaaccctcgtgggggttcttgaggccggcgtagaaggccacgcgcggcaccgtggtgtaggtggcagtgctgatggcgccgctgccccccgcgcccggcagccccggagggcccggcttgcctggctcacccttctcccccggcggccccacagggccgggaggacctgggtccccgggaggccccggagggccgggcttgccggtgcggcccggcttcccctgggggccctgcaccagcgtggaaggcgggggcgcgccgctctgctcgctcagggcgtcgccgccgtcggtccgcgcgccggcgccggggccccgcgcggggtaggggtcgcacaccatgcggcaggtgcccagcatctcatagtggccttccgggccgcccgagctcaccagcacggggatgagcaccaccagcaccagcagcatcaccacacccgcggcggccgctagcagcgtctttcggcccgcgcggagcctggggagcgccgggccgcccggccgcgccgtcggggcaatggtgccggcgggcagggggcgcg

SEQ ID NO: 113382 - DNA, 551 bp, Homo sapiens
  misc_feature 1..551: note = chr17:43047434-43047985
  misc_feature 1..551: note = Hyper
  source 1..551: mol_type = genomic DNA
ctcttccaacctcagcgcgatagagtctctaggtaccgtttactgcccaaagcccaggggtagggggctcagggcagccagacctccctaggctcaggaagagtagtcttcagcgctcggctgtcaggcaatccggtccccggttccccacggcggtctcctcggtgtgccccaccaagagcgacagggctggtgacccgaggggcgcgtgcgcggtcgtcagcctgggatttgcacggacccccttctccctagtacgctcgctcgggggcccctcctctgctacgccgctggggctcgcccgccacccacagccctcgcagagccctccgggcacaccgcggctggccgcccggggccaaggatggggcgggagcgcccacccacccccgcgccggccggggcatccaagaggcgcgctcgcagccacacggcgccccgcctcccgctccgaaaaagctcctgctcccctggcgcggtgtggcgtctccgtcagcccagccggattctccccgcttcgctggagtggaaaataacggcttcaaactttg

SEQ ID NO: 113383 - DNA, 126 bp, Homo sapiens; identical to SEQ ID NO: 80517
  misc_feature 1..126: note = chr17:43099263-43099389
  misc_feature 1..126: note = Hyper
  source 1..126: mol_type = genomic DNA

SEQ ID NO: 113384 - DNA, 104 bp, Homo sapiens; identical to SEQ ID NO: 80518
  misc_feature 1..104: note = chr17:43175938-43176042
  misc_feature 1..104: note = Hypo
  source 1..104: mol_type = genomic DNA

SEQ ID NO: 113385 - DNA, 18 bp, Homo sapiens
  misc_feature 1..18: note = chr17:43233608-43233626
  misc_feature 1..18: note = Hypo
  source 1..18: mol_type = genomic DNA
caccgtactccagcctgg

SEQ ID NO: 113386 - DNA, 41 bp, Homo sapiens; identical to SEQ ID NO: 80520
  misc_feature 1..41: note = chr17:43298625-43298666
  misc_feature 1..41: note = Hyper
  source 1..41: mol_type = genomic DNA

SEQ ID NO: 113387 - DNA, 30 bp, Homo sapiens; identical to SEQ ID NO: 45093
  misc_feature 1..30: note = chr17:43318029-43318059
  misc_feature 1..30: note = Hypo
  source 1..30: mol_type = genomic DNA

SEQ ID NO: 113388 - DNA, 51 bp, Homo sapiens; identical to SEQ ID NO: 80522
  misc_feature 1..51: note = chr17:43321296-43321347
  misc_feature 1..51: note = Hypo
  source 1..51: mol_type = genomic DNA

SEQ ID NO: 113389 - DNA, 224 bp, Homo sapiens; identical to SEQ ID NO: 36552
  misc_feature 1..224: note = chr17:43339109-43339333
  misc_feature 1..224: note = Hyper
  source 1..224: mol_type = genomic DNA

SEQ ID NO: 113390 - DNA, 305 bp, Homo sapiens; identical to SEQ ID NO: 80524
  misc_feature 1..305: note = chr17:43339632-43339937
  misc_feature 1..305: note = Hyper
  source 1..305: mol_type = genomic DNA

SEQ ID NO: 113391 - DNA, 41 bp, Homo sapiens; identical to SEQ ID NO: 80525
  misc_feature 1..41: note = chr17:43827217-43827258
  misc_feature 1..41: note = Hypo
  source 1..41: mol_type = genomic DNA

SEQ ID NO: 113392 - DNA, 227 bp, Homo sapiens
  misc_feature 1..227: note = chr17:43974207-43974434
  misc_feature 1..227: note = Hyper
  source 1..227: mol_type = genomic DNA
aacgaatccatgcctcgccctcctgtgatgaacctggtacgcacggttttctggttaattctatcgctgaaaactggtgcggggggcgcacttctgagacggaagagcatctaggagctgaatcctccacgcgggtcgcccaggttgatctgaatttctggggaatggcttggctgcccgcccgggaccaggccgaccctccttgacggtggcgtagagggctggag

SEQ ID NO: 113393 - DNA, 317 bp, Homo sapiens; identical to SEQ ID NO: 80530
  misc_feature 1..317: note = chr17:44919021-44919338
  misc_feature 1..317: note = Hyper
  source 1..317: mol_type = genomic DNA

SEQ ID NO: 113394 - DNA, 113 bp, Homo sapiens; identical to SEQ ID NO: 80531
  misc_feature 1..113: note = chr17:44928624-44928737
  misc_feature 1..113: note = Hyper
  source 1..113: mol_type = genomic DNA

SEQ ID NO: 113395 - DNA, 297 bp, Homo sapiens
  misc_feature 1..297: note = chr17:44929063-44929360
  misc_feature 1..297: note = Hyper
  source 1..297: mol_type = genomic DNA
cgccgcctcctacttcgggtcagtgcccgccgcgccccccgcccgctccccggcctgcctgtctctccctcctgcgctacagctgggccaatttttccctcccgctgtccttggccccgccgaggtctcgaactcagaccctagcccggcgcgacccaacccacttcgcagtcggagttcgcgccctgagttcggtctccagcttccccggctccgaatccatcgccctgttcagtgtccgagtctctggtcgccccccagccgccgctctcctcatcccgccgggtctcggactct

SEQ ID NO: 113396 - DNA, 136 bp, Homo sapiens; identical to SEQ ID NO: 80534
  misc_feature 1..136: note = chr17:44929567-44929703
  misc_feature 1..136: note = Hyper
  source 1..136: mol_type = genomic DNA

SEQ ID NO: 113397 - DNA, 46 bp, Homo sapiens; identical to SEQ ID NO: 80535
  misc_feature 1..46: note = chr17:44953620-44953666
  misc_feature 1..46: note = Hypo
  source 1..46: mol_type = genomic DNA

SEQ ID NO: 113398 - DNA, 30 bp, Homo sapiens; identical to SEQ ID NO: 80536
  misc_feature 1..30: note = chr17:44953868-44953898
  misc_feature 1..30: note = Hypo
  source 1..30: mol_type = genomic DNA

SEQ ID NO: 113399 - DNA, 38 bp, Homo sapiens; identical to SEQ ID NO: 80537
  misc_feature 1..38: note = chr17:45022231-45022269
  misc_feature 1..38: note = Hypo
  source 1..38: mol_type = genomic DNA

SEQ ID NO: 113400 - DNA, 586 bp, Homo sapiens
  misc_feature 1..586: note = chr17:45055719-45056305
  misc_feature 1..586: note = Hyper
  source 1..586: mol_type = genomic DNA
actcccaccctgccccgaacgtcttaaaaaacaaacaaacaaaaaaaactggtaagaaccctcaccccacattctcccaccccgcaacgctgcagcgcacacaggacagagccgggcgtccaagtcccttcccgcgcccccgccgacagtctcgccgcgtccccgcccgggcgccccaggcacgtagctgcccgcccggaggcggcggcagagcgcagagagcggggcgagggtccgggtctccggggtccttcttgcagcagcgctggcgagggcggacccagatggcgctcagtacagccccaggatggctgcgcccacgtccttggagggccggcgctcctgcaccagaaagttgatcatgctctcggacttgatgagcaggttgcagcccaggaagaagacgccgaagaccacggtaagcgacagcacgcagagcacggcgatctgcgccacccgcgacacccacaggctgcgctcgtcgggcgccagccccgcggggaccccgtcgctggcggccagcggtgcgccccctggacagcagcccagccacgtgcccagcccgtgggtgcggtttcccagggcg

SEQ ID NO: 113401 - DNA, 277 bp, Homo sapiens; identical to SEQ ID NO: 80540
  misc_feature 1..277: note = chr17:45056574-45056851
  misc_feature 1..277: note = Hyper
  source 1..277: mol_type = genomic DNA

SEQ ID NO: 113402 - DNA, 17 bp, Homo sapiens
  misc_feature 1..17: note = chr17:45187461-45187478
  misc_feature 1..17: note = Hypo
  source 1..17: mol_type = genomic DNA
tttttttttttgagacg

SEQ ID NO: 113403 - DNA, 45 bp, Homo sapiens; identical to SEQ ID NO: 80542
  misc_feature 1..45: note = chr17:45268793-45268838
  misc_feature 1..45: note = Hypo
  source 1..45: mol_type = genomic DNA

SEQ ID NO: 113404 - DNA, 243 bp, Homo sapiens; identical to SEQ ID NO: 80543
  misc_feature 1..243: note = chr17:45331432-45331675
  misc_feature 1..243: note = Hyper
  source 1..243: mol_type = genomic DNA

SEQ ID NO: 113405 - DNA, 30 bp, Homo sapiens; identical to SEQ ID NO: 80544
  misc_feature 1..30: note = chr17:45331924-45331954
  misc_feature 1..30: note = Hyper
  source 1..30: mol_type = genomic DNA

SEQ ID NO: 113406 - DNA, 129 bp, Homo sapiens; identical to SEQ ID NO: 80546
  misc_feature 1..129: note = chr17:45786739-45786868
  misc_feature 1..129: note = Hypo
  source 1..129: mol_type = genomic DNA

SEQ ID NO: 113407 - DNA, 1106 bp, Homo sapiens; identical to SEQ ID NO: 80547
  misc_feature 1..1106: note = chr17:45810394-45811500
  misc_feature 1..1106: note = Hyper
  source 1..1106: mol_type = genomic DNA

SEQ ID NO: 113408 - DNA, 567 bp, Homo sapiens; identical to SEQ ID NO: 80548
  misc_feature 1..567: note = chr17:45867017-45867584
  misc_feature 1..567: note = Hyper
  source 1..567: mol_type = genomic DNA

SEQ ID NO: 113409 - DNA, 76 bp, Homo sapiens; identical to SEQ ID NO: 80549
  misc_feature 1..76: note = chr17:45970972-45971048
  misc_feature 1..76: note = Hypo
  source 1..76: mol_type = genomic DNA

SEQ ID NO: 113410 - DNA, 30 bp, Homo sapiens; identical to SEQ ID NO: 80550
  misc_feature 1..30: note = chr17:46030424-46030454
  misc_feature 1..30: note = Hypo
  source 1..30: mol_type = genomic DNA

SEQ ID NO: 113411 - DNA, 184 bp, Homo sapiens; identical to SEQ ID NO: 80551
  misc_feature 1..184: note = chr17:46036392-46036576
  misc_feature 1..184: note = Hypo
  source 1..184: mol_type = genomic DNA

SEQ ID NO: 113412 - DNA, 32 bp, Homo sapiens; identical to SEQ ID NO: 80552
  misc_feature 1..32: note = chr17:46080796-46080828
  misc_feature 1..32: note = Hypo
  source 1..32: mol_type = genomic DNA

SEQ ID NO: 113413 - DNA, 38 bp, Homo sapiens; identical to SEQ ID NO: 80553
  misc_feature 1..38: note = chr17:46089245-46089283
  misc_feature 1..38: note = Hyper
  source 1..38: mol_type = genomic DNA

SEQ ID NO: 113414 - DNA, 521 bp, Homo sapiens; identical to SEQ ID NO: 80554
  misc_feature 1..521: note = chr17:46089581-46090102
  misc_feature 1..521: note = Hyper
  source 1..521: mol_type = genomic DNA

SEQ ID NO: 113415 - DNA, 54 bp, Homo sapiens; identical to SEQ ID NO: 80555
  misc_feature 1..54: note = chr17:46100803-46100857
  misc_feature 1..54: note = Hyper
  source 1..54: mol_type = genomic DNA

SEQ ID NO: 113416 - DNA, 247 bp, Homo sapiens
  misc_feature 1..247: note = chr17:46124901-46125148
  misc_feature 1..247: note = Hyper
  source 1..247: mol_type = genomic DNA
agcaagactaagctgcgtgggaggccaaacgaggggggtcctttgggctgtttctaccatgacaaaaatcgccattaccccacacctctcacaccgccaacgttccgccaacgttccgccaacgtcccaccaccctcatgatatccgtccgcggtactgctccagcgaaggtacccttgcctgggccatgaggcgcaaccgtccctcacagctggggtggcttctccaggttcgcaccgaggggaag

SEQ ID NO: 113417 - DNA, 17 bp, Homo sapiens
  misc_feature 1..17: note = chr17:46176758-46176775
  misc_feature 1..17: note = Hypo
  source 1..17: mol_type = genomic DNA
cccgaccctactattta

SEQ ID NO: 113418 - DNA, 81 bp, Homo sapiens; identical to SEQ ID NO: 80559
  misc_feature 1..81: note = chr17:46177127-46177208
  misc_feature 1..81: note = Hypo
  source 1..81: mol_type = genomic DNA

SEQ ID NO: 113419 - DNA, 24 bp, Homo sapiens
  misc_feature 1..24: note = chr17:46344157-46344181
  misc_feature 1..24: note = Hypo
  source 1..24: mol_type = genomic DNA
caccgtgcccggccctgttttcct

SEQ ID NO: 113420 - DNA, 251 bp, Homo sapiens; identical to SEQ ID NO: 80562
  misc_feature 1..251: note = chr17:46507487-46507738
  misc_feature 1..251: note = Hyper
  source 1..251: mol_type = genomic DNA

SEQ ID NO: 113421 - DNA, 256 bp, Homo sapiens; identical to SEQ ID NO: 80563
  misc_feature 1..256: note = chr17:46570216-46570472
  misc_feature 1..256: note = Hyper
  source 1..256: mol_type = genomic DNA

SEQ ID NO: 113422 - DNA, 63 bp, Homo sapiens
  misc_feature 1..63: note = chr17:46619072-46619135
  misc_feature 1..63: note = Hyper
  source 1..63: mol_type = genomic DNA
atccagctgggaggacgcaggggcgggggcagatcccggctgggccggcgcctcctgcagcgg

SEQ ID NO: 113423 - DNA, 1106 bp, Homo sapiens; identical to SEQ ID NO: 80565
  misc_feature 1..1106: note = chr17:46620352-46621458
  misc_feature 1..1106: note = Hyper
  source 1..1106: mol_type = genomic DNA

SEQ ID NO: 113424 - DNA, 272 bp, Homo sapiens
  misc_feature 1..272: note = chr17:46621779-46622051
  misc_feature 1..272: note = Hyper
  source 1..272: mol_type = genomic DNA
gaaccccaacaggctcgccaccattttttttaaacctccttccactgctttttctccccctcttctagctgcccctcaccccacccccaccacgcttaccgacctgcaggcgatccgaccccggaggccggaacggcggaggcggccggagaaggagacgtggcggattggctgggtttcttggcggatttcttctctttcatccaagggaactcgggggccgggggggcagcggggagtggcggcggcggtggcggcggcagagcaggccc

SEQ ID NO: 113425 - DNA, 1480 bp, Homo sapiens
  misc_feature 1..1480: note = chr17:46654951-46656431
  misc_feature 1..1480: note = Hyper
  source 1..1480: mol_type = genomic DNA
actgtatctccctggcgaaaaagtcgctggtgagaatggtgaagaggatggggaacctacttcaaaggcgcagggcccaccaggccataaaaatttatgggggatgtaattatgtggctctgaaaacaggcgaccgtaaatctccggcaatggcgagtttatagcggggacaattggcttccccagctcaacccccccccaacccatgcctccgaagtccctttggtgtaaagctccaggggtgggagggggaaggggtgcccacgcactcacccgtgctcacgtgaactttgcgcatccaggggtagacgacgggctctttgcacgcggagtgggacgggctggggtgcagggggttctgggcgcagggaggcggcggggggctgctgctgaccgcctcgcagcgctggccgggctccgggaggagggccccggcgggtggcggcgcaggagcccgaggggacagaccgggcggtggcgggggcggcgggggtggtggcggaggcggcgggggcccagggtcccggcaggccgcgtagcgctgcacggtgcacgccgcgcgccgcccgaagcccgcctccggctggaagctgctctctcgcctctggccgccggcgtagtacccgggcgagtggtcgctgggtaggtaatcgctctgtgaatattcctcgcatggagggaacttggggtcgacatagtttgagttgatcaaaaaagaactcatagccattaatttctgggaattgcccacaaaatatactaaaatttattccgacccctgactcgttttcctgtttccgaaagccctcctacttactgtcaagtgaacaaagttaggcgcccacgtgatcctccgagccaatggccgccccgcctgcgattcccggataaggaaatctgctcacccggaccccactccagccaaagaggtttatttccccttcttcccttccccctccccacccacccacccaacaccaggatttacatagggctcctgcggggcgaccccctccttgcctcgctctctccgggatcagagagagagcgagagagagagcgcgcgcaggttgcgactggagggcctgttggggcgctaggcagagcgcaaaccctagatcccttaagaagttggggctcccggtgtagccctcctgttctgcctcacctctgcccagcattctgtaccttccaaaggccccagtctcctcccctcggcgggagggagcgctagcaccctgcgtctctatggggagttaggttactggcgggttgggggctccgtctcgaaaggggaacccatacgggggccagagcacagagcttggggcttttctctgcagctggatggggaagggtaggggtgagagaggaggcgtccagagctagagggcgggtgcgcagagggacttgtcagagatgaatggaaccgcgggcggatcgataggaaattcatgcactaattcggggagacttcgcc

SEQ ID NO: 113426 - DNA, 480 bp, Homo sapiens; identical to SEQ ID NO: 4434
  misc_feature 1..480: note = chr17:46659429-46659909
  misc_feature 1..480: note = Hyper
  source 1..480: mol_type = genomic DNA

SEQ ID NO: 113427 - DNA, 440 bp, Homo sapiens
  misc_feature 1..440: note = chr17:46663408-46663848
  misc_feature 1..440: note = Hyper
  source 1..440: mol_type = genomic DNA
ccgcaaggctcagcccggatccactaggggagaggcagtccagagggcggcctcgcagactgggaactgtttccggggaggagaagctagaggatactgcagagagtgcatttttctctccaagaggaactttagggggagaagagacaagagaggagacgcctaaatcactgagaaaaggaataagaagagagggaagagaaacgttaaaacttggggacaaggtgctttttgggatccgacaggttcccgaattgcccgaagtccaatactctccaggctcccaaatttcccctcttcctcttggagcctgcaatcagtaaattcgccaaaagaaagaacgaaagatccgcctaaacctgccggcgtgcccccacccccggtctacagaggcggaggtggctgcggcggtgtggccggcggcgcgtaatgtatgctgc

SEQ ID NO: 113428 - DNA, 682 bp, Homo sapiens; identical to SEQ ID NO: 80574
  misc_feature 1..682: note = chr17:46670849-46671531
  misc_feature 1..682: note = Hyper
  source 1..682: mol_type = genomic DNA

SEQ ID NO: 113429 - DNA, 835 bp, Homo sapiens; identical to SEQ ID NO: 36578
  misc_feature 1..835: note = chr17:46674922-46675757
  misc_feature 1..835: note = Hyper
  source 1..835: mol_type = genomic DNA

SEQ ID NO: 113430 - DNA, 1216 bp, Homo sapiens; identical to SEQ ID NO: 80576
  misc_feature 1..1216: note = chr17:46687590-46688806
  misc_feature 1..1216: note = Hyper
  source 1..1216: mol_type = genomic DNA

SEQ ID NO: 113431 - DNA, 919 bp, Homo sapiens
  misc_feature 1..919: note = chr17:46689986-46690905
  misc_feature 1..919: note = Hyper
  source 1..919: mol_type = genomic DNA
cagagagaaagccagcgagctggggggttgcagaggggagagaggattgggaggggaaatgaggacgcagcgagagagagcgagagcgagagcgagcgagcgagagagagagagagaagggagacagaaagaattacggcgtgaataggcagtttcatgttgttgggagaacttagcagaaatcggtaccttggtcattacaaagaagcacgttcaaaggaaaaaaaagacaattgcacaaggaggctttttacacggggaggggaggggcatggggggctcagccgggcctttgccgctcgccctcacagggcgagggagcctttgcttaaatccttttctttccccccggcccccaagagaagggaaggagatccacggtagctcacacacagaagctattacgagatactaccactagcggggactggcgcggcgggggacgctgcggtgggaggcccggctcctggccccgctagcggggccagagctctctcgggcaggggcgcgcggcggcggcgcggccgggacccgcggacgtgcgggcggccgcggccctggcagtcccagctgaagcctacttcttgtcgcccttctgcgcgtcgccctcgtccgccgcctctggggcccgctccagcttctgtttctccagctcctcctgctcgcatttgctgctggggaacttgtctttgttgttctcttttttccacttcatcctccggttctggaaccagattttgacctgtctctctgtcagtcccagggcgtgcgatacctcgattcgccgcttacgagtcagatagggattaaataggaactccttctccagctccagggtctggtagcggctgtaggtctgtcggcctcgcctgcgtccggcggctgctgggaatgggggaaagggcgagacagaggggag

SEQ ID NO: 113432 - DNA, 1211 bp, Homo sapiens
  misc_feature 1..1211: note = chr17:46691213-46692424
  misc_feature 1..1211: note = Hyper
  source 1..1211: mol_type = genomic DNA
aaagccgggtggggacgaatggacccaccttgaaaagcccccagagcctctgccccagaagaaaagtttcttcagggtaattaaactataaagcaattgagaagtgcaaaagttgagcgcccccactcccaccaccctctcttcactaccccccataaaacagtaaaaggggaaaaaaaggaggagaagaagaagaaaagtaaggcaggatgaggggtttatagattcaggaaatgtttctaagcgacccccttcaagggaaagaaaaaagaaagaagaaagaaagataagaaagaaaggggaaaagcggcaggcgatcggaacggagccggcaagtcttccagaagctggaggaaatgcgccccggcctgccaggccttgggcccttccggccccctcctgcccttgtcggccccgaggcgagctcaccttgcgggcgcatccaggggaagagctgtgtgggcgacgggctctgctcggagccctcggcctcctcgcccaggccgctggcggcggcaagcttgcagtctgcgtactgcaccaggtctggatcctgcgcaccgaataggctctggcgttgcagcgggtcgtagccgtagaaattgccggggtccccgtggcacgccacggcgcacgggttctgctggtagggagccgtggacagcgacgacggcccgtggtagaactcctggatttgcgacgggtgctggaagctgccgccgctgctgggaccgtacaccacggtgggtcggccgcccaggtcctgggcgaagccgcagtcataataattggggcgcagggactccccggttttgtatttggagaacagtgagttgacgaaataagagctcattttattgaattttgaggcggcggcggcggcggaggctatagttgggggctgttggggagggggtggggagggggaaagggagggagagagagaaaaaaacgcggattcgccggctcctagtcaccctcgccaggaaaggagagggaaagagaggagggaaaaaaagaaaagaaagaaaaggcgaagaagatctcgaagccgacacactttttgtggtttccaggaatagaaaaggacagagaagcctccaaaagtctaagcttgcatggcagccgcggctcgctcgccctccccccaccccccaccccccaaacaaaaatataccaccacttaaagaggtcctcgctttacatttcga

SEQ ID NO: 113433 - DNA, 27 bp, Homo sapiens
  misc_feature 1..27: note = chr17:46696538-46696565
  misc_feature 1..27: note = Hyper
  source 1..27: mol_type = genomic DNA
aatcaagaggctgcccgcgcccagacg

SEQ ID NO: 113434 - DNA, 226 bp, Homo sapiens; identical to SEQ ID NO: 80583
  misc_feature 1..226: note = chr17:46702529-46702755
  misc_feature 1..226: note = Hyper
  source 1..226: mol_type = genomic DNA

SEQ ID NO: 113435 - DNA, 30 bp, Homo sapiens; identical to SEQ ID NO: 80584
  misc_feature 1..30: note = chr17:46703929-46703959
  misc_feature 1..30: note = Hyper
  source 1..30: mol_type = genomic DNA

SEQ ID NO: 113436 - DNA, 186 bp, Homo sapiens
  misc_feature 1..186: note = chr17:46710940-46711126
  misc_feature 1..186: note = Hyper
  source 1..186: mol_type = genomic DNA
gtccaggctccctcccgccctcgcccagaagcgagggtccgagtggccacgtgtccggcagggaagtccgaggtagcgagggagtccacctggccgcccgctccccctcccgggtataaatcttggggaccggaaatacaataaaacttcaccgtgttgatgaacttcaaacggtttacatcccct

SEQ ID NO: 113437 - DNA, 154 bp, Homo sapiens
  misc_feature 1..154: note = chr17:46711342-46711496
  misc_feature 1..154: note = Hyper
  source 1..154: mol_type = genomic DNA
gcagagactggaagccgccgcctacacggaaaatccacagagccccgcgcagaccctatgatcggctcggcccgccgggcttgggatgaggctccctgcttctcgctagagcagaactgggctccctggcgcttccttgcgaaagcccaggctc

SEQ ID NO: 113438 - DNA, 379 bp, Homo sapiens
  misc_feature 1..379: note = chr17:46713933-46714312
  misc_feature 1..379: note = Hyper
  source 1..379: mol_type = genomic DNA
cggctggggaagcagctctgtggtctcccggcgggtgaggccgagacagagaccaacctctaggcggcgccctggcgttgagtccgcgctgaacaagattctctcgcagctctgcgtcccgcgccgggtgaaggggcgtgttcctgcaggcgctcggggctcggcctggagctggcggccggcacgtcgcctttggcgccctctgccaaccaagagaaacacggttaaatgagtgcgctgggacagaaatccacagctaatcaaggccccatccgctcccaccccctggcccttacctcctaactccatctccgacgctagggagccttccacagcccgaatctcctttgatgtccccagcagccggctagagggcagc

SEQ ID NO: 113439 - DNA, 39 bp, Homo sapiens; identical to SEQ ID NO: 80588
  misc_feature 1..39: note = chr17:46719480-46719519
  misc_feature 1..39: note = Hyper
  source 1..39: mol_type = genomic DNA

SEQ ID NO: 113440 - DNA, 484 bp, Homo sapiens; identical to SEQ ID NO: 80589
  misc_feature 1..484: note = chr17:46723716-46724200
  misc_feature 1..484: note = Hyper
  source 1..484: mol_type = genomic DNA

SEQ ID NO: 113441 - DNA, 152 bp, Homo sapiens; identical to SEQ ID NO: 80590
  misc_feature 1..152: note = chr17:46724752-46724904
  misc_feature 1..152: note = Hyper
  source 1..152: mol_type = genomic DNA

SEQ ID NO: 113442 - DNA, 115 bp, Homo sapiens; identical to SEQ ID NO: 80591
  misc_feature 1..115: note = chr17:46755586-46755701
  misc_feature 1..115: note = Hyper
  source 1..115: mol_type = genomic DNA

SEQ ID NO: 113443 - DNA, 1184 bp, Homo sapiens
  misc_feature 1..1184: note = chr17:46795361-46796545
  misc_feature 1..1184: note = Hyper
  source 1..1184: mol_type = genomic DNA
attataaaacatacacgttgaaacaatttttttaatttaaaaggggctgtttataaaaaagttttaaaagtagctctgtgttttaagacccgtgttctacttgctgcgatcgggatagtttttttttccactttgaggctctttttttttttttttaaggggcaggaacatcattttgcatcaggccctgtaaaaaaaaaaagggggggggggtgggtaggaaccaggatgttggggaaaattatttcaatgtgttgagtctgaagctttttggaaagcaatgtagatgtgatctcgtttgctctgaatcgaattccacagaaaccgctgtgccgaatactgcaaatccttaactttcataaacgccggcaccgaactcaacgcaaaactacccaagtgccaaagaccatttctgggaagctcattccatgagaccttcgcatttttccaaatcaaaggcttcccttcggatctaattatttctcctctacagggctgcgggagggggaggggatgtgagactagggcaacagattaagattgaaagtcctttctcgcagcttcattttcgcccccacactgtcccaaatgcttagaaccctcctcgtcagaatgggaacggtgcccccgcttgtcctaaaagacacagaccaggtccgtgaacttgacccaggcgcccacgcctcttttccccgaaggtcagacaaaggcagaagggttggctggattctttcccgggccgcgaaggcctggggatcgcaagttgaggaggagaagaccgcaaacccctttggttcaagcaagctctgcggcaggtaaaaggcaaattggtggggacgggtaggacagggagagcattatctggctaactcccgcaggcctcttccgatttgtcggcggggacctgactccctgcggtgtctctggccccaaatacggaggccaggagcttttcgttgtctcgcccgatttggtatcttattagccggtgtcgctgagccgcgggggactcccggctggaaaggaagccctgcgctcgaagcgccccacgccagacggagtggcccctgcgcctccccgcgcgccggcgcgccctgttcaccttcgactggatgttaccgagccagggagagacccggagatcgagtgtttgatcttcccttgctccaggatcctgaattctt

SEQ ID NO: 113444 - DNA, 1124 bp, Homo sapiens
  misc_feature 1..1124: note = chr17:46796605-46797729
  misc_feature 1..1124: note = Hyper
  source 1..1124: mol_type = genomic DNA
cgcacacgcagcactactaccgtctgagcaggccgctcctcgcagcctccgcagtcggcgggtcgcctggaaagacgcgccggtttcccgggtcggatggctctccaggccgctatttcctccgccaccgagtagggagacgccccatttgcgaagtttaagtttccaggtcctgggaaggcagctgggaaacccgcggggctcggcagccgccctggtagcagccagggatcggatagcgcggcgggcgacagccccccggataaccccgccgagggaggggcgcttgtaaaaccgagcggcgacggcctcgttacgaccgactcgaacattctctaataaatcatcggccttagctagtattcgtttgtgtacgcatctgtttatcctgattattaaaataaattaaggattagactgcctagaataaggtaaacgaacatgaaatgccaaggaggaaaacagaaaaagttacaccatgtcgatcccgaccaaaacattggcctgacttgccggatggcctcaagaatccggcttttagctgcaggcccggcgggtgttccccggaaggcaaggattggaagctctttgataaagccgcgcgaggcccggtttctcgcgtttcgggtcgctccacagccccctccgcccttcccctccacccctccgcgtctcggcctggctccggaggggtgaaggaatgtttatagcctgactcaagttcaatgacaaaaacctgcctggaatgggaggtgcggcgagcttcagccatcaacatgacaaaggctggacgcaggtctcgggcgggggcgacgggctgggcccacctagagatggggagctgagggcccacaggatgggtacggaccccgcagaccaagagctgcctctctgccctcagcctggggtctgcggagtttggcgagtagtgcgggtgtgtgcccgcctggatgagggtaaggcgatcagcctctgagtgggcaaggggacgtctgattactgcccaggcttcgcctgggggtccaggaccctgtgagatgcccctgctctctgcctggccagctctagctcacccggagtaaggatccgcaccgtccttctatccaccgcgacctgcattttct

SEQ ID NO: 113445 - DNA, 2040 bp, Homo sapiens
  misc_feature 1..2040: note = chr17:46799288-46801328
  misc_feature 1..2040: note = Hyper
  source 1..2040: mol_type = genomic DNA
tttaaataataataacgttatcaatattaattttgcttatgccaggactccatcccattggagacaaacattaagtcttatggcagaccttacagcgggtgctagttcccactcccaagcctctcccccgcctaggtcctgcaggtcccgcgtgctgcgaaacattttctttgtccctttctgcccagggcggctgccggtctctccaggaaccgcgagtaggtgctcccgccaggtggtatcggtgaaagcctgctgctcacccttcccttgtttcccaaaacttctgaaggctcccaaattcctgggagaccctctcccagggcctcctgatgcagctaccatactgagcgatccgtcgataacgcccttggcccaccgatcagtttaccttattagagagaaaagcactcttggaggtagtaagatgggccggtccttgatctgagaaatgggcgcacaacatcgctgttctctctgcaaaggtggggaccagaatccagcttgcctgaccttgcaagcaagcatcggcctaaaggtttcagcctcccagtggcgctctgtttgcacgccttaggctaggagaggaaggacgggagcacagcactgggtgcccctctccctgtagagtctggggcggggctcagtaagaaggcctgcggttggtggctccccacctcatagctgcaagtaggggcgaaagctggagtgtctcctcccagcagcctcctcgcctccccgcaaacctccgaatctccctggacctcctggttgctgtggcccttcctcccctgattggcttcctccctctttcccaaggccagagaagtcctctcttcccctcaccttcctccctcttcccataaaacttttaggaaaatgggggcgggggcggtggagaccaccagcctggaacttcaagttcaatggcaaagtccctgaccctccccccaggctgggcgccagcattattctaggggcgattaaactcttttgctgccccctgtgcacctcccagttcgggggcagtttaggggaggagagaaggtaatggtggaattctttccctcactctcccccgaccacttcgtcccctccccctcatcccctctacacagaactaactggtagggagagaggaagaaaggctggcatcggttcctcattggatgttttaaatctgtctcaggcccaggccagtgcctggggggaggggcggggtgtcctgcttttgggctagaggcccggggccgctcccgagctttctcccctcttccctggagagcgactgttcgggagggtgagaatggtataaatttcaaaaacaacgaaaccttcttttgccccctccgcagcagtcgcctccgggctttattgcaagtttacggtaacgagttcatctatttaattcgcggttgcagctcggggatttctattagacaggacgggttggggccggggggcacagggtctcccctgaaggaaacccaattagagtgcagcacttagcaccttcaatataactttaatgaagggggggaggggagctgcagggaagagaagtttgctctaggttggggaaggaaagctggagctgctcccgagaactggggggcctggatgaggctttttcctgcttcgagggctttccagcttccggcccgggaactactatttggagtagggatcgcctgcagggaaggcggggcggattctcggctggcggcggcctcgcagggttcccggaagcgctagccagccggagtaaaacccgaaagatggagcctcaggttcgcgctctgcgttgcgggtgctggaaccgagattcaaaaagagcttccggaggtagtttctacgcattgcgccactactcccttattcggcttctggaggcctaataaaatccacttgctttggagttagaaattatttcgggcctggagcccgcgtagacgcgaccctgtgatcccatttcgtagcttgctgagagattcgctgcgggagtttggctctgagggaggggaacggtctggagggcag

SEQ ID NO: 113446 - DNA, 30 bp, Homo sapiens; identical to SEQ ID NO: 36601
  misc_feature 1..30: note = chr17:46801636-46801666
  misc_feature 1..30: note = Hyper
  source 1..30: mol_type = genomic DNA

SEQ ID NO: 113447 - DNA, 1178 bp, Homo sapiens
  misc_feature 1..1178: note = chr17:46802007-46803185
  misc_feature 1..1178: note = Hyper
  source 1..1178: mol_type = genomic DNA
cgatgaaagcctgcccgcaggttctcctggagtggtgagcctctgtcggaagggggcgcccacgtctttttaatggtcctaacacaccagtggaataaatctctaagattccacatcttttgtttgctctgaatttattgcgagtgaaaaacagagaaaatcctcaagtttaagtttctgatagcagagtgtgggagttagagcatggggagtccagaggttccagacccccaaaggtctctaccagggccatctccgttagtggcggtggcagcccctcttgtggcctttttcctctctccaaggggtcaccccgcaccatgccgctccccctcatctatcttgccccctccccacaggcccatctgcgctgaactctcgccagttccgaagtcggcgagggagggggtttacttgcccgatcgttggtgggtttgagcttatagaggcagaggagtaagaacctgcgatattgaaagctacccacatggggcttccttgaaggaggacgtggaaggcagaaagtgacctgctctgagcggcgcatgtaaccgaggaccttaagctggaccacggggcttggacgattttttaaatcaggaaatcgacctcatcttcctcctcctcgtcctcttcccctgaacccccagtccgcatgcactcacactctttggccttttccctcagtcccgggctcctctttggtaaatagatttgtaggtgtctaagtcacgtcccaccctcactccttcccaggagaggagacagggctaggatcccacccgaccgcgggccataaacacttggctgcggcggccgccgcggggtttctaggagagctggctccgggagggaaatgtcctcgaggtagtggcggccgcggcccaccaccaactgctcgccaccgaccccactactcgccaccgacccgctgctcggagcttcggttctgcgggttgtccagacttcaggcctgtgcgctcaatcgtggagaatgcgccggcaggccccccacccccagcctaaggtgcaggaaggaccagcacgaacccgctggctttgctgcgcggccaggagatgagtcccaccgggcactgagcccaggtacaggacatcagagaatgaacacagaggcagaggccctcatgtccctctcagagtcccggctctgcaaagag

SEQ ID NO: 113448 - DNA, 71 bp, Homo sapiens; identical to SEQ ID NO: 80602
  misc_feature 1..71: note = chr17:46803745-46803816
  misc_feature 1..71: note = Hyper
  source 1..71: mol_type = genomic DNA

SEQ ID NO: 113449 - DNA, 321 bp, Homo sapiens; identical to SEQ ID NO: 36605
  misc_feature 1..321: note = chr17:46804107-46804428
  misc_feature 1..321: note = Hyper
  source 1..321: mol_type = genomic DNA

SEQ ID NO: 113450 - DNA, 539 bp, Homo sapiens; identical to SEQ ID NO: 80604
  misc_feature 1..539: note = chr17:46805572-46806111
  misc_feature 1..539: note = Hyper
  source 1..539: mol_type = genomic DNA

SEQ ID NO: 113451 - DNA, 303 bp, Homo sapiens; identical to SEQ ID NO: 80605
  misc_feature 1..303: note = chr17:46806788-46807091
  misc_feature 1..303: note = Hyper
  source 1..303: mol_type = genomic DNA

SEQ ID NO: 113452 - DNA, 848 bp, Homo sapiens; identical to SEQ ID NO: 80606
  misc_feature 1..848: note = chr17:46810248-46811096
  misc_feature 1..848: note = Hyper
  source 1..848: mol_type = genomic DNA

SEQ ID NO: 113453 - DNA, 295 bp, Homo sapiens
  misc_feature 1..295: note = chr17:46811354-46811649
  misc_feature 1..295: note = Hyper
  source 1..295: mol_type = genomic DNA
tctttctctcatctccgttttacttcccttcctccgcccgccacacacgtttttcctttgcagcgctctcgcccagtttttccattgttcttctctgaagtctggaaagggcctgcggggctatagctctcagcggccggagcctgcgcttggcaggggacggcctggaggacggcctagtgtggctggtgggttcgcggagccctgccctggagctctgcctgaggctagaacagcacccgctggagatgaagggtgactccggcctttcgccctgaaacgaagtcaagcgggg

SEQ ID NO: 113454 - DNA, 47 bp, Homo sapiens; identical to SEQ ID NO: 80609
  misc_feature 1..47: note = chr17:46812568-46812615
  misc_feature 1..47: note = Hyper
  source 1..47: mol_type = genomic DNA

SEQ ID NO: 113455 - DNA, 106 bp, Homo sapiens; identical to SEQ ID NO: 80610
  misc_feature 1..106: note = chr17:46815930-46816036
  misc_feature 1..106: note = Hyper
  source 1..106: mol_type = genomic DNA

SEQ ID NO: 113456 - DNA, 499 bp, Homo sapiens; identical to SEQ ID NO: 80611
  misc_feature 1..499: note = chr17:46816240-46816739
  misc_feature 1..499: note = Hyper
  source 1..499: mol_type = genomic DNA

SEQ ID NO: 113457 - DNA, 1373 bp, Homo sapiens
  misc_feature 1..1373: note = chr17:46824310-46825683
  misc_feature 1..1373: note = Hyper
  source 1..1373: mol_type = genomic DNA
gcttctgagaggctgcgttttgaggagacaccagaagcctgggaagttcgcttactggttctcaagtcagagtcccccttcccggggctccttctggggactccgggggagagggatctctctgtccatcctgcaactcctctcctggcatagatgccccgcacccccaccttgggccatccttatctgcctgttccccatcacgattgatcctccagggtcgccaaggctcctgctgactacaaaaacatccccaagattcccttcttgacccggttcaggcatatctctttatacttccatgtctccgtttctctatatttttactgtggaggactcagaagagagctgaggctattgtccggggaggaaaggaattcgggcaaatttgtgggtaggggcccagacccaagacccgtgtttctcctgcgtgggttggagtctgtctcaggtcgctccagggacatcaagagcccgcgccgccgagagcccgcgccgccgtccagcgggaagcagcggacccacaggggcctccagccgcctccccgctcccgccccgtgtttctcctgggcctccagctccgtggagagagctgagagttctcggcccgcgggcttcctcaccaaatccccaaaaaccgacgcaggcacagagggctgactgtgttttgagtaatgcacgcgaggcagtccaatccggcgagatggcccgaagcggggcccagcggtcgggggtgtgggtctggagagagagggtctccccacttccttcctccggctgctcggtcacccatcgactacccgggcggaagcggggcgcagaggggcgcagagggaggcattgccctccaggagtatctattcccatcggggtatggtgaatgccatctaggcccatgctccattcccagggccccctcggttcctccaaaggcgtccacccagaagcagccccagtgtcgcgcattgactcccgccggccaagtcgccgccgaaacaggatctcctaaagcgggctccaccgggtcccagggcgaaaaggtccgaagatctacgctgtcggaaagacctggagaactcgggaagcccagcaacaacaaacaggtttcaacttggaaacaaaccattaaagtttggcttagtttttggtgtgaatggtgcaaataatttctcctcttcactcttcagtcgatctcagctgtatagagctgctctgcaagctaaaaagaaattagtatctattccccccgccaacaatttttttttaacccgggctaccagcttaagcaactggtatcattcttgttgaattaagctctgaaagctcgcctcagaaaaaaagtttttattttaaaaaacgaattattaagtcg

SEQ ID NO: 113458 - DNA, 97 bp, Homo sapiens; identical to SEQ ID NO: 80614
  misc_feature 1..97: note = chr17:46826997-46827094
  misc_feature 1..97: note = Hyper
  source 1..97: mol_type = genomic DNA

SEQ ID NO: 113459 - DNA, 426 bp, Homo sapiens
  misc_feature 1..426: note = chr17:46827330-46827756
  misc_feature 1..426: note = Hyper
  source 1..426: mol_type = genomic DNA
tccttggaggacaggcggctgcttaggagtgggacagtaaggactaggctgggtctggagggctggcggggcaggagttgggggccaggtaggaaagccaggggtcgaagggatcgattctaggggccgcagaggctactctcgtgctctggagaagcaccgcatctttctccggacccccgcgctcagccaatcgccccaaagtctccaggtgggggctccgcattaccagtcttggtcgcaaaagcagccctttcaatcgcaccgaatttcccctggtgtgaaaaggcgccatcgccagcattttgccggggtttatgcctcaatcccgcattccagccacttccacgaattacttggaagacagaatggtttgtgcccatttatcctacctggagcacagacaagaaacggccaaaaaatgaa

SEQ ID NO: 113460 - DNA, 221 bp, Homo sapiens; identical to SEQ ID NO: 80617
  misc_feature 1..221: note = chr17:46829434-46829655
  misc_feature 1..221: note = Hyper
  source 1..221: mol_type = genomic DNA

SEQ ID NO: 113461 - DNA, 676 bp, Homo sapiens
  misc_feature 1..676: note = chr17:46829979-46830655
  misc_feature 1..676: note = Hyper
  source 1..676: mol_type = genomic DNA
ccccaggttggttcacgcgagttttaaaatgaatcggaggtgaaatggagctcattaccctctcttcagcccgaccctcaatctttggcagcgaggggcagttatgggacggggggcgggtgggaagagcgcccagggccccctccgggttctcccacggtttcccgcatctgggcctggccagcgcctttgggaggaagggcctaggcgcggtagggatgcctgggagtctagggagtggcgggggtgtttcttggcccggcagggtggggtttccaagcgtgatctcctcgccctggcagagccggggtgccgggtgggggcaggctcgggggcctgcctgcggtgaatcaggcttgtgacctcaggccgtccaggtaaacatcctctgcgctttggaaactgttgggactagaaaggagcgggcggcagggagagggaagggggaaggagggattctgagtggaggagacctctgaaatcctctctcctgccaggaaaccagggcggtcttccaagcgggcagccacgttgcctacttgaggccaaggcagaagcatcaatcacatggggcgtagtttctgtctggctaaagaacggctcacgcggacctcgggaatgcgactgtggaaacgacggggaagctggaagggctgggtggcgggggaagctggag

SEQ ID NO: 113462 - DNA, 1161 bp, Homo sapiens
  misc_feature 1..1161: note = chr17:46831726-46832887
  misc_feature 1..1161: note = Hyper
  source 1..1161: mol_type = genomic DNA
acactgtaaaattggcgtaaccaccattccctcccagtctttctctggagtcctaatgggaacagtgacggaatgaaagtgaccacgctggaacccgaagcgctgttcccctccgtggcttcacactgatctccacactagaattccgtgtctgcagttcaagttcaaactactgtggtcggggaagggctacagagatctcgcttggccgtggagtcaccggccccgtccagtcttgcttgggacacatactggtttacactctctcgggttcagtttcctcatctgtaaatggggctcgtatccccctcataaagtggtttgggggataataaagcttgtaaaagcgctttgccccagtgcttggcacataatacgcgctacgttaacaatgtcgcgtacacgcccgaaccggaggaaccccattccacgctccttctggaaccgaattcacctctgaggctttggggcttcagagccggagccgcttgggcaaaaccagcagaacagcgagagggaacgggctggtctagccctgccctgagcatttctactgagacccccggtcctgcttcttccagcctctgctggatttctctccgacccctctggagcgaagccctttggccctgcgttgcatgcggcacggtgcgggttcgggctctgcgctggagccgggatgccctccggcggagggtgcgcgtaggcggcgcctgggcgtgagccccgcctgcaaggctcagcgtcggggaagcacttttctcgtcgacccggggtctttttccgccaaggagctcggggctcaagaactcgggactgggctgtgggcggggcatggttttcctctctgggcgtcctaatctccaatttcaggcaaattcgctaggaagaaccttcccgagcgcgccttctccaacaggacctccaagccagcctcacgcacgcaggcctggctctctcctgcagaatccccacctgccctataactacccacttcagatatgggggaatggaggagatattccaatcacgccatctacctacagtttccacggccccttctgttgaatggtattttcctttagggtccctagaagcagagcaaatgaaaaggccagggggaaaaaaaaaaaaaaaagaaagaaccggtgaattggctct

SEQ ID NO: 113463 - DNA, 57 bp, Homo sapiens; identical to SEQ ID NO: 80622
  misc_feature 1..57: note = chr17:46863338-46863395
  misc_feature 1..57: note = Hypo
  source 1..57: mol_type = genomic DNA

SEQ ID NO: 113464 - DNA, 61 bp, Homo sapiens; identical to SEQ ID NO: 36623
  misc_feature 1..61: note = chr17:46918852-46918913
  misc_feature 1..61: note = Hyper
  source 1..61: mol_type = genomic DNA

SEQ ID NO: 113465 - DNA, 116 bp, Homo sapiens; identical to SEQ ID NO: 45097
  misc_feature 1..116: note = chr17:46946208-46946324
  misc_feature 1..116: note = Hypo
  source 1..116: mol_type = genomic DNA

SEQ ID NO: 113466 - DNA, 884 bp, Homo sapiens
  misc_feature 1..884: note = chr17:47072676-47073560
  misc_feature 1..884: note = Hyper
  source 1..884: mol_type = genomic DNA
acaaaaacaaaaatccgacaaacacgtggctgggtagaacaaaacgctcattggggagggtgggctctaaggtggtggaggatatagagaaaccgagttggaagccctcccccgcccctaagtcccagccccatttcttttcagcgcgccgggaaaacggggagggggacaaaggtgctgcgtgctgtctttcaactcccgactttttgaatggcatacaatcgtccggccgcagagcggtgagccaaagtcggagtcagctcagactctgcaaacgaaaaataataacaataaaaaaaattcaaggcattcatatcggtgtagtcaacacgtgttgcggagtcggcccgggccgcaggcgactgagacaatggggtcggggactggggaaggggagtgacccccttcctcacctgccctcccagcacgcgtgcccccgctagaattatcctccctcccacagagtccggagtaacaccccagttttcgccctgttcaaggggattccagaatttctgggggtcgacccctcctttttccccgttccctgggcgagggggttccagggtctccgggccgcgctctcggccacccctggcgccatcccagcctccgccgctagaaactcgttggcctcgctcgccgctccgccgtggagccggggcttgcccgtggaccgcgcgtcccgctctccgccgcgtatccgggactccgaaacgcgcggcgagcagccccctcccccaccgcccagacggggtgcgaccgcccacgtgtcgccccttgcccagtcgggtccttccctcgggctccgggagccggaggatccggaatgagttggtcaaagccgagggaagggacccaggcggatccgcttccccctcccc

SEQ ID NO: 113467 - DNA, 501 bp, Homo sapiens; identical to SEQ ID NO: 80629
  misc_feature 1..501: note = chr17:47073908-47074409
  misc_feature 1..501: note = Hyper
  source 1..501: mol_type = genomic DNA

SEQ ID NO: 113468 - DNA, 1598 bp, Homo sapiens
  misc_feature 1..1598: note = chr17:47074697-47076295
  misc_feature 1..1598: note = Hyper
  source 1..1598: mol_type = genomic DNA
tgggggctgtcaccacgtggcttctcctttttttttttttttttttttccgctccattttttttcaagtcgattttatttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccggtaagaacacagccacctcccggaaaagccacaacgagagccccgaacaacggagacccgcaccttccggttcctctcccgccaactcctctcttcccgggcctgcggggtttggcctccgtacccaccctcgacctacccccttcgatgccccctccctcgctctgcgcctcccacccccgcgcagaaacattcgggatttcctcatccctttctcccagcctgagataaggagctctggcttcccccatccttcctccccaccgacggggcgggagcccccactggcagtagtggggggttgaatttagggacacggggatgacccctggctgggcgttatttccacgcccagcccctccctatccgccggtggacgcccccccagctggaaaaccccggctcccgttcctcagtcttaggcctttccaggcgtggaaggggtacccggaccgcctgcgatctgtccgcttcgcgtggggaatgcagccctccagcaggacttgcaaggaagggggtcttgcctcccgcccagggcctggggcttgagccattttgatttgaaagtggggcgtgagcggggtggcgcggcggcggcggcgccgggtcgccatgctgcttcccgagacgccgaggctgggccgagaggcgcgcgcggtggcagtgagggaccctccccgccaggccccgctccgctcccccaggtccaccccttcccaaaccagccccgacaggtgaccgctccgtggcccaaagcccgtcttcctggccaacagagaaaaataaagtttcattctgcacactgcctcccgccccgcgccccactttctgaggaacggggagccctttctttcctggctccttcccacatctgggagctgtgtaggcagcgcacccacacaaatggcctcgcacctttcccaaatcgggattccagagcgatccactcaacaagcctcagtgatttaataaagcaaaaattaaaaaatgaataataacgaatttacagactc

SEQ ID NO: 113469 - DNA, 270 bp, Homo sapiens; identical to SEQ ID NO: 80632
  misc_feature 1..270: note = chr17:47081179-47081449
  misc_feature 1..270: note = Hyper
  source 1..270: mol_type = genomic DNA

SEQ ID NO: 113470 - DNA, 170 bp, Homo sapiens; identical to SEQ ID NO: 80633
  misc_feature 1..170: note = chr17:47170202-47170372
  misc_feature 1..170: note = Hypo
  source 1..170: mol_type = genomic DNA

SEQ ID NO: 113471 - DNA, 30 bp, Homo sapiens; identical to SEQ ID NO: 80634
  misc_feature 1..30: note = chr17:47170926-47170956
  misc_feature 1..30: note = Hypo
  source 1..30: mol_type = genomic DNA

SEQ ID NO: 113472 - DNA, 480 bp, Homo sapiens; identical to SEQ ID NO: 80635
  misc_feature 1..480: note = chr17:47210020-47210500
  misc_feature 1..480: note = Hyper
  source 1..480: mol_type = genomic DNA

SEQ ID NO: 113473 - DNA, 81 bp, Homo sapiens; identical to SEQ ID NO: 80636
  misc_feature 1..81: note = chr17:47226409-47226490
  misc_feature 1..81: note = Hypo
  source 1..81: mol_type = genomic DNA

SEQ ID NO: 113474 - DNA, 102 bp, Homo sapiens; identical to SEQ ID NO: 80637
  misc_feature 1..102: note = chr17:47227368-47227470
  misc_feature 1..102: note = Hypo
  source 1..102: mol_type = genomic DNA

SEQ ID NO: 113475 - DNA, 30 bp, Homo sapiens; identical to SEQ ID NO: 80638
  misc_feature 1..30: note = chr17:47287915-47287945
  misc_feature 1..30: note = Hyper
  source 1..30: mol_type = genomic DNA

SEQ ID NO: 113476 - DNA, 81 bp, Homo sapiens
  misc_feature 1..81: note = chr17:47302296-47302377
  misc_feature 1..81: note = Hyper
  source 1..81: mol_type = genomic DNA
ccacgatagtctcgtcgaagtcgaaggtcaggaggaagcgcggcgcgccctgcgcggccatcctgccgtcctgggagcagg

SEQ ID NO: 113477 - DNA, 281 bp, Homo sapiens; identical to SEQ ID NO: 80639
  misc_feature 1..281: note = chr17:47307520-47307801
  misc_feature 1..281: note = Hyper
  source 1..281: mol_type = genomic DNA

SEQ ID NO: 113478 - DNA, 275 bp, Homo sapiens; identical to SEQ ID NO: 80640
  misc_feature 1..275: note = chr17:47308444-47308719
  misc_feature 1..275: note = Hyper
  source 1..275: mol_type = genomic DNA

SEQ ID NO: 113479 - DNA, 30 bp, Homo sapiens; identical to SEQ ID NO: 45100
  misc_feature 1..30: note = chr17:47330524-47330554
  misc_feature 1..30: note = Hypo
  source 1..30: mol_type = genomic DNA

SEQ ID NO: 113480 - DNA, 19 bp, Homo sapiens
  misc_feature 1..19: note = chr17:47336379-47336398
  misc_feature 1..19: note = Hypo
  source 1..19: mol_type = genomic DNA
gccacggtgccaggcccta

SEQ ID NO: 113481 - DNA, 28 bp, Homo sapiens
  misc_feature 1..28: note = chr17:47355143-47355171
  misc_feature 1..28: note = Hypo
  source 1..28: mol_type = genomic DNA
gagccaccgcgtccggcctccaatcaat

SEQ ID NO: 113482 - DNA, 30 bp, Homo sapiens; identical to SEQ ID NO: 45101
  misc_feature 1..30: note = chr17:47449030-47449060
  misc_feature 1..30: note = Hypo
  source 1..30: mol_type = genomic DNA

SEQ ID NO: 113483 - DNA, 118 bp, Homo sapiens; identical to SEQ ID NO: 80645
  misc_feature 1..118: note = chr17:47547799-47547917
  misc_feature 1..118: note = Hyper
  source 1..118: mol_type = genomic DNA

SEQ ID NO: 113484 - DNA, 30 bp, Homo sapiens; identical to SEQ ID NO: 80646
  misc_feature 1..30: note = chr17:47559443-47559473
  misc_feature 1..30: note = Hypo
  source 1..30: mol_type = genomic DNA

SEQ ID NO: 113485 - DNA, 41 bp, Homo sapiens; identical to SEQ ID NO: 80647
  misc_feature 1..41: note = chr17:47572358-47572399
  misc_feature 1..41: note = Hyper
  source 1..41: mol_type = genomic DNA

SEQ ID NO: 113486 - DNA, 2283 bp, Homo sapiens; identical to SEQ ID NO: 80648
  misc_feature 1..2283: note = chr17:47572971-47575254
  misc_feature 1..2283: note = Hyper
  source 1..2283: mol_type = genomic DNA

SEQ ID NO: 113487 - DNA, 30 bp, Homo sapiens; identical to SEQ ID NO: 80649
  misc_feature 1..30: note = chr17:47643694-47643724
  misc_feature 1..30: note = Hyper
  source 1..30: mol_type = genomic DNA

SEQ ID NO: 113488 - DNA, 30 bp, Homo sapiens; identical to SEQ ID NO: 80650
  misc_feature 1..30: note = chr17:47644064-47644094
  misc_feature 1..30: note = Hypo
  source 1..30: mol_type = genomic DNA

SEQ ID NO: 113489 - DNA, 64 bp, Homo sapiens; identical to SEQ ID NO: 80651
  misc_feature 1..64: note = chr17:47653309-47653373
  misc_feature 1..64: note = Hyper
  source 1..64: mol_type = genomic DNA

SEQ ID NO: 113490 - DNA, 97 bp, Homo sapiens; identical to SEQ ID NO: 80652
  misc_feature 1..97: note = chr17:47657497-47657594
  misc_feature 1..97: note = Hypo
  source 1..97: mol_type = genomic DNA

SEQ ID NO: 113491 - DNA, 36 bp, Homo sapiens; identical to SEQ ID NO: 80653
  misc_feature 1..36: note = chr17:47756022-47756058
  misc_feature 1..36: note = Hypo
  source 1..36: mol_type = genomic DNA

SEQ ID NO: 113492 - DNA, 62 bp, Homo sapiens; identical to SEQ ID NO: 80654
  misc_feature 1..62: note = chr17:47840698-47840760
  misc_feature 1..62: note = Hyper
  source 1..62: mol_type = genomic DNA

SEQ ID NO: 113493 - DNA, 32 bp, Homo sapiens; identical to SEQ ID NO: 16208
  misc_feature 1..32: note = chr17:47851118-47851150
  misc_feature 1..32: note = Hypo
  source 1..32: mol_type = genomic DNA

SEQ ID NO: 113494 - DNA, 31 bp, Homo sapiens; identical to SEQ ID NO: 16209
  misc_feature 1..31: note = chr17:47851390-47851421
  misc_feature 1..31: note = Hypo
  source 1..31: mol_type = genomic DNA

SEQ ID NO: 113495 - DNA, 163 bp, Homo sapiens; identical to SEQ ID NO: 80657
  misc_feature 1..163: note = chr17:47865437-47865600
  misc_feature 1..163: note = Hyper
  source 1..163: mol_type = genomic DNA

SEQ ID NO: 113496 - DNA, 376 bp, Homo sapiens; identical to SEQ ID NO: 80658
  misc_feature 1..376: note = chr17:47928151-47928527
  misc_feature 1..376: note = Hyper
  source 1..376: mol_type = genomic DNA

SEQ ID NO: 113497 - DNA, 152 bp, Homo sapiens
  misc_feature 1..152: note = chr17:47967958-47968110
  misc_feature 1..152: note = Hyper
  source 1..152: mol_type = genomic DNA
ctccgggcccgacgccggcccagcccagcagtgccgggcgccgggcccaagccgaccccctgttttggctctgccgcctgatttctaccgcaggcagatatcttccgagaccccgggcccctaggctggcctcgcgccgctaccccagggcc

SEQ ID NO: 113498 - DNA, 39 bp, Homo sapiens; identical to SEQ ID NO: 80661
  misc_feature 1..39: note = chr17:47979358-47979397
  misc_feature 1..39: note = Hyper
  source 1..39: mol_type = genomic DNA

SEQ ID NO: 113499 - DNA, 605 bp, Homo sapiens; identical to SEQ ID NO: 80662
  misc_feature 1..605: note = chr17:47987509-47988114
  misc_feature 1..605: note = Hyper
  source 1..605: mol_type = genomic DNA

SEQ ID NO: 113500 - DNA, 85 bp, Homo sapiens; identical to SEQ ID NO: 36640
  misc_feature 1..85: note = chr17:48040403-48040488
  misc_feature 1..85: note = Hyper
  source 1..85: mol_type = genomic DNA

SEQ ID NO: 113501 - DNA, 677 bp, Homo sapiens; identical to SEQ ID NO: 80664
  misc_feature 1..677: note = chr17:48041100-48041777
  misc_feature 1..677: note = Hyper
  source 1..677: mol_type = genomic DNA

SEQ ID NO: 113502 - DNA, 945 bp, Homo sapiens
  misc_feature 1..945: note = chr17:48042039-48042984
  misc_feature 1..945: note = Hyper
  source 1..945: mol_type = genomic DNA
caatccctgagaaagcgctcaggggcttgctgaggtgagcgcaaatggaagcacaaggccgggctggccgtgggctcagtaaccagtcggctgcccggcttgcgccagcactaaatgctcgatcagaaagagaaaaagaggcgcaataattccaaatttcaggaaaagtcaaatcggagaggggggacgcaggtctcttcagactgcccattctccgggcctcgctgaatgcgggggctctatccacagcgcgcggggccgagctcaggcaggctggggcgaagatctgattctttccttcccgccgccaaaccgaattaatcagtttcttcaacctgagttactaagaaagaaaggtccttccaaataaaactgaaaatcactgcgaatgacaatactatactacaagttcgttttggggccggtgggtgggatggaggagaaagggcacggataatcccggagggccgcggagtgaggaggactatggtcgcggtggaatctctgttccgctggcacatccgcgcaggtgcggctctgagtgctggctcggggttacagacctcggcatccggctgcaggggcagacagagacctcctctgctagggcgtgcggtaggcatcgtatggagcccagagactgccgagagcactgcgcactcaccaagtgttaggggtgcccgtgatagaccgccagggaaggggctggttcggagggaattcccgctaccgggaaggtcggaactcggggtgatcaaacaaggaatgcatctcacctccgtgggtgcttgtgctgcgcaaggaattattaccggagcggttgcgatggcctttgcccggcgacccaagaagagtaagcaaactaccgtccacccagcggatcaggtccaatccctgcgcctcggcccaatccctagagccccgcggcgccgtatcccctccccc

SEQ ID NO: 113503 - DNA, 319 bp, Homo sapiens
  misc_feature 1..319: note = chr17:48046722-48047041
  misc_feature 1..319: note = Hyper
  source 1..319: mol_type = genomic DNA
gctggctggggggcccgtccggcccaacgccggaggcttggaaaagagagttggcagcgggagcggactacgtgccgggccatggcccttctgcccgggccctggccacaatgacctctttgccctgccccctccccggccgggacgcctccaaagctgtcttcccagacctcgcccctgtcccgtcggtagcggctgcctacccgcttggcttgtcccctacaaccgcagcctcccccaatttgtcctactccaggccgtatggccacctcctgtcttacccctacaccgagccagcgaaccccggagactcctacct

SEQ ID NO: 113504 - DNA, 1787 bp, Homo sapiens; identical to SEQ ID NO: 80669
  misc_feature 1..1787: note = chr17:48048796-48050583
  misc_feature 1..1787: note = Hyper
  source 1..1787: mol_type = genomic DNA

SEQ ID NO: 113505 - DNA, 1226 bp, Homo sapiens
  misc_feature 1..1226: note = chr17:48070654-48071880
  misc_feature 1..1226: note = Hyper
  source 1..1226: mol_type = genomic DNA
agagttccaggagcccgcagggcccttcagtggccagccaggctcggcagcgcgcggggaactacggggtcccgcgcgcccccgcggccctggacagccaaacaccaacctgtgtctgcgtgaggcccagctgcgcggccagctcggcgcgctcgggcagcgccaggtactgggccttctggaagcggcgctgcagggcggccagctggtagctggagtagatcgtacgcggctttcggaccttcttgggcttcccattcaccatgcgcacctctgcttccggctcctccttcaccgacactgcggggaacgcaccgggcggaagagggggcggttcagcctcggcctgcgactcctgcgaccctccagggccccgccggacgcccctcgcttccgcccaccgactcgccgcgggattcccggccgcgcgctccgctgcccgcggcccaggggggagccgcggccccagagccagaactggccgcggcccacaacgcggcgctcccagctccgcgcccggccgccgcagcactgtccccggcgccagccgccgcctgcgccaggaccgcctcggcttcgctcacgacgccttcccggctcgcctcccagcctcggggctcctcgccgcccggctgctagccgcccccttcccagtcccatctcgccgtcggttgtttctctcgctccttcccgtccgccccccgccctttaaaaaagtttcattttagaatctctttagattttcagaaaagttgcaaggatagtgcagactttctttctttccctgtcccccttcttccccccttccttctctccttcctttcttgtttcttctgccctttctctcactgtctttccatacttccctcttgctgccttcacttttccctttttcagcttctctgcctctcggtggctgcttccctccgctttcccgcaacttccgtgggtccttctcattgccccctcacgactcctagtctccccatcccttatccaaaggagggcccctagagtttccagcccctgccgcctacccccaagccctctgcgacttgatcgaggatcgcctgctgaaatgcccacgaaatcacctcgattcggaggtttcctaacaacccacagccttccccttcctctctcagctcatcccgatcctcatccgggaccgcggcgcactgcgcacatcgcgccccaaatgcttgcacacccggggctggaaggtc

SEQ ID NO: 113506 - DNA, 88 bp, Homo sapiens; identical to SEQ ID NO: 80672
  misc_feature 1..88: note = chr17:48190266-48190354
  misc_feature 1..88: note = Hypo
  source 1..88: mol_type = genomic DNA

SEQ ID NO: 113507 - DNA, 277 bp, Homo sapiens; identical to SEQ ID NO: 80673
  misc_feature 1..277: note = chr17:48206298-48206575
  misc_feature 1..277: note = Hyper
  source 1..277: mol_type = genomic DNA

SEQ ID NO: 113508 - DNA, 30 bp, Homo sapiens; identical to SEQ ID NO: 80674
  misc_feature 1..30: note = chr17:48207718-48207748
  misc_feature 1..30: note = Hyper
  source 1..30: mol_type = genomic DNA

SEQ ID NO: 113509 - DNA, 30 bp, Homo sapiens; identical to SEQ ID NO: 80675
  misc_feature 1..30: note = chr17:48225911-48225941
  misc_feature 1..30: note = Hyper
  source 1..30: mol_type = genomic DNA

SEQ ID NO: 113510 - DNA, 33 bp, Homo sapiens; identical to SEQ ID NO: 80676
  misc_feature 1..33: note = chr17:48239531-48239564
  misc_feature 1..33: note = Hypo
  source 1..33: mol_type = genomic DNA

SEQ ID NO: 113511 - DNA, 39 bp, Homo sapiens; identical to SEQ ID NO: 80677
  misc_feature 1..39: note = chr17:48278705-48278744
  misc_feature 1..39: note = Hyper
  source 1..39: mol_type = genomic DNA

SEQ ID NO: 113512 - DNA, 30 bp, Homo sapiens; identical to SEQ ID NO: 80679
  misc_feature 1..30: note = chr17:48503171-48503201
  misc_feature 1..30: note = Hyper
  source 1..30: mol_type = genomic DNA

SEQ ID NO: 113513 - DNA, 30 bp, Homo sapiens; identical to SEQ ID NO: 80680
  misc_feature 1..30: note = chr17:48550296-48550326
  misc_feature 1..30: note = Hypo
  source 1..30: mol_type = genomic DNA

SEQ ID NO: 113514 - DNA, 177 bp, Homo sapiens; identical to SEQ ID NO: 80681
  misc_feature 1..177: note = chr17:48585866-48586043
  misc_feature 1..177: note = Hyper
  source 1..177: mol_type = genomic DNA

SEQ ID NO: 113515 - DNA, 369 bp, Homo sapiens; identical to SEQ ID NO: 80682
  misc_feature 1..369: note = chr17:48611939-48612308
  misc_feature 1..369: note = Hypo
  source 1..369: mol_type = genomic DNA

SEQ ID NO: 113516 - DNA, 30 bp, Homo sapiens; identical to SEQ ID NO: 80683
  misc_feature 1..30: note = chr17:48617944-48617974
  misc_feature 1..30: note = Hypo
  source 1..30: mol_type = genomic DNA

SEQ ID NO: 113517 - DNA, 640 bp, Homo sapiens
  misc_feature 1..640: note = chr17:48619096-48619736
  misc_feature 1..640: note = Hyper
  source 1..640: mol_type = genomic DNA
tcagagcctagcctccgccggaggagcccactcttcttcccaacttccacgacctcccggtgtagggctctgaaccccgggtcactcaaagccactctcgttctgcaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctca

SEQ ID NO: 113518 - DNA, 30 bp, Homo sapiens; identical to SEQ ID NO: 80686
  misc_feature 1..30: note = chr17:48620645-48620675
  misc_feature 1..30: note = Hypo
  source 1..30: mol_type = genomic DNA

SEQ ID NO: 113519 - DNA, 882 bp, Homo sapiens; identical to SEQ ID NO: 80687
  misc_feature 1..882: note = chr17:48636387-48637269
  misc_feature 1..882: note = Hyper
  source 1..882: mol_type = genomic DNA

SEQ ID NO: 113520 - DNA, 71 bp, Homo sapiens; identical to SEQ ID NO: 80688
  misc_feature 1..71: note = chr17:48637706-48637777
  misc_feature 1..71: note = Hyper
  source 1..71: mol_type = genomic DNA

SEQ ID NO: 113521 - DNA, 103 bp, Homo sapiens; identical to SEQ ID NO: 80689
  misc_feature 1..103: note = chr17:48638942-48639045
  misc_feature 1..103: note = Hyper
  source 1..103: mol_type = genomic DNA

SEQ ID NO: 113522 - DNA, 501 bp, Homo sapiens; identical to SEQ ID NO: 80690
  misc_feature 1..501: note = chr17:48639331-48639832
  misc_feature 1..501: note = Hyper
  source 1..501: mol_type = genomic DNA

SEQ ID NO: 113523 - DNA, 449 bp, Homo sapiens; identical to SEQ ID NO: 80691
  misc_feature 1..449: note = chr17:48652975-48653424
  misc_feature 1..449: note = Hypo
  source 1..449: mol_type = genomic DNA

SEQ ID NO: 113524 - DNA, 35 bp, Homo sapiens; identical to SEQ ID NO: 80692
  misc_feature 1..35: note = chr17:48673781-48673816
  misc_feature 1..35: note = Hypo
  source 1..35: mol_type = genomic DNA

SEQ ID NO: 113525 - DNA, 71 bp, Homo sapiens; identical to SEQ ID NO: 80693
  misc_feature 1..71: note = chr17:48678374-48678445
  misc_feature 1..71: note = Hypo
  source 1..71: mol_type = genomic DNA

SEQ ID NO: 113526 - DNA, 88 bp, Homo sapiens; identical to SEQ ID NO: 80694
  misc_feature 1..88: note = chr17:48687158-48687246
  misc_feature 1..88: note = Hypo
  source 1..88: mol_type = genomic DNA

SEQ ID NO: 113527 - DNA, 158 bp, Homo sapiens; identical to SEQ ID NO: 80695
  misc_feature 1..158: note = chr17:48712444-48712602
  misc_feature 1..158: note = Hyper
  source 1..158: mol_type = genomic DNA

SEQ ID NO: 113528 - DNA, 24 bp, Homo sapiens
  misc_feature 1..24: note = chr17:48799846-48799870
  misc_feature 1..24: note = Hypo
  source 1..24: mol_type = genomic DNA
gcgcccggccggctcctcttatgc

SEQ ID NO: 113529 - DNA, 105 bp, Homo sapiens; identical to SEQ ID NO: 80697
  misc_feature 1..105: note = chr17:48805065-48805170
  misc_feature 1..105: note = Hypo
  source 1..105: mol_type = genomic DNA

SEQ ID NO: 113530 - DNA, 36 bp, Homo sapiens; identical to SEQ ID NO: 80698
  misc_feature 1..36: note = chr17:48846173-48846209
  misc_feature 1..36: note = Hypo
  source 1..36: mol_type = genomic DNA

SEQ ID NO: 113531 - DNA, 43 bp, Homo sapiens; identical to SEQ ID NO: 80699
  misc_feature 1..43: note = chr17:48911187-48911230
  misc_feature 1..43: note = Hypo
  source 1..43: mol_type = genomic DNA

SEQ ID NO: 113532 - DNA, 273 bp, Homo sapiens; identical to SEQ ID NO: 80701
  misc_feature 1..273: note = chr17:49008614-49008887
  misc_feature 1..273: note = Hyper
  source 1..273: mol_type = genomic DNA

SEQ ID NO: 113533 - DNA, 38 bp, Homo sapiens; identical to SEQ ID NO: 80702
  misc_feature 1..38: note = chr17:49012104-49012142
  misc_feature 1..38: note = Hypo
  source 1..38: mol_type = genomic DNA

SEQ ID NO: 113534 - DNA, 30 bp, Homo sapiens; identical to SEQ ID NO: 80703
  misc_feature 1..30: note = chr17:49021785-49021815
  misc_feature 1..30: note = Hyper
  source 1..30: mol_type = genomic DNA

SEQ ID NO: 113535 - DNA, 120 bp, Homo sapiens; identical to SEQ ID NO: 80704
  misc_feature 1..120: note = chr17:49229481-49229601
  misc_feature 1..120: note = Hypo
  source 1..120: mol_type = genomic DNA

SEQ ID NO: 113536 - DNA, 124 bp, Homo sapiens; identical to SEQ ID NO: 80705
  misc_feature 1..124: note = chr17:49462711-49462835
  misc_feature 1..124: note = Hypo
  source 1..124: mol_type = genomic DNA

SEQ ID NO: 113537 - DNA, 40 bp, Homo sapiens; identical to SEQ ID NO: 80712
  misc_feature 1..40: note = chr17:50234619-50234659
  misc_feature 1..40: note = Hyper
  source 1..40: mol_type = genomic DNA

SEQ ID NO: 113538 - DNA, 197 bp, Homo sapiens
  misc_feature 1..197: note = chr17:50235160-50235357
  misc_feature 1..197: note = Hyper
  source 1..197: mol_type = genomic DNA
tccaagtgcatcactcgacgggaaaacggggggaaggggggagcccgacacggcacacacacatacacactcgcacacacttccgagcgagtgcacactcgcactcccacccgacagccggccagggacagtcacccccaagatcaatatcgcagtttgaattgttccggcaaatctcccctcgggctcgacggatg

SEQ ID NO: 113539 - DNA, 751 bp, Homo sapiens; identical to SEQ ID NO: 80714
  misc_feature 1..751: note = chr17:50235728-50236479
  misc_feature 1..751: note = Hyper
  source 1..751: mol_type = genomic DNA

SEQ ID NO: 113540 - DNA, 60 bp, Homo sapiens; identical to SEQ ID NO: 36657
  misc_feature 1..60: note = chr17:50236690-50236750
  misc_feature 1..60: note = Hyper
  source 1..60: mol_type = genomic DNA

SEQ ID NO: 113541 - DNA, 30 bp, Homo sapiens; identical to SEQ ID NO: 36658
  misc_feature 1..30: note = chr17:50237251-50237281
  misc_feature 1..30: note = Hyper
  source 1..30: mol_type = genomic DNA

SEQ ID NO: 113542 - DNA, 30 bp, Homo sapiens; identical to SEQ ID NO: 45112
  misc_feature 1..30: note = chr17:51321147-51321177
  misc_feature 1..30: note = Hypo
  source 1..30: mol_type = genomic DNA

SEQ ID NO: 113543 - DNA, 21 bp, Homo sapiens
  misc_feature 1..21: note = chr17:51787080-51787101
  misc_feature 1..21: note = Hypo
  source 1..21: mol_type = genomic DNA
aggcacggtggctcacgcctg

SEQ ID NO: 113544 - DNA, 178 bp, Homo sapiens; identical to SEQ ID NO: 80721
  misc_feature 1..178: note = chr17:51900906-51901084
  misc_feature 1..178: note = Hypo
  source 1..178: mol_type = genomic DNA

SEQ ID NO: 113545 - DNA, 50 bp, Homo sapiens; identical to SEQ ID NO: 80722
  misc_feature 1..50: note = chr17:52978290-52978340
  misc_feature 1..50: note = Hyper
  source 1..50: mol_type = genomic DNA

SEQ ID NO: 113546 - DNA, 270 bp, Homo sapiens; identical to SEQ ID NO: 80725
  misc_feature 1..270: note = chr17:53341212-53341482
  misc_feature 1..270: note = Hyper
  source 1..270: mol_type = genomic DNA

SEQ ID NO: 113547 - DNA, 1474 bp, Homo sapiens
  misc_feature 1..1474: note = chr17:53342183-53343657
  misc_feature 1..1474: note = Hyper
  source 1..1474: mol_type = genomic DNA
gtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggcggccggatgcgctgagcccggcgctgcggggccgcggagcgctggggagcagcggccgccggcgcggggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcacgcccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctc

SEQ ID NO: 113548 - DNA, 40 bp, Homo sapiens; identical to SEQ ID NO: 80728
  misc_feature 1..40: note = chr17:53479136-53479176
  misc_feature 1..40: note = Hypo
  source 1..40: mol_type = genomic DNA

SEQ ID NO: 113549 - DNA, 87 bp, Homo sapiens; identical to SEQ ID NO: 80730
  misc_feature 1..87: note = chr17:53916938-53917025
  misc_feature 1..87: note = Hypo
  source 1..87: mol_type = genomic DNA

SEQ ID NO: 113550 - DNA, 357 bp, Homo sapiens; identical to SEQ ID NO: 36663
  misc_feature 1..357: note = chr17:53922649-53923006
  misc_feature 1..357: note = Hyper
  source 1..357: mol_type = genomic DNA

SEQ ID NO: 113551 - DNA, 28 bp, Homo sapiens
  misc_feature 1..28: note = chr17:54150661-54150689
  misc_feature 1..28: note = Hypo
  source 1..28: mol_type = genomic DNA
cttaacatcctaacgttttattatgaaa

SEQ ID NO: 113552 - DNA, 22 bp, Homo sapiens
  misc_feature 1..22: note = chr17:54266818-54266840
  misc_feature 1..22: note = Hypo
  source 1..22: mol_type = genomic DNA
ccgcgcccggcctgccctgact

SEQ ID NO: 113553 - DNA, 30 bp, Homo sapiens; identical to SEQ ID NO: 16216
  misc_feature 1..30: note = chr17:54473510-54473540
  misc_feature 1..30: note = Hypo
  source 1..30: mol_type = genomic DNA

SEQ ID NO: 113554 - DNA, 52 bp, Homo sapiens; identical to SEQ ID NO: 80736
  misc_feature 1..52: note = chr17:54588100-54588152
  misc_feature 1..52: note = Hypo
  source 1..52: mol_type = genomic DNA

SEQ ID NO: 113555 - DNA, 124 bp, Homo sapiens; identical to SEQ ID NO: 80737
  misc_feature 1..124: note = chr17:54670716-54670840
  misc_feature 1..124: note = Hyper
  source 1..124: mol_type = genomic DNA

SEQ ID NO: 113556 - DNA, 1166 bp, Homo sapiens; identical to SEQ ID NO: 80738
  misc_feature 1..1166: note = chr17:54671198-54672364
  misc_feature 1..1166: note = Hyper
  source 1..1166: mol_type = genomic DNA

SEQ ID NO: 113557 - DNA, 183 bp, Homo sapiens; identical to SEQ ID NO: 80739
  misc_feature 1..183: note = chr17:54673501-54673684
  misc_feature 1..183: note = Hyper
  source 1..183: mol_type = genomic DNA

SEQ ID NO: 113558 - DNA, 155 bp, Homo sapiens; identical to SEQ ID NO: 36666
  misc_feature 1..155: note = chr17:54673918-54674073
  misc_feature 1..155: note = Hyper
  source 1..155: mol_type = genomic DNA

SEQ ID NO: 113559 - DNA, 571 bp, Homo sapiens
  misc_feature 1..571: note = chr17:54674738-54675309
  misc_feature 1..571: note = Hyper
  source 1..571: mol_type = genomic DNA
aaactttctgtgccccgggccaatatttttttagacagagtttcacttgcgaggggcggaggtggtggggagtggggaagaggaggggtcttatgcgaggggggcgaaagcaagaattttcatgcctggtaaacacgcgaattatgcgaagagagttattcccagctgggcgggcagccaaaactcggagagcgcgccgaggccagcgcccccacccccacgttggcaatgtcattggattacaatgcgaggtcttcccctccgcgacgccccctcctccctccgcgggcccgcccgcccgcgcccctcctccccacccctgcccacttggaaaacccgcccgcagccggcgagcttctcggctttcagagcaggagccggtgtgagctgggaggacgcgggttgcagacgtgaccggcgacagacagaccaccggatgcacagaaccagagagcaggcccgaagccgctgcggccgcgggagaggacccagcgggacccaggcagtcccagaagctaacgaaggaagtgctggtcctggaacattgtgcctaatgcgcagctggttacct

SEQ ID NO: 113560 - DNA, 100 bp, Homo sapiens
  misc_feature 1..100: note = chr17:54755949-54756049
  misc_feature 1..100: note = Hyper
  source 1..100: mol_type = genomic DNA
taaccccccaggaagcgctccacgtgctgctggtgcgagcgccggcgcggcgcactaaatcatcgctggcgtccacatttcaaagcggagccggaggagt

SEQ ID NO: 113561 - DNA, 136 bp, Homo sapiens; identical to SEQ ID NO: 80744
  misc_feature 1..136: note = chr17:54756259-54756395
  misc_feature 1..136: note = Hyper
  source 1..136: mol_type = genomic DNA

SEQ ID NO: 113562 - DNA, 95 bp, Homo sapiens; identical to SEQ ID NO: 80745
  misc_feature 1..95: note = chr17:54911779-54911874
  misc_feature 1..95: note = Hyper
  source 1..95: mol_type = genomic DNA

SEQ ID NO: 113563 - DNA, 32 bp, Homo sapiens; identical to SEQ ID NO: 80746
  misc_feature 1..32: note = chr17:55037248-55037280
  misc_feature 1..32: note = Hypo
  source 1..32: mol_type = genomic DNA

SEQ ID NO: 113564 - DNA, 30 bp, Homo sapiens; identical to SEQ ID NO: 80747
  misc_feature 1..30: note = chr17:55139041-55139071
  misc_feature 1..30: note = Hypo
  source 1..30: mol_type = genomic DNA

SEQ ID NO: 113565 - DNA, 82 bp, Homo sapiens; identical to SEQ ID NO: 80748
  misc_feature 1..82: note = chr17:55184753-55184835
  misc_feature 1..82: note = Hypo
  source 1..82: mol_type = genomic DNA

SEQ ID NO: 113566 - DNA, 181 bp, Homo sapiens; identical to SEQ ID NO: 45118
  misc_feature 1..181: note = chr17:55364048-55364229
  misc_feature 1..181: note = Hypo
  source 1..181: mol_type = genomic DNA

SEQ ID NO: 113567 - DNA, 30 bp, Homo sapiens; identical to SEQ ID NO: 80750
  misc_feature 1..30: note = chr17:55568360-55568390
  misc_feature 1..30: note = Hypo
  source 1..30: mol_type = genomic DNA

SEQ ID NO: 113568 - DNA, 180 bp, Homo sapiens; identical to SEQ ID NO: 80751
  misc_feature 1..180: note = chr17:56024224-56024404
  misc_feature 1..180: note = Hyper
  source 1..180: mol_type = genomic DNA

SEQ ID NO: 113569 - DNA, 79 bp, Homo sapiens; identical to SEQ ID NO: 80752
  misc_feature 1..79: note = chr17:56031530-56031609
  misc_feature 1..79: note = Hypo
  source 1..79: mol_type = genomic DNA

SEQ ID NO: 113570 - DNA, 20 bp, Homo sapiens
  misc_feature 1..20: note = chr17:56092600-56092620
  misc_feature 1..20: note = Hypo
  source 1..20: mol_type = genomic DNA
taagagctgaaatcacgaga

SEQ ID NO: 113571 - DNA, 569 bp, Homo sapiens; identical to SEQ ID NO: 36671
  misc_feature 1..569: note = chr17:56234271-56234840
  misc_feature 1..569: note = Hyper
  source 1..569: mol_type = genomic DNA

SEQ ID NO: 113572 - DNA, 186 bp, Homo sapiens; identical to SEQ ID NO: 80755
  misc_feature 1..186: note = chr17:56326821-56327007
  misc_feature 1..186: note = Hyper
  source 1..186: mol_type = genomic DNA

SEQ ID NO: 113573 - DNA, 79 bp, Homo sapiens; identical to SEQ ID NO: 80756
  misc_feature 1..79: note = chr17:56327222-56327301
  misc_feature 1..79: note = Hyper
  source 1..79: mol_type = genomic DNA

SEQ ID NO: 113574 - DNA, 30 bp, Homo sapiens; identical to SEQ ID NO: 80757
  misc_feature 1..30: note = chr17:56435300-56435330
  misc_feature 1..30: note = Hypo
  source 1..30: mol_type = genomic DNA

SEQ ID NO: 113575 - DNA, 30 bp, Homo sapiens; identical to SEQ ID NO: 80758
  misc_feature 1..30: note = chr17:56680534-56680564
  misc_feature 1..30: note = Hypo
  source 1..30: mol_type = genomic DNA

SEQ ID NO: 113576 - DNA, 30 bp, Homo sapiens; identical to SEQ ID NO: 80759
  misc_feature 1..30: note = chr17:56742978-56743008
  misc_feature 1..30: note = Hypo
  source 1..30: mol_type = genomic DNA

SEQ ID NO: 113577 - DNA, 30 bp, Homo sapiens; identical to SEQ ID NO: 80760
  misc_feature 1..30: note = chr17:56781879-56781909
  misc_feature 1..30: note = Hypo
  source 1..30: mol_type = genomic DNA

SEQ ID NO: 113578 - DNA, 1435 bp, Homo sapiens
  misc_feature 1..1435: note = chr17:56832946-56834381
  misc_feature 1..1435: note = Hyper
  source 1..1435: mol_type = genomic DNA
ttcagagttggagagcgggcgagtggagtgtcctttagactccgcggactcgacgggagggaccctgcaatgcttaattagaaccggttgccatggcgacagtctctaggcagcgtgggctgagctctccgtaggaataaagggtgggccgccgctggaccctgcgcgcgcccgccaccaactttccctccagatccgagaggggcggcgcgctccgcccccgggccgcgcacgtcggtgctcggcggcgcgcacgcctgcgggagccctctccaggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatagttaagtagctgggcttggctggtggtgggcccgcggtccccaccgcgccggcctcggacgcggctccctcggcccctcaaactgctctcttttctgctcctctcccccgcacccgcgcctgccgccgctgaaagcgcccccgctgctcggacccgggcggtcggctgagagctgcccacgcccgcctcggcccccacgcccgcctcggcccccacgcctcctacccggccttgaagccgctctcctgagccccggcgccctcccgccgggcccgggcccctcatcccctttcacctcggcccccagcttctagctccacttcacgcaacctttccctttcctgcctggaaaggtccttcctcccaggcttgagctccctcttcttcccagatcccttctttctccgggaggtttcctcccaccccagtctgtcttttcccgggctgagtgccttgttgtttggcggcagagacgcgactcctttctagactgagctgcgaggtgcctcctgcgtaactgcaacaatgatggttataccggccccgtatccagatgaga

SEQ ID NO: 113579 - DNA, 102 bp, Homo sapiens; identical to SEQ ID NO: 45120
  misc_feature 1..102: note = chr17:57297027-57297129
  misc_feature 1..102: note = Hypo
  source 1..102: mol_type = genomic DNA

SEQ ID NO: 113580 - DNA, 97 bp, Homo sapiens; identical to SEQ ID NO: 80764
  misc_feature 1..97: note = chr17:57299480-57299577
  misc_feature 1..97: note = Hypo
  source 1..97: mol_type = genomic DNA

SEQ ID NO: 113581 - DNA, 22 bp, Homo sapiens
  misc_feature 1..22: note = chr17:57787544-57787566
  misc_feature 1..22: note = Hypo
  source 1..22: mol_type = genomic DNA
cagactccgtctcaaaaaaaaa

SEQ ID NO: 113582 - DNA, 30 bp, Homo sapiens; identical to SEQ ID NO: 80766
  misc_feature 1..30: note = chr17:57866235-57866265
  misc_feature 1..30: note = Hypo
  source 1..30: mol_type = genomic DNA

SEQ ID NO: 113583 - DNA, 26 bp, Homo sapiens
  misc_feature 1..26: note = chr17:57879973-57879999
  misc_feature 1..26: note = Hypo
  source 1..26: mol_type = genomic DNA
tgtagtgcagtggcacgatctctgct

SEQ ID NO: 113584 - DNA, 30 bp, Homo sapiens; identical to SEQ ID NO: 45121
  misc_feature 1..30: note = chr17:57881555-57881585
  misc_feature 1..30: note = Hypo
  source 1..30: mol_type = genomic DNA

SEQ ID NO: 113585 - DNA, 47 bp, Homo sapiens; identical to SEQ ID NO: 80769
  misc_feature 1..47: note = chr17:58212262-58212309
  misc_feature 1..47: note = Hyper
  source 1..47: mol_type = genomic DNA

SEQ ID NO: 113586 - DNA, 735 bp, Homo sapiens; identical to SEQ ID NO: 80770
  misc_feature 1..735: note = chr17:58212587-58213322
  misc_feature 1..735: note = Hyper
  source 1..735: mol_type = genomic DNA

SEQ ID NO: 113587 - DNA, 1361 bp, Homo sapiens
  misc_feature 1..1361: note = chr17:58216263-58217624
  misc_feature 1..1361: note = Hyper
  source 1..1361: mol_type = genomic DNA
actcaggagatggggcgttgtgtataggcaagtcgctaaccgggagccccgcgcctcattccgactggatcagggggccccgcctgtccacggtccccatgcgcggtgcgctccccctcctagggccgtaattgccgcagccatccctacgcgtctccagcccccgtcgtctttgtccattcggttccgaggccgcgcttggactggggcgcccacgactgaccccggaggcacagcgaacggggcagctgcagggactccctgtcctgcaggcgactgggctcccgcgaggcagcaggtgccgaggactagcagcagatctggtgtgcagaaccctggattcgagtcccggcttcagagaccctcggctgtgtgacgtggaggcgtcggccgccctctgagagccttcgtggatgacagctgatgcttgggcctaccttcctcggctgctgagaggctcagaagggaccgcgtgtaaaacgccttggaatcttaaatctacttaattccatttacctgcttcccagaaacggtccatggcttccgtcccggtcatagcgctgcgcagcgggaccgttctgccccgctgccctcgaacagcccgtccgcgctccattgcccctccaggtgccgttattttgccttttaacctggggcgggaggttttagacgaggctgcaagtctgggccagcggggacctgagggtcccttgcaaccagcacccgcgacggtgtctacactggaattccaaggaaaagagggctccaggggcgcgaccaaggtttggtcttctgctgagcgctgctggatgaatcgccagccttcgcccgcggccccctcctcctcatccctgaccccaactcgacaagatcccccgagcgcaggcccaaactccgcacagcttgtgggccgtgaggtccgggtctcgaagctcggtcccgctggggctgtccctccgcctctacttccagggtaaagaccgcggaaccaggcgggggtctggggagcctggctgcgacctcggctgcaggcttccgcagctgcttccagggtgctgtccaccccgtggtgctgaagtgccccacgcccctccgccacctaccggaagccgcgtccgcgctacagcctccactcaggattcgacccgaactccaagacgcgtccgcactggtccaacaaccctcatggatcgtcgcctgcctcaactgtttagaccaccgcgggtttcacccggaagcaccggggaggtcggagcttgcctgagaggctcagcgaaggtccatgccttgttcagtcccaggcagtgcgggacaggtgggcgaagctcgaaccccatgctctgtcccggcactggcaggaa

SEQ ID NO: 113588 - DNA, 446 bp, Homo sapiens; identical to SEQ ID NO: 80775
  misc_feature 1..446: note = chr17:58218611-58219057
  misc_feature 1..446: note = Hyper
  source 1..446: mol_type = genomic DNA

SEQ ID NO: 113589 - DNA, 508 bp, Homo sapiens
  misc_feature 1..508: note = chr17:58227104-58227612
  misc_feature 1..508: note = Hyper
  source 1..508: mol_type = genomic DNA
gctgagtggagaggacgcggagtgggtgagggggccttgcgcacagggcaagaggtggccaggcagggcgggggaccggggagagcggaggatttcagatgagggacaggggaaggtggagaggggagggcaggccccgccagggggaggagccgcctcccgcgtccagctgtcggggctccctcccgtcgcggctccgctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcaggtgagctcccgggctccggccccaggtgcccctcggcggtcccctccgtgcccccagctcccgcccctgcagaggatccccccgcgggcgaccggtgagcgtcggtggcgctggggtcccgggttgcgtgtgcgccgggggccgcgagggtgcgggagg

SEQ ID NO: 113590 - DNA, 325 bp, Homo sapiens; identical to SEQ ID NO: 80777
  misc_feature 1..325: note = chr17:58228072-58228397
  misc_feature 1..325: note = Hyper
  source 1..325: mol_type = genomic DNA

SEQ ID NO: 113591 - DNA, 88 bp, Homo sapiens; identical to SEQ ID NO: 80778
  misc_feature 1..88: note = chr17:58471337-58471425
  misc_feature 1..88: note = Hypo
  source 1..88: mol_type = genomic DNA

SEQ ID NO: 113592 - DNA, 598 bp, Homo sapiens
  misc_feature 1..598: note = chr17:58498747-58499345
  misc_feature 1..598: note = Hyper
  source 1..598: mol_type = genomic DNA
cccctctcctgtgcccgaggtggccgctgggtggcaggggaggcccgggccgacggcggtcccaccgcactgtcgcgaaggcaggcgaagaacagggccacactgagtggggacaactgggcccgggcccagaggacacgaaggaaggtccgggagaaggaattcctagtttcagggaagaaaaggtggctcgagtgaggaaactgcgggggcaacggtctctcgtcgccgggaccccgccgtgtgccgcccagggacgcgagggggcgctgctgccgcgccaggggcgagggtcccggggcctcctgagcacctcccggccctgcccggccaactcagactacacccggactctgcccaccgcgtttccgccctcggcctcgggtccctggagggctcgcgggtaggaagagtcggggtggcgggactttcgccgacacccggctccccgcctggtggctgcgcacacgaggccggcgacgggacttgcccgcgtctcagcgcctcctgtgtgaagcgggaccgctgcggtacctgccccagggaaggccgcggggagggttacagagcccgtaggcactggcggggatctttatac

SEQ ID NO: 113593 - DNA, 30 bp, Homo sapiens; identical to SEQ ID NO: 80781
  misc_feature 1..30: note = chr17:58896180-58896210
  misc_feature 1..30: note = Hypo
  source 1..30: mol_type = genomic DNA

SEQ ID NO: 113594 - DNA, 30 bp, Homo sapiens; identical to SEQ ID NO: 80782
  misc_feature 1..30: note = chr17:59277972-59278002
  misc_feature 1..30: note = Hypo
  source 1..30: mol_type = genomic DNA

SEQ ID NO: 113595 - DNA, 30 bp, Homo sapiens; identical to SEQ ID NO: 80783
  misc_feature 1..30: note = chr17:59380675-59380705
  misc_feature 1..30: note = Hypo
  source 1..30: mol_type = genomic DNA

SEQ ID NO: 113596 - DNA, 128 bp, Homo sapiens; identical to SEQ ID NO: 80784
  misc_feature 1..128: note = chr17:59467426-59467554
  misc_feature 1..128: note = Hyper
  source 1..128: mol_type = genomic DNA

SEQ ID NO: 113597 - DNA, 1413 bp, Homo sapiens
  misc_feature 1..1413: note = chr17:59473731-59475144
  misc_feature 1..1413: note = Hyper
  source 1..1413: mol_type = genomic DNA
gttggccccaccctgcgcgggataattgggacgggagggaggcgacgggagggcggcggctccagagagactgcgcgcctgtcagcggcaatttgtttaagtggacgggacgggccgggccgctgcgggctggggtcaccgaggccgcggcccccaccccaaccagacctgggaccgcgggggagcccggtccggccgctaaaccgggctggctggcgccagggctccgggaggtgcggtccggcggggaagccgtgatgggaagcgactctgtccagggagtgtccttcaccaccacactcctcacgtccaggcagtgatcgacggcctggcggcaccctcacagcgggcccatagcacggggccacacacgtcccctgagcttagcctgggcacattcgtctgccaccgagggcttaagccagtctgcagcccgcgccccgtcactcggacgcaagtccgtcgtccgctctgccacgcggccgcacagcccgagcttcctgctgcccactgcccgcggggtcacgcaaccccggccctgcacacagaggaggaagcggcggggaccccctgccacctggaggctcaacccggggaaggtcccagcagtgccccttaaccctgcgagaggtgacggggccggaggacggaagggcagccacgccaggctcaggaccgcggccccacccggcccaggccgtccccgctcccgccccatttcactgttgcgggaagcgcggggcgcacagaccgcgcgccaccagcccaagcccgcccgacgccctggccggagaccgcctgcgagagggaggggcggccgagcgcgcgtcccccgcctgtctgcgggacctggccgatgcgaagtgacaggggccggagctttgttgtggagcctcggccgcctggcgccagccgcccccgcccgcgccctccccctccagccccgggcggcccgcgaggcgccccccggggcctcttaaaggaacacgcacactcggcccccggggctccgccaggggagggggttcctgggaagggggagggggccggcctaggtgggggaggggcccagcggaggcctcacggcgccgctccagggcctcccaggcctccccagcgccagctttcggtgagcctcgggcattcctagctggagagtttggctgggggtcgctacagactcttcagagcggctgcagcaggacctcagggtgatcgcgggaccgcggggcggggcgagtggtgggatcctggcccggacagagccccggaaagccagagggaaggtcggtgccactgtaggtggggtcgccgtccccagatgcagccgctgcactgtcgccgccaggtttctcggtcaaataacccaggcctgagtgtttcaaactcttcaggcctcggacccctggacca

SEQ ID NO: 113598 - DNA, 3321 bp, Homo sapiens; identical to SEQ ID NO: 80787
  misc_feature 1..3321: note = chr17:59475357-59478678
  misc_feature 1..3321: note = Hyper
  source 1..3321: mol_type = genomic DNA

SEQ ID NO: 113599 - DNA, 32 bp, Homo sapiens; identical to SEQ ID NO: 80788
  misc_feature 1..32: note = chr17:59483112-59483144
  misc_feature 1..32: note = Hyper
  source 1..32: mol_type = genomic DNA

SEQ ID NO: 113600 - DNA, 1012 bp, Homo sapiens
  misc_feature 1..1012: note = chr17:59488100-59489112
  misc_feature 1..1012: note = Hyper
  source 1..1012: mol_type = genomic DNA
cctgcctcagacctgcgggcaggtccgggaacccgacagggacagagaagcccgttttccagcctaaatagaagctcgtgggcagcgcgtttgctggaggtcgctttgggctgaaacgcctctcatactcctagaggagcggcgcgtttgcgtcccgcggcttctcactttcagcaggacattaggagggagacgagagtcggctgcgcgcccgcggcggcctacgtacagggctgcggacaccagggggcagcaccgacttagggtcgcgggaggggtgcgggtgcgggcatgggcgcgggggaggcgggtgcctgcgaaggccgggcggggcggcctagtcgcggccgtttttaggccgcgtcgttgctgcagcaacccgggtggggtggggtgggactccagggcctcgagatcccccacaccactttcgccgccacctcccgccgcacatgtcccctccgagtcgcccacccggcgctccgcggggccccagctggtagcctgagtgcgactgcgggaacccgcggccggcggctgggccttgtcccagacaaaggctaggccactcccatgtccaattaagccaccctcctccccggcctcccagccctcattgtccccggggtcgccaattagcctaggcgcccggcgtacccgccgctccggtgccgcaaggcctccttaacccttcagggcctggcccggggtccttggacggcagagccgccggcacacgcgtggcaggagggccagtgctgggacgatggcgatacctgctggcggcctagcctgtcgcctcgggctctcgcgtgtggggcgtgtgaggtctaagagggaattgtgcgtgtcggtgtggggtggcgcgtgcgattcccggaggaactcggagatggagggtgtgagtgcaggggctccgagagacccctagcggctaagccgcccggatcccaaggcccaggggacctcatttcctctcgggttaatcggaatcttccgagccctcaagccc

SEQ ID NO: 113601 - DNA, 172 bp, Homo sapiens; identical to SEQ ID NO: 80791
  misc_feature 1..172: note = chr17:59490094-59490266
  misc_feature 1..172: note = Hyper
  source 1..172: mol_type = genomic DNA

SEQ ID NO: 113602 - DNA, 1476 bp, Homo sapiens
  misc_feature 1..1476: note = chr17:59528876-59530352
  misc_feature 1..1476: note = Hyper
  source 1..1476: mol_type = genomic DNA
atctcaaggagctgccgcggaatcctggccctgggccgcagtttccccaggaggctctgccaagcctggcaccttgcagcccggcctgggctctgtcaaggcccgagccggactcggctccactcagaggccggcccagcacttccctgccgccgccgccccgcacccggccaccgggcttcctcccagtcctcacccctgacctccgcggccgacttcgaggcgcgccaggccgggtccagcgcccgcggccccctgggccgggacaaggagggcgggtgagcagaagggccgtgcccagggcctggaagtgcaaggccgcgtggtgggcatggtagggaagcggagcgtgggcctgtgaggcgcgtgtgcgcctgcgacctcgggaccggggctcccaaatgaacagcgcgcacagctgggagcagggcttggggagcggggctctgcggccggggatccgtagaagccgctgcctggaagcgggcgccggcagggggtggccagacccggtcgtggagcgtcctagtcttcgggcacggcggggccaggcgagccctcctggttgtcgagcctcggctgagagccgggctgctcgcccttgcttcccgcctctctaatctaaaccatgcggggctcccagcccctacccggctcgcggggcccgagggccaagaggagggcactgggccgcgcggtggaggagccggcggctcgcgtggggctcgggatcttggggaccgcgacgccggggaaccctggagcccccctccccgggggacagcgggcgcagactgattgacagcggcgacgtcagcgcggagggggggcggccccagagggagggagggaggaggagggaattgaggccccaaagtgcagccttggagatcaagggcccgctccagagccgggatgtgtccagccccgagggcacggcaggcagctggaccctgacccagcggcgcggagtcggagccccggccgtcccgcgctcctcggacccgaacctgcaggggacctcgggccgctggcgcctccgcatgcggcaccgcaattagggtgagtgtgggttccagccgagtggggacgagctgggcgtgcggggctggggccacaggggctcagggttaggctgcggggacggacaggaggatgagctggaaaggggtgagtcacgcgacccggggaagaacttcaggggcggtcaaagttgcaggaaggcggcgcgaagtgccttgggtcgggccgccgcctcggcccgacacccagtagttggggcacgagccctcctctctgagtaacgcgatgaattgggtctagagatccaagagcatagaaatatcgacagcgccagcaccctaagaacaaggccgtgacaggcggagcggtggcctggaaattggtgtttgcagaatatgcaaggccaaggaagagggccccggtactggagcgaaaatccgtgtagatatgtga

SEQ ID NO: 113603 - DNA, 691 bp, Homo sapiens
  misc_feature 1..691: note = chr17:59531667-59532358
  misc_feature 1..691: note = Hyper
  source 1..691: mol_type = genomic DNA
aaagagaaatgctgtcgtctttggaaaacgaggcagctgaaagcaacagaccccatcgcaaaggcagcggaggttgcgggccgcacccgcggaggagtggatgtgaaggacgagagcggaccgctatgcggtgctgagtgcgggaccccgcggtgctggcggcggccgagcgcgcccaagctcgaggtccgagaggaccgcgaggacggccgccccgggccagccgggcgtggaaaaaaggaaattgctgggaagggggcaagctgtcccgaggtctggatgtggcttcgtggcggagagaaaaggaagaggcaaaccctgagcccgggagggagagcactgagcaggcctcgtccccagtccgagctgcgggaccggcgtcagtggacgcgggcggtgaaccagctcctcacagggcagggctgagcgcgtaggactgagagcgcagggcgcgagccgcagggctccgctgcacggctccgggtgtgacaagagcccagcagaggaccccatggccatgcgggccaagcgcgagacggcccctccttgcgaccccgcaggccgccacatctgggaccagcggatcgcttggtcgctggagccgatcccgccggggccctagatatagttggacccagcgcgctggccggagcgggcagctaccctactggcgcagcggccctgtgtgggg

SEQ ID NO: 113604 - DNA, 1508 bp, Homo sapiens
  misc_feature 1..1508: note = chr17:59533759-59535267
  misc_feature 1..1508: note = Hyper
  source 1..1508: mol_type = genomic DNA
acgaagtcccggaatcggctggagagggccaggggtcctctggcgagtgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcaggtagggctgcgccagccgtcgggtagaagtcgggcgtcggtctgtctgcggggccgcctgtgtccgtctttccgtccgattgtcggcaggactcgctttcaggaggacctggctgcattcaggacggtctgcccgttcgttctccactggacatggctcgctttctctgccttttgggtccttctccactttgagccctcggggctactctgggacaagcaagagctagagctagagatagaggagagggcggtaagagagagggagacccccgtagcatctgagcgagcctggaccaagtgtccagctccaacaacccgtagagggcctgggacccaacggcgagggggcaggaggaggccaccccgccggtgcgcacgggagccgctgcggggatccgaggcctctgggacgtcgccgagggcttcacagtgataatcggacgatcacagcgcacgggatgccgcctggggatctgtgtgcactatctgcaggcgcgcgcctggccgagggtgcgtgcgcctctccctgtctgtgtctgccccgggagcctgtggcgatggcccgccacagaaatgttcatgagtgagcaggagtgtcgtctaacctgcgctggccactatgtgtgtcctctgagggttcctccgtaggtgcagctttaaaggaggaagttttagccaccgattaattcttttatattcacgaatagttcaaaatcgttctgtgaaacgaaatctggagccatgggctccgggcgggcagggttccgcacagctcttcgggtctggttcttctttcctcaggctccgcgtggagccctgggcctggcagacacaagtttctctccctcccatccccagaccatcgagaacatcaaggtggggctgcatgagaaggagctctggaagaagttccacgaggcgggcaccgagatgatcatcactaaggctggcaggtcagcgctgggagatttacttccggggatggcggtggggagcaaggggggccagggaggtcccttagaagtcctctcggccccggcctggtggcctgtgggaggcctctctgcctcctcgggcgtcagtgccacctcccttcgcagcttgggactgggccgccaaagcccgcagggggccaccgcagccgcgcgggccttgcgggaaagaccgaggggaggggcagcgctatgcaaatgaatccaaacagggatcgcgacgctcaaaagtccca

SEQ ID NO: 113605 - DNA, 37 bp, Homo sapiens; identical to SEQ ID NO: 80800
  misc_feature 1..37: note = chr17:59535526-59535563
  misc_feature 1..37: note = Hyper
  source 1..37: mol_type = genomic DNA

SEQ ID NO: 113606 - DNA, 728 bp, Homo sapiens; identical to SEQ ID NO: 80801
  misc_feature 1..728: note = chr17:59539215-59539943
  misc_feature 1..728: note = Hyper
  source 1..728: mol_type = genomic DNA

SEQ ID NO: 113607 - DNA, 30 bp, Homo sapiens; identical to SEQ ID NO: 80804
  misc_feature 1..30: note = chr17:60214776-60214806
  misc_feature 1..30: note = Hypo
  source 1..30: mol_type = genomic DNA

SEQ ID NO: 113608 - DNA, 158 bp, Homo sapiens; identical to SEQ ID NO: 80805
  misc_feature 1..158: note = chr17:60216617-60216775
  misc_feature 1..158: note = Hypo
  source 1..158: mol_type = genomic DNA

SEQ ID NO: 113609 - DNA, 41 bp, Homo sapiens; identical to SEQ ID NO: 45124
  misc_feature 1..41: note = chr17:60221577-60221618
  misc_feature 1..41: note = Hypo
  source 1..41: mol_type = genomic DNA

SEQ ID NO: 113610 - DNA, 30 bp, Homo sapiens; identical to SEQ ID NO: 45125
  misc_feature 1..30: note = chr17:60242060-60242090
  misc_feature 1..30: note = Hypo
  source 1..30: mol_type = genomic DNA

SEQ ID NO: 113611 - DNA, 21 bp, Homo sapiens
  misc_feature 1..21: note = chr17:60499390-60499411
  misc_feature 1..21: note = Hypo
  source 1..21: mol_type = genomic DNA
agactccgtctcaaaaataaa

SEQ ID NO: 113612 - DNA, 32 bp, Homo sapiens; identical to SEQ ID NO: 80810
  misc_feature 1..32: note = chr17:60669597-60669629
  misc_feature 1..32: note = Hypo
  source 1..32: mol_type = genomic DNA

SEQ ID NO: 113613 - DNA, 42 bp, Homo sapiens; identical to SEQ ID NO: 80811
  misc_feature 1..42: note = chr17:60670437-60670479
  misc_feature 1..42: note = Hypo
  source 1..42: mol_type = genomic DNA

SEQ ID NO: 113614 - DNA, 70 bp, Homo sapiens; identical to SEQ ID NO: 80812
  misc_feature 1..70: note = chr17:60704531-60704601
  misc_feature 1..70: note = Hyper
  source 1..70: mol_type = genomic DNA

SEQ ID NO: 113615 - DNA, 30 bp, Homo sapiens; identical to SEQ ID NO: 80813
  misc_feature 1..30: note = chr17:60705143-60705173
  misc_feature 1..30: note = Hyper
  source 1..30: mol_type = genomic DNA

SEQ ID NO: 113616 - DNA, 387 bp, Homo sapiens; identical to SEQ ID NO: 80814
  misc_feature 1..387: note = chr17:60705569-60705956
  misc_feature 1..387: note = Hyper
  source 1..387: mol_type = genomic DNA

SEQ ID NO: 113617 - DNA, 30 bp, Homo sapiens; identical to SEQ ID NO: 80816
  misc_feature 1..30: note = chr17:60739876-60739906
  misc_feature 1..30: note = Hypo
  source 1..30: mol_type = genomic DNA

SEQ ID NO: 113618 - DNA, 84 bp, Homo sapiens; identical to SEQ ID NO: 80817
  misc_feature 1..84: note = chr17:60743917-60744001
  misc_feature 1..84: note = Hypo
  source 1..84: mol_type = genomic DNA

SEQ ID NO: 113619 - DNA, 156 bp, Homo sapiens; identical to SEQ ID NO: 80818
  misc_feature 1..156: note = chr17:60744464-60744620
  misc_feature 1..156: note = Hypo
  source 1..156: mol_type = genomic DNA

SEQ ID NO: 113620 - DNA, 42 bp, Homo sapiens; identical to SEQ ID NO: 80819
  misc_feature 1..42: note = chr17:60747365-60747407
  misc_feature 1..42: note = Hypo
  source 1..42: mol_type = genomic DNA

SEQ ID NO: 113621 - DNA, 30 bp, Homo sapiens; identical to SEQ ID NO: 80820
  misc_feature 1..30: note = chr17:60754622-60754652
  misc_feature 1..30: note = Hypo
  source 1..30: mol_type = genomic DNA

SEQ ID NO: 113622 - DNA, 167 bp, Homo sapiens; identical to SEQ ID NO: 80821
  misc_feature 1..167: note = chr17:60765906-60766073
  misc_feature 1..167: note = Hypo
  source 1..167: mol_type = genomic DNA

SEQ ID NO: 113623 - DNA, 173 bp, Homo sapiens; identical to SEQ ID NO: 80822
  misc_feature 1..173: note = chr17:60766934-60767107
  misc_feature 1..173: note = Hypo
  source 1..173: mol_type = genomic DNA

SEQ ID NO: 113624 - DNA, 91 bp, Homo sapiens; identical to SEQ ID NO: 80823
  misc_feature 1..91: note = chr17:60843863-60843954
  misc_feature 1..91: note = Hypo
  source 1..91: mol_type = genomic DNA

SEQ ID NO: 113625 - DNA, 234 bp, Homo sapiens; identical to SEQ ID NO: 45129
  misc_feature 1..234: note = chr17:60856637-60856871
  misc_feature 1..234: note = Hypo
  source 1..234: mol_type = genomic DNA

SEQ ID NO: 113626 - DNA, 30 bp, Homo sapiens; identical to SEQ ID NO: 80825
  misc_feature 1..30: note = chr17:60869374-60869404
  misc_feature 1..30: note = Hypo
  source 1..30: mol_type = genomic DNA

SEQ ID NO: 113627 - DNA, 100 bp, Homo sapiens
  misc_feature 1..100: note = chr17:60885448-60885548
  misc_feature 1..100: note = Hyper
  source 1..100: mol_type = genomic DNA
cccttcctcccctgccggggctacaggggtcgaggggctgggcgggcgggccggtccagggcgcaggagccgcccattaattgcgcggggacggccctga

SEQ ID NO: 113628 - DNA, 30 bp, Homo sapiens; identical to SEQ ID NO: 80828
  misc_feature 1..30: note = chr17:61151401-61151431
  misc_feature 1..30: note = Hypo
  source 1..30: mol_type = genomic DNA

SEQ ID NO: 113629 - DNA, 107 bp, Homo sapiens; identical to SEQ ID NO: 80830
  misc_feature 1..107: note = chr17:61553987-61554094
  misc_feature 1..107: note = Hyper
  source 1..107: mol_type = genomic DNA

SEQ ID NO: 113630 - DNA, 87 bp, Homo sapiens; identical to SEQ ID NO: 80831
  misc_feature 1..87: note = chr17:61580782-61580869
  misc_feature 1..87: note = Hypo
  source 1..87: mol_type = genomic DNA

SEQ ID NO: 113631 - DNA, 87 bp, Homo sapiens; identical to SEQ ID NO: 80832
  misc_feature 1..87: note = chr17:61580929-61581016
  misc_feature 1..87: note = Hypo
  source 1..87: mol_type = genomic DNA

SEQ ID NO: 113632 - DNA, 30 bp, Homo sapiens; identical to SEQ ID NO: 80833
  misc_feature 1..30: note = chr17:61586953-61586983
  misc_feature 1..30: note = Hypo
  source 1..30: mol_type = genomic DNA

SEQ ID NO: 113633 - DNA, 106 bp, Homo sapiens; identical to SEQ ID NO: 80834
  misc_feature 1..106: note = chr17:61600692-61600798
  misc_feature 1..106: note = Hyper
  source 1..106: mol_type = genomic DNA

SEQ ID NO: 113634 - DNA, 66 bp, Homo sapiens; identical to SEQ ID NO: 45132
  misc_feature 1..66: note = chr17:61607855-61607921
  misc_feature 1..66: note = Hypo
  source 1..66: mol_type = genomic DNA

SEQ ID NO: 113635 - DNA, 30 bp, Homo sapiens; identical to SEQ ID NO: 80836
  misc_feature 1..30: note = chr17:61611741-61611771
  misc_feature 1..30: note = Hypo
  source 1..30: mol_type = genomic DNA

SEQ ID NO: 113636 - DNA, 33 bp, Homo sapiens; identical to SEQ ID NO: 80837
  misc_feature 1..33: note = chr17:61616015-61616048
  misc_feature 1..33: note = Hyper
  source 1..33: mol_type = genomic DNA

SEQ ID NO: 113637 - DNA, 26 bp, Homo sapiens
  misc_feature 1..26: note = chr17:61677513-61677539
  misc_feature 1..26: note = Hypo
  source 1..26: mol_type = genomic DNA
gccaccgcgcccggctgtcctgcttc

SEQ ID NO: 113638 - DNA, 508 bp, Homo sapiens
  misc_feature 1..508: note = chr17:61777872-61778380
  misc_feature 1..508: note = Hyper
  source 1..508: mol_type = genomic DNA
ctcccggcctggctccgggataaccgggcggggcctgggccattcactgcctcggtttcccccggttggcctcgcgcgtaggcgccggcgcccccatccccgcccagagctgtggggccgcagagacccagccggggcgaccccggagcctggcccggggtccctcgggcggccgagtcctcccgccgccaggggccgcccccgcccctttgcggcccacgaggctggcggcggcgtccgggcacgcggtctccaggcccggccgcgaggctgcggggaggagcctgcacgagggcccggcagccccggcagcccccccagccctcggcgcctctgcaaccctgcgacgggctggggaggccggtatgcgtggttcccggagcacccgtcccccgaggctccacgtactcaagcgtttctggggcggaattctgtgggcagcaacgggggccccctctccaacaagcgcacctcatttctcacgtgggagccgcggcccagagagctg

SEQ ID NO: 113639 - DNA, 160 bp, Homo sapiens; identical to SEQ ID NO: 45134
  misc_feature 1..160: note = chr17:61817857-61818017
  misc_feature 1..160: note = Hypo
  source 1..160: mol_type = genomic DNA

SEQ ID NO: 113640 - DNA, 89 bp, Homo sapiens; identical to SEQ ID NO: 80843
  misc_feature 1..89: note = chr17:61847615-61847704
  misc_feature 1..89: note = Hypo
  source 1..89: mol_type = genomic DNA

SEQ ID NO: 113641 - DNA, 573 bp, Homo sapiens
  misc_feature 1..573: note = chr17:61926136-61926709
  misc_feature 1..573: note = Hyper
  source 1..573: mol_type = genomic DNA
tttcaaaacaaaaaaacaagactttttgcaaattatccattgtcaaaactccgccaaatacatctcccagcccgccagggagcagccagcagaggccgcaagctcggccaagcgagccgggatgtccaaggcgggaacgtggcttcgcgcgcaactctctgagacgcgggccggctcacgtgtccgggccgcaccacgaaaacaacagccacaggggagaacaacctcttgttttcctcatacagccgagctttgctgcaaacgatccctttccttttgtttccacattgcgttattcagaagtggttatgcggcgccaaacacgcgctttctgccccacaggtttcagccttccccaccctcatcttccccgcgctcccctcccgtcgttgtagcttcctgctcgcccctctcatctcagccaaccctgctgagctttcgcgtgggcgtcacgagtttctaggcagatcaggaaaaccgctctccggccgcaccctcgcgcgcccccgcctggcggtgtagaacaaacggtctgagcgcttggcgggcgactgagagcggagcgggcgaggc

SEQ ID NO: 113642 - DNA, 73 bp, Homo sapiens; identical to SEQ ID NO: 80846
  misc_feature 1..73: note = chr17:62020120-62020193
  misc_feature 1..73: note = Hypo
  source 1..73: mol_type = genomic DNA

SEQ ID NO: 113643 - DNA, 30 bp, Homo sapiens; identical to SEQ ID NO: 80847
  misc_feature 1..30: note = chr17:62022052-62022082
  misc_feature 1..30: note = Hypo
  source 1..30: mol_type = genomic DNA

SEQ ID NO: 113644 - DNA, 144 bp, Homo sapiens; identical to SEQ ID NO: 80848
  misc_feature 1..144: note = chr17:62029028-62029172
  misc_feature 1..144: note = Hypo
  source 1..144: mol_type = genomic DNA

SEQ ID NO: 113645 - DNA, 30 bp, Homo sapiens; identical to SEQ ID NO: 80849
  misc_feature 1..30: note = chr17:62032715-62032745
  misc_feature 1..30: note = Hypo
  source 1..30: mol_type = genomic DNA

SEQ ID NO: 113646 - DNA, 23 bp, Homo sapiens
  misc_feature 1..23: note = chr17:62054825-62054848
  misc_feature 1..23: note = Hypo
  source 1..23: mol_type = genomic DNA
agcaagaccgtgtctctaaaaat

SEQ ID NO: 113647 - DNA, 48 bp, Homo sapiens; identical to SEQ ID NO: 80851
  misc_feature 1..48: note = chr17:62066209-62066257
  misc_feature 1..48: note = Hypo
  source 1..48: mol_type = genomic DNA

SEQ ID NO: 113648 - DNA, 92 bp, Homo sapiens; identical to SEQ ID NO: 80852
  misc_feature 1..92: note = chr17:62221901-62221993
  misc_feature 1..92: note = Hypo
  source 1..92: mol_type = genomic DNA

SEQ ID NO: 113649 - DNA, 30 bp, Homo sapiens; identical to SEQ ID NO: 80853
  misc_feature 1..30: note = chr17:62773492-62773522
  misc_feature 1..30: note = Hyper
  source 1..30: mol_type = genomic DNA

SEQ ID NO: 113650 - DNA, 54 bp, Homo sapiens; identical to SEQ ID NO: 36710
  misc_feature 1..54: note = chr17:62776217-62776271
  misc_feature 1..54: note = Hyper
  source 1..54: mol_type = genomic DNA

SEQ ID NO: 113651 - DNA, 1364 bp, Homo sapiens; identical to SEQ ID NO: 80855
  misc_feature 1..1364: note = chr17:62776506-62777870
  misc_feature 1..1364: note = Hyper
  source 1..1364: mol_type = genomic DNA

SEQ ID NO: 113652 - DNA, 30 bp, Homo sapiens; identical to SEQ ID NO: 80856
  misc_feature 1..30: note = chr17:62782754-62782784
  misc_feature 1..30: note = Hypo
  source 1..30: mol_type = genomic DNA

SEQ ID NO: 113653 - DNA, 30 bp, Homo sapiens; identical to SEQ ID NO: 80857
  misc_feature 1..30: note = chr17:62831104-62831134
  misc_feature 1..30: note = Hypo
  source 1..30: mol_type = genomic DNA

SEQ ID NO: 113654 - DNA, 42 bp, Homo sapiens; identical to SEQ ID NO: 80860
  misc_feature 1..42: note = chr17:63063928-63063970
  misc_feature 1..42: note = Hypo
  source 1..42: mol_type = genomic DNA

SEQ ID NO: 113655 - DNA, 38 bp, Homo sapiens; identical to SEQ ID NO: 80861
  misc_feature 1..38: note = chr17:63152807-63152845
  misc_feature 1..38: note = Hypo
  source 1..38: mol_type = genomic DNA

SEQ ID NO: 113656 - DNA, 131 bp, Homo sapiens; identical to SEQ ID NO: 80863
  misc_feature 1..131: note = chr17:63533315-63533446
  misc_feature 1..131: note = Hypo
  source 1..131: mol_type = genomic DNA

SEQ ID NO: 113657 - DNA, 30 bp, Homo sapiens; identical to SEQ ID NO: 80864
  misc_feature 1..30: note = chr17:63973353-63973383
  misc_feature 1..30: note = Hypo
  source 1..30: mol_type = genomic DNA

SEQ ID NO: 113658 - DNA, 27 bp, Homo sapiens
  misc_feature 1..27: note = chr17:64197672-64197699
  misc_feature 1..27: note = Hypo
  source 1..27: mol_type = genomic DNA
aaaatagaggatgggcggggcgcagtg

SEQ ID NO: 113659 - DNA, 30 bp, Homo sapiens; identical to SEQ ID NO: 80866
  misc_feature 1..30: note = chr17:64412556-64412586
  misc_feature 1..30: note = Hypo
  source 1..30: mol_type = genomic DNA

SEQ ID NO: 113660 - DNA, 32 bp, Homo sapiens; identical to SEQ ID NO: 80869
  misc_feature 1..32: note = chr17:64671946-64671978
  misc_feature 1..32: note = Hypo
  source 1..32: mol_type = genomic DNA

SEQ ID NO: 113661 - DNA, 272 bp, Homo sapiens; identical to SEQ ID NO: 80870
  misc_feature 1..272: note = chr17:64672325-64672597
  misc_feature 1..272: note = Hypo
  source 1..272: mol_type = genomic DNA

SEQ ID NO: 113662 - DNA, 30 bp, Homo sapiens; identical to SEQ ID NO: 80871
  misc_feature 1..30: note = chr17:64751173-64751203
  misc_feature 1..30: note = Hypo
  source 1..30: mol_type = genomic DNA

SEQ ID NO: 113663 - DNA, 289 bp, Homo sapiens; identical to SEQ ID NO: 80872
  misc_feature 1..289: note = chr17:64825601-64825890
  misc_feature 1..289: note = Hyper
  source 1..289: mol_type = genomic DNA

SEQ ID NO: 113664 - DNA, 467 bp, Homo sapiens; identical to SEQ ID NO: 80873
  misc_feature 1..467: note = chr17:64831006-64831473
  misc_feature 1..467: note = Hyper
  source 1..467: mol_type = genomic DNA

SEQ ID NO: 113665 - DNA, 561 bp, Homo sapiens; identical to SEQ ID NO: 80874
  misc_feature 1..561: note = chr17:64960744-64961305
  misc_feature 1..561: note = Hyper
  source 1..561: mol_type = genomic DNA

SEQ ID NO: 113666 - DNA, 260 bp, Homo sapiens; identical to SEQ ID NO: 80875
  misc_feature 1..260: note = chr17:64961365-64961625
  misc_feature 1..260: note = Hyper
  source 1..260: mol_type = genomic DNA

SEQ ID NO: 113667 - DNA, 314 bp, Homo sapiens; identical to SEQ ID NO: 80876
  misc_feature 1..314: note = chr17:64961827-64962141
  misc_feature 1..314: note = Hyper
  source 1..314: mol_type = genomic DNA

SEQ ID NO: 113668 - DNA, 59 bp, Homo sapiens; identical to SEQ ID NO: 80877
  misc_feature 1..59: note = chr17:65021078-65021137
  misc_feature 1..59: note = Hypo
  source 1..59: mol_type = genomic DNA

SEQ ID NO: 113669 - DNA, 61 bp, Homo sapiens; identical to SEQ ID NO: 80878
  misc_feature 1..61: note = chr17:65254229-65254290
  misc_feature 1..61: note = Hyper
  source 1..61: mol_type = genomic DNA

SEQ ID NO: 113670 - DNA, 30 bp, Homo sapiens; identical to SEQ ID NO: 45139
  misc_feature 1..30: note = chr17:65298508-65298538
  misc_feature 1..30: note = Hypo
  source 1..30: mol_type = genomic DNA

SEQ ID NO: 113671 - DNA, 90 bp, Homo sapiens; identical to SEQ ID NO: 80880
  misc_feature 1..90: note = chr17:65363297-65363387
  misc_feature 1..90: note = Hypo
  source 1..90: mol_type = genomic DNA

SEQ ID NO: 113672 - DNA, 30 bp, Homo sapiens; identical to SEQ ID NO: 80881
  misc_feature 1..30: note = chr17:65712223-65712253
  misc_feature 1..30: note = Hypo
  source 1..30: mol_type = genomic DNA

SEQ ID NO: 113673 - DNA, 80 bp, Homo sapiens; identical to SEQ ID NO: 80882
  misc_feature 1..80: note = chr17:65778166-65778246
  misc_feature 1..80: note = Hypo
  source 1..80: mol_type = genomic DNA

SEQ ID NO: 113674 - DNA, 36 bp, Homo sapiens; identical to SEQ ID NO: 80883
  misc_feature 1..36: note = chr17:65789836-65789872
  misc_feature 1..36: note = Hypo
  source 1..36: mol_type = genomic DNA

SEQ ID NO: 113675 - DNA, 39 bp, Homo sapiens; identical to SEQ ID NO: 45141
  misc_feature 1..39: note = chr17:66421027-66421066
  misc_feature 1..39: note = Hypo
  source 1..39: mol_type = genomic DNA

SEQ ID NO: 113676 - DNA, 30 bp, Homo sapiens; identical to SEQ ID NO: 80887
  misc_feature 1..30: note = chr17:66426439-66426469
  misc_feature 1..30: note = Hypo
  source 1..30: mol_type = genomic DNA

SEQ ID NO: 113677 - DNA, 30 bp, Homo sapiens; identical to SEQ ID NO: 80888
  misc_feature 1..30: note = chr17:66430633-66430663
  misc_feature 1..30: note = Hypo
  source 1..30: mol_type = genomic DNA

SEQ ID NO: 113678 - DNA, 96 bp, Homo sapiens; identical to SEQ ID NO: 80889
  misc_feature 1..96: note = chr17:66434324-66434420
  misc_feature 1..96: note = Hyper
  source 1..96: mol_type = genomic DNA

SEQ ID NO: 113679 - DNA, 41 bp, Homo sapiens; identical to SEQ ID NO: 80890
  misc_feature 1..41: note = chr17:66462815-66462856
  misc_feature 1..41: note = Hypo
  source 1..41: mol_type = genomic DNA

SEQ ID NO: 113680 - DNA, 143 bp, Homo sapiens; identical to SEQ ID NO: 80891
  misc_feature 1..143: note = chr17:66506934-66507077
  misc_feature 1..143: note = Hypo
  source 1..143: mol_type = genomic DNA

SEQ ID NO: 113681 - DNA, 1253 bp, Homo sapiens
  misc_feature 1..1253: note = chr17:66596286-66597539
  misc_feature 1..1253: note = Hyper
  source 1..1253: mol_type = genomic DNA
agccgtgggtggagccgctgcagccctgggccgggggcgtcaggaaactcgagactggggcgcggggaggccccggccagagcgcccgctctcccgcgtcccgggcggggtcctcacctgttccagcgggccaccttcctccggtaataccgcagcgcctcctggctggccaggagcgagtcctcggctcccaggagaggcggctcctccgggacgttgtacagcgggtgggcgaagagggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaacttggggaccaggtgcacggagcaccggggctctcggagtcagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatccgaagccggcgctgcccttgcacc

SEQ ID NO: 113682 - DNA, 37 bp, Homo sapiens; identical to SEQ ID NO: 80894
  misc_feature 1..37: note = chr17:66643278-66643315
  misc_feature 1..37: note = Hypo
  source 1..37: mol_type = genomic DNA

SEQ ID NO: 113683 - DNA, 30 bp, Homo sapiens; identical to SEQ ID NO: 80896
  misc_feature 1..30: note = chr17:66834845-66834875
  misc_feature 1..30: note = Hypo
  source 1..30: mol_type = genomic DNA

SEQ ID NO: 113684 - DNA, 42 bp, Homo sapiens; identical to SEQ ID NO: 80897
  misc_feature 1..42: note = chr17:66872604-66872646
  misc_feature 1..42: note = Hypo
  source 1..42: mol_type = genomic DNA

SEQ ID NO: 113685 - DNA, 53 bp, Homo sapiens; identical to SEQ ID NO: 80898
  misc_feature 1..53: note = chr17:66959344-66959397
  misc_feature 1..53: note = Hypo
  source 1..53: mol_type = genomic DNA

SEQ ID NO: 113686 - DNA, 22 bp, Homo sapiens
  misc_feature 1..22: note = chr17:67410388-67410410
  misc_feature 1..22: note = Hypo
  source 1..22: mol_type = genomic DNA
tccctctcgggaaaaaaacaac

SEQ ID NO: 113687 - DNA, 30 bp, Homo sapiens; identical to SEQ ID NO: 80901
  misc_feature 1..30: note = chr17:67410790-67410820
  misc_feature 1..30: note = Hyper
  source 1..30: mol_type = genomic DNA

SEQ ID NO: 113688 - DNA, 30 bp, Homo sapiens; identical to SEQ ID NO: 80902
  misc_feature 1..30: note = chr17:68164507-68164537
  misc_feature 1..30: note = Hyper
  source 1..30: mol_type = genomic DNA

SEQ ID NO: 113689 - DNA, 36 bp, Homo sapiens; identical to SEQ ID NO: 80903
  misc_feature 1..36: note = chr17:68164768-68164804
  misc_feature 1..36: note = Hyper
  source 1..36: mol_type = genomic DNA

SEQ ID NO: 113690 - DNA, 1064 bp, Homo sapiens; identical to SEQ ID NO: 80904
  misc_feature 1..1064: note = chr17:68165132-68166196
  misc_feature 1..1064: note = Hyper
  source 1..1064: mol_type = genomic DNA

SEQ ID NO: 113691 - DNA, 34 bp, Homo sapiens; identical to SEQ ID NO: 80905
  misc_feature 1..34: note = chr17:68268160-68268194
  misc_feature 1..34: note = Hypo
  source 1..34: mol_type = genomic DNA

SEQ ID NO: 113692 - DNA, 167 bp, Homo sapiens; identical to SEQ ID NO: 80914
  misc_feature 1..167: note = chr17:70026568-70026735
  misc_feature 1..167: note = Hyper
  source 1..167: mol_type = genomic DNA

SEQ ID NO: 113693 - DNA, 67 bp, Homo sapiens; identical to SEQ ID NO: 80915
  misc_feature 1..67: note = chr17:70026970-70027037
  misc_feature 1..67: note = Hyper
  source 1..67: mol_type = genomic DNA

SEQ ID NO: 113694 - DNA, 1821 bp, Homo sapiens
  misc_feature 1..1821: note = chr17:70112816-70114637
  misc_feature 1..1821: note = Hyper
  source 1..1821: mol_type = genomic DNA
aaattttccgcagggcgttctagggatgagttgagggaagccgcatgacgcgcggctccccggtgccacagctaaggacagatattttcgcaaaacccagaatgaaaaaagagcacgctccctttgggagcgctgtccctttgggactggggccttccactcccacccctcctttttccctgatcggctccgcagctccacgacaagccagctggtctggtctctgacttgggctccggtccgtacccccggggcgccctgctgtgttacagccgcccgacgcccccagacccggccaggtcaccagggcagattggaggttcgcgccccctcacccgacacctcccgtccacctcatctttctttttttcgaaaacaggaaagggaagaaaactgaaacgggcctcttggtctgcagttttagcggagtcgggattccacagccctgagtggcacatgccggtcaacttcccaaagtcgggctcccgtgtggggagaaatacacacgcaggaatgcacaagcatcgcgtgttcgcaactgtcgctgggaggtctggcggctgtgatgggacatgcactcactcgggcaacacgtccacaggtgacatctattcgatcagtcaacagatatttattgcgcacctacgacgctatctggtactttccttttccccttagctgttgctgtccagcccagcgccagtccagagacgggcttaccggccgctcccttccacaagaaactcgtgtccggcgtgaagagcggacgataaacactctccaagcccagcgaaatgtactaattacaggagcggctgggagcccgcgacacggggacctgtccctccagggataggagtcttctacctgcaagggacccggcctggggaactggaatagacaaggggtaaccccttctcccatcacctctaatgagaacattgtccggggctgagatatttgggggacgccgctgctcaccccaccaaactttccctagggacagaaaagcgtccctaccgaaaacggatttaaacaccgtccccacttttgctaaggaagtttggatagggaggttgtggtccttaattcgccaggtaaaaggaaccccatcagctcgcatccctcacccccatcctgagcactgagtgtttgcgagaaactcgccctgcgccagcaactctgggctccggtctcagctcccgcgtagacgcggaggagagattggcggcccccgctggggaaattgagcccggcgccggtccgggacgtgcaagagggggaaagggggagatcccagacctcggtttcccgagggcttccctggggagccactcgcacctctgtgtctccgctcccggcggcagacctcgcggcgcttgctcaagagcgggtatccgaaagcacgtcccgaacacggagaagcgccctccgtctcctgcctcgtgacctgcgccctttccctccctcaccgcatcagatggaggaccctggctcctttcgcccctggcaaaatgctctagccaacactgggtcaacagccttagtttccagatctgtaacctgaacatcaggagcgggttcctttccttctacctgtgtctgaggtcctctggtcggggactgcgcgcgtcttcccaggtcagggaggaggggtcggggcgacctgagaaagacacaacgaagcgaatggagcccctgaatggggaaaggggagtggacaccaggaggcccctgcagaaatgcaggaccgatccactcgcgagctgacaatgccacgcgctagacttggcctgacggtggcaacgcttggcacctggg

SEQ ID NO: 113695 - DNA, 30 bp, Homo sapiens; identical to SEQ ID NO: 36724
  misc_feature 1..30: note = chr17:70115315-70115345
  misc_feature 1..30: note = Hyper
  source 1..30: mol_type = genomic DNA

SEQ ID NO: 113696 - DNA, 76 bp, Homo sapiens; identical to SEQ ID NO: 80920
  misc_feature 1..76: note = chr17:70116259-70116335
  misc_feature 1..76: note = Hyper
  source 1..76: mol_type = genomic DNA

SEQ ID NO: 113697 - DNA, 38 bp, Homo sapiens; identical to SEQ ID NO: 80921
  misc_feature 1..38: note = chr17:70117768-70117806
  misc_feature 1..38: note = Hyper
  source 1..38: mol_type = genomic DNA

SEQ ID NO: 113698 - DNA, 1028 bp, Homo sapiens
  misc_feature 1..1028: note = chr17:70215667-70216695
  misc_feature 1..1028: note = Hyper
  source 1..1028: mol_type = genomic DNA
ccagggcagcagacacgctctcccaaaggggcggacacagacgtcctcacaccgcggcccgaccggccgcacattaatccgggtggatttggccatcttgtgacatagccaatcagttcgagggaggggacggcaggaacgcctctcctttcacgccacaaaaggattttcgtcccttgagagcacaatgaaaaaaaaaaaaaaaaaaagccaatcaaggcgggatcagctgtgggctggtcgctgcagatctgtctctcccagaggggggtgggggcacatattggtccgtgtgggaaacccagagcctcagcttctcacacattgttctcctcctcttcaactgcaccccctccccaccagcccggaccctcccctctcccctccccaaagccgttattgccacaaaagatactttccccattgtgccccggacagctgagaggtccgagttagccatacacagctccgcgtcctctccagggagaaaggggatggaccctgcaagtggagagcgggatgcttatcatacaaaggaattaaacccacttgggctctctcgccatccaggactgtggggggttaaatacggttacattttcattaggtgctaatagcagaagggcagccccgggcagcacggaccagacattgttatgaagaacgtccccgacaagggaaggtcagggcaggtggggtgggaggtggggagagggacatgccagcgtcaaagccgggtccagggaaggggggcatgccatgggcgtattgttggcctgcgagttccgtcaatgggaaaagtcatgtttcctccgaaggaaacaagtggaaattgtcggggaggggaagggctggtgggtggctgggaagcagagctcggccagttgctactaaggctgccttcgaactgtccctccccactgccagtttctgcaaatgggcaagtctggtccttctggaaggcagttctggggaggggcagtggaagggaacgttttaatatcaggaagaaccgatgtaaatcctag

SEQ ID NO: 113699 - DNA, 33 bp, Homo sapiens; identical to SEQ ID NO: 80925
  misc_feature 1..33: note = chr17:70585967-70586000
  misc_feature 1..33: note = Hypo
  source 1..33: mol_type = genomic DNA

SEQ ID NO: 113700 - DNA, 121 bp, Homo sapiens; identical to SEQ ID NO: 80926
  misc_feature 1..121: note = chr17:70588010-70588131
  misc_feature 1..121: note = Hyper
  source 1..121: mol_type = genomic DNA

SEQ ID NO: 113701 - DNA, 189 bp, Homo sapiens; identical to SEQ ID NO: 80927
  misc_feature 1..189: note = chr17:70588893-70589082
  misc_feature 1..189: note = Hyper
  source 1..189: mol_type = genomic DNA

SEQ ID NO: 113702 - DNA, 38 bp, Homo sapiens; identical to SEQ ID NO: 16227
  misc_feature 1..38: note = chr17:70657503-70657541
  misc_feature 1..38: note = Hypo
  source 1..38: mol_type = genomic DNA

SEQ ID NO: 113703 - DNA, 30 bp, Homo sapiens; identical to SEQ ID NO: 16228
  misc_feature 1..30: note = chr17:70712704-70712734
  misc_feature 1..30: note = Hypo
  source 1..30: mol_type = genomic DNA

SEQ ID NO: 113704 - DNA, 146 bp, Homo sapiens; identical to SEQ ID NO: 80933
  misc_feature 1..146: note = chr17:71160732-71160878
  misc_feature 1..146: note = Hyper
  source 1..146: mol_type = genomic DNA

SEQ ID NO: 113705 - DNA, 320 bp, Homo sapiens
  misc_feature 1..320: note = chr17:71161118-71161438
  misc_feature 1..320: note = Hyper
  source 1..320: mol_type = genomic DNA
atgtgccgaggggcccgggctggctgggccagtcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaaggtgaggggtgt

SEQ ID NO: 113706 - DNA, 979 bp, Homo sapiens; identical to SEQ ID NO: 80936
  misc_feature 1..979: note = chr17:71161498-71162477
  misc_feature 1..979: note = Hyper
  source 1..979: mol_type = genomic DNA

SEQ ID NO: 113707 - DNA, 25 bp, Homo sapiens
  misc_feature 1..25: note = chr17:71183402-71183427
  misc_feature 1..25: note = Hypo
  source 1..25: mol_type = genomic DNA
gagccaccgtcgccggccccaagtg

SEQ ID NO: 113708 - DNA, 19 bp, Homo sapiens
  misc_feature 1..19: note = chr17:71190303-71190322
  misc_feature 1..19: note = Hypo
  source 1..19: mol_type = genomic DNA
gggtgcggtggctcacgcc

SEQ ID NO: 113709 - DNA, 30 bp, Homo sapiens; identical to SEQ ID NO: 80939
  misc_feature 1..30: note = chr17:71191269-71191299
  misc_feature 1..30: note = Hypo
  source 1..30: mol_type = genomic DNA

SEQ ID NO: 113710 - DNA, 30 bp, Homo sapiens; identical to SEQ ID NO: 45149
  misc_feature 1..30: note = chr17:71201620-71201650
  misc_feature 1..30: note = Hypo
  source 1..30: mol_type = genomic DNA

SEQ ID NO: 113711 - DNA, 30 bp, Homo sapiens; identical to SEQ ID NO: 45150
  misc_feature 1..30: note = chr17:71202377-71202407
  misc_feature 1..30: note = Hypo
  source 1..30: mol_type = genomic DNA

SEQ ID NO: 113712 - DNA, 36 bp, Homo sapiens; identical to SEQ ID NO: 80942
  misc_feature 1..36: note = chr17:71202740-71202776
  misc_feature 1..36: note = Hypo
  source 1..36: mol_type = genomic DNA

SEQ ID NO: 113713 - DNA, 126 bp, Homo sapiens; identical to SEQ ID NO: 80943
  misc_feature 1..126: note = chr17:71246047-71246173
  misc_feature 1..126: note = Hypo
  source 1..126: mol_type = genomic DNA

SEQ ID NO: 113714 - DNA, 39 bp, Homo sapiens; identical to SEQ ID NO: 80944
  misc_feature 1..39: note = chr17:71283415-71283454
  misc_feature 1..39: note = Hypo
  source 1..39: mol_type = genomic DNA

SEQ ID NO: 113715 - DNA, 30 bp, Homo sapiens; identical to SEQ ID NO: 45151
  misc_feature 1..30: note = chr17:71375377-71375407
  misc_feature 1..30: note = Hypo
  source 1..30: mol_type = genomic DNA

SEQ ID NO: 113716 - DNA, 30 bp, Homo sapiens; identical to SEQ ID NO: 80947
  misc_feature 1..30: note = chr17:71378704-71378734
  misc_feature 1..30: note = Hypo
  source 1..30: mol_type = genomic DNA

SEQ ID NO: 113717 - DNA, 61 bp, Homo sapiens; identical to SEQ ID NO: 80948
  misc_feature 1..61: note = chr17:71391476-71391537
  misc_feature 1..61: note = Hypo
  source 1..61: mol_type = genomic DNA

SEQ ID NO: 113718 - DNA, 30 bp, Homo sapiens; identical to SEQ ID NO: 45153
  misc_feature 1..30: note = chr17:71417363-71417393
  misc_feature 1..30: note = Hypo
  source 1..30: mol_type = genomic DNA

SEQ ID NO: 113719 - DNA, 30 bp, Homo sapiens; identical to SEQ ID NO: 45154
  misc_feature 1..30: note = chr17:71427753-71427783
  misc_feature 1..30: note = Hypo
  source 1..30: mol_type = genomic DNA

SEQ ID NO: 113720 - DNA, 30 bp, Homo sapiens; identical to SEQ ID NO: 80951
  misc_feature 1..30: note = chr17:71439688-71439718
  misc_feature 1..30: note = Hypo
  source 1..30: mol_type = genomic DNA

SEQ ID NO: 113721 - DNA, 30 bp, Homo sapiens; identical to SEQ ID NO: 80952
  misc_feature 1..30: note = chr17:71475104-71475134
  misc_feature 1..30: note = Hypo
  source 1..30: mol_type = genomic DNA

SEQ ID NO: 113722 - DNA, 30 bp, Homo sapiens; identical to SEQ ID NO: 45155
  misc_feature 1..30: note = chr17:71484009-71484039
  misc_feature 1..30: note = Hypo
  source 1..30: mol_type = genomic DNA

SEQ ID NO: 113723 - DNA, 1254 bp, Homo sapiens; identical to SEQ ID NO: 80955
  misc_feature 1..1254: note = chr17:71639013-71640267
  misc_feature 1..1254: note = Hyper
  source 1..1254: mol_type = genomic DNA

SEQ ID NO: 113724 - DNA, 123 bp, Homo sapiens; identical to SEQ ID NO: 80956
  misc_feature 1..123: note = chr17:71640470-71640593
  misc_feature 1..123: note = Hyper
  source 1..123: mol_type = genomic DNA

SEQ ID NO: 113725 - DNA, 301 bp, Homo sapiens; identical to SEQ ID NO: 80957
  misc_feature 1..301: note = chr17:71640832-71641133
  misc_feature 1..301: note = Hyper
  source 1..301: mol_type = genomic DNA

SEQ ID NO: 113726 - DNA, 325 bp, Homo sapiens; identical to SEQ ID NO: 80958
  misc_feature 1..325: note = chr17:71641358-71641683
  misc_feature 1..325: note = Hyper
  source 1..325: mol_type = genomic DNA

SEQ ID NO: 113727 - DNA, 21 bp, Homo sapiens
  misc_feature 1..21: note = chr17:71879558-71879579
  misc_feature 1..21: note = Hypo
  source 1..21: mol_type = genomic DNA
ctccaaaatccgaaacgctcc

SEQ ID NO: 113728 - DNA, 494 bp, Homo sapiens
  misc_feature 1..494: note = chr17:71897979-71898473
  misc_feature 1..494: note = Hyper
  source 1..494: mol_type = genomic DNA
attcgcacctgattacgctgcgcggacacaacagaggcgcccggacccgcagccctgccttcgccgcctttgctgggctgtttgcgcttcgtttccttctcgccgccccatggcgcgctttctctcttctttatttcgccggttctccccgctcctaacctgcttaacaacttacctcgctctcccgcttgctctccccccgccccccatctccactggttcccgagcttctcttcatgtccctaatggcgtggctgcgccagcatttaataaaagctgctgaccgggaaatccgagctaactgaattacttcctcattaaagaggcgggcagattcttgggccccgcgtgcagccaccctcgctgcctccctccccgccccgctccgccctgctggtcccgcctgccgtccgcaattaggcggcagatgcttgccgcccggtggtggcctgggttctgcagggactgagggggctcgtcggcttctctccagg

SEQ ID NO: 113729 - DNA, 990 bp, Homo sapiens; identical to SEQ ID NO: 80963
  misc_feature 1..990: note = chr17:71948390-71949380
  misc_feature 1..990: note = Hyper
  source 1..990: mol_type = genomic DNA

SEQ ID NO: 113730 - DNA, 30 bp, Homo sapiens; identical to SEQ ID NO: 80965
  misc_feature 1..30: note = chr17:72111461-72111491
  misc_feature 1..30: note = Hypo
  source 1..30: mol_type = genomic DNA

SEQ ID NO: 113731 - DNA, 35 bp, Homo sapiens; identical to SEQ ID NO: 80967
  misc_feature 1..35: note = chr17:72203913-72203948
  misc_feature 1..35: note = Hypo
  source 1..35: mol_type = genomic DNA

SEQ ID NO: 113732 - DNA, 30 bp, Homo sapiens; identical to SEQ ID NO: 80968
  misc_feature 1..30: note = chr17:72207414-72207444
  misc_feature 1..30: note = Hypo
  source 1..30: mol_type = genomic DNA

SEQ ID NO: 113733 - DNA, 307 bp, Homo sapiens; identical to SEQ ID NO: 80969
  misc_feature 1..307: note = chr17:72208361-72208668
  misc_feature 1..307: note = Hyper
  source 1..307: mol_type = genomic DNA

SEQ ID NO: 113734 - DNA, 176 bp, Homo sapiens; identical to SEQ ID NO: 80970
  misc_feature 1..176: note = chr17:72209140-72209316
  misc_feature 1..176: note = Hyper
  source 1..176: mol_type = genomic DNA

SEQ ID NO: 113735 - DNA, 44 bp, Homo sapiens; identical to SEQ ID NO: 80971
  misc_feature 1..44: note = chr17:72220254-72220298
  misc_feature 1..44: note = Hypo
  source 1..44: mol_type = genomic DNA

SEQ ID NO: 113736 - DNA, 30 bp, Homo sapiens; identical to SEQ ID NO: 80972
  misc_feature 1..30: note = chr17:72222074-72222104
  misc_feature 1..30: note = Hypo
  source 1..30: mol_type = genomic DNA

SEQ ID NO: 113737 - DNA, 213 bp, Homo sapiens; identical to SEQ ID NO: 80973
  misc_feature 1..213: note = chr17:72233492-72233705
  misc_feature 1..213: note = Hypo
  source 1..213: mol_type = genomic DNA

SEQ ID NO: 113738 - DNA, 30 bp, Homo sapiens; identical to SEQ ID NO: 80974
  misc_feature 1..30: note = chr17:72249016-72249046
  misc_feature 1..30: note = Hypo
  source 1..30: mol_type = genomic DNA

SEQ ID NO: 113739 - DNA, 30 bp, Homo sapiens; identical to SEQ ID NO: 80975
  misc_feature 1..30: note = chr17:72249492-72249522
  misc_feature 1..30: note = Hypo
  source 1..30: mol_type = genomic DNA

SEQ ID NO: 113740 - DNA, 80 bp, Homo sapiens; identical to SEQ ID NO: 80976
  misc_feature 1..80: note = chr17:72269879-72269959
  misc_feature 1..80: note = Hypo
  source 1..80: mol_type = genomic DNA

SEQ ID NO: 113741 - DNA, 351 bp, Homo sapiens; identical to SEQ ID NO: 80977
  misc_feature 1..351: note = chr17:72270174-72270525
  misc_feature 1..351: note = Hyper
  source 1..351: mol_type = genomic DNA

SEQ ID NO: 113742 - DNA, 128 bp, Homo sapiens; identical to SEQ ID NO: 80978
  misc_feature 1..128: note = chr17:72278015-72278143
  misc_feature 1..128: note = Hypo
  source 1..128: mol_type = genomic DNA

SEQ ID NO: 113743 - DNA, 35 bp, Homo sapiens; identical to SEQ ID NO: 80979
  misc_feature 1..35: note = chr17:72287189-72287224
  misc_feature 1..35: note = Hypo
  source 1..35: mol_type = genomic DNA

SEQ ID NO: 113744 - DNA, 36 bp, Homo sapiens; identical to SEQ ID NO: 80980
  misc_feature 1..36: note = chr17:72296926-72296962
  misc_feature 1..36: note = Hypo
  source 1..36: mol_type = genomic DNA

SEQ ID NO: 113745 - DNA, 719 bp, Homo sapiens
  misc_feature 1..719: note = chr17:72321933-72322652
  misc_feature 1..719: note = Hyper
  source 1..719: mol_type = genomic DNA
cacaggcacctgctgcgatgcacgcggcgcccacggaaacccgaggctgccagccgccgccctggagaccccagagacagcggcagatgcgtgtgcttcaaggggcagcgtggctgctggggcgctccctaaagggcagtggcacggggtcgcgccgcgagcagaggggcgcgggtgggcgcgcaggagttagcgaactgacacggaggcgccaggcggacgcacggacgcaccgagggccgcagggccgcacagccgggcacacatcgtcgcgcagcggttcaggctcgggggcctcctcggcggaggcggccaactctcaccctcagcgcggggaggggcgggcgccgggggcggggcggcgccgtccgggccctccccctgccccgcctcgggtcggcgtccttagccgctggcgcgttgttggtttcgggttgtcaggcagcgcgcgaggcggcgggcagctagcagctggcggacgcgacccggaggcggtgggggtgcggctgagccatgcccggtggcgcggcctgagcccctccacctgctgcaatcatgaaggacagcggggactccaaggaccagcaactcatggtgagacccttttagaccctcctccccaccccgctccgtggtctacttcagtcggcctccagcgacagagtcctgtcccctcgccgccaccccactgagaggacaggcaacgaccagggccggga

SEQ ID NO: 113746 - DNA, 36 bp, Homo sapiens; identical to SEQ ID NO: 80984
  misc_feature 1..36: note = chr17:72346588-72346624
  misc_feature 1..36: note = Hypo
  source 1..36: mol_type = genomic DNA

SEQ ID NO: 113747 - DNA, 473 bp, Homo sapiens
  misc_feature 1..473: note = chr17:72352964-72353437
  misc_feature 1..473: note = Hyper
  source 1..473: mol_type = genomic DNA
aggcggccctgctggcgcgcccccaccagcaccgtcttctggaagctcacgcccgccgcgtcgccgccgctgctggccggcgtcaccaccagccgcggtcggccgtcctccgggcgcgcggcgggcagagcagtgcccgcggcgtccgcgtaaacgggccgcaggctgacgggcagccagcgcggcgagaagagcacgttccaggtgacccggcggcccgcgtcgtggccactcgggcccagctgcgtctggaagctggtgctgcggtcgtcgcgggccgggttgttgatgacccacggggcgccccaggcgggcgcgaggtagttgcggggcaggaaggcgctgccgttgacgtcgaagaacttggcgtagtgcagcggcgacgcggcgtggaactggtaggcctgcagcaggaggtcggccaccgcggggccgtggcgcgccagggctgccgagcgcgcctgcagctggaa

SEQ ID NO: 113748 - DNA, 236 bp, Homo sapiens; identical to SEQ ID NO: 80987
  misc_feature 1..236: note = chr17:72356203-72356439
  misc_feature 1..236: note = Hypo
  source 1..236: mol_type = genomic DNA

SEQ ID NO: 113749 - DNA, 67 bp, Homo sapiens; identical to SEQ ID NO: 80988
  misc_feature 1..67: note = chr17:72368063-72368130
  misc_feature 1..67: note = Hypo
  source 1..67: mol_type = genomic DNA

SEQ ID NO: 113750 - DNA, 30 bp, Homo sapiens; identical to SEQ ID NO: 16232
  misc_feature 1..30: note = chr17:72370768-72370798
  misc_feature 1..30: note = Hypo
  source 1..30: mol_type = genomic DNA

SEQ ID NO: 113751 - DNA, 502 bp, Homo sapiens; identical to SEQ ID NO: 80990
  misc_feature 1..502: note = chr17:72427092-72427594
  misc_feature 1..502: note = Hyper
  source 1..502: mol_type = genomic DNA

SEQ ID NO: 113752 - DNA, 59 bp, Homo sapiens; identical to SEQ ID NO: 80991
  misc_feature 1..59: note = chr17:72427813-72427872
  misc_feature 1..59: note = Hyper
  source 1..59: mol_type = genomic DNA

SEQ ID NO: 113753 - DNA, 158 bp, Homo sapiens; identical to SEQ ID NO: 80992
  misc_feature 1..158: note = chr17:72428331-72428489
  misc_feature 1..158: note = Hyper
  source 1..158: mol_type = genomic DNA

SEQ ID NO: 113754 - DNA, 43 bp, Homo sapiens; identical to SEQ ID NO: 80993
  misc_feature 1..43: note = chr17:72428829-72428872
  misc_feature 1..43: note = Hyper
  source 1..43: mol_type = genomic DNA

SEQ ID NO: 113755 - DNA, 30 bp, Homo sapiens; identical to SEQ ID NO: 80995
  misc_feature 1..30: note = chr17:72539052-72539082
  misc_feature 1..30: note = Hypo
  source 1..30: mol_type = genomic DNA

SEQ ID NO: 113756 - DNA, 30 bp, Homo sapiens; identical to SEQ ID NO: 80996
  misc_feature 1..30: note = chr17:72560329-72560359
  misc_feature 1..30: note = Hypo
  source 1..30: mol_type = genomic DNA

SEQ ID NO: 113757 - DNA, 303 bp, Homo sapiens
  misc_feature 1..303: note = chr17:72667283-72667586
  misc_feature 1..303: note = Hyper
  source 1..303: mol_type = genomic DNA
gctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactg

SEQ ID NO: 113758 - DNA, 30 bp, Homo sapiens; identical to SEQ ID NO: 45160
  misc_feature 1..30: note = chr17:72731669-72731699
  misc_feature 1..30: note = Hypo
  source 1..30: mol_type = genomic DNA

SEQ ID NO: 113759 - DNA, 74 bp, Homo sapiens; identical to SEQ ID NO: 80999
  misc_feature 1..74: note = chr17:72733981-72734055
  misc_feature 1..74: note = Hyper
  source 1..74: mol_type = genomic DNA

SEQ ID NO: 113760 - DNA, 30 bp, Homo sapiens; identical to SEQ ID NO: 81000
  misc_feature 1..30: note = chr17:72773643-72773673
  misc_feature 1..30: note = Hypo
  source 1..30: mol_type = genomic DNA

SEQ ID NO: 113761 - DNA, 30 bp, Homo sapiens; identical to SEQ ID NO: 45161
  misc_feature 1..30: note = chr17:72800435-72800465
  misc_feature 1..30: note = Hypo
  source 1..30: mol_type = genomic DNA

SEQ ID NO: 113762 - DNA, 211 bp, Homo sapiens; identical to SEQ ID NO: 81002
  misc_feature 1..211: note = chr17:72838894-72839105
  misc_feature 1..211: note = Hyper
  source 1..211: mol_type = genomic DNA

SEQ ID NO: 113763 - DNA, 74 bp, Homo sapiens; identical to SEQ ID NO: 81003
  misc_feature 1..74: note = chr17:72839514-72839588
  misc_feature 1..74: note = Hyper
  source 1..74: mol_type = genomic DNA

SEQ ID NO: 113764 - DNA, 61 bp, Homo sapiens; identical to SEQ ID NO: 81004
  misc_feature 1..61: note = chr17:72848164-72848225
  misc_feature 1..61: note = Hypo
  source 1..61: mol_type = genomic DNA

SEQ ID NO: 113765 - DNA, 770 bp, Homo sapiens
  misc_feature 1..770: note = chr17:72848502-72849272
  misc_feature 1..770: note = Hyper
  source 1..770: mol_type = genomic DNA
agcaggcgctgcgtgcgcgcgcgcggccctcccgggcccagctccagcgtgaccacgtccagcagccgccaactcacgtggctggcgtcggcgacggcgcgcacgccctccaggaagagcgcgtggcccgggtgcaggctggtgatgacggcgaaggcgctccagtcgtactcttccagcaccttgaacagcacctgcagctgctgctccagggacacgcccagctgcaggaaggcggagcccggctcctgggggcgggcggggcctgagcggggcgggagggccgagcccctcctcccgccccttccccgacctcggcccctccatcagctcccaggcgcccttgcgccggcggatgctccgcattccgggagccctctggcctgcgcctccctcccgccccaatgtggttccccgctgcctagtagcatggtcatgcccggcccccagcccaccacgctggcccgcagacccgcagcatcagcaccactggggagtttgtcagaaatgcagattctcaggtcgcaccccacaccgactggatcggagtcgctgggtatgccgcctggcatctgtattctcacaagctcttcagccgatccttgagcccgctagactgagaagcgctgccccagaccaactgaatctgaattccagaggtgcaaagccaggcgtccgtatttcctaagagcacgatgagggttgagagccaatgtcctgagatcttatgccggggccccaagaggacggggaaacgccaccctggttga

SEQ ID NO: 113766 - DNA, 539 bp, Homo sapiens; identical to SEQ ID NO: 81008
  misc_feature 1..539: note = chr17:72855927-72856466
  misc_feature 1..539: note = Hyper
  source 1..539: mol_type = genomic DNA

SEQ ID NO: 113767 - DNA, 1084 bp, Homo sapiens; identical to SEQ ID NO: 81009
  misc_feature 1..1084: note = chr17:72856941-72858025
  misc_feature 1..1084: note = Hyper
  source 1..1084: mol_type = genomic DNA

SEQ ID NO: 113768 - DNA, 786 bp, Homo sapiens
  misc_feature 1..786: note = chr17:72889307-72890093
  misc_feature 1..786: note = Hyper
  source 1..786: mol_type = genomic DNA
ccagactctcaggttcggggtgtgaccctccatccttgggtgcggggccccgaccacctccgcctccctgccgccgccagtccactccgcaggctgcactcccacggctgctgttgcagaccccgcgccgccacctccgccgcaccccgcccccacccgcagcccggccgggacgccgggtccccgcgttcctcacctgccggcaaggcgaagaggctgagcgcgaggatggcgcagtccacgccgtggcgctcccaccaggagctcgtcctcaccacgtcctgcaccagcacctccagctcccgcagcagcgcctcgcccccacggtgcgcgctccgcgccggttccatgggctccgtaggttccatgggctccgtgggttccatggactctgtgggctcgggcccgacgcgcacggaggactggaggactggggcgtgtgtctgcggtgcaggcgaggcggggcgggccggggcggagtcacgcgccgcctggggacacccgcccccggggtcaaggtgcgagacaccctggctcctctgctgcgggcgctggcgacccaggcccggctcaggcgcgcgaccctggcaggcggcatcagaaccgccgcggagggaggagccaggccgatgagctgagagtggctaggcggggaggcgaccctgcggtgagacccagcccaggtagtagggacggaggcgtcaggggcacggagaccccagtggagacaccccccacccccgccccgccccgagggccttccctgacctccgacctcaaataact

SEQ ID NO: 113769 - DNA, 791 bp, Homo sapiens; identical to SEQ ID NO: 81012
  misc_feature 1..791: note = chr17:72919501-72920292
  misc_feature 1..791: note = Hyper
  source 1..791: mol_type = genomic DNA

SEQ ID NO: 113770 - DNA, 30 bp, Homo sapiens; identical to SEQ ID NO: 36757
  misc_feature 1..30: note = chr17:72920550-72920580
  misc_feature 1..30: note = Hyper
  source 1..30: mol_type = genomic DNA

SEQ ID NO: 113771 - DNA, 278 bp, Homo sapiens; identical to SEQ ID NO: 81014
  misc_feature 1..278: note = chr17:72920796-72921074
  misc_feature 1..278: note = Hyper
  source 1..278: mol_type = genomic DNA

SEQ ID NO: 113772 - DNA, 756 bp, Homo sapiens
  misc_feature 1..756: note = chr17:72931909-72932665
  misc_feature 1..756: note = Hyper
  source 1..756: mol_type = genomic DNA
cccgagcggcggctgcgcagtcccgctgggggagggcgtcgcgggcatcggtctcacctggacggacgatccgctcagcgcccgcagtcggtggttagcccacggcgatgcctctcccggcctcaggtaagcccggagcgccggcggaactttcccagcttgcgcaccccagacactggcacatactacccacccccccaaaaggggggttcacaagtaggggctgcagggattggaacgggaaagcggggtgactgtggagaggtgaactccctttaatctgaggccggcccctccacccgccccgcaacccgcgctccgcgcccctactcctttccgtggacccggggagcacagagggcctcagggcgcgactcctcccggccgggtccacacagcagaaagcgcggaggcctggggtgtgaggttggttggggctgtctggacgcccggtctggggcacgcaggaagcggctgccccggccccgcagtccctaaaatggctcggaaggaaatcccgagggcgcccgcactcagcagcctcctcggagccggccctgcgctgctgggccgggcgccgggcccgacggctccgcggctttcatcgccaatccagccgagacccacaaaccagtccagtgtcccggccctcccttggactggcgtcgcgcccaggggcgtgccagggggcggcagagtactgcttgtcagttccaggtgcccttgccccagccttctgcccgagacccctaaatg

SEQ ID NO: 113773 - DNA, 30 bp, Homo sapiens; identical to SEQ ID NO: 81017
  misc_feature 1..30: note = chr17:72937996-72938026
  misc_feature 1..30: note = Hypo
  source 1..30: mol_type = genomic DNA

SEQ ID NO: 113774 - DNA, 76 bp, Homo sapiens; identical to SEQ ID NO: 81018
  misc_feature 1..76: note = chr17:72950368-72950444
  misc_feature 1..76: note = Hypo
  source 1..76: mol_type = genomic DNA

SEQ ID NO: 113775 - DNA, 30 bp, Homo sapiens; identical to SEQ ID NO: 45162
  misc_feature 1..30: note = chr17:72969610-72969640
  misc_feature 1..30: note = Hypo
  source 1..30: mol_type = genomic DNA

SEQ ID NO: 113776 - DNA, 157 bp, Homo sapiens; identical to SEQ ID NO: 81020
  misc_feature 1..157: note = chr17:72971503-72971660
  misc_feature 1..157: note = Hypo
  source 1..157: mol_type = genomic DNA

SEQ ID NO: 113777 - DNA, 39 bp, Homo sapiens; identical to SEQ ID NO: 81021
  misc_feature 1..39: note = chr17:73031580-73031619
  misc_feature 1..39: note = Hypo
  source 1..39: mol_type = genomic DNA

SEQ ID NO: 113778 - DNA, 353 bp, Homo sapiens
  misc_feature 1..353: note = chr17:73073429-73073782
  misc_feature 1..353: note = Hyper
  source 1..353: mol_type = genomic DNA
cgcagatgctgtgctcgcgcggcctgtccgagggccgccactaggacgggaggtggaggtgtccaactcgtgggtgtgcctgggcgtcacctacccccgcagctccccgctcggcggccgcccgagccgcagcgtggtctacctgctgggccgcaaccccttctcgtggtgcctggagtgggacgacaacgcgcagaccgtgctgcacggcgcctaccaccgcacgctgggcgtggcgctcgactgcgacgccggcggcttgtccttctacggcctggcgggtggcgccagcctcttctaccgcttcctggcagccttcctcgagccgctctaccccgcggtcatggtcagca

SEQ ID NO: 113779 - DNA, 24 bp, Homo sapiens
  misc_feature 1..24: note = chr17:73083439-73083463
  misc_feature 1..24: note = Hypo
  source 1..24: mol_type = genomic DNA
cgagactcccggccaactgagtac

SEQ ID NO: 113780 - DNA, 504 bp, Homo sapiens; identical to SEQ ID NO: 81024
  misc_feature 1..504: note = chr17:73089623-73090127
  misc_feature 1..504: note = Hypo
  source 1..504: mol_type = genomic DNA

SEQ ID NO: 113781 - DNA, 105 bp, Homo sapiens; identical to SEQ ID NO: 45166
  misc_feature 1..105: note = chr17:73091075-73091180
  misc_feature 1..105: note = Hypo
  source 1..105: mol_type = genomic DNA

SEQ ID NO: 113782 - DNA, 30 bp, Homo sapiens; identical to SEQ ID NO: 45167
  misc_feature 1..30: note = chr17:73091437-73091467
  misc_feature 1..30: note = Hypo
  source 1..30: mol_type = genomic DNA

SEQ ID NO: 113783 - DNA, 30 bp, Homo sapiens; identical to SEQ ID NO: 45168
  misc_feature 1..30: note = chr17:73124882-73124912
  misc_feature 1..30: note = Hypo
  source 1..30: mol_type = genomic DNA

SEQ ID NO: 113784 - DNA, 39 bp, Homo sapiens; identical to SEQ ID NO: 81028
  misc_feature 1..39: note = chr17:73128817-73128856
  misc_feature 1..39: note = Hypo
  source 1..39: mol_type = genomic DNA

SEQ ID NO: 113785 - DNA, 120 bp, Homo sapiens; identical to SEQ ID NO: 81029
  misc_feature 1..120: note = chr17:73135899-73136019
  misc_feature 1..120: note = Hypo
  source 1..120: mol_type = genomic DNA

SEQ ID NO: 113786 - DNA, 25 bp, Homo sapiens
  misc_feature 1..25: note = chr17:73138356-73138381
  misc_feature 1..25: note = Hypo
  source 1..25: mol_type = genomic DNA
agaaagcagtagaaccggccgggcc

SEQ ID NO: 113787 - DNA, 35 bp, Homo sapiens; identical to SEQ ID NO: 81031
  misc_feature 1..35: note = chr17:73145732-73145767
  misc_feature 1..35: note = Hypo
  source 1..35: mol_type = genomic DNA

SEQ ID NO: 113788 - DNA, 35 bp, Homo sapiens; identical to SEQ ID NO: 81032
  misc_feature 1..35: note = chr17:73179829-73179864
  misc_feature 1..35: note = Hypo
  source 1..35: mol_type = genomic DNA

SEQ ID NO: 113789 - DNA, 101 bp, Homo sapiens; identical to SEQ ID NO: 81033
  misc_feature 1..101: note = chr17:73236201-73236302
  misc_feature 1..101: note = Hypo
  source 1..101: mol_type = genomic DNA

SEQ ID NO: 113790 - DNA, 123 bp, Homo sapiens; identical to SEQ ID NO: 81035
  misc_feature 1..123: note = chr17:73464698-73464821
  misc_feature 1..123: note = Hypo
  source 1..123: mol_type = genomic DNA

SEQ ID NO: 113791 - DNA, 63 bp, Homo sapiens; identical to SEQ ID NO: 81038
  misc_feature 1..63: note = chr17:73518223-73518286
  misc_feature 1..63: note = Hypo
  source 1..63: mol_type = genomic DNA

SEQ ID NO: 113792 - DNA, 37 bp, Homo sapiens
  misc_feature 1..37: note = chr17:73522412-73522449
  misc_feature 1..37: note = Hyper
  source 1..37: mol_type = genomic DNA
ccgcgggagggacttcggtctccggcctttctccagc

SEQ ID NO: 113793 - DNA, 117 bp, Homo sapiens; identical to SEQ ID NO: 81040
  misc_feature 1..117: note = chr17:73545911-73546028
  misc_feature 1..117: note = Hypo
  source 1..117: mol_type = genomic DNA

SEQ ID NO: 113794 - DNA, 269 bp, Homo sapiens
  misc_feature 1..269: note = chr17:73584682-73584951
  misc_feature 1..269: note = Hyper
  source 1..269: mol_type = genomic DNA
ccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagtccgctggggaccggacctggacggggctctcgggcagctatggcctccaggaccttcgaggacagctcgcgggctcctcgggac

SEQ ID NO: 113795 - DNA, 559 bp, Homo sapiens; identical to SEQ ID NO: 81042
  misc_feature 1..559: note = chr17:73585942-73586501
  misc_feature 1..559: note = Hypo
  source 1..559: mol_type = genomic DNA

SEQ ID NO: 113796 - DNA, 48 bp, Homo sapiens; identical to SEQ ID NO: 45172
  misc_feature 1..48: note = chr17:73592635-73592683
  misc_feature 1..48: note = Hypo
  source 1..48: mol_type = genomic DNA

SEQ ID NO: 113797 - DNA, 79 bp, Homo sapiens; identical to SEQ ID NO: 81044
  misc_feature 1..79: note = chr17:73606380-73606459
  misc_feature 1..79: note = Hypo
  source 1..79: mol_type = genomic DNA

SEQ ID NO: 113798 - DNA, 109 bp, Homo sapiens; identical to SEQ ID NO: 81045
  misc_feature 1..109: note = chr17:73608267-73608376
  misc_feature 1..109: note = Hypo
  source 1..109: mol_type = genomic DNA

SEQ ID NO: 113799 - DNA, 62 bp, Homo sapiens; identical to SEQ ID NO: 81046
  misc_feature 1..62: note = chr17:73613362-73613424
  misc_feature 1..62: note = Hypo
  source 1..62: mol_type = genomic DNA

SEQ ID NO: 113800 - DNA, 658 bp, Homo sapiens; identical to SEQ ID NO: 81047
  misc_feature 1..658: note = chr17:73615929-73616587
  misc_feature 1..658: note = Hypo
  source 1..658: mol_type = genomic DNA

SEQ ID NO: 113801 - DNA, 30 bp, Homo sapiens; identical to SEQ ID NO: 45176
  misc_feature 1..30: note = chr17:73635801-73635831
  misc_feature 1..30: note = Hypo
  source 1..30: mol_type = genomic DNA

SEQ ID NO: 113802 - DNA, 359 bp, Homo sapiens; identical to SEQ ID NO: 81049
  misc_feature 1..359: note = chr17:73636032-73636391
  misc_feature 1..359: note = Hypo
  source 1..359: mol_type = genomic DNA

SEQ ID NO: 113803 - DNA, 37 bp, Homo sapiens; identical to SEQ ID NO: 16241
  misc_feature 1..37: note = chr17:73638388-73638425
  misc_feature 1..37: note = Hypo
  source 1..37: mol_type = genomic DNA

SEQ ID NO: 113804 - DNA, 30 bp, Homo sapiens; identical to SEQ ID NO: 81051
  misc_feature 1..30: note = chr17:73639482-73639512
  misc_feature 1..30: note = Hypo
  source 1..30: mol_type = genomic DNA

SEQ ID NO: 113805 - DNA, 30 bp, Homo sapiens; identical to SEQ ID NO: 81052
  misc_feature 1..30: note = chr17:73641552-73641582
  misc_feature 1..30: note = Hypo
  source 1..30: mol_type = genomic DNA

SEQ ID NO: 113806 - DNA, 259 bp, Homo sapiens; identical to SEQ ID NO: 81054
  misc_feature 1..259: note = chr17:73690259-73690518
  misc_feature 1..259: note = Hypo
  source 1..259: mol_type = genomic DNA

SEQ ID NO: 113807 - DNA, 35 bp, Homo sapiens; identical to SEQ ID NO: 81055
  misc_feature 1..35: note = chr17:73693131-73693166
  misc_feature 1..35: note = Hypo
  source 1..35: mol_type = genomic DNA

SEQ ID NO: 113808 - DNA, 138 bp, Homo sapiens; identical to SEQ ID NO: 81056
  misc_feature 1..138: note = chr17:73719889-73720027
  misc_feature 1..138: note = Hypo
  source 1..138: mol_type = genomic DNA

SEQ ID NO: 113809 - DNA, 30 bp, Homo sapiens; identical to SEQ ID NO: 81057
  misc_feature 1..30: note = chr17:73805937-73805967
  misc_feature 1..30: note = Hypo
  source 1..30: mol_type = genomic DNA

SEQ ID NO: 113810 - DNA, 30 bp, Homo sapiens; identical to SEQ ID NO: 81058
  misc_feature 1..30: note = chr17:73811184-73811214
  misc_feature 1..30: note = Hypo
  source 1..30: mol_type = genomic DNA

SEQ ID NO: 113811 - DNA, 47 bp, Homo sapiens; identical to SEQ ID NO: 81059
  misc_feature 1..47: note = chr17:73879974-73880021
  misc_feature 1..47: note = Hypo
  source 1..47: mol_type = genomic DNA

SEQ ID NO: 113812 - DNA, 30 bp, Homo sapiens; identical to SEQ ID NO: 81060
  misc_feature 1..30: note = chr17:73895697-73895727
  misc_feature 1..30: note = Hypo
  source 1..30: mol_type = genomic DNA

SEQ ID NO: 113813 - DNA, 216 bp, Homo sapiens; identical to SEQ ID NO: 81061
  misc_feature 1..216: note = chr17:73909942-73910158
  misc_feature 1..216: note = Hypo
  source 1..216: mol_type = genomic DNA

SEQ ID NO: 113814 - DNA, 110 bp, Homo sapiens; identical to SEQ ID NO: 81062
  misc_feature 1..110: note = chr17:73913787-73913897
  misc_feature 1..110: note = Hypo
  source 1..110: mol_type = genomic DNA

SEQ ID NO: 113815 - DNA, 30 bp, Homo sapiens; identical to SEQ ID NO: 45180
  misc_feature 1..30: note = chr17:73931814-73931844
  misc_feature 1..30: note = Hypo
  source 1..30: mol_type = genomic DNA

SEQ ID NO: 113816 - DNA, 30 bp, Homo sapiens; identical to SEQ ID NO: 81064
  misc_feature 1..30: note = chr17:73934350-73934380
  misc_feature 1..30: note = Hypo
  source 1..30: mol_type = genomic DNA

SEQ ID NO: 113817 - DNA, 149 bp, Homo sapiens; identical to SEQ ID NO: 81065
  misc_feature 1..149: note = chr17:73993427-73993576
  misc_feature 1..149: note = Hyper
  source 1..149: mol_type = genomic DNA

SEQ ID NO: 113818 - DNA, 69 bp, Homo sapiens; identical to SEQ ID NO: 81066
  misc_feature 1..69: note = chr17:73996851-73996920
  misc_feature 1..69: note = Hypo
  source 1..69: mol_type = genomic DNA

SEQ ID NO: 113819 - DNA, 42 bp, Homo sapiens; identical to SEQ ID NO: 45181
  misc_feature 1..42: note = chr17:74005455-74005497
  misc_feature 1..42: note = Hypo
  source 1..42: mol_type = genomic DNA

SEQ ID NO: 113820 - DNA, 74 bp, Homo sapiens; identical to SEQ ID NO: 81068
  misc_feature 1..74: note = chr17:74028304-74028378
  misc_feature 1..74: note = Hypo
  source 1..74: mol_type = genomic DNA

SEQ ID NO: 113821 - DNA, 154 bp, Homo sapiens; identical to SEQ ID NO: 81069
  misc_feature 1..154: note = chr17:74047840-74047994
  misc_feature 1..154: note = Hypo
  source 1..154: mol_type = genomic DNA

SEQ ID NO: 113822 - DNA, 30 bp, Homo sapiens; identical to SEQ ID NO: 45183
  misc_feature 1..30: note = chr17:74062044-74062074
  misc_feature 1..30: note = Hypo
  source 1..30: mol_type = genomic DNA

SEQ ID NO: 113823 - DNA, 1344 bp, Homo sapiens
  misc_feature 1..1344: note = chr17:74070385-74071729
  misc_feature 1..1344: note = Hyper
  source 1..1344: mol_type = genomic DNA
gactccggggcccctcatccgcctccgccccgcgtttcctccccccgatctcccaggggtcctcttttgagggcaccccagcccctcgacggtcccgggatatcctgcacccctgccaggctgcagggaagcgccgaggcgcgcggagtgcgaggtccgtgctccctgcggcgcggcgcacacgcagggtccggggtcgacccctccaccgctccggcgtctgccggggaagtcagtccgcctggtcagcccagaacccccgactgcgggggctggagctcggaagcaggtacaagcgccactctccgcctgcgccgtggaatgcgcgccgggaccactccgcagcccttcccccagcgccgccggccgctgctggggacaacctcgccctcctgtctcttgctcctcctcctgaccccagcgcacccccatccccgccccagatgaggcaaggctccctccgccttcagcccggcagagtcgcactaggagttgcagcggccgcagccccgggagcttcccgctcgcggagacccagacggctgcaggagcccgggcagcctcggggtcagcggcaccatgaacgtctcgggctgcccaggggccgggaacgcgagccaggcgggcggcgggggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaaggcagtggaagacaagcgggcgcggaggaggaaaaagaggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttgagttcctaagtaactcgctcagagtcgccagccagggatc

SEQ ID NO: 113824 - DNA, 32 bp, Homo sapiens
  misc_feature 1..32: note = chr17:74072034-74072066
  misc_feature 1..32: note = Hyper
  source 1..32: mol_type = genomic DNA
gcacattcgggagagcgcgggactcaggtgga

SEQ ID NO: 113825 - DNA, 103 bp, Homo sapiens; identical to SEQ ID NO: 36765
  misc_feature 1..103: note = chr17:74072477-74072580
  misc_feature 1..103: note = Hyper
  source 1..103: mol_type = genomic DNA

SEQ ID NO: 113826 - DNA, 620 bp, Homo sapiens
  misc_feature 1..620: note = chr17:74072851-74073471
  misc_feature 1..620: note = Hyper
  source 1..620: mol_type = genomic DNA
gctggccaacctgaccgtgtgccatcccgcgtggagcgcccctcgccgccgcgccatggacatctgcaccttcgtcttcagctacctgcttcctgtgctggttctcggcctgacctacgcgcgcaccttgcgctacctctggcgcgccgtcgacccggtggccgcgggctcgggtgcccggcgcgccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgcgcgggcctgctgggccgtgccccaggccgagcctcgggccgtgtgtgcgctgccgcgcggggcacccacagtggcagcgtgttggagcgcgagtccagcgacctgttgcacatgagcgaggcggcgggggcccttcgtccctgccccggcgcttcccagccatgcatcctcgagccctgtcctggcccgtcctggcagggcc

SEQ ID NO: 113827 - DNA, 30 bp, Homo sapiens; identical to SEQ ID NO: 81076
  misc_feature 1..30: note = chr17:74076403-74076433
  misc_feature 1..30: note = Hyper
  source 1..30: mol_type = genomic DNA

SEQ ID NO: 113828 - DNA, 30 bp, Homo sapiens; identical to SEQ ID NO: 81077
  misc_feature 1..30: note = chr17:74081696-74081726
  misc_feature 1..30: note = Hypo
  source 1..30: mol_type = genomic DNA

SEQ ID NO: 113829 - DNA, 228 bp, Homo sapiens
  misc_feature 1..228: note = chr17:74117868-74118096
  misc_feature 1..228: note = Hyper
  source 1..228: mol_type = genomic DNA
gcatccagagggtcccgggaacgcgacctgggggttggacaggaaaccaggggtcggggcagcctgctgggggcgtctcgtgccccccaccctccattcctctgaaccagtccggaaggggggttcggctggcaagccgcggtggcgtcagcctctggcacccgctgctgcccggcccgtggctccaggcaaccggggacgctgcgggggctgcgctgggcagcgggt

SEQ ID NO: 113830 - DNA, 183 bp, Homo sapiens; identical to SEQ ID NO: 81079
  misc_feature 1..183: note = chr17:74128189-74128372
  misc_feature 1..183: note = Hypo
  source 1..183: mol_type = genomic DNA

SEQ ID NO: 113831 - DNA, 466 bp, Homo sapiens
  misc_feature 1..466: note = chr17:74136280-74136746
  misc_feature 1..466: note = Hyper
  source 1..466: mol_type = genomic DNA
gcacctggtggtagccgtgggggtcggtgccccccgggggcagggcgggggccttggcgttgagaatggagaattcctgcagccactgcaggctggtcaggctgtcatccagggcgtcgggctcctccaggccgccctccggcccggcctcctccgccggcccggctcccgagaggcgcagccagctctccgccatgtctgcggggactctccgagggggcggtcagcatccacgggctgagccgggggtggcccgccgcgctctctggcccgctgagtcccgcagctcccgttacacggcctcccggacgcgcgcttccatctcgcgaccccgggggcgcctcctccgaataagtatgtggtgcctgcgaggaccacggtgggagctgagcactaccccacccccgaggggacagtgtgtgtacggggacgccctctctaacatcatccccgcagctggggagga

SEQ ID NO: 113832 - DNA, 74 bp, Homo sapiens; identical to SEQ ID NO: 81082
  misc_feature 1..74: note = chr17:74172769-74172843
  misc_feature 1..74: note = Hypo
  source 1..74: mol_type = genomic DNA

SEQ ID NO: 113833 - DNA, 37 bp, Homo sapiens; identical to SEQ ID NO: 81083
  misc_feature 1..37: note = chr17:74187103-74187140
  misc_feature 1..37: note = Hypo
  source 1..37: mol_type = genomic DNA

SEQ ID NO: 113834 - DNA, 74 bp, Homo sapiens; identical to SEQ ID NO: 81085
  misc_feature 1..74: note = chr17:74269861-74269935
  misc_feature 1..74: note = Hypo
  source 1..74: mol_type = genomic DNA

SEQ ID NO: 113835 - DNA, 37 bp, Homo sapiens; identical to SEQ ID NO: 81086
  misc_feature 1..37: note = chr17:74299237-74299274
  misc_feature 1..37: note = Hypo
  source 1..37: mol_type = genomic DNA

SEQ ID NO: 113836 - DNA, 22 bp, Homo sapiens
  misc_feature 1..22: note = chr17:74299969-74299991
  misc_feature 1..22: note = Hypo
  source 1..22: mol_type = genomic DNA
aaaaagtcgccaccagcaaagg

SEQ ID NO: 113837 - DNA, 30 bp, Homo sapiens; identical to SEQ ID NO: 45185
  misc_feature 1..30: note = chr17:74362291-74362321
  misc_feature 1..30: note = Hypo
  source 1..30: mol_type = genomic DNA

SEQ ID NO: 113838 - DNA, 68 bp, Homo sapiens; identical to SEQ ID NO: 81089
  misc_feature 1..68: note = chr17:74378890-74378958
  misc_feature 1..68: note = Hyper
  source 1..68: mol_type = genomic DNA

SEQ ID NO: 113839 - DNA, 96 bp, Homo sapiens; identical to SEQ ID NO: 81090
  misc_feature 1..96: note = chr17:74390363-74390459
  misc_feature 1..96: note = Hypo
  source 1..96: mol_type = genomic DNA

SEQ ID NO: 113840 - DNA, 38 bp, Homo sapiens; identical to SEQ ID NO: 81091
  misc_feature 1..38: note = chr17:74459661-74459699
  misc_feature 1..38: note = Hypo
  source 1..38: mol_type = genomic DNA

SEQ ID NO: 113841 - DNA, 945 bp, Homo sapiens
  misc_feature 1..945: note = chr17:74533488-74534433
  misc_feature 1..945: note = Hyper
  source 1..945: mol_type = genomic DNA
ggatggccacccccacgtcctcgcagttggcatagagccgggcccacatagcctgcaccgccttcctctccgcctcggacagctcctcgctccgctccctgcgctcgatctccatctcgcctggcactttctccatgagcagctccaagcccagcccggctttgctcggcggcggcggtggcggggcgcggggcgcggggcgcggggcgccgggagccggggccggctgcgtgcgcggcgggcgggcgaggggtagagcgcggagggagggagcgtgtgtctgtgcgcgccgggtgtgtgtgtgtgtgtgcgtgcgtgtgtgcagggtatatgtgcggggggcgggggacagccagcggtggggcggggatgtggtctgctggaaaatgtttaaaaaaacaaatccgctccaaacccccagccccgtgtgggtaagagccaatgccggcaaggtgaaggctgcgcggggtgggggcgacgcgactgccgcccgcccacccgcaggccacggcggagttgcaccgcggggcggggctcgggtaggtgtggccggggcgctgggggtcccgggaggaatgggcggtcacgcggcgctgggcggcgcgggccgcacaggagtgcgctggggcgggcgcgggccgggagcgctgggttccgggtcccagtgcttgcggcgtcgcgagtgtgcgcgtgcggacccttcccgcggcggggaactgactcaaagtccaacactcccgagctttcgcggcgaggccgaccgccagcccgcccgtgggggcgaacaggagcccctccggcggccgccgtggacctagctgggctcccctcgcccgggcctctccccgcgcccccgagccagccgctgggggccgcggcgccactcccacggctctggacgcccaggctctggggggttagcacgggggtcgtccccctgcccgc

SEQ ID NO: 113842 - DNA, 658 bp, Homo sapiens; identical to SEQ ID NO: 81096
  misc_feature 1..658: note = chr17:74581043-74581701
  misc_feature 1..658: note = Hyper
  source 1..658: mol_type = genomic DNA

SEQ ID NO: 113843 - DNA, 30 bp, Homo sapiens; identical to SEQ ID NO: 81098
  misc_feature 1..30: note = chr17:74636168-74636198
  misc_feature 1..30: note = Hypo
  source 1..30: mol_type = genomic DNA

SEQ ID NO: 113844 - DNA, 35 bp, Homo sapiens; identical to SEQ ID NO: 81100
  misc_feature 1..35: note = chr17:74823893-74823928
  misc_feature 1..35: note = Hypo
  source 1..35: mol_type = genomic DNA

SEQ ID NO: 113845 - DNA, 43 bp, Homo sapiens; identical to SEQ ID NO: 81101
  misc_feature 1..43: note = chr17:74835961-74836004
  misc_feature 1..43: note = Hyper
  source 1..43: mol_type = genomic DNA

SEQ ID NO: 113846 - DNA, 38 bp, Homo sapiens; identical to SEQ ID NO: 81102
  misc_feature 1..38: note = chr17:74854240-74854278
  misc_feature 1..38: note = Hypo
  source 1..38: mol_type = genomic DNA

SEQ ID NO: 113847 - DNA, 651 bp, Homo sapiens
  misc_feature 1..651: note = chr17:74864643-74865294
  misc_feature 1..651: note = Hyper
  source 1..651: mol_type = genomic DNA
cgcggggctgaggatcggcgcggcccggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggtaaagttccctcctggttggttttttccccaggggggcgccgggtggaggtgggcgaggtcggttcctgcgaacgttcaagtcctggtggcagagggggcggttcacacttcaa

SEQ ID NO: 113848 - DNA, 800 bp, Homo sapiens; identical to SEQ ID NO: 81105
  misc_feature 1..800: note = chr17:74865520-74866320
  misc_feature 1..800: note = Hyper
  source 1..800: mol_type = genomic DNA

SEQ ID NO: 113849 - DNA, 84 bp, Homo sapiens; identical to SEQ ID NO: 81106
  misc_feature 1..84: note = chr17:74908730-74908814
  misc_feature 1..84: note = Hypo
  source 1..84: mol_type = genomic DNA

SEQ ID NO: 113850 - DNA, 52 bp, Homo sapiens; identical to SEQ ID NO: 81108
  misc_feature 1..52: note = chr17:74920557-74920609
  misc_feature 1..52: note = Hypo
  source 1..52: mol_type = genomic DNA

SEQ ID NO: 113851 - DNA, 506 bp, Homo sapiens; identical to SEQ ID NO: 81110
  misc_feature 1..506: note = chr17:74965247-74965753
  misc_feature 1..506: note = Hyper
  source 1..506: mol_type = genomic DNA

SEQ ID NO: 113852 - DNA, 18 bp, Homo sapiens
  misc_feature 1..18: note = chr17:75047191-75047209
  misc_feature 1..18: note = Hypo
  source 1..18: mol_type = genomic DNA
aatcatccgcttggccgg

SEQ ID NO: 113853 - DNA, 291 bp, Homo sapiens; identical to SEQ ID NO: 81112
  misc_feature 1..291: note = chr17:75049728-75050019
  misc_feature 1..291: note = Hypo
  source 1..291: mol_type = genomic DNA

SEQ ID NO: 113854 - DNA, 30 bp, Homo sapiens; identical to SEQ ID NO: 81113
  misc_feature 1..30: note = chr17:75054527-75054557
  misc_feature 1..30: note = Hypo
  source 1..30: mol_type = genomic DNA

SEQ ID NO: 113855 - DNA, 30 bp, Homo sapiens; identical to SEQ ID NO: 45189
  misc_feature 1..30: note = chr17:75207839-75207869
  misc_feature 1..30: note = Hypo
  source 1..30: mol_type = genomic DNA

SEQ ID NO: 113856 - DNA, 30 bp, Homo sapiens; identical to SEQ ID NO: 81115
  misc_feature 1..30: note = chr17:75326544-75326574
  misc_feature 1..30: note = Hypo
  source 1..30: mol_type = genomic DNA

SEQ ID NO: 113857 - DNA, 1195 bp, Homo sapiens
  misc_feature 1..1195: note = chr17:75368715-75369910
  misc_feature 1..1195: note = Hyper
  source 1..1195: mol_type = genomic DNA
gccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttcctt

SEQ ID NO: 113858 - DNA, 204 bp, Homo sapiens
  misc_feature 1..204: note = chr17:75370138-75370342
  misc_feature 1..204: note = Hyper
  source 1..204: mol_type = genomic DNA
ccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagta

SEQ ID NO: 113859 - DNA, 253 bp, Homo sapiens; identical to SEQ ID NO: 81121
  misc_feature 1..253: note = chr17:75370564-75370817
  misc_feature 1..253: note = Hyper
  source 1..253: mol_type = genomic DNA

SEQ ID NO: 113860 - DNA, 30 bp, Homo sapiens; identical to SEQ ID NO: 81122
  misc_feature 1..30: note = chr17:75385196-75385226
  misc_feature 1..30: note = Hyper
  source 1..30: mol_type = genomic DNA

SEQ ID NO: 113861 - DNA, 30 bp, Homo sapiens; identical to SEQ ID NO: 81123
  misc_feature 1..30: note = chr17:75411816-75411846
  misc_feature 1..30: note = Hypo
  source 1..30: mol_type = genomic DNA

SEQ ID NO: 113862 - DNA, 30 bp, Homo sapiens; identical to SEQ ID NO: 81124
  misc_feature 1..30: note = chr17:75413782-75413812
  misc_feature 1..30: note = Hypo
  source 1..30: mol_type = genomic DNA

SEQ ID NO: 113863 - DNA, 265 bp, Homo sapiens; identical to SEQ ID NO: 81125
  misc_feature 1..265: note = chr17:75447462-75447727
  misc_feature 1..265: note = Hyper
  source 1..265: mol_type = genomic DNA

SEQ ID NO: 113864 - DNA, 257 bp, Homo sapiens; identical to SEQ ID NO: 81126
  misc_feature 1..257: note = chr17:75523015-75523272
  misc_feature 1..257: note = Hypo
  source 1..257: mol_type = genomic DNA

SEQ ID NO: 113865 - DNA, 609 bp, Homo sapiens
  misc_feature 1..609: note = chr17:75524585-75525194
  misc_feature 1..609: note = Hyper
  source 1..609: mol_type = genomic DNA
cccccgaccccctctcgtggtcgccagggtaggggtgggaggaatctggaagccacgtgcgatgctcggagctgcgtcctctgtcctggggcgtgggtccgcgagcgccgcgcagcctcccggaccgccctgagctgctgcgcccggcgctgctcctccttccccagctccgcgccttcccctcgcgatccccctcctgcctcttcggtcctggaagcgtcccaagatggggtgggggcatggagggagagaggggaggagggagctgcccgggggcagtgccgccaggaagtgggacggggactctggcgcccctccaggctgctgcgcgcgggctggggaccgtgcaccgctttgcgcgccagacgatgcatcttctggaacggcagctgaggcaatgcggggtgtgaagtggcggcgggcagaggggctcgcaggggctgggatccgcgtgcccctctctgcctcggtgcggagcacgatgtgcccgggcgggggcgaggacgtccgggaggggctgggctgcgcacgctcgcggggccgtcgcagatgggcggtttggaggcgctgcagtccctgggaaatgggagcctccgtcctgttctctct

SEQ ID NO: 113866 - DNA, 102 bp, Homo sapiens; identical to SEQ ID NO: 81129
  misc_feature 1..102: note = chr17:75544144-75544246
  misc_feature 1..102: note = Hypo
  source 1..102: mol_type = genomic DNA

SEQ ID NO: 113867 - DNA, 33 bp, Homo sapiens; identical to SEQ ID NO: 81131
  misc_feature 1..33: note = chr17:75548384-75548417
  misc_feature 1..33: note = Hypo
  source 1..33: mol_type = genomic DNA

SEQ ID NO: 113868 - DNA, 79 bp, Homo sapiens; identical to SEQ ID NO: 81133
  misc_feature 1..79: note = chr17:75557167-75557246
  misc_feature 1..79: note = Hypo
  source 1..79: mol_type = genomic DNA

SEQ ID NO: 113869 - DNA, 30 bp, Homo sapiens; identical to SEQ ID NO: 81134
  misc_feature 1..30: note = chr17:75587520-75587550
  misc_feature 1..30: note = Hypo
  source 1..30: mol_type = genomic DNA

SEQ ID NO: 113870 - DNA, 56 bp, Homo sapiens; identical to SEQ ID NO: 45192
  misc_feature 1..56: note = chr17:75630378-75630434
  misc_feature 1..56: note = Hypo
  source 1..56: mol_type = genomic DNA

SEQ ID NO: 113871 - DNA, 41 bp, Homo sapiens; identical to SEQ ID NO: 45193
  misc_feature 1..41: note = chr17:75733967-75734008
  misc_feature 1..41: note = Hypo
  source 1..41: mol_type = genomic DNA

SEQ ID NO: 113872 - DNA, 30 bp, Homo sapiens; identical to SEQ ID NO: 81137
  misc_feature 1..30: note = chr17:75748192-75748222
  misc_feature 1..30: note = Hypo
  source 1..30: mol_type = genomic DNA

SEQ ID NO: 113873 - DNA, 33 bp, Homo sapiens; identical to SEQ ID NO: 45194
  misc_feature 1..33: note = chr17:75770731-75770764
  misc_feature 1..33: note = Hypo
  source 1..33: mol_type = genomic DNA

SEQ ID NO: 113874 - DNA, 30 bp, Homo sapiens; identical to SEQ ID NO: 81139
  misc_feature 1..30: note = chr17:75792358-75792388
  misc_feature 1..30: note = Hypo
  source 1..30: mol_type = genomic DNA

SEQ ID NO: 113875 - DNA, 30 bp, Homo sapiens; identical to SEQ ID NO: 81140
  misc_feature 1..30: note = chr17:75797195-75797225
  misc_feature 1..30: note = Hypo
  source 1..30: mol_type = genomic DNA

SEQ ID NO: 113876 - DNA, 30 bp, Homo sapiens; identical to SEQ ID NO: 45195
  misc_feature 1..30: note = chr17:75840791-75840821
  misc_feature 1..30: note = Hypo
  source 1..30: mol_type = genomic DNA

SEQ ID NO: 113877 - DNA, 30 bp, Homo sapiens; identical to SEQ ID NO: 81142
  misc_feature 1..30: note = chr17:75849397-75849427
  misc_feature 1..30: note = Hypo
  source 1..30: mol_type = genomic DNA

SEQ ID NO: 113878 - DNA, 91 bp, Homo sapiens; identical to SEQ ID NO: 81143
  misc_feature 1..91: note = chr17:75893341-75893432
  misc_feature 1..91: note = Hypo
  source 1..91: mol_type = genomic DNA

SEQ ID NO: 113879 - DNA, 30 bp, Homo sapiens; identical to SEQ ID NO: 81144
  misc_feature 1..30: note = chr17:75895459-75895489
  misc_feature 1..30: note = Hypo
  source 1..30: mol_type = genomic DNA

SEQ ID NO: 113880 - DNA, 43 bp, Homo sapiens; identical to SEQ ID NO: 45196
  misc_feature 1..43: note = chr17:75905178-75905221
  misc_feature 1..43: note = Hypo
  source 1..43: mol_type = genomic DNA

SEQ ID NO: 113881 - DNA, 30 bp, Homo sapiens; identical to SEQ ID NO: 81146
  misc_feature 1..30: note = chr17:75925908-75925938
  misc_feature 1..30: note = Hypo
  source 1..30: mol_type = genomic DNA

SEQ ID NO: 113882 - DNA, 30 bp, Homo sapiens; identical to SEQ ID NO: 81147
  misc_feature 1..30: note = chr17:75927761-75927791
  misc_feature 1..30: note = Hypo
  source 1..30: mol_type = genomic DNA

SEQ ID NO: 113883 - DNA, 238 bp, Homo sapiens; identical to SEQ ID NO: 81148
  misc_feature 1..238: note = chr17:75953744-75953982
  misc_feature 1..238: note = Hyper
  source 1..238: mol_type = genomic DNA

SEQ ID NO: 113884 - DNA, 57 bp, Homo sapiens; identical to SEQ ID NO: 81149
  misc_feature 1..57: note = chr17:75955156-75955213
  misc_feature 1..57: note = Hyper
  source 1..57: mol_type = genomic DNA

SEQ ID NO: 113885 - DNA, 79 bp, Homo sapiens; identical to SEQ ID NO: 45197
  misc_feature 1..79: note = chr17:76021242-76021321
  misc_feature 1..79: note = Hypo
  source 1..79: mol_type = genomic DNA

SEQ ID NO: 113886 - DNA, 27 bp, Homo sapiens
  misc_feature 1..27: note = chr17:76026881-76026908
  misc_feature 1..27: note = Hypo
  source 1..27: mol_type = genomic DNA
tagaaatgcaaattccggccgggcatg

SEQ ID NO: 113887 - DNA, 30 bp, Homo sapiens; identical to SEQ ID NO: 81152
  misc_feature 1..30: note = chr17:76034067-76034097
  misc_feature 1..30: note = Hypo
  source 1..30: mol_type = genomic DNA

SEQ ID NO: 113888 - DNA, 30 bp, Homo sapiens; identical to SEQ ID NO: 81153
  misc_feature 1..30: note = chr17:76073363-76073393
  misc_feature 1..30: note = Hypo
  source 1..30: mol_type = genomic DNA

SEQ ID NO: 113889 - DNA, 205 bp, Homo sapiens; identical to SEQ ID NO: 81156
  misc_feature 1..205: note = chr17:76098484-76098689
  misc_feature 1..205: note = Hypo
  source 1..205: mol_type = genomic DNA

SEQ ID NO: 113890 - DNA, 91 bp, Homo sapiens; identical to SEQ ID NO: 81157
  misc_feature 1..91: note = chr17:76101037-76101128
  misc_feature 1..91: note = Hypo
  source 1..91: mol_type = genomic DNA

SEQ ID NO: 113891 - DNA, 34 bp, Homo sapiens; identical to SEQ ID NO: 81158
  misc_feature 1..34: note = chr17:76123797-76123831
  misc_feature 1..34: note = Hyper
  source 1..34: mol_type = genomic DNA

SEQ ID NO: 113892 - DNA, 29 bp, Homo sapiens
  misc_feature 1..29: note = chr17:76125196-76125225
  misc_feature 1..29: note = Hyper
  source 1..29: mol_type = genomic DNA
gcccccccccccgccgcccccgcaagcct

SEQ ID NO: 113893 - DNA, 30 bp, Homo sapiens; identical to SEQ ID NO: 81159
  misc_feature 1..30: note = chr17:76131445-76131475
  misc_feature 1..30: note = Hypo
  source 1..30: mol_type = genomic DNA

SEQ ID NO: 113894 - DNA, 92 bp, Homo sapiens; identical to SEQ ID NO: 45199
  misc_feature 1..92: note = chr17:76134317-76134409
  misc_feature 1..92: note = Hypo
  source 1..92: mol_type = genomic DNA

SEQ ID NO: 113895 - DNA, 122 bp, Homo sapiens; identical to SEQ ID NO: 81161
  misc_feature 1..122: note = chr17:76134633-76134755
  misc_feature 1..122: note = Hypo
  source 1..122: mol_type = genomic DNA

SEQ ID NO: 113896 - DNA, 87 bp, Homo sapiens; identical to SEQ ID NO: 81162
  misc_feature 1..87: note = chr17:76135474-76135561
  misc_feature 1..87: note = Hypo
  source 1..87: mol_type = genomic DNA

SEQ ID NO: 113897 - DNA, 87 bp, Homo sapiens; identical to SEQ ID NO: 81163
  misc_feature 1..87: note = chr17:76136101-76136188
  misc_feature 1..87: note = Hypo
  source 1..87: mol_type = genomic DNA

SEQ ID NO: 113898 - DNA, 333 bp, Homo sapiens; identical to SEQ ID NO: 81164
  misc_feature 1..333: note = chr17:76137857-76138190
  misc_feature 1..333: note = Hypo
  source 1..333: mol_type = genomic DNA

SEQ ID NO: 113899 - DNA, 120 bp, Homo sapiens; identical to SEQ ID NO: 81165
  misc_feature 1..120: note = chr17:76138614-76138734
  misc_feature 1..120: note = Hypo
  source 1..120: mol_type = genomic DNA

SEQ ID NO: 113900 - DNA, 19 bp, Homo sapiens
  misc_feature 1..19: note = chr17:76146895-76146914
  misc_feature 1..19: note = Hypo
  source 1..19: mol_type = genomic DNA
agcctacactccaaacggc

SEQ ID NO: 113901 - DNA, 39 bp, Homo sapiens; identical to SEQ ID NO: 81167
  misc_feature 1..39: note = chr17:76211240-76211279
  misc_feature 1..39: note = Hypo
  source 1..39: mol_type = genomic DNA

SEQ ID NO: 113902 - DNA, 99 bp, Homo sapiens; identical to SEQ ID NO: 81168
  misc_feature 1..99: note = chr17:76211519-76211618
  misc_feature 1..99: note = Hypo
  source 1..99: mol_type = genomic DNA

SEQ ID NO: 113903 - DNA, 89 bp, Homo sapiens; identical to SEQ ID NO: 81169
  misc_feature 1..89: note = chr17:76211992-76212081
  misc_feature 1..89: note = Hypo
  source 1..89: mol_type = genomic DNA

SEQ ID NO: 113904 - DNA, 55 bp, Homo sapiens; identical to SEQ ID NO: 81171
  misc_feature 1..55: note = chr17:76217079-76217134
  misc_feature 1..55: note = Hypo
  source 1..55: mol_type = genomic DNA

SEQ ID NO: 113905 - DNA, 625 bp, Homo sapiens
  misc_feature 1..625: note = chr17:76227749-76228374
  misc_feature 1..625: note = Hyper
  source 1..625: mol_type = genomic DNA
tggctgctgaggagccgggggttcagggaaattaaggaacgtgcccagggacccggggccagcccgtggggacgctgggattggagcccaagccccaggttcgccgcgcggctctcgacttcctctcctttcccccaggggcgagctcagcgaccgcagagaggtggggtcgatctccctgcgaccccagggggcccgcgaggccagtgcgcgggcaggagcggggacgtgctcagaagagccgggcgccgccgcgcccgcccgccccccgtcccccggctcccggctccgcgcgccccccgccgcccccggggccctgctacccccgacccgtcccctcccgccggccgcccccatggcccggctgggcgcgctgctcctggccgccgccctgggtgcactgctcagcttcgcgctcctggccgccgcggtcgccagcgactactggtacatcctggaggtggcggacgccggcaatggcagcgcctggcccgggcgcgcagagctgctctcctcgcactcggggctctggcgcatctgcgaaggtaaccggccaccgcgccggccctcctccctccgcgacctcgtccctccgacacccccttaaccccgccctgctcgtgtt

SEQ ID NO: 113906 - DNA, 71 bp, Homo sapiens
  misc_feature 1..71: note = chr17:76254783-76254854
  misc_feature 1..71: note = Hyper
  source 1..71: mol_type = genomic DNA
gctgagttcagtgtgcggattcctgtaacgctgggctgctggcaggaagtgcgcgccggggaggctgctgc

SEQ ID NO: 113907 - DNA, 125 bp, Homo sapiens; identical to SEQ ID NO: 45208
  misc_feature 1..125: note = chr17:76395588-76395713
  misc_feature 1..125: note = Hypo
  source 1..125: mol_type = genomic DNA

SEQ ID NO: 113908 - DNA, 66 bp, Homo sapiens; identical to SEQ ID NO: 81176
  misc_feature 1..66: note = chr17:76396807-76396873
  misc_feature 1..66: note = Hypo
  source 1..66: mol_type = genomic DNA

SEQ ID NO: 113909 - DNA, 44 bp, Homo sapiens; identical to SEQ ID NO: 45209
  misc_feature 1..44: note = chr17:76404759-76404803
  misc_feature 1..44: note = Hypo
  source 1..44: mol_type = genomic DNA

SEQ ID NO: 113910 - DNA, 35 bp, Homo sapiens; identical to SEQ ID NO: 81178
  misc_feature 1..35: note = chr17:76405095-76405130
  misc_feature 1..35: note = Hypo
  source 1..35: mol_type = genomic DNA

SEQ ID NO: 113911 - DNA, 114 bp, Homo sapiens; identical to SEQ ID NO: 81179
  misc_feature 1..114: note = chr17:76419325-76419439
  misc_feature 1..114: note = Hypo
  source 1..114: mol_type = genomic DNA

SEQ ID NO: 113912 - DNA, 23 bp, Homo sapiens
  misc_feature 1..23: note = chr17:76441957-76441980
  misc_feature 1..23: note = Hypo
  source 1..23: mol_type = genomic DNA
attgaccattttggccgggcaca

SEQ ID NO: 113913 - DNA, 165 bp, Homo sapiens; identical to SEQ ID NO: 81181
  misc_feature 1..165: note = chr17:76455024-76455189
  misc_feature 1..165: note = Hypo
  source 1..165: mol_type = genomic DNA

SEQ ID NO: 113914 - DNA, 30 bp, Homo sapiens; identical to SEQ ID NO: 81182
  misc_feature 1..30: note = chr17:76458828-76458858
  misc_feature 1..30: note = Hypo
  source 1..30: mol_type = genomic DNA

SEQ ID NO: 113915 - DNA, 94 bp, Homo sapiens; identical to SEQ ID NO: 81183
  misc_feature 1..94: note = chr17:76490678-76490772
  misc_feature 1..94: note = Hypo
  source 1..94: mol_type = genomic DNA

SEQ ID NO: 113916 - DNA, 83 bp, Homo sapiens; identical to SEQ ID NO: 81184
  misc_feature 1..83: note = chr17:76498516-76498599
  misc_feature 1..83: note = Hypo
  source 1..83: mol_type = genomic DNA

SEQ ID NO: 113917 - DNA, 71 bp, Homo sapiens; identical to SEQ ID NO: 81185
  misc_feature 1..71: note = chr17:76498901-76498972
  misc_feature 1..71: note = Hypo
  source 1..71: mol_type = genomic DNA

SEQ ID NO: 113918 - DNA, 329 bp, Homo sapiens; identical to SEQ ID NO: 81186
  misc_feature 1..329: note = chr17:76501454-76501783
  misc_feature 1..329: note = Hypo
  source 1..329: mol_type = genomic DNA

SEQ ID NO: 113919 - DNA, 66 bp, Homo sapiens; identical to SEQ ID NO: 81187
  misc_feature 1..66: note = chr17:76526194-76526260
  misc_feature 1..66: note = Hypo
  source 1..66: mol_type = genomic DNA

SEQ ID NO: 113920 - DNA, 63 bp, Homo sapiens; identical to SEQ ID NO: 81188
  misc_feature 1..63: note = chr17:76526566-76526629
  misc_feature 1..63: note = Hypo
  source 1..63: mol_type = genomic DNA

SEQ ID NO: 113921 - DNA, 86 bp, Homo sapiens; identical to SEQ ID NO: 81189
  misc_feature 1..86: note = chr17:76557425-76557511
  misc_feature 1..86: note = Hypo
  source 1..86: mol_type = genomic DNA

SEQ ID NO: 113922 - DNA, 30 bp, Homo sapiens; identical to SEQ ID NO: 81190
  misc_feature 1..30: note = chr17:76562886-76562916
  misc_feature 1..30: note = Hypo
  source 1..30: mol_type = genomic DNA

SEQ ID NO: 113923 - DNA, 109 bp, Homo sapiens; identical to SEQ ID NO: 81191
  misc_feature 1..109: note = chr17:76670709-76670818
  misc_feature 1..109: note = Hypo
  source 1..109: mol_type = genomic DNA

SEQ ID NO: 113924 - DNA, 172 bp, Homo sapiens; identical to SEQ ID NO: 81192
  misc_feature 1..172: note = chr17:76676165-76676337
  misc_feature 1..172: note = Hypo
  source 1..172: mol_type = genomic DNA

SEQ ID NO: 113925 - DNA, 30 bp, Homo sapiens; identical to SEQ ID NO: 81193
  misc_feature 1..30: note = chr17:76702385-76702415
  misc_feature 1..30: note = Hypo
  source 1..30: mol_type = genomic DNA

SEQ ID NO: 113926 - DNA, 21 bp, Homo sapiens
  misc_feature 1..21: note = chr17:76779848-76779869
  misc_feature 1..21: note = Hypo
  source 1..21: mol_type = genomic DNA
ccaccacgcctggctggattc

SEQ ID NO: 113927 - DNA, 185 bp, Homo sapiens; identical to SEQ ID NO: 81195
  misc_feature 1..185: note = chr17:76897086-76897271
  misc_feature 1..185: note = Hypo
  source 1..185: mol_type = genomic DNA

SEQ ID NO: 113928 - DNA, 30 bp, Homo sapiens
  misc_feature 1..30: note = chr17:76921829-76921859
  misc_feature 1..30: note = Hyper
  source 1..30: mol_type = genomic DNA
gactctggagggctacgctgctccgtcccc

SEQ ID NO: 113929 - DNA, 30 bp, Homo sapiens; identical to SEQ ID NO: 81196
  misc_feature 1..30: note = chr17:76932264-76932294
  misc_feature 1..30: note = Hypo
  source 1..30: mol_type = genomic DNA

SEQ ID NO: 113930 - DNA, 33 bp, Homo sapiens; identical to SEQ ID NO: 45218
  misc_feature 1..33: note = chr17:76958740-76958773
  misc_feature 1..33: note = Hypo
  source 1..33: mol_type = genomic DNA

SEQ ID NO: 113931 - DNA, 36 bp, Homo sapiens; identical to SEQ ID NO: 81198
  misc_feature 1..36: note = chr17:76967407-76967443
  misc_feature 1..36: note = Hyper
  source 1..36: mol_type = genomic DNA

SEQ ID NO: 113932 - DNA, 30 bp, Homo sapiens; identical to SEQ ID NO: 81199
  misc_feature 1..30: note = chr17:76970826-76970856
  misc_feature 1..30: note = Hypo
  source 1..30: mol_type = genomic DNA

SEQ ID NO: 113933 - DNA, 36 bp, Homo sapiens; identical to SEQ ID NO: 81200
  misc_feature 1..36: note = chr17:76972067-76972103
  misc_feature 1..36: note = Hypo
  source 1..36: mol_type = genomic DNA

SEQ ID NO: 113934 - DNA, 374 bp, Homo sapiens; identical to SEQ ID NO: 81201
  misc_feature 1..374: note = chr17:76974125-76974499
  misc_feature 1..374: note = Hypo
  source 1..374: mol_type = genomic DNA

SEQ ID NO: 113935 - DNA, 30 bp, Homo sapiens; identical to SEQ ID NO: 81202
  misc_feature 1..30: note = chr17:76975153-76975183
  misc_feature 1..30: note = Hypo
  source 1..30: mol_type = genomic DNA

SEQ ID NO: 113936 - DNA, 38 bp, Homo sapiens; identical to SEQ ID NO: 81203
  misc_feature 1..38: note = chr17:76975538-76975576
  misc_feature 1..38: note = Hypo
  source 1..38: mol_type = genomic DNA

SEQ ID NO: 113937 - DNA, 190 bp, Homo sapiens; identical to SEQ ID NO: 81204
  misc_feature 1..190: note = chr17:76991522-76991712
  misc_feature 1..190: note = Hypo
  source 1..190: mol_type = genomic DNA

SEQ ID NO: 113938 - DNA, 61 bp, Homo sapiens; identical to SEQ ID NO: 81205
  misc_feature 1..61: note = chr17:76993358-76993419
  misc_feature 1..61: note = Hypo
  source 1..61: mol_type = genomic DNA

SEQ ID NO: 113939 - DNA, 85 bp, Homo sapiens; identical to SEQ ID NO: 81206
  misc_feature 1..85: note = chr17:76996482-76996567
  misc_feature 1..85: note = Hypo
  source 1..85: mol_type = genomic DNA

SEQ ID NO: 113940 - DNA, 62 bp, Homo sapiens; identical to SEQ ID NO: 81207
  misc_feature 1..62: note = chr17:76996979-76997041
  misc_feature 1..62: note = Hypo
  source 1..62: mol_type = genomic DNA

SEQ ID NO: 113941 - DNA, 30 bp, Homo sapiens; identical to SEQ ID NO: 45221
  misc_feature 1..30: note = chr17:76997571-76997601
  misc_feature 1..30: note = Hypo
  source 1..30: mol_type = genomic DNA

SEQ ID NO: 113942 - DNA, 526 bp, Homo sapiens; identical to SEQ ID NO: 81209
  misc_feature 1..526: note = chr17:77002640-77003166
  misc_feature 1..526: note = Hypo
  source 1..526: mol_type = genomic DNA

SEQ ID NO: 113943 - DNA, 229 bp, Homo sapiens
  misc_feature 1..229: note = Hyper
  source 1..229: mol_type = genomic DNA
cggctgctgtttggacgaaaagcgctgggggtgttggaggctcctcgctgctcacatctggctgggcttcgctccttgcgcgtctgtcccactttctccctctcttcctttactttcgagaaaccgcgcttccgcttctggtcgcagagacctcggagaccgcgccggggagacggaggtgctgtgggtgggggggacctgtggctgctcgtaccgccccccaccctcc

SEQ ID NO: 113944 - DNA, 30 bp, Homo sapiens; identical to SEQ ID NO: 81212
  misc_feature 1..30: note = chr17:77084562-77084592
  misc_feature 1..30: note = Hypo
  source 1..30: mol_type = genomic DNA

SEQ ID NO: 113945 - DNA, 203 bp, Homo sapiens; identical to SEQ ID NO: 81213
  misc_feature 1..203: note = chr17:77104080-77104283
  misc_feature 1..203: note = Hypo
  source 1..203: mol_type = genomic DNA

SEQ ID NO: 113946 - DNA, 235 bp, Homo sapiens; identical to SEQ ID NO: 81214
  misc_feature 1..235: note = chr17:77104986-77105221
  misc_feature 1..235: note = Hypo
  source 1..235: mol_type = genomic DNA

SEQ ID NO: 113947 - DNA, 30 bp, Homo sapiens; identical to SEQ ID NO: 81215
  misc_feature 1..30: note = chr17:77114143-77114173
  misc_feature 1..30: note = Hypo
  source 1..30: mol_type = genomic DNA

SEQ ID NO: 113948 - DNA, 48 bp, Homo sapiens; identical to SEQ ID NO: 81216
  misc_feature 1..48: note = chr17:77126443-77126491
  misc_feature 1..48: note = Hypo
  source 1..48: mol_type = genomic DNA

SEQ ID NO: 113949 - DNA, 30 bp, Homo sapiens; identical to SEQ ID NO: 45226
  misc_feature 1..30: note = chr17:77126850-77126880
  misc_feature 1..30: note = Hypo
  source 1..30: mol_type = genomic DNA

SEQ ID NO: 113950 - DNA, 53 bp, Homo sapiens; identical to SEQ ID NO: 81218
  misc_feature 1..53: note = chr17:77127124-77127177
  misc_feature 1..53: note = Hypo
  source 1..53: mol_type = genomic DNA

SEQ ID NO: 113951 - DNA, 30 bp, Homo sapiens; identical to SEQ ID NO: 81219
  misc_feature 1..30: note = chr17:77135204-77135234
  misc_feature 1..30: note = Hypo
  source 1..30: mol_type = genomic DNA

SEQ ID NO: 113952 - DNA, 72 bp, Homo sapiens; identical to SEQ ID NO: 45228
  misc_feature 1..72: note = chr17:77135878-77135950
  misc_feature 1..72: note = Hypo
  source 1..72: mol_type = genomic DNA

SEQ ID NO: 113953 - DNA, 212 bp, Homo sapiens; identical to SEQ ID NO: 81221
  misc_feature 1..212: note = chr17:77143891-77144103
  misc_feature 1..212: note = Hypo
  source 1..212: mol_type = genomic DNA

SEQ ID NO: 113954 - DNA, 154 bp, Homo sapiens; identical to SEQ ID NO: 45230
  misc_feature 1..154: note = chr17:77145129-77145283
  misc_feature 1..154: note = Hypo
  source 1..154: mol_type = genomic DNA

SEQ ID NO: 113955 - DNA, 233 bp, Homo sapiens; identical to SEQ ID NO: 81223
  misc_feature 1..233: note = chr17:77147053-77147286
  misc_feature 1..233: note = Hypo
  source 1..233: mol_type = genomic DNA

SEQ ID NO: 113956 - DNA, 182 bp, Homo sapiens; identical to SEQ ID NO: 81224
  misc_feature 1..182: note = chr17:77174854-77175036
  misc_feature 1..182: note = Hypo
  source 1..182: mol_type = genomic DNA

SEQ ID NO: 113957 - DNA, 1662 bp, Homo sapiens
  misc_feature 1..1662: note = chr17:77178580-77180242
  misc_feature 1..1662: note = Hyper
  source 1..1662: mol_type = genomic DNA
cgcattgggtggcagcgcaggacccccgtcccctcccccaacgccccggccggccggcgggcaggcggctgctgatgctctgtgcgcacctccccacggggcatcctggggatctggtggctcagagtcgccgactttcctgcccccacccaaccccaactcgccagccggagcttcctgcgcagcccccaagattgcaaaagtctggccccagccccctccccggccagagctcctggggcctccctcgccaggcgggtggcccacctcccccgcctccccggaggcccggcgcgcggtctgcgctgcagcagagctcggcgcccccgccgccacctctgcgcgccccccggctttcccgacgctgccagggaggatgccccgctccccgccccgagtccccagcggcccggcgcgaagttccccaaagtgacccgggcgccgagaacccccgccccctcccctcgggcttccccggagactccgcccgccgccccctcccgcgccttcggaaaagttgcgagcgacgccccaaactccggcccccccgcctcgcgccgcgcgcgccctgggcgcccccgcgctcggccgccgcgcaggggcgcagttccccctaccccagccccggcgccatgacgcggggagcgcagcgggggccaccggtggcggcggcggcgcagaggcggccaagtgcggggcgtgggcggcagcgcggggcgcacgtgcgccgggccgggggccggggccgggcggggggccgcttacctgttggaggtagaggaaggcgggcgggcagggcacggagtgcgggagcatgctgccggagttggacagcaggaggcagcccgagttcgccatggagcacagcatggggcggcaggggggcgcccggcggcggctctgcgctcgctgcgtccctcggagtgtgcgcgcgccctgcctcccgggcgccctcccggtctctctcctcctcctcctctgggcctcccctccccctcgtggcgctctttaagagggaggcatcgaaaggagagcggcgcgcctctgcccggtgttccccctgcccgggcggggaggctggagagagcgcgcgcgagaatacggccagagagtctgtgcgcgagagatcgggcgagcgggcgagagcaggagtcagtcactttggagcctccggagccctgtctgcaaagagtggtgcgtgtgcgtgtgtgagtgcgcgcgtgtgcgcgcgtgtgtagcggtgggagggggagtccctggcgtactccaacatcaaacggagccccgcgcggagggaagagaatccggagcgacggcacaacagctgatcccacacttaacccctcgcccgccggcaccggggcagccctccctcgcgccctcccacgctcgggcccctgcgcgcccctcctcccccccgttgccagcacttgctcctggcctggggggtctggaatctccctttgcccccgctccgttctccggccgctgcggagaggaggagccgctccgccggctctgcggccgaccgaccggaaggcgcctcgtcctgtttcgcgttcagagaagcgcctttcctaagggaggccggctcagtggcggggatgtcggtgatgtaatccgagggcatctacgcagaggcttccgcgctggggaaggctt

SEQ ID NO: 113958 - DNA, 211 bp, Homo sapiens; identical to SEQ ID NO: 81233
  misc_feature 1..211: note = chr17:77188723-77188934
  misc_feature 1..211: note = Hyper
  source 1..211: mol_type = genomic DNA

SEQ ID NO: 113959 - DNA, 65 bp, Homo sapiens; identical to SEQ ID NO: 81234
  misc_feature 1..65: note = chr17:77200378-77200443
  misc_feature 1..65: note = Hypo
  source 1..65: mol_type = genomic DNA

SEQ ID NO: 113960 - DNA, 179 bp, Homo sapiens; identical to SEQ ID NO: 81235
  misc_feature 1..179: note = chr17:77216294-77216473
  misc_feature 1..179: note = Hyper
  source 1..179: mol_type = genomic DNA

SEQ ID NO: 113961 - DNA, 198 bp, Homo sapiens; identical to SEQ ID NO: 81236
  misc_feature 1..198: note = chr17:77240121-77240319
  misc_feature 1..198: note = Hypo
  source 1..198: mol_type = genomic DNA

SEQ ID NO: 113962 - DNA, 143 bp, Homo sapiens; identical to SEQ ID NO: 81238
  misc_feature 1..143: note = chr17:77290782-77290925
  misc_feature 1..143: note = Hyper
  source 1..143: mol_type = genomic DNA

SEQ ID NO: 113963 - DNA, 30 bp, Homo sapiens; identical to SEQ ID NO: 81239
  misc_feature 1..30: note = chr17:77306065-77306095
  misc_feature 1..30: note = Hypo
  source 1..30: mol_type = genomic DNA

SEQ ID NO: 113964 - DNA, 40 bp, Homo sapiens; identical to SEQ ID NO: 81240
  misc_feature 1..40: note = chr17:77356491-77356531
  misc_feature 1..40: note = Hypo
  source 1..40: mol_type = genomic DNA

SEQ ID NO: 113965 - DNA, 183 bp, Homo sapiens; identical to SEQ ID NO: 81241
  misc_feature 1..183: note = chr17:77365331-77365514
  misc_feature 1..183: note = Hypo
  source 1..183: mol_type = genomic DNA

SEQ ID NO: 113966 - DNA, 45 bp, Homo sapiens; identical to SEQ ID NO: 81242
  misc_feature 1..45: note = chr17:77390958-77391003
  misc_feature 1..45: note = Hypo
  source 1..45: mol_type = genomic DNA

SEQ ID NO: 113967 - DNA, 171 bp, Homo sapiens; identical to SEQ ID NO: 81243
  misc_feature 1..171: note = chr17:77772124-77772295
  misc_feature 1..171: note = Hyper
  source 1..171: mol_type = genomic DNA

SEQ ID NO: 113968 - DNA, 364 bp, Homo sapiens; identical to SEQ ID NO: 81244
  misc_feature 1..364: note = chr17:77772527-77772891
  misc_feature 1..364: note = Hyper
  source 1..364: mol_type = genomic DNA

SEQ ID NO: 113969 - DNA, 30 bp, Homo sapiens; identical to SEQ ID NO: 81245
  misc_feature 1..30: note = chr17:77773662-77773692
  misc_feature 1..30: note = Hyper
  source 1..30: mol_type = genomic DNA

SEQ ID NO: 113970 - DNA, 52 bp, Homo sapiens; identical to SEQ ID NO: 81246
  misc_feature 1..52: note = chr17:77774368-77774420
  misc_feature 1..52: note = Hyper
  source 1..52: mol_type = genomic DNA

SEQ ID NO: 113971 - DNA, 165 bp, Homo sapiens; identical to SEQ ID NO: 81247
  misc_feature 1..165: note = chr17:77774622-77774787
  misc_feature 1..165: note = Hyper
  source 1..165: mol_type = genomic DNA

SEQ ID NO: 113972 - DNA, 39 bp, Homo sapiens; identical to SEQ ID NO: 81248
  misc_feature 1..39: note = chr17:77775268-77775307
  misc_feature 1..39: note = Hyper
  source 1..39: mol_type = genomic DNA

SEQ ID NO: 113973 - DNA, 1492 bp, Homo sapiens
  misc_feature 1..1492: note = chr17:77776539-77778031
  misc_feature 1..1492: note = Hyper
  source 1..1492: mol_type = genomic DNA
cttgggcatctggaccggttgggccacgtgggctcgctgggaaaacgcgccggcgtcccctcggagcgccgaggccgggcgagctgagggtgcggtgccgctggagcacgcgcacagcgcccgaaccagcacgcatgcgcgccgcgggccggccccatttccgccccccccccacgcgcccccccatcacacgcacacccaatccccggactgctcgctggtgctgcttgtgagacccattcctaggagccccaggcgcccttggggagcagaaagaggcggtccagagttgggccggacaaccgcaacctggaaggagtccgggagtccttgggtctgggcgctcagttctcacggtctggggagaaggggctcagacgggacggactaggcacagccaggggcggggactgcgagaggcgaggggaggccggcagggtgtggcggcagagcagcccgggacaagtgagcggcctagagatcaaggccttggagtcccgtccgagagcaggacgttatcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcatgagaaaggcggggagcaccaaccctcccacgggaaaacacggggagaggctgggcgagtcaaggaatggtggcaccagagcctgggcgcagagaggcagctggacctcctgggctcccttgagccggagctccgccagggtgggcacttctgcctccagcgatgctgggtgccacagtcctcccgcctcctcctggaccacacgcggctctccagagtcccagggaagctccagggactcctcggactccgcctggcgcttcccgttttttcatttcctaccccacccccatgcagaaggaattgaagtgacttttttgctgggacgtcgggacctcaagtcagttccaaagtgggagtctctcagccggtgccgttcccttgcgagattgttaacgccaagagccacagtccagcttccccttttagagatcagaaaatcctaagtgcagggcctgccgggtcattcgagaaggcacaagctgcggaggccagtctggggcctctcgcagaacctcggggaacagaggcgtctgccgggccgcctaccctccgcaagagtgggccacgcgggcggcaaacccgagggcagacgtttgggagctgaccgagaaaacgcgacggtgccggcgaggttctgggcgaagcctcggcgtcctccactgtggtcgacgcctttcctcgcagccccggtacagggcttcctcggtgcacccctagccgttgccccgggaggaggcgccgtctgggacacgaa

SEQ ID NO: 113974 - DNA, 624 bp, Homo sapiens; identical to SEQ ID NO: 81254
  misc_feature 1..624: note = chr17:77778434-77779058
  misc_feature 1..624: note = Hyper
  source 1..624: mol_type = genomic DNA

SEQ ID NO: 113975 - DNA, 30 bp, Homo sapiens; identical to SEQ ID NO: 81255
  misc_feature 1..30: note = chr17:77786072-77786102
  misc_feature 1..30: note = Hyper
  source 1..30: mol_type = genomic DNA

SEQ ID NO: 113976 - DNA, 338 bp, Homo sapiens; identical to SEQ ID NO: 81256
  misc_feature 1..338: note = chr17:77786467-77786805
  misc_feature 1..338: note = Hyper
  source 1..338: mol_type = genomic DNA

SEQ ID NO: 113977 - DNA, 739 bp, Homo sapiens
  misc_feature 1..739: note = chr17:77788761-77789500
  misc_feature 1..739: note = Hyper
  source 1..739: mol_type = genomic DNA
gtcgcctgctagggtcgggaaaggaccctccaccgccaccctcggggttcggtcctcccccaccaacgtctgccagtccgcgtggattccgagcccggctccggaaaccagtctgaccacttcgcccatttcccaagcctccccgggcggcggccggccagcttccatggtgcggtgagccaggctcggccgccgcctcggccgccctgcgatgaatggctctgcccagaaggccggcgtccaagcgacgctcccgcccgcgcgcccggggcctccaggccgctccccgccccgtgtccccacattgcgaaacggacggtcggatgctccgctccagggccggggtcgcctgtcccctgccgacctggcgcagagccgccttctgcacccggccccgtgccgccctggggttgcttacagccgggctgtgccaccgagctgagcccggaatcgaatggcgggccgcggaaaaggcggccaggcccgcaggggcgactgctcgaggtcccagaacagcgcccggggagccccaggccggcctcgaggggaccgcgggcgggacaggaggggaacagctggcatcggcgcccggcttcagctgcccgactgcggtgggcgggtaggcacgttcccccgcagccacccgcgcacgggtttccaaggcgtcaagggcaattcacctggtcgctgcaagaaagcgactgcgcccccacgtccagccagccgccttgtccatgag

SEQ ID NO: 113978 - DNA, 57 bp, Homo sapiens
  misc_feature 1..57: note = chr17:77789749-77789806
  misc_feature 1..57: note = Hyper
  source 1..57: mol_type = genomic DNA
gcgactcctggtgcccggctgggacacgtggggccggctttgcggagtcagcagggc

SEQ ID NO: 113979 - DNA, 569 bp, Homo sapiens; identical to SEQ ID NO: 81258
  misc_feature 1..569: note = chr17:77807459-77808028
  misc_feature 1..569: note = Hypo
  source 1..569: mol_type = genomic DNA

SEQ ID NO: 113980 - DNA, 375 bp, Homo sapiens; identical to SEQ ID NO: 81259
  misc_feature 1..375: note = chr17:77808375-77808750
  misc_feature 1..375: note = Hypo
  source 1..375: mol_type = genomic DNA

SEQ ID NO: 113981 - DNA, 80 bp, Homo sapiens; identical to SEQ ID NO: 81260
  misc_feature 1..80: note = chr17:77809064-77809144
  misc_feature 1..80: note = Hypo
  source 1..80: mol_type = genomic DNA

SEQ ID NO: 113982 - DNA, 385 bp, Homo sapiens
  misc_feature 1..385: note = chr17:77814048-77814433
  misc_feature 1..385: note = Hyper
  source 1..385: mol_type = genomic DNA
aagctaggcgagaggcgtaggaggcagagagagcgggcgcgggaggccagggtccgcctgggggcctgaggggacttcgtggggtcccgggagtggcctagaaacagggagctgggagggccgggaagagcttgaggctgagcgggggacgaacgggcagcgcaaaggggagatgaacggaatggccgaggagccacgcattcgccttgtgtccgcggacccttgttcccgacaggcgaccaagccaaggccctccggactgacgcggcctgagcagcagcgagtgtgaagtttggcacctccggcggcgagacggcgcgttctggcgcgcggctcctgcgtccggctggtggagctgctgcgccctatgcggcctgccgagggc

SEQ ID NO: 113983 - DNA, 179 bp, Homo sapiens; identical to SEQ ID NO: 81262
  misc_feature 1..179: note = chr17:77814750-77814929
  misc_feature 1..179: note = Hyper
  source 1..179: mol_type = genomic DNA

SEQ ID NO: 113984 - DNA, 785 bp, Homo sapiens; identical to SEQ ID NO: 81263
  misc_feature 1..785: note = chr17:77815150-77815935
  misc_feature 1..785: note = Hyper
  source 1..785: mol_type = genomic DNA

SEQ ID NO: 113985 - DNA, 30 bp, Homo sapiens; identical to SEQ ID NO: 81264
  misc_feature 1..30: note = chr17:77818158-77818188
  misc_feature 1..30: note = Hyper
  source 1..30: mol_type = genomic DNA

SEQ ID NO: 113986 - DNA, 534 bp, Homo sapiens; identical to SEQ ID NO: 81265
  misc_feature 1..534: note = chr17:77825231-77825765
  misc_feature 1..534: note = Hypo
  source 1..534: mol_type = genomic DNA

SEQ ID NO: 113987 - DNA, 44 bp, Homo sapiens; identical to SEQ ID NO: 81266
  misc_feature 1..44: note = chr17:77827279-77827323
  misc_feature 1..44: note = Hypo
  source 1..44: mol_type = genomic DNA

SEQ ID NO: 113988 - DNA, 23 bp, Homo sapiens
  misc_feature 1..23: note = chr17:77837400-77837423
  misc_feature 1..23: note = Hypo
  source 1..23: mol_type = genomic DNA
gagacagagtcttgccgtatcgt

SEQ ID NO: 113989 - DNA, 30 bp, Homo sapiens; identical to SEQ ID NO: 81268
  misc_feature 1..30: note = chr17:77899529-77899559
  misc_feature 1..30: note = Hypo
  source 1..30: mol_type = genomic DNA

SEQ ID NO: 113990 - DNA, 313 bp, Homo sapiens; identical to SEQ ID NO: 81269
  misc_feature 1..313: note = chr17:77904151-77904464
  misc_feature 1..313: note = Hyper
  source 1..313: mol_type = genomic DNA

SEQ ID NO: 113991 - DNA, 106 bp, Homo sapiens; identical to SEQ ID NO: 81270
  misc_feature 1..106: note = chr17:77926452-77926558
  misc_feature 1..106: note = Hypo
  source 1..106: mol_type = genomic DNA

SEQ ID NO: 113992 - DNA, 221 bp, Homo sapiens; identical to SEQ ID NO: 81271
  misc_feature 1..221: note = chr17:77948898-77949119
  misc_feature 1..221: note = Hypo
  source 1..221: mol_type = genomic DNA

SEQ ID NO: 113993 - DNA, 181 bp, Homo sapiens; identical to SEQ ID NO: 81272
  misc_feature 1..181: note = chr17:78010865-78011046
  misc_feature 1..181: note = Hyper
  source 1..181: mol_type = genomic DNA

SEQ ID NO: 113994 - DNA, 30 bp, Homo sapiens; identical to SEQ ID NO: 81273
  misc_feature 1..30: note = chr17:78041466-78041496
  misc_feature 1..30: note = Hypo
  source 1..30: mol_type = genomic DNA

SEQ ID NO: 113995 - DNA, 159 bp, Homo sapiens; identical to SEQ ID NO: 36819
  misc_feature 1..159: note = chr17:78045491-78045650
  misc_feature 1..159: note = Hyper
  source 1..159: mol_type = genomic DNA

SEQ ID NO: 113996 - DNA, 138 bp, Homo sapiens; identical to SEQ ID NO: 81275
  misc_feature 1..138: note = chr17:78059751-78059889
  misc_feature 1..138: note = Hypo
  source 1..138: mol_type = genomic DNA

SEQ ID NO: 113997 - DNA, 71 bp, Homo sapiens; identical to SEQ ID NO: 81276
  misc_feature 1..71: note = chr17:78073436-78073507
  misc_feature 1..71: note = Hypo
  source 1..71: mol_type = genomic DNA

SEQ ID NO: 113998 - DNA, 279 bp, Homo sapiens; identical to SEQ ID NO: 81277
  misc_feature 1..279: note = chr17:78078871-78079150
  misc_feature 1..279: note = Hypo
  source 1..279: mol_type = genomic DNA

SEQ ID NO: 113999 - DNA, 71 bp, Homo sapiens; identical to SEQ ID NO: 81278
  misc_feature 1..71: note = chr17:78083747-78083818
  misc_feature 1..71: note = Hypo
  source 1..71: mol_type = genomic DNA

SEQ ID NO: 114000 - DNA, 93 bp, Homo sapiens; identical to SEQ ID NO: 81279
  misc_feature 1..93: note = chr17:78112862-78112955
  misc_feature 1..93: note = Hypo
  source 1..93: mol_type = genomic DNA

SEQ ID NO: 114001 - DNA, 30 bp, Homo sapiens; identical to SEQ ID NO: 81280
  misc_feature 1..30: note = chr17:78122014-78122044
  misc_feature 1..30: note = Hypo
  source 1..30: mol_type = genomic DNA

SEQ ID NO: 114002 - DNA, 89 bp, Homo sapiens; identical to SEQ ID NO: 81281
  misc_feature 1..89: note = chr17:78122164-78122253
  misc_feature 1..89: note = Hypo
  source 1..89: mol_type = genomic DNA

SEQ ID NO: 114003 - DNA, 81 bp, Homo sapiens; identical to SEQ ID NO: 81282
  misc_feature 1..81: note = chr17:78143912-78143993
  misc_feature 1..81: note = Hypo
  source 1..81: mol_type = genomic DNA

SEQ ID NO: 114004 - DNA, 178 bp, Homo sapiens; identical to SEQ ID NO: 81283
  misc_feature 1..178: note = chr17:78151768-78151946
  misc_feature 1..178: note = Hypo
  source 1..178: mol_type = genomic DNA

SEQ ID NO: 114005 - DNA, 58 bp, Homo sapiens; identical to SEQ ID NO: 81284
  misc_feature 1..58: note = chr17:78152480-78152538
  misc_feature 1..58: note = Hypo
  source 1..58: mol_type = genomic DNA

SEQ ID NO: 114006 - DNA, 30 bp, Homo sapiens; identical to SEQ ID NO: 81285
  misc_feature 1..30: note = chr17:78439146-78439176
  misc_feature 1..30: note = Hypo
  source 1..30: mol_type = genomic DNA

SEQ ID NO: 114007 - DNA, 63 bp, Homo sapiens; identical to SEQ ID NO: 81286
  misc_feature 1..63: note = chr17:78447061-78447124
  misc_feature 1..63: note = Hypo
  source 1..63: mol_type = genomic DNA

SEQ ID NO: 114008 - DNA, 30 bp, Homo sapiens; identical to SEQ ID NO: 81287
  misc_feature 1..30: note = chr17:78447361-78447391
  misc_feature 1..30: note = Hypo
  source 1..30: mol_type = genomic DNA

SEQ ID NO: 114009 - DNA, 1512 bp, Homo sapiens; identical to SEQ ID NO: 81288
  misc_feature 1..1512: note = chr17:78449408-78450920
  misc_feature 1..1512: note = Hyper
  source 1..1512: mol_type = genomic DNA

SEQ ID NO: 114010 - DNA, 1683 bp, Homo sapiens
  misc_feature 1..1683: note = chr17:78451302-78452985
  misc_feature 1..1683: note = Hyper
  source 1..1683: mol_type = genomic DNA
gggtgtccacctgtgcgtggggggctgtttcccgtctgtccagccgcgcccacttctcaggcccaaaggccagcaggaagggtcccggaggtggctgggggcgtccacctgagaagctccgctctcgctcagacaccccacccggcacccgcgcactcgcgccttcatctggaccgcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttttaagcctccctgagccggggctgcgttctcgttgtctccttcggccgccgcttcctggcgccagagggaccccgcggcccgcacgggcctgtcctcggctccgctcggagggtgtgcgggttcccgctccgctggccccgcttgcccaccacggcgcgcccaaacccacgcggcccgcggccccttgcgtgctctgccgaccccgggccgcaggaggggttagcctcgccggtccccacgcggggtctgcgccggcagcgccacgggctggaacgcgcctcgggagaaattacccgcgcggggtcgcggcgtcttctgccccaactcccgtagggagccgctaggcgggtgccctcctggccccagcgctttggcctcgccgccctcccgcacgcgtccagtggggaggccgcgcccgtcaggcctggagccggaccgtgcccagccgagagcgcgcgggcgcgggagaggagccctgccctgcccagggcaggctgtttagacggggcgggaacccttagcctggccccgcgtctctatccccagcagccgtggagccttcctagccgcccaaggccagggaccctgcctggcttttcctccagggcagcagatctcagcggcctggcacctcggcacagaggagcgtgtcccccttccgcagaggaagggagtggacggcgtcagaaagggaggggagcctggggcggtgtctggggctagcgggacctctgggcactgtggggccccaggagaggagaccctcgggtccagcctgcaactgttgtgcaggaggcgctgggcgggacacctgcaggcgctgcacacacacgcgagggccaccatgccgcgtttctccttcacaagaccctgggcaagcggagggtcgtatttaggattccctcggcctccccagtgttctgaaagtatctgagagggagggagcaggaaaacgaagggccgccctgcccaaactcatcggggtgtctggttactaggtcggaagaggggggatggtgttgtgaacagccagtgatcccggccctgcctgagt

SEQ ID NO: 114011 - DNA, 79 bp, Homo sapiens; identical to SEQ ID NO: 81291
  misc_feature 1..79: note = chr17:78496397-78496476
  misc_feature 1..79: note = Hypo
  source 1..79: mol_type = genomic DNA

SEQ ID NO: 114012 - DNA, 33 bp, Homo sapiens; identical to SEQ ID NO: 81292
  misc_feature 1..33: note = chr17:78517569-78517602
  misc_feature 1..33: note = Hypo
  source 1..33: mol_type = genomic DNA

SEQ ID NO: 114013 - DNA, 145 bp, Homo sapiens; identical to SEQ ID NO: 81293
  misc_feature 1..145: note = chr17:78518203-78518348
  misc_feature 1..145: note = Hypo
  source 1..145: mol_type = genomic DNA

SEQ ID NO: 114014 - DNA, 33 bp, Homo sapiens; identical to SEQ ID NO: 81294
  misc_feature 1..33: note = chr17:78539654-78539687
  misc_feature 1..33: note = Hypo
  source 1..33: mol_type = genomic DNA

SEQ ID NO: 114015 - DNA, 153 bp, Homo sapiens; identical to SEQ ID NO: 81296
  misc_feature 1..153: note = chr17:78587674-78587827
  misc_feature 1..153: note = Hypo
  source 1..153: mol_type = genomic DNA

SEQ ID NO: 114016 - DNA, 346 bp, Homo sapiens; identical to SEQ ID NO: 81297
  misc_feature 1..346: note = chr17:78599426-78599772
  misc_feature 1..346: note = Hypo
  source 1..346: mol_type = genomic DNA

SEQ ID NO: 114017 - DNA, 370 bp, Homo sapiens; identical to SEQ ID NO: 81298
  misc_feature 1..370: note = chr17:78667873-78668243
  misc_feature 1..370: note = Hypo
  source 1..370: mol_type = genomic DNA

SEQ ID NO: 114018 - DNA, 52 bp, Homo sapiens; identical to SEQ ID NO: 81299
  misc_feature 1..52: note = chr17:78772792-78772844
  misc_feature 1..52: note = Hypo
  source 1..52: mol_type = genomic DNA

SEQ ID NO: 114019 - DNA, 49 bp, Homo sapiens; identical to SEQ ID NO: 81300
  misc_feature 1..49: note = chr17:78773568-78773617
  misc_feature 1..49: note = Hypo
  source 1..49: mol_type = genomic DNA

SEQ ID NO: 114020 - DNA, 30 bp, Homo sapiens; identical to SEQ ID NO: 81301
  misc_feature 1..30: note = chr17:78792696-78792726
  misc_feature 1..30: note = Hypo
  source 1..30: mol_type = genomic DNA

SEQ ID NO: 114021 - DNA, 30 bp, Homo sapiens; identical to SEQ ID NO: 81302
  misc_feature 1..30: note = chr17:78794230-78794260
  misc_feature 1..30: note = Hypo
  source 1..30: mol_type = genomic DNA

SEQ ID NO: 114022 - DNA, 65 bp, Homo sapiens; identical to SEQ ID NO: 81303
  misc_feature 1..65: note = chr17:78820077-78820142
  misc_feature 1..65: note = Hypo
  source 1..65: mol_type = genomic DNA

SEQ ID NO: 114023 - DNA, 42 bp, Homo sapiens; identical to SEQ ID NO: 81304
  misc_feature 1..42: note = chr17:78861192-78861234
  misc_feature 1..42: note = Hypo
  source 1..42: mol_type = genomic DNA

SEQ ID NO: 114024 - DNA, 65 bp, Homo sapiens; identical to SEQ ID NO: 81305
  misc_feature 1..65: note = chr17:78867045-78867110
  misc_feature 1..65: note = Hypo
  source 1..65: mol_type = genomic DNA

SEQ ID NO: 114025 - DNA, 30 bp, Homo sapiens; identical to SEQ ID NO: 81306
  misc_feature 1..30: note = chr17:78869491-78869521
  misc_feature 1..30: note = Hypo
  source 1..30: mol_type = genomic DNA

SEQ ID NO: 114026 - DNA, 96 bp, Homo sapiens; identical to SEQ ID NO: 81307
  misc_feature 1..96: note = chr17:78872638-78872734
  misc_feature 1..96: note = Hypo
  source 1..96: mol_type = genomic DNA

SEQ ID NO: 114027 - DNA, 158 bp, Homo sapiens; identical to SEQ ID NO: 81308
  misc_feature 1..158: note = chr17:78874417-78874575
  misc_feature 1..158: note = Hypo
  source 1..158: mol_type = genomic DNA

SEQ ID NO: 114028 - DNA, 83 bp, Homo sapiens; identical to SEQ ID NO: 81309
  misc_feature 1..83: note = chr17:78897683-78897766
  misc_feature 1..83: note = Hypo
  source 1..83: mol_type = genomic DNA

SEQ ID NO: 114029 - DNA, 39 bp, Homo sapiens; identical to SEQ ID NO: 81310
  misc_feature 1..39: note = chr17:78946490-78946529
  misc_feature 1..39: note = Hypo
  source 1..39: mol_type = genomic DNA

SEQ ID NO: 114030 - DNA, 30 bp, Homo sapiens; identical to SEQ ID NO: 81311
  misc_feature 1..30: note = chr17:78957836-78957866
  misc_feature 1..30: note = Hypo
  source 1..30: mol_type = genomic DNA

SEQ ID NO: 114031 - DNA, 43 bp, Homo sapiens; identical to SEQ ID NO: 81312
  misc_feature 1..43: note = chr17:78968896-78968939
  misc_feature 1..43: note = Hypo
  source 1..43: mol_type = genomic DNA

SEQ ID NO: 114032 - DNA, 77 bp, Homo sapiens; identical to SEQ ID NO: 81313
  misc_feature 1..77: note = chr17:78975561-78975638
  misc_feature 1..77: note = Hypo
  source 1..77: mol_type = genomic DNA

SEQ ID NO: 114033 - DNA, 16 bp, Homo sapiens
  misc_feature 1..16: note = chr17:78975938-78975954
  misc_feature 1..16: note = Hypo
  source 1..16: mol_type = genomic DNA
gcgggtccatcctgga

SEQ ID NO: 114034 - DNA, 226 bp, Homo sapiens
  misc_feature 1..226: note = chr17:78977598-78977824
  misc_feature 1..226: note = Hyper
  source 1..226: mol_type = genomic DNA
gctgggtaatactcccggtgccgcccttgctgttcgtcgatgcacatctggctgcttttcgctggctgcgagcggagctgctagggacatggccacggggctgtgagagcggagtttcctctctccggtgaccctgagctgcgcctttctcagccgcctcccgaggccccaggcgctctgcgggggctctggcggggttggtgggggtgggcgttctcgttgtttc

SEQ ID NO: 114035 - DNA, 392 bp, Homo sapiens; identical to SEQ ID NO: 81317
  misc_feature 1..392: note = chr17:78978124-78978516
  misc_feature 1..392: note = Hyper
  source 1..392: mol_type = genomic DNA

SEQ ID NO: 114036 - DNA, 30 bp, Homo sapiens; identical to SEQ ID NO: 45252
  misc_feature 1..30: note = chr17:79001034-79001064
  misc_feature 1..30: note = Hypo
  source 1..30: mol_type = genomic DNA

SEQ ID NO: 114037 - DNA, 30 bp, Homo sapiens; identical to SEQ ID NO: 81319
  misc_feature 1..30: note = chr17:79001300-79001330
  misc_feature 1..30: note = Hypo
  source 1..30: mol_type = genomic DNA

SEQ ID NO: 114038 - DNA, 52 bp, Homo sapiens; identical to SEQ ID NO: 81320
  misc_feature 1..52: note = chr17:79001565-79001617
  misc_feature 1..52: note = Hypo
  source 1..52: mol_type = genomic DNA

SEQ ID NO: 114039 - DNA, 96 bp, Homo sapiens; identical to SEQ ID NO: 81321
  misc_feature 1..96: note = chr17:79009595-79009691
  misc_feature 1..96: note = Hyper
  source 1..96: mol_type = genomic DNA

SEQ ID NO: 114040 - DNA, 74 bp, Homo sapiens; identical to SEQ ID NO: 81322
  misc_feature 1..74: note = chr17:79035028-79035102
  misc_feature 1..74: note = Hypo
  source 1..74: mol_type = genomic DNA

SEQ ID NO: 114041 - DNA, 30 bp, Homo sapiens; identical to SEQ ID NO: 81323
  misc_feature 1..30: note = chr17:79048658-79048688
  misc_feature 1..30: note = Hypo
  source 1..30: mol_type = genomic DNA

SEQ ID NO: 114042 - DNA, 142 bp, Homo sapiens; identical to SEQ ID NO: 81325
  misc_feature 1..142: note = chr17:79066660-79066802
  misc_feature 1..142: note = Hypo
  source 1..142: mol_type = genomic DNA

SEQ ID NO: 114043 - DNA, 525 bp, Homo sapiens; identical to SEQ ID NO: 81326
  misc_feature 1..525: note = chr17:79093956-79094481
  misc_feature 1..525: note = Hypo
  source 1..525: mol_type = genomic DNA

SEQ ID NO: 114044 - DNA, 46 bp, Homo sapiens; identical to SEQ ID NO: 45255
  misc_feature 1..46: note = chr17:79094742-79094788
  misc_feature 1..46: note = Hypo
  source 1..46: mol_type = genomic DNA

SEQ ID NO: 114045 - DNA, 317 bp, Homo sapiens; identical to SEQ ID NO: 81328
  misc_feature 1..317: note = chr17:79096940-79097257
  misc_feature 1..317: note = Hypo
  source 1..317: mol_type = genomic DNA

SEQ ID NO: 114046 - DNA, 48 bp, Homo sapiens; identical to SEQ ID NO: 45257
  misc_feature 1..48: note = chr17:79098155-79098203
  misc_feature 1..48: note = Hypo
  source 1..48: mol_type = genomic DNA

SEQ ID NO: 114047 - DNA, 139 bp, Homo sapiens
  misc_feature 1..139: note = chr17:79098539-79098678
  misc_feature 1..139: note = Hypo
  source 1..139: mol_type = genomic DNA
tcttggtctggtccacgacgagcaggttgctatgcacctcgtccaccagctctggcgcgatccagcgcagaggcacccacagctggtcggcagtcacgaagtagtcctcctgttggcacagggacgggtcacccctgcc

SEQ ID NO: 114048 - DNA, 188 bp, Homo sapiens; identical to SEQ ID NO: 81330
  misc_feature 1..188: note = chr17:79099741-79099929
  misc_feature 1..188: note = Hypo
  source 1..188: mol_type = genomic DNA

SEQ ID NO: 114049 - DNA, 75 bp, Homo sapiens; identical to SEQ ID NO: 45259
  misc_feature 1..75: note = chr17:79100184-79100259
  misc_feature 1..75: note = Hypo
  source 1..75: mol_type = genomic DNA

SEQ ID NO: 114050 - DNA, 352 bp, Homo sapiens; identical to SEQ ID NO: 81332
  misc_feature 1..352: note = chr17:79104807-79105159
  misc_feature 1..352: note = Hypo
  source 1..352: mol_type = genomic DNA

SEQ ID NO: 114051 - DNA, 30 bp, Homo sapiens; identical to SEQ ID NO: 16265
  misc_feature 1..30: note = chr17:79107633-79107663
  misc_feature 1..30: note = Hypo
  source 1..30: mol_type = genomic DNA

SEQ ID NO: 114052 - DNA, 84 bp, Homo sapiens; identical to SEQ ID NO: 81334
  misc_feature 1..84: note = chr17:79127888-79127972
  misc_feature 1..84: note = Hypo
  source 1..84: mol_type = genomic DNA

SEQ ID NO: 114053 - DNA, 30 bp, Homo sapiens; identical to SEQ ID NO: 81335
  misc_feature 1..30: note = chr17:79130785-79130815
  misc_feature 1..30: note = Hypo
  source 1..30: mol_type = genomic DNA

SEQ ID NO: 114054 - DNA, 141 bp, Homo sapiens; identical to SEQ ID NO: 81336
  misc_feature 1..141: note = chr17:79131533-79131674
  misc_feature 1..141: note = Hypo
  source 1..141: mol_type = genomic DNA

SEQ ID NO: 114055 - DNA, 30 bp, Homo sapiens; identical to SEQ ID NO: 81337
  misc_feature 1..30: note = chr17:79133024-79133054
  misc_feature 1..30: note = Hypo
  source 1..30: mol_type = genomic DNA

SEQ ID NO: 114056 - DNA, 256 bp, Homo sapiens; identical to SEQ ID NO: 81338
  misc_feature 1..256: note = chr17:79139708-79139964
  misc_feature 1..256: note = Hyper
  source 1..256: mol_type = genomic DNA

SEQ ID NO: 114057 - DNA, 105 bp, Homo sapiens; identical to SEQ ID NO: 81339
  misc_feature 1..105: note = chr17:79155470-79155575
  misc_feature 1..105: note = Hypo
  source 1..105: mol_type = genomic DNA

SEQ ID NO: 114058 - DNA, 168 bp, Homo sapiens; identical to SEQ ID NO: 81340
  misc_feature 1..168: note = chr17:79158112-79158280
  misc_feature 1..168: note = Hypo
  source 1..168: mol_type = genomic DNA

SEQ ID NO: 114059 - DNA, 256 bp, Homo sapiens; identical to SEQ ID NO: 81341
  misc_feature 1..256: note = chr17:79166315-79166571
  misc_feature 1..256: note = Hypo
  source 1..256: mol_type = genomic DNA

SEQ ID NO: 114060 - DNA, 30 bp, Homo sapiens; identical to SEQ ID NO: 81342
  misc_feature 1..30: note = chr17:79178454-79178484
  misc_feature 1..30: note = Hypo
  source 1..30: mol_type = genomic DNA

SEQ ID NO: 114061 - DNA, 40 bp, Homo sapiens; identical to SEQ ID NO: 81344
  misc_feature 1..40: note = chr17:79197382-79197422
  misc_feature 1..40: note = Hyper
  source 1..40: mol_type = genomic DNA

SEQ ID NO: 114062 - DNA, 212 bp, Homo sapiens; identical to SEQ ID NO: 81345
  misc_feature 1..212: note = chr17:79205207-79205419
  misc_feature 1..212: note = Hypo
  source 1..212: mol_type = genomic DNA

SEQ ID NO: 114063 - DNA, 125 bp, Homo sapiens; identical to SEQ ID NO: 45263
  misc_feature 1..125: note = chr17:79211706-79211831
  misc_feature 1..125: note = Hypo
  source 1..125: mol_type = genomic DNA

SEQ ID NO: 114064 - DNA, 30 bp, Homo sapiens; identical to SEQ ID NO: 81347
  misc_feature 1..30: note = chr17:79220179-79220209
  misc_feature 1..30: note = Hypo
  source 1..30: mol_type = genomic DNA

SEQ ID NO: 114065 - DNA, 30 bp, Homo sapiens; identical to SEQ ID NO: 81348
  misc_feature 1..30: note = chr17:79220690-79220720
  misc_feature 1..30: note = Hypo
  source 1..30: mol_type = genomic DNA

SEQ ID NO: 114066 - DNA, 30 bp, Homo sapiens; identical to SEQ ID NO: 45264
  misc_feature 1..30: note = chr17:79226304-79226334
  misc_feature 1..30: note = Hypo
  source 1..30: mol_type = genomic DNA

SEQ ID NO: 114067 - DNA, 39 bp, Homo sapiens; identical to SEQ ID NO: 81350
  misc_feature 1..39: note = chr17:79257246-79257285
  misc_feature 1..39: note = Hypo
  source 1..39: mol_type = genomic DNA

SEQ ID NO: 114068 - DNA, 18 bp, Homo sapiens
  misc_feature 1..18: note = chr17:79292579-79292597
  misc_feature 1..18: note = Hypo
  source 1..18: mol_type = genomic DNA
ggccgggcatggtggcgg

SEQ ID NO: 114069 - DNA, 77 bp, Homo sapiens; identical to SEQ ID NO: 81352
  misc_feature 1..77: note = chr17:79292717-79292794
  misc_feature 1..77: note = Hypo
  source 1..77: mol_type = genomic DNA

SEQ ID NO: 114070 - DNA, 38 bp, Homo sapiens; identical to SEQ ID NO: 81353
  misc_feature 1..38: note = chr17:79309612-79309650
  misc_feature 1..38: note = Hypo
  source 1..38: mol_type = genomic DNA

SEQ ID NO: 114071 - DNA, 390 bp, Homo sapiens; identical to SEQ ID NO: 81354
  misc_feature 1..390: note = chr17:79316623-79317013
  misc_feature 1..390: note = Hyper
  source 1..390: mol_type = genomic DNA

SEQ ID NO: 114072 - DNA, 94 bp, Homo sapiens; identical to SEQ ID NO: 81355
  misc_feature 1..94: note = chr17:79317370-79317464
  misc_feature 1..94: note = Hyper
  source 1..94: mol_type = genomic DNA

SEQ ID NO: 114073 - DNA, 57 bp, Homo sapiens; identical to SEQ ID NO: 36829
  misc_feature 1..57: note = chr17:79317833-79317890
  misc_feature 1..57: note = Hyper
  source 1..57: mol_type = genomic DNA

SEQ ID NO: 114074 - DNA, 36 bp, Homo sapiens; identical to SEQ ID NO: 81357
  misc_feature 1..36: note = chr17:79318173-79318209
  misc_feature 1..36: note = Hyper
  source 1..36: mol_type = genomic DNA

SEQ ID NO: 114075 - DNA, 41 bp, Homo sapiens; identical to SEQ ID NO: 81358
  misc_feature 1..41: note = chr17:79505417-79505458
  misc_feature 1..41: note = Hypo
  source 1..41: mol_type = genomic DNA

SEQ ID NO: 114076 - DNA, 221 bp, Homo sapiens; identical to SEQ ID NO: 81359
  misc_feature 1..221: note = chr17:79544089-79544310
  misc_feature 1..221: note = Hypo
  source 1..221: mol_type = genomic DNA

SEQ ID NO: 114077 - DNA, 161 bp, Homo sapiens; identical to SEQ ID NO: 81360
  misc_feature 1..161: note = chr17:79609256-79609417
  misc_feature 1..161: note = Hypo
  source 1..161: mol_type = genomic DNA

SEQ ID NO: 114078 - DNA, 48 bp, Homo sapiens; identical to SEQ ID NO: 81361
  misc_feature 1..48: note = chr17:79612764-79612812
  misc_feature 1..48: note = Hypo
  source 1..48: mol_type = genomic DNA

SEQ ID NO: 114079 - DNA, 360 bp, Homo sapiens
  misc_feature 1..360: note = chr17:79615102-79615462
  misc_feature 1..360: note = Hyper
  source 1..360: mol_type = genomic DNA
ctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctaccca

SEQ ID NO: 114080 - DNA, 256 bp, Homo sapiens; identical to SEQ ID NO: 81364
  misc_feature 1..256: note = chr17:79619054-79619310
  misc_feature 1..256: note = Hypo
  source 1..256: mol_type = genomic DNA

SEQ ID NO: 114081 - DNA, 104 bp, Homo sapiens; identical to SEQ ID NO: 81365
  misc_feature 1..104: note = chr17:79626311-79626415
  misc_feature 1..104: note = Hypo
  source 1..104: mol_type = genomic DNA

SEQ ID NO: 114082 - DNA, 104 bp, Homo sapiens; identical to SEQ ID NO: 81366
  misc_feature 1..104: note = chr17:79626655-79626759
  misc_feature 1..104: note = Hypo
  source 1..104: mol_type = genomic DNA

SEQ ID NO: 114083 - DNA, 82 bp, Homo sapiens; identical to SEQ ID NO: 81367
  misc_feature 1..82: note = chr17:79634674-79634756
  misc_feature 1..82: note = Hypo
  source 1..82: mol_type = genomic DNA

SEQ ID NO: 114084 - DNA, 30 bp, Homo sapiens; identical to SEQ ID NO: 81368
  misc_feature 1..30: note = chr17:79635057-79635087
  misc_feature 1..30: note = Hypo
  source 1..30: mol_type = genomic DNA

SEQ ID NO: 114085 - DNA, 30 bp, Homo sapiens; identical to SEQ ID NO: 45271
  misc_feature 1..30: note = chr17:79643888-79643918
  misc_feature 1..30: note = Hypo
  source 1..30: mol_type = genomic DNA

SEQ ID NO: 114086 - DNA, 37 bp, Homo sapiens; identical to SEQ ID NO: 81370
  misc_feature 1..37: note = chr17:79663023-79663060
  misc_feature 1..37: note = Hypo
  source 1..37: mol_type = genomic DNA

SEQ ID NO: 114087 - DNA, 87 bp, Homo sapiens; identical to SEQ ID NO: 81371
  misc_feature 1..87: note = chr17:79668241-79668328
  misc_feature 1..87: note = Hypo
  source 1..87: mol_type = genomic DNA

SEQ ID NO: 114088 - DNA, 145 bp, Homo sapiens; identical to SEQ ID NO: 45272
  misc_feature 1..145: note = chr17:79668589-79668734
  misc_feature 1..145: note = Hypo
  source 1..145: mol_type = genomic DNA

SEQ ID NO: 114089 - DNA, 226 bp, Homo sapiens; identical to SEQ ID NO: 81373
  misc_feature 1..226: note = chr17:79677781-79678007
  misc_feature 1..226: note = Hyper
  source 1..226: mol_type = genomic DNA

SEQ ID NO: 114090 - DNA, 30 bp, Homo sapiens; identical to SEQ ID NO: 81374
  misc_feature 1..30: note = chr17:79691709-79691739
  misc_feature 1..30: note = Hypo
  source 1..30: mol_type = genomic DNA

SEQ ID NO: 114091 - DNA, 36 bp, Homo sapiens; identical to SEQ ID NO: 81375
  misc_feature 1..36: note = chr17:79695465-79695501
  misc_feature 1..36: note = Hypo
  source 1..36: mol_type = genomic DNA

SEQ ID NO: 114092 - DNA, 1087 bp, Homo sapiens
  misc_feature 1..1087: note = chr17:79761585-79762672
  misc_feature 1..1087: note = Hyper
  source 1..1087: mol_type = genomic DNA
aagggggcgagggggcgcccagggaggcggagggagcgagaggaaggggggctgagccacggcccccacgcccgcgcgcccctccgcgtcccagggcgtcccctcccggagctgggacccaccgcgaccaccacctgctgggccagggtccgcgggctcaggggtctgcaggattagggtctgcggaaccaggacccgtgggacaaaggtctgtggggcgcgggtccgcggggtggaattcagcgcgccgagtctgcgtatggccggggtacgaggcgctccctgcgcagggtgggcaggaccgaagctcgccgggaggctgcgcggagggcgggcggggaccctcggctgccgctcccacccccgcggggccgcccccgagcccgccctccgccgccgccctcgccctgcgtcgccgccggaaagtttgcaccgaccccgatctggcagcgccgcgaagacgagcggtcaccggcgcccgacccgagcgcgcccagaggacggcggggagccaagccgacccccgagcagcgccgcgcggtgagcacctgggccgcggccccgaggggacgttggggagtcgacccggtggggacagagaccgcggggcgggcgcggcggggccgggggcgcggggagcggggagccggccgggcggtctccggggtccgggctggtgcgctcctcagtcccgtcagacacccccgttcccaaccccggctcggacaccacccggtcctgcaccgtcgggcaggtccaggggtctcagcccctcccccgttctctggtcctggggggcgcggctgggggcgggggtgtcgctggccgcctggcgccctgcggcggccacactgcagcggccacactccccactcagggccccgggccccgccgccctggggagcgcacaaagcgccgcggacgcgtccccgaggcgcggggtctcaccagcgctgtctcccctcggtgggctcctgccccgaggactgcccggtggcaccggcgcggcccaggatggggtgaggggtgtctgcgccccgcctggccgctcctcttccgcggcccacactggcgactttgaccccgg

SEQ ID NO: 114093 - DNA, 455 bp, Homo sapiens; identical to SEQ ID NO: 81379
  misc_feature 1..455: note = chr17:79769238-79769693
  misc_feature 1..455: note = Hypo
  source 1..455: mol_type = genomic DNA

SEQ ID NO: 114094 - DNA, 95 bp, Homo sapiens; identical to SEQ ID NO: 81380
  misc_feature 1..95: note = chr17:79774960-79775055
  misc_feature 1..95: note = Hypo
  source 1..95: mol_type = genomic DNA

SEQ ID NO: 114095 - DNA, 52 bp, Homo sapiens; identical to SEQ ID NO: 81382
  misc_feature 1..52: note = chr17:79826977-79827029
  misc_feature 1..52: note = Hypo
  source 1..52: mol_type = genomic DNA

SEQ ID NO: 114096 - DNA, 34 bp, Homo sapiens; identical to SEQ ID NO: 81383
  misc_feature 1..34: note = chr17:79847763-79847797
  misc_feature 1..34: note = Hypo
  source 1..34: mol_type = genomic DNA

SEQ ID NO: 114097 - DNA, 30 bp, Homo sapiens
  misc_feature 1..30: note = chr17:79856558-79856588
  misc_feature 1..30: note = Hypo
  source 1..30: mol_type = genomic DNA
acaatgagtccatcccgcatcccaggggac

SEQ ID NO: 114098 - DNA, 751 bp, Homo sapiens; identical to SEQ ID NO: 81384
  misc_feature 1..751: note = chr17:79859940-79860691
  misc_feature 1..751: note = Hyper
  source 1..751: mol_type = genomic DNA

SEQ ID NO: 114099 - DNA, 147 bp, Homo sapiens; identical to SEQ ID NO: 81385
  misc_feature 1..147: note = chr17:79870402-79870549
  misc_feature 1..147: note = Hypo
  source 1..147: mol_type = genomic DNA

SEQ ID NO: 114100 - DNA, 391 bp, Homo sapiens; identical to SEQ ID NO: 81386
  misc_feature 1..391: note = chr17:79874636-79875027
  misc_feature 1..391: note = Hypo
  source 1..391: mol_type = genomic DNA

SEQ ID NO: 114101 - DNA, 58 bp, Homo sapiens; identical to SEQ ID NO: 81387
  misc_feature 1..58: note = chr17:79886467-79886525
  misc_feature 1..58: note = Hyper
  source 1..58: mol_type = genomic DNA

SEQ ID NO: 114102 - DNA, 30 bp, Homo sapiens; identical to SEQ ID NO: 81388
  misc_feature 1..30: note = chr17:79887265-79887295
  misc_feature 1..30: note = Hypo
  source 1..30: mol_type = genomic DNA

SEQ ID NO: 114103 - DNA, 259 bp, Homo sapiens; identical to SEQ ID NO: 81389
  misc_feature 1..259: note = chr17:79887590-79887849
  misc_feature 1..259: note = Hypo
  source 1..259: mol_type = genomic DNA

SEQ ID NO: 114104 - DNA, 77 bp, Homo sapiens; identical to SEQ ID NO: 81390
  misc_feature 1..77: note = chr17:79892813-79892890
  misc_feature 1..77: note = Hypo
  source 1..77: mol_type = genomic DNA

SEQ ID NO: 114105 - DNA, 97 bp, Homo sapiens; identical to SEQ ID NO: 81391
  misc_feature 1..97: note = chr17:79899293-79899390
  misc_feature 1..97: note = Hypo
  source 1..97: mol_type = genomic DNA

SEQ ID NO: 114106 - DNA, 23 bp, Homo sapiens
  misc_feature 1..23: note = chr17:79913143-79913166
  misc_feature 1..23: note = Hypo
  source 1..23: mol_type = genomic DNA
actgcgcccggcctacaagacct

SEQ ID NO: 114107 - DNA, 30 bp, Homo sapiens; identical to SEQ ID NO: 81393
  misc_feature 1..30: note = chr17:79913444-79913474
  misc_feature 1..30: note = Hypo
  source 1..30: mol_type = genomic DNA

SEQ ID NO: 114108 - DNA, 197 bp, Homo sapiens; identical to SEQ ID NO: 81394
  misc_feature 1..197: note = chr17:79914766-79914963
  misc_feature 1..197: note = Hypo
  source 1..197: mol_type = genomic DNA

SEQ ID NO: 114109 - DNA, 66 bp, Homo sapiens; identical to SEQ ID NO: 81395
  misc_feature 1..66: note = chr17:79917369-79917435
  misc_feature 1..66: note = Hyper
  source 1..66: mol_type = genomic DNA

SEQ ID NO: 114110 - DNA, 140 bp, Homo sapiens; identical to SEQ ID NO: 81396
  misc_feature 1..140: note = chr17:79918501-79918641
  misc_feature 1..140: note = Hyper
  source 1..140: mol_type = genomic DNA

SEQ ID NO: 114111 - DNA, 30 bp, Homo sapiens; identical to SEQ ID NO: 81397
  misc_feature 1..30: note = chr17:79926633-79926663
  misc_feature 1..30: note = Hypo
  source 1..30: mol_type = genomic DNA

SEQ ID NO: 114112 - DNA, 87 bp, Homo sapiens; identical to SEQ ID NO: 81398
  misc_feature 1..87: note = chr17:79950224-79950311
  misc_feature 1..87: note = Hypo
  source 1..87: mol_type = genomic DNA

SEQ ID NO: 114113 - DNA, 30 bp, Homo sapiens; identical to SEQ ID NO: 81399
  misc_feature 1..30: note = chr17:79952351-79952381
  misc_feature 1..30: note = Hypo
  source 1..30: mol_type = genomic DNA

SEQ ID NO: 114114 - DNA, 76 bp, Homo sapiens; identical to SEQ ID NO: 81401
  misc_feature 1..76: note = chr17:79973168-79973244
  misc_feature 1..76: note = Hypo
  source 1..76: mol_type = genomic DNA

SEQ ID NO: 114115 - DNA, 30 bp, Homo sapiens; identical to SEQ ID NO: 81402
  misc_feature 1..30: note = chr17:79977416-79977446
  misc_feature 1..30: note = Hypo
  source 1..30: mol_type = genomic DNA

SEQ ID NO: 114116 - DNA, 30 bp, Homo sapiens; identical to SEQ ID NO: 81403
  misc_feature 1..30: note = chr17:79982080-79982110
  misc_feature 1..30: note = Hypo
  source 1..30: mol_type = genomic DNA

SEQ ID NO: 114117 - DNA, 54 bp, Homo sapiens; identical to SEQ ID NO: 81404
  misc_feature 1..54: note = chr17:79987004-79987058
  misc_feature 1..54: note = Hypo
  source 1..54: mol_type = genomic DNA

SEQ ID NO: 114118 - DNA, 622 bp, Homo sapiens; identical to SEQ ID NO: 81405
  misc_feature 1..622: note = chr17:79988475-79989097
  misc_feature 1..622: note = Hyper
  source 1..622: mol_type = genomic DNA

SEQ ID NO: 114119 - DNA, 30 bp, Homo sapiens; identical to SEQ ID NO: 45281
  misc_feature 1..30: note = chr17:80163670-80163700
  misc_feature 1..30: note = Hypo
  source 1..30: mol_type = genomic DNA

SEQ ID NO: 114120 - DNA, 63 bp, Homo sapiens; identical to SEQ ID NO: 81407
  misc_feature 1..63: note = chr17:80186555-80186618
  misc_feature 1..63: note = Hyper
  source 1..63: mol_type = genomic DNA

SEQ ID NO: 114121 - DNA, 231 bp, Homo sapiens; identical to SEQ ID NO: 81408
  misc_feature 1..231: note = chr17:80188720-80188951
  misc_feature 1..231: note = Hyper
  source 1..231: mol_type = genomic DNA

SEQ ID NO: 114122 - DNA, 30 bp, Homo sapiens; identical to SEQ ID NO: 81409
  misc_feature 1..30: note = chr17:80192672-80192702
  misc_feature 1..30: note = Hypo
  source 1..30: mol_type = genomic DNA

SEQ ID NO: 114123 - DNA, 30 bp, Homo sapiens; identical to SEQ ID NO: 81410
  misc_feature 1..30: note = chr17:80193470-80193500
  misc_feature 1..30: note = Hypo
  source 1..30: mol_type = genomic DNA

SEQ ID NO: 114124 - DNA, 157 bp, Homo sapiens; identical to SEQ ID NO: 81411
  misc_feature 1..157: note = chr17:80194730-80194887
  misc_feature 1..157: note = Hypo
  source 1..157: mol_type = genomic DNA

SEQ ID NO: 114125 - DNA, 30 bp, Homo sapiens; identical to SEQ ID NO: 45282
  misc_feature 1..30: note = chr17:80201941-80201971
  misc_feature 1..30: note = Hypo
  source 1..30: mol_type = genomic DNA

SEQ ID NO: 114126 - DNA, 30 bp, Homo sapiens; identical to SEQ ID NO: 81414
  misc_feature 1..30: note = chr17:80222132-80222162
  misc_feature 1..30: note = Hypo
  source 1..30: mol_type = genomic DNA

SEQ ID NO: 114127 - DNA, 90 bp, Homo sapiens; identical to SEQ ID NO: 81415
  misc_feature 1..90: note = chr17:80229870-80229960
  misc_feature 1..90: note = Hypo
  source 1..90: mol_type = genomic DNA

SEQ ID NO: 114128 - DNA, 29 bp, Homo sapiens
  misc_feature 1..29: note = chr17:80230200-80230229
  misc_feature 1..29: note = Hypo
  source 1..29: mol_type = genomic DNA
caagagcgaaactccgtctcaggaaaaaa

SEQ ID NO: 114129 - DNA, 252 bp, Homo sapiens; identical to SEQ ID NO: 81417
  misc_feature 1..252: note = chr17:80240815-80241067
  misc_feature 1..252: note = Hypo
  source 1..252: mol_type = genomic DNA

SEQ ID NO: 114130 - DNA, 46 bp, Homo sapiens; identical to SEQ ID NO: 81418
  misc_feature 1..46: note = chr17:80246775-80246821
  misc_feature 1..46: note = Hypo
  source 1..46: mol_type = genomic DNA

SEQ ID NO: 114131 - DNA, 99 bp, Homo sapiens; identical to SEQ ID NO: 81419
  misc_feature 1..99: note = chr17:80251905-80252004
  misc_feature 1..99: note = Hypo
  source 1..99: mol_type = genomic DNA

SEQ ID NO: 114132 - DNA, 259 bp, Homo sapiens; identical to SEQ ID NO: 81420
  misc_feature 1..259: note = chr17:80254257-80254516
  misc_feature 1..259: note = Hypo
  source 1..259: mol_type = genomic DNA

SEQ ID NO: 114133 - DNA, 30 bp, Homo sapiens; identical to SEQ ID NO: 81421
  misc_feature 1..30: note = chr17:80268179-80268209
  misc_feature 1..30: note = Hypo
  source 1..30: mol_type = genomic DNA

SEQ ID NO: 114134 - DNA, 30 bp, Homo sapiens; identical to SEQ ID NO: 81422
  misc_feature 1..30: note = chr17:80272271-80272301
  misc_feature 1..30: note = Hypo
  source 1..30: mol_type = genomic DNA

SEQ ID NO: 114135 - DNA, 63 bp, Homo sapiens; identical to SEQ ID NO: 81423
  misc_feature 1..63: note = chr17:80274115-80274178
  misc_feature 1..63: note = Hyper
  source 1..63: mol_type = genomic DNA

SEQ ID NO: 114136 - DNA, 35 bp, Homo sapiens; identical to SEQ ID NO: 81424
  misc_feature 1..35: note = chr17:80277765-80277800
  misc_feature 1..35: note = Hypo
  source 1..35: mol_type = genomic DNA

SEQ ID NO: 114137 - DNA, 80 bp, Homo sapiens; identical to SEQ ID NO: 81426
  misc_feature 1..80: note = chr17:80281051-80281131
  misc_feature 1..80: note = Hypo
  source 1..80: mol_type = genomic DNA

SEQ ID NO: 114138 - DNA, 156 bp, Homo sapiens; identical to SEQ ID NO: 81427
  misc_feature 1..156: note = chr17:80287972-80288128
  misc_feature 1..156: note = Hypo
  source 1..156: mol_type = genomic DNA

SEQ ID NO: 114139 - DNA, 497 bp, Homo sapiens; identical to SEQ ID NO: 81428
  misc_feature 1..497: note = chr17:80289234-80289731
  misc_feature 1..497: note = Hypo
  source 1..497: mol_type = genomic DNA

SEQ ID NO: 114140 - DNA, 76 bp, Homo sapiens; identical to SEQ ID NO: 81429
  misc_feature 1..76: note = chr17:80290031-80290107
  misc_feature 1..76: note = Hypo
  source 1..76: mol_type = genomic DNA

SEQ ID NO: 114141 - DNA, 43 bp, Homo sapiens; identical to SEQ ID NO: 81430
  misc_feature 1..43: note = chr17:80291659-80291702
  misc_feature 1..43: note = Hyper
  source 1..43: mol_type = genomic DNA

SEQ ID NO: 114142 - DNA, 30 bp, Homo sapiens; identical to SEQ ID NO: 81431
  misc_feature 1..30: note = chr17:80294443-80294473
  misc_feature 1..30: note = Hypo
  source 1..30: mol_type = genomic DNA

SEQ ID NO: 114143 - DNA, 135 bp, Homo sapiens; identical to SEQ ID NO: 45289
  misc_feature 1..135: note = chr17:80300182-80300317
  misc_feature 1..135: note = Hypo
  source 1..135: mol_type = genomic DNA

SEQ ID NO: 114144 - DNA, 970 bp, Homo sapiens
  misc_feature 1..970: note = chr17:80329251-80330221
  misc_feature 1..970: note = Hyper
  source 1..970: mol_type = genomic DNA
tttctatgaccctctcggggtttaggggtgttcctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctttggtggcgggactggcgggcgcccctgccgtgtgctctggaagccgaggccaccgcggagcccctcgcgccccctctgcgctgggacaggggagcgcgcctcggaaagttccccgcggccccgctgcgcgaggagtttggagccgcgagcggctgcccccacgcgcgaccccaggctcggcgggcaggtctggccgctcagtgaccggaggcaggtgggtcctcggtgggtgaccgggagcgcgcggggactgccgggtctgtgcccttcggggccctccgcagggctgggccggggtttcgcggtgggaacccaccctgggcgaggggagcggggtccagcgaggcggcttctcccgtgccgtggaactttcggcccctccccttcccccctagcgaccctggagcaatcctagcggcccggcggccgctgtccccctgcccgtgactcgggctcgcgcacaactggggagcccggtgcaccctcggcttctgcgccgtcccctgggtgag

SEQ ID NO: 114145 - DNA, 43 bp, Homo sapiens; identical to SEQ ID NO: 81435
  misc_feature 1..43: note = chr17:80332249-80332292
  misc_feature 1..43: note = Hypo
  source 1..43: mol_type = genomic DNA

SEQ ID NO: 114146 - DNA, 233 bp, Homo sapiens
  misc_feature 1..233: note = chr17:80333050-80333283
  misc_feature 1..233: note = Hyper
  source 1..233: mol_type = genomic DNA
accaggccccgctggcgccgcggacggcgcgcatcgtcaactacctgaccacctgcctcacctacggcaacagctgcgccaaccccttcctctacacgctgctcaccaggaactaccgcgaccacctgcgcggccgcgtgcggggcccgggcagcgggggaggccgggggcccgttccctccctgcagccccgcgcccgcttccagcgctgttcgggccgctccctgtcttcc

SEQ ID NO: 114147 - DNA, 30 bp, Homo sapiens; identical to SEQ ID NO: 81437
  misc_feature 1..30: note = chr17:80336816-80336846
  misc_feature 1..30: note = Hypo
  source 1..30: mol_type = genomic DNA

SEQ ID NO: 114148 - DNA, 151 bp, Homo sapiens; identical to SEQ ID NO: 45290
  misc_feature 1..151: note = chr17:80338743-80338894
  misc_feature 1..151: note = Hypo
  source 1..151: mol_type = genomic DNA

SEQ ID NO: 114149 - DNA, 30 bp, Homo sapiens; identical to SEQ ID NO: 81439
  misc_feature 1..30: note = chr17:80344822-80344852
  misc_feature 1..30: note = Hypo
  source 1..30: mol_type = genomic DNA

SEQ ID NO: 114150 - DNA, 49 bp, Homo sapiens; identical to SEQ ID NO: 81440
  misc_feature 1..49: note = chr17:80394753-80394802
  misc_feature 1..49: note = Hypo
  source 1..49: mol_type = genomic DNA

SEQ ID NO: 114151 - DNA, 46 bp, Homo sapiens; identical to SEQ ID NO: 81441
  misc_feature 1..46: note = chr17:80395100-80395146
  misc_feature 1..46: note = Hypo
  source 1..46: mol_type = genomic DNA

SEQ ID NO: 114152 - DNA, 216 bp, Homo sapiens; identical to SEQ ID NO: 81442
  misc_feature 1..216: note = chr17:80447977-80448193
  misc_feature 1..216: note = Hypo
  source 1..216: mol_type = genomic DNA

SEQ ID NO: 114153 - DNA, 53 bp, Homo sapiens; identical to SEQ ID NO: 81443
  misc_feature 1..53: note = chr17:80448677-80448730
  misc_feature 1..53: note = Hypo
  source 1..53: mol_type = genomic DNA

SEQ ID NO: 114154 - DNA, 30 bp, Homo sapiens; identical to SEQ ID NO: 81444
  misc_feature 1..30: note = chr17:80453489-80453519
  misc_feature 1..30: note = Hypo
  source 1..30: mol_type = genomic DNA

SEQ ID NO: 114155 - DNA, 30 bp, Homo sapiens; identical to SEQ ID NO: 81445
  misc_feature 1..30: note = chr17:80453917-80453947
  misc_feature 1..30: note = Hypo
  source 1..30: mol_type = genomic DNA

SEQ ID NO: 114156 - DNA, 56 bp, Homo sapiens; identical to SEQ ID NO: 81446
  misc_feature 1..56: note = chr17:80455848-80455904
  misc_feature 1..56: note = Hyper
  source 1..56: mol_type = genomic DNA

SEQ ID NO: 114157 - DNA, 180 bp, Homo sapiens; identical to SEQ ID NO: 81447
  misc_feature 1..180: note = chr17:80479365-80479545
  misc_feature 1..180: note = Hypo
  source 1..180: mol_type = genomic DNA

SEQ ID NO: 114158 - DNA, 32 bp, Homo sapiens; identical to SEQ ID NO: 81448
  misc_feature 1..32: note = chr17:80485937-80485969
  misc_feature 1..32: note = Hypo
  source 1..32: mol_type = genomic DNA

SEQ ID NO: 114159 - DNA, 30 bp, Homo sapiens; identical to SEQ ID NO: 81449
  misc_feature 1..30: note = chr17:80517466-80517496
  misc_feature 1..30: note = Hypo
  source 1..30: mol_type = genomic DNA

SEQ ID NO: 114160 - DNA, 84 bp, Homo sapiens; identical to SEQ ID NO: 81450
  misc_feature 1..84: note = chr17:80518273-80518357
  misc_feature 1..84: note = Hypo
  source 1..84: mol_type = genomic DNA

SEQ ID NO: 114161 - DNA, 30 bp, Homo sapiens; identical to SEQ ID NO: 81451
  misc_feature 1..30: note = chr17:80526057-80526087
  misc_feature 1..30: note = Hypo
  source 1..30: mol_type = genomic DNA

SEQ ID NO: 114162 - DNA, 64 bp, Homo sapiens; identical to SEQ ID NO: 81452
  misc_feature 1..64: note = chr17:80535317-80535381
  misc_feature 1..64: note = Hypo
  source 1..64: mol_type = genomic DNA

SEQ ID NO: 114163 - DNA, 75 bp, Homo sapiens; identical to SEQ ID NO: 81454
  misc_feature 1..75: note = chr17:80572274-80572349
  misc_feature 1..75: note = Hypo
  source 1..75: mol_type = genomic DNA

SEQ ID NO: 114164 - DNA, 95 bp, Homo sapiens; identical to SEQ ID NO: 81455
  misc_feature 1..95: note = chr17:80603615-80603710
  misc_feature 1..95: note = Hypo
  source 1..95: mol_type = genomic DNA

SEQ ID NO: 114165 - DNA, 444 bp, Homo sapiens; identical to SEQ ID NO: 81456
  misc_feature 1..444: note = chr17:80654726-80655170
  misc_feature 1..444: note = Hypo
  source 1..444: mol_type = genomic DNA

SEQ ID NO: 114166 - DNA, 222 bp, Homo sapiens; identical to SEQ ID NO: 81457
  misc_feature 1..222: note = chr17:80655505-80655727
  misc_feature 1..222: note = Hyper
  source 1..222: mol_type = genomic DNA

SEQ ID NO: 114167 - DNA, 47 bp, Homo sapiens; identical to SEQ ID NO: 81458
  misc_feature 1..47: note = chr17:80657047-80657094
  misc_feature 1..47: note = Hyper
  source 1..47: mol_type = genomic DNA

SEQ ID NO: 114168 - DNA, 21 bp, Homo sapiens
  misc_feature 1..21: note = chr17:80659786-80659807
  misc_feature 1..21: note = Hypo
  source 1..21: mol_type = genomic DNA
agactccgtctcaaaaaaaaa

SEQ ID NO: 114169 - DNA, 30 bp, Homo sapiens; identical to SEQ ID NO: 81460
  misc_feature 1..30: note = chr17:80661495-80661525
  misc_feature 1..30: note = Hypo
  source 1..30: mol_type = genomic DNA

SEQ ID NO: 114170 - DNA, 30 bp, Homo sapiens; identical to SEQ ID NO: 81461
  misc_feature 1..30: note = chr17:80673406-80673436
  misc_feature 1..30: note = Hypo
  source 1..30: mol_type = genomic DNA

SEQ ID NO: 114171 - DNA, 20 bp, Homo sapiens
  misc_feature 1..20: note = chr17:80692466-80692486
  misc_feature 1..20: note = Hypo
  source 1..20: mol_type = genomic DNA
aacctcatgcatggccgggc

SEQ ID NO: 114172 - DNA, 80 bp, Homo sapiens; identical to SEQ ID NO: 81463
  misc_feature 1..80: note = chr17:80692846-80692926
  misc_feature 1..80: note = Hypo
  source 1..80: mol_type = genomic DNA

SEQ ID NO: 114173 - DNA, 76 bp, Homo sapiens; identical to SEQ ID NO: 81464
  misc_feature 1..76: note = chr17:80693424-80693500
  misc_feature 1..76: note = Hyper
  source 1..76: mol_type = genomic DNA

SEQ ID NO: 114174 - DNA, 35 bp, Homo sapiens; identical to SEQ ID NO: 81465
  misc_feature 1..35: note = chr17:80712937-80712972
  misc_feature 1..35: note = Hypo
  source 1..35: mol_type = genomic DNA

SEQ ID NO: 114175 - DNA, 44 bp, Homo sapiens; identical to SEQ ID NO: 81466
  misc_feature 1..44: note = chr17:80744257-80744301
  misc_feature 1..44: note = Hypo
  source 1..44: mol_type = genomic DNA

SEQ ID NO: 114176 - DNA, 232 bp, Homo sapiens; identical to SEQ ID NO: 81467
  misc_feature 1..232: note = chr17:80747022-80747254
  misc_feature 1..232: note = Hypo
  source 1..232: mol_type = genomic DNA

SEQ ID NO: 114177 - DNA, 74 bp, Homo sapiens; identical to SEQ ID NO: 81468
  misc_feature 1..74: note = chr17:80747816-80747890
  misc_feature 1..74: note = Hypo
  source 1..74: mol_type = genomic DNA

SEQ ID NO: 114178 - DNA, 69 bp, Homo sapiens; identical to SEQ ID NO: 81470
  misc_feature 1..69: note = chr17:80772872-80772941
  misc_feature 1..69: note = Hypo
  source 1..69: mol_type = genomic DNA

SEQ ID NO: 114179 - DNA, 1155 bp, Homo sapiens; identical to SEQ ID NO: 81471
  misc_feature 1..1155: note = chr17:80797664-80798819
  misc_feature 1..1155: note = Hypo
  source 1..1155: mol_type = genomic DNA

SEQ ID NO: 114180 - DNA, 30 bp, Homo sapiens; identical to SEQ ID NO: 81472
  misc_feature 1..30: note = chr17:80820683-80820713
  misc_feature 1..30: note = Hypo
  source 1..30: mol_type = genomic DNA

SEQ ID NO: 114181 - DNA, 593 bp, Homo sapiens; identical to SEQ ID NO: 81473
  misc_feature 1..593: note = chr17:80832203-80832796
  misc_feature 1..593: note = Hypo
  source 1..593: mol_type = genomic DNA

SEQ ID NO: 114182 - DNA, 36 bp, Homo sapiens; identical to SEQ ID NO: 81474
  misc_feature 1..36: note = chr17:80847858-80847894
  misc_feature 1..36: note = Hypo
  source 1..36: mol_type = genomic DNA

SEQ ID NO: 114183 - DNA, 38 bp, Homo sapiens; identical to SEQ ID NO: 81475
  misc_feature 1..38: note = chr17:80859827-80859865
  misc_feature 1..38: note = Hypo
  source 1..38: mol_type = genomic DNA

SEQ ID NO: 114184 - DNA, 30 bp, Homo sapiens; identical to SEQ ID NO: 81476
  misc_feature 1..30: note = chr17:80879262-80879292
  misc_feature 1..30: note = Hypo
  source 1..30: mol_type = genomic DNA

SEQ ID NO: 114185 - DNA, 41 bp, Homo sapiens; identical to SEQ ID NO: 81477
  misc_feature 1..41: note = chr17:80879980-80880021
  misc_feature 1..41: note = Hypo
  source 1..41: mol_type = genomic DNA

SEQ ID NO: 114186 - DNA, 95 bp, Homo sapiens; identical to SEQ ID NO: 81478
  misc_feature 1..95: note = chr17:80882906-80883001
  misc_feature 1..95: note = Hypo
  source 1..95: mol_type = genomic DNA

SEQ ID NO: 114187 - DNA, 131 bp, Homo sapiens; identical to SEQ ID NO: 81479
  misc_feature 1..131: note = chr17:80965822-80965953
  misc_feature 1..131: note = Hypo
  source 1..131: mol_type = genomic DNA

SEQ ID NO: 114188 - DNA, 35 bp, Homo sapiens; identical to SEQ ID NO: 81480
  misc_feature 1..35: note = chr17:80970418-80970453
  misc_feature 1..35: note = Hypo
  source 1..35: mol_type = genomic DNA

SEQ ID NO: 114189 - DNA, 57 bp, Homo sapiens; identical to SEQ ID NO: 81481
  misc_feature 1..57: note = chr17:80972313-80972370
  misc_feature 1..57: note = Hypo
  source 1..57: mol_type = genomic DNA

SEQ ID NO: 114190 - DNA, 315 bp, Homo sapiens; identical to SEQ ID NO: 81482
  misc_feature 1..315: note = chr17:81008590-81008905
  misc_feature 1..315: note = Hypo
  source 1..315: mol_type = genomic DNA

SEQ ID NO: 114191 - DNA, 30 bp, Homo sapiens; identical to SEQ ID NO: 81483
  misc_feature 1..30: note = chr17:81014892-81014922
  misc_feature 1..30: note = Hypo
  source 1..30: mol_type = genomic DNA

SEQ ID NO: 114192 - DNA, 166 bp, Homo sapiens; identical to SEQ ID NO: 45303
  misc_feature 1..166: note = chr17:81015300-81015466
  misc_feature 1..166: note = Hypo
  source 1..166: mol_type = genomic DNA

SEQ ID NO: 114193 - DNA, 79 bp, Homo sapiens; identical to SEQ ID NO: 81485
  misc_feature 1..79: note = chr17:81015900-81015979
  misc_feature 1..79: note = Hypo
  source 1..79: mol_type = genomic DNA

SEQ ID NO: 114194 - DNA, 36 bp, Homo sapiens; identical to SEQ ID NO: 81486
  misc_feature 1..36: note = chr17:81021220-81021256
  misc_feature 1..36: note = Hypo
  source 1..36: mol_type = genomic DNA

SEQ ID NO: 114195 - DNA, 125 bp, Homo sapiens; identical to SEQ ID NO: 81487
  misc_feature 1..125: note = chr17:81024242-81024367
  misc_feature 1..125: note = Hypo
  source 1..125: mol_type = genomic DNA

SEQ ID NO: 114196 - DNA, 30 bp, Homo sapiens; identical to SEQ ID NO: 81488
  misc_feature 1..30: note = chr17:81032806-81032836
  misc_feature 1..30: note = Hypo
  source 1..30: mol_type = genomic DNA

SEQ ID NO: 114197 - DNA, 30 bp, Homo sapiens; identical to SEQ ID NO: 45307
  misc_feature 1..30: note = chr17:81033487-81033517
  misc_feature 1..30: note = Hypo
  source 1..30: mol_type = genomic DNA

SEQ ID NO: 114198 - DNA, 30 bp, Homo sapiens; identical to SEQ ID NO: 81490
  misc_feature 1..30: note = chr17:81034580-81034610
  misc_feature 1..30: note = Hypo
  source 1..30: mol_type = genomic DNA

SEQ ID NO: 114199 - DNA, 37 bp, Homo sapiens; identical to SEQ ID NO: 81491
  misc_feature 1..37: note = chr17:81040640-81040677
  misc_feature 1..37: note = Hypo
  source 1..37: mol_type = genomic DNA

SEQ ID NO: 114200 - DNA, 167 bp, Homo sapiens; identical to SEQ ID NO: 81493
  misc_feature 1..167: note = chr17:81043026-81043193
  misc_feature 1..167: note = Hypo
  source 1..167: mol_type = genomic DNA

SEQ ID NO: 114201 - DNA, 59 bp, Homo sapiens; identical to SEQ ID NO: 81495
  misc_feature 1..59: note = chr17:81047898-81047957
  misc_feature 1..59: note = Hypo
  source 1..59: mol_type = genomic DNA

SEQ ID NO: 114202 - DNA, 30 bp, Homo sapiens; identical to SEQ ID NO: 81496
  misc_feature 1..30: note = chr17:81048443-81048473
  misc_feature 1..30: note = Hypo
  source 1..30: mol_type = genomic DNA

SEQ ID NO: 114203 - DNA, 251 bp, Homo sapiens; identical to SEQ ID NO: 81497
  misc_feature 1..251: note = chr17:81048783-81049034
  misc_feature 1..251: note = Hypo
  source 1..251: mol_type = genomic DNA

SEQ ID NO: 114204 - DNA, 317 bp, Homo sapiens; identical to SEQ ID NO: 81499
  misc_feature 1..317: note = chr17:81050023-81050340
  misc_feature 1..317: note = Hypo
  source 1..317: mol_type = genomic DNA

SEQ ID NO: 114205 - DNA, 63 bp, Homo sapiens; identical to SEQ ID NO: 81500
  misc_feature 1..63: note = chr17:81050653-81050716
  misc_feature 1..63: note = Hypo
  source 1..63: mol_type = genomic DNA

SEQ ID NO: 114206 - DNA, 78 bp, Homo sapiens; identical to SEQ ID NO: 81501
  misc_feature 1..78: note = chr17:81050921-81050999
  misc_feature 1..78: note = Hypo
  source 1..78: mol_type = genomic DNA

SEQ ID NO: 114207 - DNA, 294 bp, Homo sapiens; identical to SEQ ID NO: 81502
  misc_feature 1..294: note = chr17:81062099-81062393
  misc_feature 1..294: note = Hypo
  source 1..294: mol_type = genomic DNA

SEQ ID NO: 114208 - DNA, 102 bp, Homo sapiens; identical to SEQ ID NO: 81503
  misc_feature 1..102: note = chr17:81065766-81065868
  misc_feature 1..102: note = Hypo
  source 1..102: mol_type = genomic DNA

SEQ ID NO: 114209 - DNA, 138 bp, Homo sapiens; identical to SEQ ID NO: 81504
  misc_feature 1..138: note = chr17:81068653-81068791
  misc_feature 1..138: note = Hypo
  source 1..138: mol_type = genomic DNA

SEQ ID NO: 114210 - DNA, 82 bp, Homo sapiens; identical to SEQ ID NO: 45316
  misc_feature 1..82: note = chr17:81076347-81076429
  misc_feature 1..82: note = Hypo
  source 1..82: mol_type = genomic DNA

SEQ ID NO: 114211 - DNA, 33 bp, Homo sapiens; identical to SEQ ID NO: 81506
  misc_feature 1..33: note = chr17:81081890-81081923
  misc_feature 1..33: note = Hypo
  source 1..33: mol_type = genomic DNA

SEQ ID NO: 114212 - DNA, 30 bp, Homo sapiens; identical to SEQ ID NO: 81507
  misc_feature 1..30: note = chr17:81084673-81084703
  misc_feature 1..30: note = Hypo
  source 1..30: mol_type = genomic DNA

SEQ ID NO: 114213 - DNA, 138 bp, Homo sapiens; identical to SEQ ID NO: 81508
  misc_feature 1..138: note = chr17:81087463-81087601
  misc_feature 1..138: note = Hypo
  source 1..138: mol_type = genomic DNA

SEQ ID NO: 114214 - DNA, 120 bp, Homo sapiens; identical to SEQ ID NO: 81509
  misc_feature 1..120: note = chr17:81087901-81088021
  misc_feature 1..120: note = Hypo
  source 1..120: mol_type = genomic DNA

SEQ ID NO: 114215 - DNA, 78 bp, Homo sapiens; identical to SEQ ID NO: 81510
  misc_feature 1..78: note = chr17:81088141-81088219
  misc_feature 1..78: note = Hypo
  source 1..78: mol_type = genomic DNA

SEQ ID NO: 114216 - DNA, 85 bp, Homo sapiens; identical to SEQ ID NO: 81753
  misc_feature 1..85: note = chr18:266838-266923
  misc_feature 1..85: note = Hypo
  source 1..85: mol_type = genomic DNA

SEQ ID NO: 114217 - DNA, 30 bp, Homo sapiens; identical to SEQ ID NO: 81904
  misc_feature 1..30: note = chr18:499528-499558
  misc_feature 1..30: note = Hyper
  source 1..30: mol_type = genomic DNA

SEQ ID NO: 114218 - DNA, 1248 bp, Homo sapiens; identical to SEQ ID NO: 81905
  misc_feature 1..1248: note = chr18:500042-501290
  misc_feature 1..1248: note = Hyper
  source 1..1248: mol_type = genomic DNA

SEQ ID NO: 114219 - DNA, 86 bp, Homo sapiens; identical to SEQ ID NO: 82004
  misc_feature 1..86: note = chr18:597381-597467
  misc_feature 1..86: note = Hypo
  source 1..86: mol_type = genomic DNA

SEQ ID NO: 114220 - DNA, 53 bp, Homo sapiens; identical to SEQ ID NO: 82294
  misc_feature 1..53: note = chr18:812816-812869
  misc_feature 1..53: note = Hyper
  source 1..53: mol_type = genomic DNA

SEQ ID NO: 114221 - DNA, 174 bp, Homo sapiens; identical to SEQ ID NO: 82308
  misc_feature 1..174: note = chr18:903670-903844
  misc_feature 1..174: note = Hyper
  source 1..174: mol_type = genomic DNA

SEQ ID NO: 114222 - DNA, 2558 bp, Homo sapiens
  misc_feature 1..2558: note = chr18:904374-906932
  misc_feature 1..2558: note = Hyper
  source 1..2558: mol_type = genomic DNA
ttcatgaataaaaatcggagcgcaacagtgcaacaaaatattctgtacttaaaggcaacaggcaggcagatgttgacaaagagggctctccaaaaaccatgttcggatagatttttgcgaactgcacagataaataggagcagaaggccggtcacctctgtaaccagcggtagcagcagcagaagccgcagcttcagaggcagccggagagacctcggagcagagaaggcgccgccgaccctcgcggctgcctggcccgcggctcctacaaaggcgggctagccgcccgccctctcccttgccttcctccccttcttttctgactttccctctttcccttaatcgcctgcttcttcctccgggtggacttacggccaccttgctcctccgcgcttcacctcatcgccccctctttctttcttctgcctctctctctgcgcccccttctctccgtgtcacgctccctcctggttctgcgcgtctacaaacttttgagcagaacacgagcctcggcaaacgagtcccgcagctcctcctgctgctcccgctggttcctgcggcttctgctcagacaccaacgccagacggcgatgcctctcgggtggtgactccagcgcaggaacttgaagaagcgctttgcccgccgtcctacctggcagctctcctggcagcgggaggagttgaagggtaagggagggaaaatcttaccaaagcgaccggctcactcgactgctgattctttcgcttggcatcgcgtcaggggagttagctttccttcagccgggtctggctagttattgggcgccgggtagatgcatatatatatatttttttctaactatagcaagcaagaagtggcagggcgcgcaccggctgtcgccaagtgctgttcaactcagggagccggggcttcgctccgtccctcccccggcttccagagctttttggggttggagggtgggaggccaggggcgttctcacagctgtgtgtcctctttcccatcctgcgcagaatgaccatgtgtagcggagcgaggctggccctgctggtctatgggataatcatgcacagcagcgtctacagctcacctgccgccgccggactccggttccccgggatcaggtaggtgctggctgcctggcccaagcaggagctggggcttcccaggcacagacgcttcctcacggtctccttcctgcagtcctttgggtccagactactagcatcgccctctgcgcccccggtgcgcctccgccagcctcggctggacagcgggtccccattctagccgagggtctggcaggctccgcgactgctcggacgcctcccccagccctaggcagctcagggtcccgggtagagccagtgagcttctggccgctggagaaccccccctcccccaacccggcccacaggatgggggcagggcacggcccctagcttggtttcttttacctattcttgggacgagttaggagaacttcagctctggagcctggccgggggttgagcgtgaagctccctcggactttgctttgttactgcttgttctggactatccgggtggggtctctctctctcctccaccctttcttttcatttcattccaattctttcccctgaagagctttctttcaagtgatccgtgttccaactgcattttgaatcccaggctgtcttggggggcgtgcggtggggagggtgttggcccggtgtgattgaggaaaagcgacttaagagagggaagaacaaggacgagactgcgaaggagggggaaaaacaggcgcaaaggaggaggaagggaaagccagcaggcaggcaggaccgggagagcagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggggttgagatggggcaccgccatcgataacagatcagcgcgaactattcgtttagtggcctta

SEQ ID NO: 114223 - DNA, 1205 bp, Homo sapiens
  misc_feature 1..1205: note = chr18:907314-908519
  misc_feature 1..1205: note = Hyper
  source 1..1205: mol_type = genomic DNA
ggctcgggagccaggcggggaggggggcggtccttttccgtagacaggtgtgcgcgatcggcggagacgcctcggtttcccagcgcttgttgaggccgtggcccgcaggacgaccctttacccgcgaagggggggtgggcgggccgcccggcggggtaggagtggttgggtgtcgttgcctcctccttacctctgctcccacccccagtcctgggagaagagacaattctcagcggaggacttttatcacctgtgaaaatccgcgcgagccccttactttggatcctcgccgagctggggaggaacttgcactgaccacaccttctgtccccggccaccccgcaggccagaggaagaggcgtacggcgaggacggaaacccgctgccagacttcgatggctcggagccgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcctgtcctctccctggcccgatcctattgcagcgacagaaaatcagcagcgggcgggtctgtgtggacctgagggccgcgtggggaccgaggggggctgtggcccaaagagtggcagtgagtggcgtcaaggaacccacactccgcatctgccactcctagagccgggactagctcccgatcctagcagttgctctcgagatcatcccgggagttattggcgagttctgggcctctggaggtttccctgtcagcctccccggccgccgagggggcgcgcgcccaacaagggggtctctagcggccacctggggacagaaacagtgaccctgggcgcgcactttgcctccccgttagagatgtcgcccacgggatccttaacgaggcctaccgcaaagtgctggaccagctgtccgccgggaagcacctgcagtcgctcgtggcccggggcgtggggtaagagtttgtggaaggattaacctgcgcgcgccggggtgggtgcctgtgcggggcgcgcggggcgggcggcggtgggtgcccgtgggggccagggtgagtctgcgcccctgggtctggggtgggcatccgccacgggtcgcagttggagattt

SEQ ID NO: 114224 - DNA, 810 bp, Homo sapiens
  misc_feature 1..810: note = chr18:908922-909732
  misc_feature 1..810: note = Hyper
  source 1..810: mol_type = genomic DNA
ttgcctacagcctgtcgacttatattattatcacgtttttcaactcggcgtgaggagggagaggagtgttcatatttgactaggaattgcaggatcgatgcaaactccagggcagcagccagactggcatatgtagggctctccggttactttctctgtatgtcgcgggtgagaggaacagcgaggacaatttagcgcaaacacacgaagggtcggatctcaagggggcagcgctgggagaaaggttaggcttgaagcgcgcgtcgcctgcccggatcttatcccgggccccctccgcagggtttggtgccaggagatcctgcgtggggaggggggcatcgaggggctgccgtctcggccctccccacggctgcttccaggcagaggcgggcgacgcggtgggcagtgcgagccccgggccctccccgaaggctcccgcgtggggtggggcccgcctgctccccgcggcgattgaacctgtgtctcccgccccgccaccctcttcccgacccctttgcttgcagtgggagcctcggcggcggcgcgggggacgacgcggagccgctctccaagcgccactcggacgggatcttcacggacagctacagccgctaccggaaacaaatggctgtcaagaaatacttggcggccgtcctagggaagaggtataaacaaagggttaaaaacaaaggacgccgaatagcttatttgtagcgatgggttaccagctaccctgtgtatacagccctgacgcaatgaaaagtcgttttccaaactgactcaacagtcatcgctcgtgtgttctatcca

SEQ ID NO: 114225 - DNA, 233 bp, Homo sapiens; identical to SEQ ID NO: 82323
  misc_feature 1..233: note = chr18:961751-961984
  misc_feature 1..233: note = Hyper
  source 1..233: mol_type = genomic DNA

SEQ ID NO: 114226 - DNA, 30 bp, Homo sapiens; identical to SEQ ID NO: 81703
  misc_feature 1..30: note = chr18:2038636-2038666
  misc_feature 1..30: note = Hypo
  source 1..30: mol_type = genomic DNA

SEQ ID NO: 114227 - DNA, 30 bp, Homo sapiens; identical to SEQ ID NO: 81752
  misc_feature 1..30: note = chr18:2623947-2623977
  misc_feature 1..30: note = Hypo
  source 1..30: mol_type = genomic DNA

SEQ ID NO: 114228 - DNA, 24 bp, Homo sapiens
  misc_feature 1..24: note = chr18:2755854-2755878
  misc_feature 1..24: note = Hypo
  source 1..24: mol_type = genomic DNA
gccctcggccgtgtattttctttt

SEQ ID NO: 114229 - DNA, 1715 bp, Homo sapiens; identical to SEQ ID NO: 81755
  misc_feature 1..1715: note = chr18:2846451-2848166
  misc_feature 1..1715: note = Hyper
  source 1..1715: mol_type = genomic DNA

SEQ ID NO: 114230 - DNA, 30 bp, Homo sapiens; identical to SEQ ID NO: 81763
  misc_feature 1..30: note = chr18:2879366-2879396
  misc_feature 1..30: note = Hypo
  source 1..30: mol_type = genomic DNA

SEQ ID NO: 114231 - DNA, 463 bp, Homo sapiens
  misc_feature 1..463: note = chr18:2905967-2906430
  misc_feature 1..463: note = Hyper
  source 1..463: mol_type = genomic DNA
gccgccgatttttgtcgggtcctaaacaaaaatcaaatgtgttgcgctttggaactctgggcatcgtgggcaccaggctgacgggggcggcggggatggcgtttcttggcgagcgggtccctcagccaggcccgggtattgtcaggcgtcccgtggacggtcgggaggggcttcctggagggctcgttccgggaacgagttcaaaggaggaaagggcggcagcttccggcgccttccccagagggccgggagacgcacgccaggagcttcctccgttggaagtcccttccgctggcgacgtgggcgctgtggccgcggccctcgtggagcctgagccctcctcacggcctccgcgcagccctggggccccccggcagggtccctcggcagcccgcgggagaggccgtggggccccggcaggagtgtggttcagagacggtgcgggggtcggtggcctcaggtc

SEQ ID NO: 114232 - DNA, 30 bp, Homo sapiens; identical to SEQ ID NO: 81765
  misc_feature 1..30: note = chr18:2907170-2907200
  misc_feature 1..30: note = Hyper
  source 1..30: mol_type = genomic DNA

SEQ ID NO: 114233 - DNA, 98 bp, Homo sapiens; identical to SEQ ID NO: 81767
  misc_feature 1..98: note = chr18:2913170-2913268
  misc_feature 1..98: note = Hypo
  source 1..98: mol_type = genomic DNA

SEQ ID NO: 114234 - DNA, 30 bp, Homo sapiens; identical to SEQ ID NO: 81768
  misc_feature 1..30: note = chr18:2917759-2917789
  misc_feature 1..30: note = Hypo
  source 1..30: mol_type = genomic DNA

SEQ ID NO: 114235 - DNA, 30 bp, Homo sapiens; identical to SEQ ID NO: 81780
  misc_feature 1..30: note = chr18:3126638-3126668
  misc_feature 1..30: note = Hypo
  source 1..30: mol_type = genomic DNA

SEQ ID NO: 114236 - DNA, 30 bp, Homo sapiens; identical to SEQ ID NO: 81781
  misc_feature 1..30: note = chr18:3152033-3152063
  misc_feature 1..30: note = Hypo
  source 1..30: mol_type = genomic DNA

SEQ ID NO: 114237 - DNA, 42 bp, Homo sapiens; identical to SEQ ID NO: 81792
  misc_feature 1..42: note = chr18:3215130-3215172
  misc_feature 1..42: note = Hypo
  source 1..42: mol_type = genomic DNA

SEQ ID NO: 114238 - DNA, 104 bp, Homo sapiens; identical to SEQ ID NO: 81797
  misc_feature 1..104: note = chr18:3330713-3330817
  misc_feature 1..104: note = Hypo
  source 1..104: mol_type = genomic DNA

SEQ ID NO: 114239 - DNA, 89 bp, Homo sapiens; identical to SEQ ID NO: 81803
  misc_feature 1..89: note = chr18:3453723-3453812
  misc_feature 1..89: note = Hyper
  source 1..89: mol_type = genomic DNA

SEQ ID NO: 114240 - DNA, 328 bp, Homo sapiens; identical to SEQ ID NO: 81809
  misc_feature 1..328: note = chr18:3499043-3499371
  misc_feature 1..328: note = Hyper
  source 1..328: mol_type = genomic DNA

SEQ ID NO: 114241 - DNA, 161 bp, Homo sapiens; identical to SEQ ID NO: 81824
  misc_feature 1..161: note = chr18:3616260-3616421
  misc_feature 1..161: note = Hypo
  source 1..161: mol_type = genomic DNA

SEQ ID NO: 114242 - DNA, 56 bp, Homo sapiens; identical to SEQ ID NO: 81826
  misc_feature 1..56: note = chr18:3771517-3771573
  misc_feature 1..56: note = Hyper
  source 1..56: mol_type = genomic DNA

SEQ ID NO: 114243 - DNA, 113 bp, Homo sapiens; identical to SEQ ID NO: 81828
  misc_feature 1..113: note = chr18:3930496-3930609
  misc_feature 1..113: note = Hypo
  source 1..113: mol_type = genomic DNA

SEQ ID NO: 114244 - DNA, 30 bp, Homo sapiens; identical to SEQ ID NO: 81834
  misc_feature 1..30: note = chr18:4334251-4334281
  misc_feature 1..30: note = Hypo
  source 1..30: mol_type = genomic DNA

SEQ ID NO: 114245 - DNA, 186 bp, Homo sapiens; identical to SEQ ID NO: 81843
  misc_feature 1..186: note = chr18:4398414-4398600
  misc_feature 1..186: note = Hypo
  source 1..186: mol_type = genomic DNA

SEQ ID NO: 114246 - DNA, 979 bp, Homo sapiens
  misc_feature 1..979: note = chr18:4453666-4454645
  misc_feature 1..979: note = Hyper
  source 1..979: mol_type = genomic DNA
tatcctcaccttctacgaagccattcacgaagaccacaaaagctaaaagatctgtctttaattggtacttttattatatgtctttcctcgtaattccctaacttcacgtgttatggaaggaggcagggagcattcacctcccacgaccgggagtcagtctctgtgtcaggagtaaggagtgaagagtctcgcctggatccacaaaagacgtgacatctcccacccagcgtcccactgcttgccgcctggctacctttaaccccttgccctccgcacatcctccccttctctagcagaaaattccgcagcgctacggtcgggctggaggcaagccctgcagccgggggcgagcgcggcactcggacacaggcactcagtgtctccggcgccggcagccgagccacgggccaccccttcccacggcctcccggtgccacccagcgaggccgggacagcgcgccttccgcaaaaagcgcagcagccgaagtcctgaaagcagggtcttcatcgccgcgggccctccgaaggtgcctctcccagctgcagccgcccctcaatgaaagtgcaatgtgttatctcgcccagcccagaggagaggtccctgtttggccttggttccagcccggctcattcaattcgctgaatgtcgggtctcccggcccgccccgcgattctccgggaattggccttggccgcgggcagggggcgactctccagtgacctcctccttggaccccatttctctctctctctctctctctgtgcctgtctttgtgtctctgtttctttggctttctcttacaaacgcacgggggagttggtccttttccacaatgccaaaatgtcacccaaaaagctagtgcaacaacttgctttgcaaacgacccaggagcctgccgagaaagccctgcggggagcagccccctcctcccctgcaaggtgcatcgggggtggggtgggggtgcgaatttgaccggtg

SEQ ID NO: 114247 - DNA, 368 bp, Homo sapiens
  misc_feature 1..368: note = chr18:4455044-4455412
  misc_feature 1..368: note = Hyper
  source 1..368: mol_type = genomic DNA
cgtccgttggtcccacgagcctcggaggaaggagagagatgtccccgcgaccaggaccggctctcagcgaggtgacgggaaggactcgagagaggagccgaggcggcggcggccgttcgcgccgcctatgctgccgattccccgaggcggaaggtgtccgcgaggccgtgtcctggagattgcggcgcccgaagcgcagcgctcgcctctggagcggaggctgagcgccgggacgcggcgggctggggctgcaaggctgggctggtgacccgcccctgggtgcatgttaatacggtggggaggaggagtcccgcgcttcctccgcccaaccaccggagccggcgggcgggcggcggccgcggcccgga

SEQ ID NO: 114248 - DNA, 30 bp, Homo sapiens; identical to SEQ ID NO: 81856
  misc_feature 1..30: note = chr18:4455651-4455681
  misc_feature 1..30: note = Hyper
  source 1..30: mol_type = genomic DNA

SEQ ID NO: 114249 - DNA, 30 bp, Homo sapiens; identical to SEQ ID NO: 81857
  misc_feature 1..30: note = chr18:4455910-4455940
  misc_feature 1..30: note = Hyper
  source 1..30: mol_type = genomic DNA

SEQ ID NO: 114250 - DNA, 219 bp, Homo sapiens; identical to SEQ ID NO: 81908
  misc_feature 1..219: note = chr18:5133145-5133364
  misc_feature 1..219: note = Hypo
  source 1..219: mol_type = genomic DNA

SEQ ID NO: 114251 - DNA, 1531 bp, Homo sapiens
  misc_feature 1..1531: note = chr18:5196228-5197759
  misc_feature 1..1531: note = Hyper
  source 1..1531: mol_type = genomic DNA
tacccctagagacagcgtcggacgttcacaacgaccacgcttttccccgcttcctcgattagcctggcctcccttgctccagtggggcggactcaaatgcgcacgcacgcacacgccgccaagccggtcaaccgcagacaaatctgactcttcgccaactagtagccacggagagcagcaaagggaccaaggtccttcaccgcctgctccaaaaagacacggcaacctccagcggcgccgcagtagctgcctctgtgctgcagcctccggtcggagtttcaggtctaattccttaagaagtatcgctcctctgcccttcgtcctactccccttggcttcgcccacttcgcctccttctcctcgggaggccaggaggacccgggtcactttgccaattctgcggagggggaagtagcagtgagggagattcccacgcaagtagcccgaagcccactactctttgccccacctctccactctcttgcccgtgtaggtgccggtgctgctggcgaaagtcccagttcttaaggctcctgagctcggaaggggtgtggaggagccagatgggaagagaagcagcgggacgagggcgaggaagggctggagattgttagaggacagatggggcgggactggggagaggggcgaaggcgacgcgccgaggcactcctccgccccatgagcacagacagtaactccgaaacgcgcagatgggccgtaaggtaaagaggccttttttccctctcctctccgtcctctaccctgctcccctcctagacacttggtgaaaaagcaaggtgcggtgtacctggagcgaacaccatgatttcttccagccgctacgcccccagattaagagagaaagacaggcagacggaggatgggaagaaggccggacttggcggggtccggtgcaggagggcgcgctgggcgggcggcgggcggggcggtcagcaccccggacagctcccgccgctagatcctggggccgcagctccagccgccgccgcgcgctctgcctccacaatgcggccacagcggcggcgggaggaggagggtgaatccccgctcagtccatccctcattcctgtgccagctcggcgacgtacactgctgcttagggagcaaagcacttccaccgctttcacgcgacgaaggtcggaagagcaagagagagaaaggtaaacttcccggcaggggacagtgaattgcttttaattacctgctgtggctcgtcgccgtggatattggactgacatttaagatagatttgtcaaaaaaaaaaaactctaagagctttctttactctcgaggatgactctgagttctccgagttgggctggctcgaatagaggggcgggtctgtcaagttaataggtcctggaggtccgtgagtcctctctcgcgagtcccagtcctctgctaacgtcaggaagagagcaagaggaaggacacagtgactatggagcgctcgaggagggcgctactatcaggttccgctcccaggtggcaaatccggctctgaaagctc

SEQ ID NO: 114252 - DNA, 24 bp, Homo sapiens
  misc_feature 1..24: note = chr18:5233199-5233223
  misc_feature 1..24: note = Hypo
  source 1..24: mol_type = genomic DNA
cgctaaggccgagagagcaaaagt

SEQ ID NO: 114253 - DNA, 744 bp, Homo sapiens
  misc_feature 1..744: note = chr18:5542700-5543444
  misc_feature 1..744: note = Hyper
  source 1..744: mol_type = genomic DNA
ctgggctgcaactaacggaaaaaccctagaaaacttcagatccgtaatataaaaagaaaattgaaaagaatactctcattgcaagggaccacagttacaatttactaggtaaccacacccaccgcattgcagaagccatgaacttggcgggcgtgggggggaaggggaagaagtccggcgagattagaggggaaatccgaaaaagcaagcccctgcggcagcagccaggaaacactcgccaggaactggctgcgaccccaactccagcggtccgaagccctagcctccccacccccaccgcggcagagccgccttcgcagacacctcccgaggagaatcgcggccccgagggcgccaggtgagtcgcgccgccccgagcccccgggccacggcaggccgacccaggcgcccccggcccgcccgtgctcccgcgcccgggtgccagaggcgaggggccccggcaggtgcccaggcccagggcaaccccgcttggacgctccctcctcctcccccaccggccgggggccgctgccccagtttggggaacgaggcaagttatataaaagcggccggcccccctgcccagcggggatgctttgtgcggagcgcaccttatcggccccgcgctgcgcccgcccgcgcctgcacccgggacgagcccgctgccgccgcgcgctgagcgcagggcccctcccgcggcccgccagccgccacccgcccgggcggcgccgcagtgtcgccccc

SEQ ID NO: 114254 - DNA, 564 bp, Homo sapiens
  misc_feature 1..564: note = chr18:5543683-5544247
  misc_feature 1..564: note = Hyper
  source 1..564: mol_type = genomic DNA
cgcggcgcgcaggctcggcccggtgggggtcccggcgagcgggagggcggttggggaccccggccgcgccgggcgcggggctcgggattcgggagaccgcgcggcgccgaagccacgcgtcagccccactgtcccgcgcgcctcgccccaggcctcgggctcttcctccgcacctcgtaaagccgagaccccctcgcagtcccccactccgagaggcggaaaagttacctgggatcagcagggagcccgggcgcgccgcggcgtggggactaggctcgggcgcgcgtcctcggcggcggtgcgcaggagactcgggcgtggggaggaagccgcagcccagggctgctcgccgctgttccccccgccccctgttgcaggagacaccgaggctccgcggagctgcggcgggggcccacgcccagagaccgtgcgaggaaagccaacctcgtcctgcctgccctcccagccgcgggggagggggccaccgcagtacttcaggacagttacatgggcacagcctcctccgtcctggcgcagggtcaggctccgcggacgacgcctgga

SEQ ID NO: 114255 - DNA, 30 bp, Homo sapiens; identical to SEQ ID NO: 81950
  misc_feature 1..30: note = chr18:5561844-5561874
  misc_feature 1..30: note = Hypo
  source 1..30: mol_type = genomic DNA

SEQ ID NO: 114256 - DNA, 2716 bp, Homo sapiens
  misc_feature 1..2716: note = chr18:5628082-5630798
  misc_feature 1..2716: note = Hyper
  source 1..2716: mol_type = genomic DNA
cactggagcccaccccgctcctacgccgcaaagcagcacaattacagcctgggaggggcaagtcttgcggggcccgtcggtaactgccattatttgaatgcgatataggagatcccacatagaccctgctctaccgggttagaatctgtttctaatcacgtggaatttagatttaaaccacagttagatttgggatttaccatcgtttctactttcattcatttagtggcttccagccctctcgcggcccagtcttaatccatcgcacttcagagggaattacgagggagttgcggactggcgggggcgggggtctgtaactaacaccaggtgcctgtgagagagccccaagggcgggggcagcacctcctggctgggttgggtccgcctggcctcgcctcgcctccgggatccttggcgctcagcgccgccctcccgctactgcgctacccgccagagcccggcgtcttccctttccttgtcttgtggacgccgcccttcgctcccgggaggatttcgcctccagcacctcaggcttttctggcgcaaaggtcgccagcccgagcgagcccaggcggcggcttcacttctgcagagggaaagcgaaagacgcggccggcgggccgagggggcggccgaacgcgccgcgtggttgctgctcccgaatccgcagcggcggcgccagggcggtcaccgagccctgcggaccccggctcaacttccagcgccactcgggtgccccgagcccgccgcagctcccggcgcgccctccagccgcggcacgcagcccctgacgcgcccggggcgccctcccgcagcaccagccaggccaccccacctcccgcgccgcgcttccccgccagccgccggccaggagctccccggcttctgagcaggacgcgccaaagggagttgggaggctcagcagcccccagcgtcgccttctcgggtgacgtgacgctctctctggagcgcgggcccgcctccgccaagcctccaccgcaggtccttacagccgagccacgggaagatgcaacgccgggcgaggggcgcctcccggattttgaaaaacagcctcattcgcctcgggaacgcctcgatcccccacccgcaccctttggccagatgattttaatcctgggattccgcgttggtcgtgggggtaccgggagctggagctggaggagaggagccggcagcgcggagttgccggggtgcagctgcgcgcagctggcggcgaggggaggcggtccctgcggctccgccgggctgggggaactggctcctgcgcctctgcctcccggaggatcgcactcgctcatccttacacaccacacacacacacacacacacacacacacacacactgccgctagcgccccccacgccacaagccggaatgcggaggtcagagccactgtccacttgaaagcaggaaagcaggggctgaaacgctgagatggaggcggaggctctggcctcatctgcgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagcccacaactaggctgccgggaccggggagccagaccccaggtcgctccaactccggcgagggcggggaggggagtgacagcagcaactagcgcgcgctggcaaaagcacagagtctcggaataggctaaacggccggcgcggaggggtggaggcaagagggggcggaggaggagttgcccgagcggagagggatgacgtcctccagggccttgggctccgaggaaccgaagactggtgcgctcgccgggccccgcgcactagctctggggttcgcagaggcgccgcgcccggcttccgcggcagctccaacacagcgcgcaggcggtcgatcccggtcagcttaaaccgggcgcaagccctctgtccccctcaaagcacctctctgctcgtccctagtctccaggtgcccgtctgagagtccctgtcgcctccgggcggacccggccaggcagcccccggtcgggccagcctcgccccttcctcgctttctcccccatcgacctcgagccaagggcaggcggcccgcacccgcgcccctgcccacggggctaggcggcgctcccggcctacgcccggctgccaagaagagaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcgggcgcctgtgacagcccgcgccgctcagccctcgcgggcccgccctccccgtccgctcgttggctgcgcccggtgcccgggcggtccccgcgctctgccccgccctgagcccgcctcccagccgcgcgctcgcaaagtatgggtc

SEQ ID NO: 114257 - DNA, 1046 bp, Homo sapiens
  misc_feature 1..1046: note = chr18:5890466-5891512
  misc_feature 1..1046: note = Hyper
  source 1..1046: mol_type = genomic DNA
gctggatgggtcatccgactgggagctcccggagtcccgcctggtggggggcgagccctccagccgcaggggtggcgagggggaggcggccttggccagagggctggagtccgggtccgcactccccggggagggcgggggctcgggggacggcggcgcccggtagtccgggagcccgctggtgctgcggcgccgcaaggccgcgtacctgccggtcctgggcaggcggccgccctgccccctggcggcgcgcgccgctaccgcgccctcgggctcctccggctcccggcgcgccccgcgcatgctgccctctgcgccgcggaggttggtcatgctcaggtcgagctcgcccctcgggatctcctgggagccgcgttcccccggaggcctctgccagctgcagctcgcgccctccgcgtccccgcccctatcgcggcccccttgcaagggcagcagcgcgaaggcgctcagcgaggagtccacgaaggagctggccgtgctctggcgcccccagctctcgggtgggctgcagggcgccggactgctgcagctgctagcggctgcggcggcggtggcagcggcggcccggcgactgcctgccacgcccgagcgctcgcggtagacgctgtacacggcctcggccaggctcgggggctcccgcggacagcgcggggaagaggccaggtccggcggggacgcggcgccccgagggcggccgccgctcggcgccgcggggtgaggaggccacgagcccttggccagcatcgccgccgctccgaaggcgtccccggagccaccgcagcccccgggcttcagctccaggccccgcgactgcacgtagctgaggaagccgttgagcggtatggccccggggggcgccgcggcgggggcagacgacgacgaagaggcggcggcggccgcggcggcggccgcggcggccgccaggtctttggcgcggaggctgtgcacgtcgatgacggtggagtagaggtcccgcaggttgatgattttggtcttcttgtcccggttctcgtggaggaccgcgt

SEQ ID NO: 114258 - DNA, 1469 bp, Homo sapiens
  misc_feature 1..1469: note = chr18:5894663-5896132
  misc_feature 1..1469: note = Hyper
  source 1..1469: mol_type = genomic DNA
gcgctgtgctgtgcccggtacccaacccaggtcctcgaccccggcccctcactggcagggcggcgaccccctggcccctggctttggtctgcttattgatgttagctggagtcacatgagtgcagcagctgggagtccgcctctggaaagaagacaggcaggagccaagtgagggcaatcctgaactagctttttctgggcagcgcatcccgtgtagccagcccgggaaaaagcctctcaccgaacaccagcccggggcgcggggactcggggacccgaggggcggggaggggcccccaagggctggggactggcagaattgctcaaaatggcagcactctccgcacgcaagatcgctcacttacccagggagaccgagggaggtcggggccggcgaacgggcgctcgggcgacacaaaggaaccatggagaaactttttcagcccgagccgacggcggagcgcagggacagcgccccggggccccgcatccgagcgcgactcagcagccccgcgggggcgagcgcccgccccaggctcgcagtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggtcggggcccgcccggctcggcggagtcggggggcgcccccgcccccgccccccgccccaccccctcctccggcgcccccccccacgccgccggccttccccgctcccccgcgtcctccgccgcccgccgcccgtcccttcggaagcgccgattcctcggggaggaggaggcgtgaggggaggcggcggaggcagccggcacggggcgctcgggccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctccctcccctcgtgcctcggtcttttgttgcctctactcctcggcacggcgcagcctgggctctcttccccctcccgcttgggagtttgcagtgtggacgctcggcaagcacagtaagttgtcccccagcgaactcgggcccgggcggagtggagccgcc

SEQ ID NO: 114259 - DNA, 98 bp, Homo sapiens; identical to SEQ ID NO: 82002
  misc_feature 1..98: note = chr18:5967868-5967966
  misc_feature 1..98: note = Hypo
  source 1..98: mol_type = genomic DNA

SEQ ID NO: 114260 - DNA, 30 bp, Homo sapiens; identical to SEQ ID NO: 82003
  misc_feature 1..30: note = chr18:5969470-5969500
  misc_feature 1..30: note = Hypo
  source 1..30: mol_type = genomic DNA

SEQ ID NO: 114261 - DNA, 39 bp, Homo sapiens
  misc_feature 1..39: note = chr18:6414162-6414201
  misc_feature 1..39: note = Hyper
  source 1..39: mol_type = genomic DNA
ggccaggcgcccgcccgccctgcgcgcactccctgggct

SEQ ID NO: 114262 - DNA, 227 bp, Homo sapiens
  misc_feature 1..227: note = chr18:6414470-6414697
  misc_feature 1..227: note = Hyper
  source 1..227: mol_type = genomic DNA
ccgcgcctggcaccccgaccctgccctcgcggctgaccgaggcgccgggctctgcggcggccgcgcccgtccaaagtaggcgacaagtgaggcagcgcctctcgcggggagcccggcgcgcgccccggcggcgaaagagaaagagaaagagcctgggccgggaccggggctatccccaaccgccaccgcccccaccggcccggccctcgccgcgggagtcgtgcagg

SEQ ID NO: 114263 - DNA, 279 bp, Homo sapiens; identical to SEQ ID NO: 82033
  misc_feature 1..279: note = chr18:6729441-6729720
  misc_feature 1..279: note = Hyper
  source 1..279: mol_type = genomic DNA

SEQ ID NO: 114264 - DNA, 158 bp, Homo sapiens; identical to SEQ ID NO: 82034
  misc_feature 1..158: note = chr18:6729981-6730139
  misc_feature 1..158: note = Hyper
  source 1..158: mol_type = genomic DNA

SEQ ID NO: 114265 - DNA, 37 bp, Homo sapiens; identical to SEQ ID NO: 82041
  misc_feature 1..37: note = chr18:6929750-6929787
  misc_feature 1..37: note = Hypo
  source 1..37: mol_type = genomic DNA

SEQ ID NO: 114266 - DNA, 183 bp, Homo sapiens; identical to SEQ ID NO: 82053
  misc_feature 1..183: note = chr18:7109195-7109378
  misc_feature 1..183: note = Hypo
  source 1..183: mol_type = genomic DNA

SEQ ID NO: 114267 - DNA, 147 bp, Homo sapiens; identical to SEQ ID NO: 82054
  misc_feature 1..147: note = chr18:7116490-7116637
  misc_feature 1..147: note = Hyper
  source 1..147: mol_type = genomic DNA

SEQ ID NO: 114268 - DNA, 440 bp, Homo sapiens
  misc_feature 1..440: note = chr18:7116857-7117297
  misc_feature 1..440: note = Hyper
  source 1..440: mol_type = genomic DNA
gcccgcaaaaacagaaaatgaaaattcgctctgagtttctcttctcaatccttgcaacgcgcatgcaaggtgctcccttctccgctggtccctcgccccggcgcgcccacggtcaatcccgcgcagtgaatgagcgggtttggccacttcgcctattgcacaaaaagcgcgggtcgggaaggcgcatcagtgccctggacgccgcctgcgggtccccctgcccgggacggctggctaggggcgcccttctcgccgcgtctctccccactagcccgcttggctgccaggggccccgaggaatccgccctttcccggccgccgcgacccagcttgcgcagccggacaatgagggcgactcgggagagctctttctccattcatcccccgcgcccggccaacagccccgccacccccgcccgcgcagccggggcactaaaagc

SEQ ID NO: 114269 - DNA, 690 bp, Homo sapiens
  misc_feature 1..690: note = chr18:7117522-7118212
  misc_feature 1..690: note = Hyper
  source 1..690: mol_type = genomic DNA
ccgagacacccactccgaggtggatcaggatgcgcgcccggactccagcagccccaacgcgacgggctttgtccgcggccgcccccgcccgcccgcctgcgggggacagggaccctaggacccgggccgggctcacctctctgccggcactgcgcggcgacacacagcagcaagaccaggagcacgcccccgcgcatctcgcctccgccgccactcggtgggtctggggagaaagccgcgcgcccgcctggaacgctccacgggacgcgagtccgcgctgccctggccccgccgctcctggagtcctgccgcccctccctccagccgccctcggacacacccctcggctgcgccccgccccgccccgtcccgccccggcttggccccgccacccagacccctcccccgggggcgcccagcttggcctctgggtcccggcgcacgcggaccccaagtcggggaggccgggctgaccgcggccgcctccccggctccgggtaggaggtgggcagagaaggtgggctgaggggaggagaaactgggctgcgggggtccgggagggtggattccgagaaactatgtgcccagctgaccctgcccgccccgccgcggccctgcagtccccgggccaggacccacgcgcccctgccaggagctgggcgagaggcgacccctcgggaagccacccag

SEQ ID NO: 114270 - DNA, 19 bp, Homo sapiens
  misc_feature 1..19: note = chr18:7118760-7118779
  misc_feature 1..19: note = Hypo
  source 1..19: mol_type = genomic DNA
agagcgagactctgtctca

SEQ ID NO: 114271 - DNA, 30 bp, Homo sapiens; identical to SEQ ID NO: 82101
  misc_feature 1..30: note = chr18:7444343-7444373
  misc_feature 1..30: note = Hypo
  source 1..30: mol_type = genomic DNA

SEQ ID NO: 114272 - DNA, 211 bp, Homo sapiens
  misc_feature 1..211: note = chr18:7566582-7566793
  misc_feature 1..211: note = Hyper
  source 1..211: mol_type = genomic DNA
cgcttcgggcccacacgggacaccgaggcatgatgaggacgcagaacagcagaagcgcgccctgcttcccgggcgccagtgctcggggccagcggcgtgtacccggcgggcccggccgggagcgggctggcgatcgcggggctcggcgctcccggctcccgcgccatctcccggcgcccgccaacttcgctccgcccgcggcgtagagaag

SEQ ID NO: 114273 - DNA, 326 bp, Homo sapiens; identical to SEQ ID NO: 82140
  misc_feature 1..326: note = chr18:7567009-7567335
  misc_feature 1..326: note = Hyper
  source 1..326: mol_type = genomic DNA

SEQ ID NO: 114274 - DNA, 1071 bp, Homo sapiens
  misc_feature 1..1071: note = chr18:7567750-7568821
  misc_feature 1..1071: note = Hyper
  source 1..1071: mol_type = genomic DNA
ggccccctccgccctcgcgcgcccacccaccgccgccggggagcggcccggcccgcactcagcaccatgaggggacttgggacttgcctggcgactttggccggacttttgctaactgcggcgggcgagacgttctcaggtaagcgggaccgcctctgccgcccccgaggcgcgcgggccggcgcgggacgcccgggacgccgacagctccctggtggtagagccctaaggctggcgtcggggccgggcggggggcgcggcgggccggacaccgcttctgcctgtgagccgggcgctgggcgaggggccgtggggctggcaggcacccagtcctcgggcgggcggagcggacggaccccgagggcgagctccccagccgggactgccagctcggccgccgtccttccgcggcctgggctagtgctcaaggttgggcggcttgcactcttgagtccctggccggctgcaaaaggaacagcagaaaactttgcttgaagttcccagttgcagccgccgggccgcctggcgtaggcgctgcgcggtccccgccgaccccgagcagcggccgggcccaggccgctggtgttcggctgcgcccgcagcgatcgccgggaactggcggccgctccggcggcggcgatctcccggtgccctgccctccctgtcgccccctgcccggcgcggctggcgaccccgggaggtccccgcggtcgtgcagcgtctgcggagaggctggggggagttcctcgccggtcccagcggtagggcttggcggccgcggagggaagcgggcaggtccccaggccctggccacggccctgcgccccgctgggctccccctccccaccctcgtccccctagcggagcgccgcggccagctgcaacttgttcatccagcccggctgcccgggggtcccaggtgggaaggagaggcactggcggtgtgcgagcaagcgtgtgagtgtgtgcgcgtgtgtgcctgcacgcgcgcgcgggggcgttctaagcccagaggaacccctcacggagaggatctgtggatcggagtcgggggtccggcgtgggggcgaa

SEQ ID NO: 114275 - DNA, 36 bp, Homo sapiens; identical to SEQ ID NO: 82295
  misc_feature 1..36: note = chr18:8261957-8261993
  misc_feature 1..36: note = Hypo
  source 1..36: mol_type = genomic DNA

SEQ ID NO: 114276 - DNA, 30 bp, Homo sapiens; identical to SEQ ID NO: 82296
  misc_feature 1..30: note = chr18:8390038-8390068
  misc_feature 1..30: note = Hypo
  source 1..30: mol_type = genomic DNA

SEQ ID NO: 114277 - DNA, 97 bp, Homo sapiens; identical to SEQ ID NO: 45326
  misc_feature 1..97: note = chr18:8570976-8571073
  misc_feature 1..97: note = Hypo
  source 1..97: mol_type = genomic DNA

SEQ ID NO: 114278 - DNA, 260 bp, Homo sapiens
  misc_feature 1..260: note = chr18:8608722-8608982
  misc_feature 1..260: note = Hyper
  source 1..260: mol_type = genomic DNA
ctctgagtgagacagcgatcagagttaaaaataactgatttcgcgcgtttccgtgcaaaatgggagacagacgtgacggagagagaccgagcagtgccacggcccggtagagggtgcgggggcttgcacccgctggtgtttgtgagagagcgctggtgtagacgcgaacgcagcgcaggcggcccggcggcgcggcctcaggtcggggcctttccagcgttccagctacaccgagcgcgcgggggcgaaaacatgtgcat

SEQ ID NO: 114279 - DNA, 78 bp, Homo sapiens; identical to SEQ ID NO: 82300
  misc_feature 1..78: note = chr18:8612204-8612282
  misc_feature 1..78: note = Hypo
  source 1..78: mol_type = genomic DNA

SEQ ID NO: 114280 - DNA, 30 bp, Homo sapiens; identical to SEQ ID NO: 82301
  misc_feature 1..30: note = chr18:8658999-8659029
  misc_feature 1..30: note = Hypo
  source 1..30: mol_type = genomic DNA

SEQ ID NO: 114281 - DNA, 40 bp, Homo sapiens; identical to SEQ ID NO: 82302
  misc_feature 1..40: note = chr18:8659257-8659297
  misc_feature 1..40: note = Hypo
  source 1..40: mol_type = genomic DNA

SEQ ID NO: 114282 - DNA, 30 bp, Homo sapiens; identical to SEQ ID NO: 82303
  misc_feature 1..30: note = chr18:8663049-8663079
  misc_feature 1..30: note = Hypo
  source 1..30: mol_type = genomic DNA

SEQ ID NO: 114283 - DNA, 200 bp, Homo sapiens; identical to SEQ ID NO: 82304
  misc_feature 1..200: note = chr18:8706608-8706808
  misc_feature 1..200: note = Hyper
  source 1..200: mol_type = genomic DNA

SEQ ID NO: 114284 - DNA, 84 bp, Homo sapiens; identical to SEQ ID NO: 82305
  misc_feature 1..84: note = chr18:8779033-8779117
  misc_feature 1..84: note = Hypo
  source 1..84: mol_type = genomic DNA

SEQ ID NO: 114285 - DNA, 45 bp, Homo sapiens; identical to SEQ ID NO: 82306
  misc_feature 1..45: note = chr18:8823136-8823181
  misc_feature 1..45: note = Hypo
  source 1..45: mol_type = genomic DNA

SEQ ID NO: 114286 - DNA, 40 bp, Homo sapiens; identical to SEQ ID NO: 16294
  misc_feature 1..40: note = chr18:8845133-8845173
  misc_feature 1..40: note = Hypo
  source 1..40: mol_type = genomic DNA

SEQ ID NO: 114287 - DNA, 220 bp, Homo sapiens; identical to SEQ ID NO: 82319
  misc_feature 1..220: note = chr18:9333406-9333626
  misc_feature 1..220: note = Hypo
  source 1..220: mol_type = genomic DNA

SEQ ID NO: 114288 - DNA, 156 bp, Homo sapiens; identical to SEQ ID NO: 82320
  misc_feature 1..156: note = chr18:9364375-9364531
  misc_feature 1..156: note = Hypo
  source 1..156: mol_type = genomic DNA

SEQ ID NO: 114289 - DNA, 30 bp, Homo sapiens; identical to SEQ ID NO: 45331
  misc_feature 1..30: note = chr18:9547786-9547816
  misc_feature 1..30: note = Hypo
  source 1..30: mol_type = genomic DNA

SEQ ID NO: 114290 - DNA, 30 bp, Homo sapiens; identical to SEQ ID NO: 82322
  misc_feature 1..30: note = chr18:9615430-9615460
  misc_feature 1..30: note = Hypo
  source 1..30: mol_type = genomic DNA

SEQ ID NO: 114291 - DNA, 145 bp, Homo sapiens; identical to SEQ ID NO: 82324
  misc_feature 1..145: note = chr18:9707918-9708063
  misc_feature 1..145: note = Hyper
  source 1..145: mol_type = genomic DNA

SEQ ID NO: 114292 - DNA, 192 bp, Homo sapiens; identical to SEQ ID NO: 82325
  misc_feature 1..192: note = chr18:9708338-9708530
  misc_feature 1..192: note = Hyper
  source 1..192: mol_type = genomic DNA

SEQ ID NO: 114293 - DNA, 673 bp, Homo sapiens; identical to SEQ ID NO: 82326
  misc_feature 1..673: note = chr18:9708733-9709406
  misc_feature 1..673: note = Hyper
  source 1..673: mol_type = genomic DNA

SEQ ID NO: 114294 - DNA, 39 bp, Homo sapiens; identical to SEQ ID NO: 82327
  misc_feature 1..39: note = chr18:9720510-9720549
  misc_feature 1..39: note = Hypo
  source 1..39: mol_type = genomic DNA

SEQ ID NO: 114295 - DNA, 34 bp, Homo sapiens; identical to SEQ ID NO: 82328
  misc_feature 1..34: note = chr18:9737968-9738002
  misc_feature 1..34: note = Hypo
  source 1..34: mol_type = genomic DNA

SEQ ID NO: 114296 - DNA, 59 bp, Homo sapiens; identical to SEQ ID NO: 82329
  misc_feature 1..59: note = chr18:9771710-9771769
  misc_feature 1..59: note = Hyper
  source 1..59: mol_type = genomic DNA

SEQ ID NO: 114297 - DNA, 80 bp, Homo sapiens; identical to SEQ ID NO: 82330
  misc_feature 1..80: note = chr18:9797320-9797400
  misc_feature 1..80: note = Hypo
  source 1..80: mol_type = genomic DNA

SEQ ID NO: 114298 - DNA, 30 bp, Homo sapiens; identical to SEQ ID NO: 82331
  misc_feature 1..30: note = chr18:9800222-9800252
  misc_feature 1..30: note = Hypo
  source 1..30: mol_type = genomic DNA

SEQ ID NO: 114299 - DNA, 30 bp, Homo sapiens; identical to SEQ ID NO: 82332
  misc_feature 1..30: note = chr18:9836107-9836137
  misc_feature 1..30: note = Hypo
  source 1..30: mol_type = genomic DNA

SEQ ID NO: 114300 - DNA, 236 bp, Homo sapiens; identical to SEQ ID NO: 82333
  misc_feature 1..236: note = chr18:9912767-9913003
  misc_feature 1..236: note = Hypo
  source 1..236: mol_type = genomic DNA

SEQ ID NO: 114301 - DNA, 90 bp, Homo sapiens; identical to SEQ ID NO: 81560
  misc_feature 1..90: note = chr18:10132081-10132171
  misc_feature 1..90: note = Hyper
  source 1..90: mol_type = genomic DNA

SEQ ID NO: 114302 - DNA, 30 bp, Homo sapiens; identical to SEQ ID NO: 81561
  misc_feature 1..30: note = chr18:10414395-10414425
  misc_feature 1..30: note = Hypo
  source 1..30: mol_type = genomic DNA

SEQ ID NO: 114303 - DNA, 578 bp, Homo sapiens; identical to SEQ ID NO: 81562
  misc_feature 1..578: note = chr18:10454592-10455170
  misc_feature 1..578: note = Hyper
  source 1..578: mol_type = genomic DNA

SEQ ID NO: 114304 - DNA, 46 bp, Homo sapiens; identical to SEQ ID NO: 81563
  misc_feature 1..46: note = chr18:10474416-10474462
  misc_feature 1..46: note = Hypo
  source 1..46: mol_type = genomic DNA

SEQ ID NO: 114305 - DNA, 30 bp, Homo sapiens; identical to SEQ ID NO: 81564
  misc_feature 1..30: note = chr18:10562257-10562287
  misc_feature 1..30: note = Hypo
  source 1..30: mol_type = genomic DNA

SEQ ID NO: 114306 - DNA, 543 bp, Homo sapiens; identical to SEQ ID NO: 81565
  misc_feature 1..543: note = chr18:10589037-10589580
  misc_feature 1..543: note = Hypo
  source 1..543: mol_type = genomic DNA

SEQ ID NO: 114307 - DNA, 30 bp, Homo sapiens; identical to SEQ ID NO: 45335
  misc_feature 1..30: note = chr18:10664802-10664832
  misc_feature 1..30: note = Hypo
  source 1..30: mol_type = genomic DNA

SEQ ID NO: 114308 - DNA, 149 bp, Homo sapiens; identical to SEQ ID NO: 81567
  misc_feature 1..149: note = chr18:10696211-10696360
  misc_feature 1..149: note = Hypo
  source 1..149: mol_type = genomic DNA

SEQ ID NO: 114309 - DNA, 25 bp, Homo sapiens
  misc_feature 1..25: note = chr18:10809544-10809569
  misc_feature 1..25: note = Hypo
  source 1..25: mol_type = genomic DNA
tgtgagccaccgcacctggcatctc

SEQ ID NO: 114310 - DNA, 30 bp, Homo sapiens; identical to SEQ ID NO: 45337
  misc_feature 1..30: note = chr18:10832633-10832663
  misc_feature 1..30: note = Hypo
  source 1..30: mol_type = genomic DNA

SEQ ID NO: 114311 - DNA, 25 bp, Homo sapiens
  misc_feature 1..25: note = chr18:10906877-10906902
  misc_feature 1..25: note = Hypo
  source 1..25: mol_type = genomic DNA
tgtcttttgtcgccttcctgagccc

SEQ ID NO: 114312 - DNA, 89 bp, Homo sapiens; identical to SEQ ID NO: 81571
  misc_feature 1..89: note = chr18:10907451-10907540
  misc_feature 1..89: note = Hypo
  source 1..89: mol_type = genomic DNA

SEQ ID NO: 114313 - DNA, 86 bp, Homo sapiens; identical to SEQ ID NO: 45339
  misc_feature 1..86: note = chr18:11009583-11009669
  misc_feature 1..86: note = Hypo
  source 1..86: mol_type = genomic DNA

SEQ ID NO: 114314 - DNA, 87 bp, Homo sapiens; identical to SEQ ID NO: 81573
  misc_feature 1..87: note = chr18:11074158-11074245
  misc_feature 1..87: note = Hypo
  source 1..87: mol_type = genomic DNA

SEQ ID NO: 114315 - DNA, 36 bp, Homo sapiens; identical to SEQ ID NO: 81574
  misc_feature 1..36: note = chr18:11103949-11103985
  misc_feature 1..36: note = Hypo
  source 1..36: mol_type = genomic DNA

SEQ ID NO: 114316 - DNA, 35 bp, Homo sapiens; identical to SEQ ID NO: 81575
  misc_feature 1..35: note = chr18:11148401-11148436
  misc_feature 1..35: note = Hyper
  source 1..35: mol_type = genomic DNA

SEQ ID NO: 114317 - DNA, 593 bp, Homo sapiens
  misc_feature 1..593: note = chr18:11148663-11149256
  misc_feature 1..593: note = Hyper
  source 1..593: mol_type = genomic DNA
ccgtctatggcctctcgccgccggcagctcgcagccacccgagcatcgcctcggcgcgggccgcgacgctctccgccccgagggcacgctcccggggctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaaagggggcaagaagggcgtgctgtgctcccgcctggctcccggggcgtcgtttgggggcggccggggagttttctacttggaagcccctctgaagccaccgcgtctcctttgcccggcctcgtctccgctgcccacgcaggctgccgcgctctggcctcggccccggctctcggagctgcccggcgggctccgggtctcgccctccagcccccaggcggcccgcggcggatccccgagaggcagcgcagctcagcccctgcgccccccagcttcgggccggagagacc

SEQ ID NO: 114318 - DNA, 494 bp, Homo sapiens
  misc_feature 1..494: note = chr18:11149498-11149992
  misc_feature 1..494: note = Hyper
  source 1..494: mol_type = genomic DNA
gccgccttgcagcctcgccctcgcggcgcagccggggctccccggcggcgcgcgcttctccaccttcaatgaaactttcgaagccctcactcggggacgggcgtgtcccccggccaatgggatggcggctccggggcctgcgcgcgcggagcccgcccctgagcggctggggaagtgagagccttgcaccggcgcggagggcaagcccccacccgcggctcccgcgcctgggagagacccggcctggcctgccagtgggctgcgcgccttggctcgccctccgcgggcactcctgccccactggctcccgcagccccgcggctctgcgtggttctgtcattccggtggtgcaccctggcatccagtccacccggccgggccctgagcttgcccaaacccagggaaccgtttaaggtccgagggaaacgcacaggcccggcaggagagaagccaggggcttggagagtcctgtgcgaccccgacttctgctgggt

SEQ ID NO: 114319 - DNA, 30 bp, Homo sapiens; identical to SEQ ID NO: 81580
  misc_feature 1..30: note = chr18:11211262-11211292
  misc_feature 1..30: note = Hypo
  source 1..30: mol_type = genomic DNA

SEQ ID NO: 114320 - DNA, 30 bp, Homo sapiens; identical to SEQ ID NO: 81581
  misc_feature 1..30: note = chr18:11214264-11214294
  misc_feature 1..30: note = Hypo
  source 1..30: mol_type = genomic DNA

SEQ ID NO: 114321 - DNA, 88 bp, Homo sapiens; identical to SEQ ID NO: 81582
  misc_feature 1..88: note = chr18:11232104-11232192
  misc_feature 1..88: note = Hypo
  source 1..88: mol_type = genomic DNA

SEQ ID NO: 114322 - DNA, 27 bp, Homo sapiens
  misc_feature 1..27: note = chr18:11263248-11263275
  misc_feature 1..27: note = Hypo
  source 1..27: mol_type = genomic DNA
tgtgagccaccacgcccagcctaaaat

SEQ ID NO: 114323 - DNA, 30 bp, Homo sapiens; identical to SEQ ID NO: 81584
  misc_feature 1..30: note = chr18:11378497-11378527
  misc_feature 1..30: note = Hypo
  source 1..30: mol_type = genomic DNA

SEQ ID NO: 114324 - DNA, 46 bp, Homo sapiens; identical to SEQ ID NO: 81585
  misc_feature 1..46: note = chr18:11379033-11379079
  misc_feature 1..46: note = Hypo
  source 1..46: mol_type = genomic DNA

SEQ ID NO: 114325 - DNA, 129 bp, Homo sapiens; identical to SEQ ID NO: 81586
  misc_feature 1..129: note = chr18:11401631-11401760
  misc_feature 1..129: note = Hypo
  source 1..129: mol_type = genomic DNA

SEQ ID NO: 114326 - DNA, 175 bp, Homo sapiens; identical to SEQ ID NO: 81587
  misc_feature 1..175: note = chr18:11430289-11430464
  misc_feature 1..175: note = Hypo
  source 1..175: mol_type = genomic DNA

SEQ ID NO: 114327 - DNA, 458 bp, Homo sapiens; identical to SEQ ID NO: 81588
  misc_feature 1..458: note = chr18:11533257-11533715
  misc_feature 1..458: note = Hypo
  source 1..458: mol_type = genomic DNA

SEQ ID NO: 114328 - DNA, 173 bp, Homo sapiens; identical to SEQ ID NO: 81589
  misc_feature 1..173: note = chr18:11546891-11547064
  misc_feature 1..173: note = Hypo
  source 1..173: mol_type = genomic DNA

SEQ ID NO: 114329 - DNA, 30 bp, Homo sapiens; identical to SEQ ID NO: 81590
  misc_feature 1..30: note = chr18:11571295-11571325
  misc_feature 1..30: note = Hypo
  source 1..30: mol_type = genomic DNA

SEQ ID NO: 114330 - DNA, 82 bp, Homo sapiens; identical to SEQ ID NO: 81591
  misc_feature 1..82: note = chr18:11580091-11580173
  misc_feature 1..82: note = Hypo
  source 1..82: mol_type = genomic DNA

SEQ ID NO: 114331 - DNA, 39 bp, Homo sapiens; identical to SEQ ID NO: 81592
  misc_feature 1..39: note = chr18:11689795-11689834
  misc_feature 1..39: note = Hyper
  source 1..39: mol_type = genomic DNA

SEQ ID NO: 114332 - DNA, 30 bp, Homo sapiens; identical to SEQ ID NO: 81593
  misc_feature 1..30: note = chr18:11749664-11749694
  misc_feature 1..30: note = Hypo
  source 1..30: mol_type = genomic DNA

SEQ ID NO: 114333 - DNA, 1372 bp, Homo sapiens
  misc_feature 1..1372: note = chr18:11751397-11752769
  misc_feature 1..1372: note = Hyper
  source 1..1372: mol_type = genomic DNA
actgcacaggagaaacgggggctggaggtaaagacaggaggctcgggaggcggcgacgtgggcgagctggaatagtctagaagctgagcagaacaaaggcggtgtgactggtgagcctcggagggatcctcctccctgctagaatatgcatgatcctccgcgagtcttcgcccgccaggagcagggacgcgtccgagccaacacggggcgcgcgcccagacgcactttcccggctcggggtgcaagagagccaggcggccgcggcgcagcggaggggctgcgggcccggaacccaggccggtcagcgtgtaagcgccccagccggccgggctccgtggggggtcagctccctgacccctacagcgcggtagcgcctctccgagagctccgggaccagcggcccggccgcccccaaagccagcctccctctcccttccccgcaccgggatcccagaccagggagggggcgcacgtccgacggctgaggaatagcagggcgcgagccggcccggcaggtgcccatcgtcgccctctgggaccccggtggcgcgctctgtcctccgcgccacgctcagccaccaccccggctgtttgggacccggcacccagccgagcgcgccgccccctcggggacccgctgggcggggctgagcgaggcttggagtgcgggcgaagggacgtggggcgaacccggggcgctgcgccacctcggctgtctccagcggagaccggcgccctcgccccccgtctccgttcattgtgctgtattcatccagcagattttgaaacaattctcgtgtaaaaaggcattttactccgcgcgtcttccttacagccatttagttgggagtttgcggtgggcagggggagggagaagaaacgcctgctctgaatcggaaaacaccgaagagaccagaccatctctttcagcagcaggaaagagaggagccgtcgcaggagccgcacacgtctccaactctctattgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcccggccccagcggagcgcacagccaggagcggcgagcgccaggctgggcgggcagggccgggcgagggtcgcgcgcacctctgggccgcggagcccagacggcggccggggcgagctcctccagccaggaacccgcgtgtaggaaatccccgtgctgggggagga

SEQ ID NO: 114334 - DNA, 36 bp, Homo sapiens; identical to SEQ ID NO: 81597
  misc_feature 1..36: note = chr18:11822332-11822368
  misc_feature 1..36: note = Hypo
  source 1..36: mol_type = genomic DNA

SEQ ID NO: 114335 - DNA, 37 bp, Homo sapiens; identical to SEQ ID NO: 81598
  misc_feature 1..37: note = chr18:11877710-11877747
  misc_feature 1..37: note = Hypo
  source 1..37: mol_type = genomic DNA

SEQ ID NO: 114336 - DNA, 20 bp, Homo sapiens
  misc_feature 1..20: note = chr18:11921463-11921483
  misc_feature 1..20: note = Hypo
  source 1..20: mol_type = genomic DNA
ctggccgacaggttctaatt

SEQ ID NO: 114337 - DNA, 18 bp, Homo sapiens
  misc_feature 1..18: note = chr18:11942728-11942746
  misc_feature 1..18: note = Hypo
  source 1..18: mol_type = genomic DNA
tttttttttttgagacgg

SEQ ID NO: 114338 - DNA, 120 bp, Homo sapiens; identical to SEQ ID NO: 81601
  misc_feature 1..120: note = chr18:11942866-11942986
  misc_feature 1..120: note = Hypo
  source 1..120: mol_type = genomic DNA

SEQ ID NO: 114339 - DNA, 239 bp, Homo sapiens; identical to SEQ ID NO: 81602
  misc_feature 1..239: note = chr18:11947249-11947488
  misc_feature 1..239: note = Hyper
  source 1..239: mol_type = genomic DNA

SEQ ID NO: 114340 - DNA, 30 bp, Homo sapiens; identical to SEQ ID NO: 16298
  misc_feature 1..30: note = chr18:11979044-11979074
  misc_feature 1..30: note = Hypo
  source 1..30: mol_type = genomic DNA

SEQ ID NO: 114341 - DNA, 102 bp, Homo sapiens; identical to SEQ ID NO: 81604
  misc_feature 1..102: note = chr18:11979855-11979957
  misc_feature 1..102: note = Hypo
  source 1..102: mol_type = genomic DNA

SEQ ID NO: 114342 - DNA, 168 bp, Homo sapiens; identical to SEQ ID NO: 81605
  misc_feature 1..168: note = chr18:11989272-11989440
  misc_feature 1..168: note = Hypo
  source 1..168: mol_type = genomic DNA

SEQ ID NO: 114343 - DNA, 30 bp, Homo sapiens; identical to SEQ ID NO: 81606
  misc_feature 1..30: note = chr18:11995477-11995507
  misc_feature 1..30: note = Hyper
  source 1..30: mol_type = genomic DNA

SEQ ID NO: 114344 - DNA, 30 bp, Homo sapiens; identical to SEQ ID NO: 81607
  misc_feature 1..30: note = chr18:12005824-12005854
  misc_feature 1..30: note = Hypo
  source 1..30: mol_type = genomic DNA

SEQ ID NO: 114345 - DNA, 19 bp, Homo sapiens
  misc_feature 1..19: note = chr18:12072041-12072060
  misc_feature 1..19: note = Hypo
  source 1..19: mol_type = genomic DNA
actccgtctcaaaacaaaa

SEQ ID NO: 114346 - DNA, 30 bp, Homo sapiens; identical to SEQ ID NO: 45345
  misc_feature 1..30: note = chr18:12076093-12076123
  misc_feature 1..30: note = Hypo
  source 1..30: mol_type = genomic DNA

SEQ ID NO: 114347 - DNA, 151 bp, Homo sapiens; identical to SEQ ID NO: 81610
  misc_feature 1..151: note = chr18:12208462-12208613
  misc_feature 1..151: note = Hypo
  source 1..151: mol_type = genomic DNA

SEQ ID NO: 114348 - DNA, 30 bp, Homo sapiens; identical to SEQ ID NO: 81611
  misc_feature 1..30: note = chr18:12245897-12245927
  misc_feature 1..30: note = Hypo
  source 1..30: mol_type = genomic DNA

SEQ ID NO: 114349 - DNA, 301 bp, Homo sapiens; identical to SEQ ID NO: 81612
  misc_feature 1..301: note = chr18:12253591-12253892
  misc_feature 1..301: note = Hyper
  source 1..301: mol_type = genomic DNA

SEQ ID NO: 114350 - DNA, 526 bp, Homo sapiens
  misc_feature 1..526: note = chr18:12254104-12254630
  misc_feature 1..526: note = Hyper
  source 1..526: mol_type = genomic DNA
tgaccaaaagagacccggggagcatctgggcttccaaggtcctcggtacggcccaaggcagcgaaggacgcgcggctccaggctgcgggagccaggacgaccgggggctcccagagcgcgaagtcgcgatcctcggcggtggagagctcgtgccaaaacgtcctcccctgcgccagtcaggccttcgcggggctggcaggcgggcgggggcggggccgccgcactttaagaggctgtgcaggcagacagacctccaggcccgctaggggatccgcgccatggaggccgcccgggactatgcaggagccctcatcaggcgagtgccccgcgtccccctgattgccgtgcgcttccaatcgccttgcgttcggtggcctcatattcccctgtgcgcctctagtaccgtaccccgctcccttcagccccctgctccccgcattctcttgcgctccgcgaccccgcgcacacacccatccgccccactggtgcccaagccgtccagccgcgcccgcgggcagagcccaat

SEQ ID NO: 114351 - DNA, 167 bp, Homo sapiens; identical to SEQ ID NO: 81615
  misc_feature 1..167: note = chr18:12258116-12258283
  misc_feature 1..167: note = Hypo
  source 1..167: mol_type = genomic DNA

SEQ ID NO: 114352 - DNA, 171 bp, Homo sapiens; identical to SEQ ID NO: 81616
  misc_feature 1..171: note = chr18:12287792-12287963
  misc_feature 1..171: note = Hyper
  source 1..171: mol_type = genomic DNA

SEQ ID NO: 114353 - DNA, 1065 bp, Homo sapiens
  misc_feature 1..1065: note = chr18:12307144-12308209
  misc_feature 1..1065: note = Hyper
  source 1..1065: mol_type = genomic DNA
ccactcccttccaaacgtacaaacatgcacacacacaattaggaatttcccaaagttttcatctgtctaaaaagaaagtgccagtgcaaattacagaacatcgtcgcttcctcatgtgcggcgtttctacgggcctgggaggggacgcagaggctaccccggtggtcccagcctgcagcgttcacgtgaggaaacttccgcaaaagccctgatgcatgcacattctgactgcagaggccagagcatcccgcattttggaggctgaaaggctcccctaggataaccttttccgttaacagaggagtccgctgaagcgcagagctaactgaaaacagctagaattaaaatccaagtcacccggccggcatcagcagtcattcctttccaccacacaaaactggccaggaagacggactctggcgcgccctcccaggccgaagcgcatttcttcgctaacgcgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtcccccgactggcgcccgcgcgtcctccctcggctgctgcaggccgggccgcggcgtcgagcgggggcggcggggcggggcccgcagccattggcgagcggcggggcgggggcgggggcgcggaggg

SEQ ID NO: 114354 - DNA, 30 bp, Homo sapiens; identical to SEQ ID NO: 36912
  misc_feature 1..30: note = chr18:12308897-12308927
  misc_feature 1..30: note = Hyper
  source 1..30: mol_type = genomic DNA

SEQ ID NO: 114355 - DNA, 27 bp, Homo sapiens
  misc_feature 1..27: note = chr18:12375267-12375294
  misc_feature 1..27: note = Hypo
  source 1..27: mol_type = genomic DNA
ttaggagacagagtccgtcacccacgc

SEQ ID NO: 114356 - DNA, 120 bp, Homo sapiens; identical to SEQ ID NO: 81620
  misc_feature 1..120: note = chr18:12375354-12375474
  misc_feature 1..120: note = Hypo
  source 1..120: mol_type = genomic DNA

SEQ ID NO: 114357 - DNA, 120 bp, Homo sapiens; identical to SEQ ID NO: 81621
  misc_feature 1..120: note = chr18:12375952-12376072
  misc_feature 1..120: note = Hypo
  source 1..120: mol_type = genomic DNA

SEQ ID NO: 114358 - DNA, 29 bp, Homo sapiens
  misc_feature 1..29: note = chr18:12376132-12376161
  misc_feature 1..29: note = Hypo
  source 1..29: mol_type = genomic DNA
ccttacagtgaagacgttgagctgactac

SEQ ID NO: 114359 - DNA, 96 bp, Homo sapiens; identical to SEQ ID NO: 81623
  misc_feature 1..96: note = chr18:12408021-12408117
  misc_feature 1..96: note = Hyper
  source 1..96: mol_type = genomic DNA

SEQ ID NO: 114360 - DNA, 62 bp, Homo sapiens; identical to SEQ ID NO: 81624
  misc_feature 1..62: note = chr18:12420148-12420210
  misc_feature 1..62: note = Hyper
  source 1..62: mol_type = genomic DNA

SEQ ID NO: 114361 - DNA, 59 bp, Homo sapiens; identical to SEQ ID NO: 81625
  misc_feature 1..59: note = chr18:12657095-12657154
  misc_feature 1..59: note = Hyper
  source 1..59: mol_type = genomic DNA

SEQ ID NO: 114362 - DNA, 30 bp, Homo sapiens; identical to SEQ ID NO: 81626
  misc_feature 1..30: note = chr18:12700987-12701017
  misc_feature 1..30: note = Hypo
  source 1..30: mol_type = genomic DNA

SEQ ID NO: 114363 - DNA, 30 bp, Homo sapiens; identical to SEQ ID NO: 16300
  misc_feature 1..30: note = chr18:12701811-12701841
  misc_feature 1..30: note = Hypo
  source 1..30: mol_type = genomic DNA

SEQ ID NO: 114364 - DNA, 244 bp, Homo sapiens
  misc_feature 1..244: note = chr18:12911076-12911320
  misc_feature 1..244: note = Hyper
  source 1..244: mol_type = genomic DNA
caggttggggcaggccgggtggggcccagcgagtgggcgggggcgcgagcgggagcggaagcgggcccgggccgcactgctgccgcgtctagccgcctcccaggctgcctgcgccgcgtggctcgcccccgggacttgccagcagcgagtggggcctgactagctcttcaccacgctccactgcatcggcaagggctggttctgggagaggcgcaagggcatcgacctccgcaccaatcaggtg

SEQ ID NO: 114365 - DNA, 157 bp, Homo sapiens; identical to SEQ ID NO: 81629
  misc_feature 1..157: note = chr18:12949178-12949335
  misc_feature 1..157: note = Hypo
  source 1..157: mol_type = genomic DNA

SEQ ID NO: 114366 - DNA, 35 bp, Homo sapiens; identical to SEQ ID NO: 81630
  misc_feature 1..35: note = chr18:13036778-13036813
  misc_feature 1..35: note = Hypo
  source 1..35: mol_type = genomic DNA

SEQ ID NO: 114367 - DNA, 19 bp, Homo sapiens
  misc_feature 1..19: note = chr18:13135175-13135194
  misc_feature 1..19: note = Hypo
  source 1..19: mol_type = genomic DNA
gaggcgccaagagtgagcg

SEQ ID NO: 114368 - DNA, 28 bp, Homo sapiens
  misc_feature 1..28: note = chr18:13195551-13195579
  misc_feature 1..28: note = Hypo
  source 1..28: mol_type = genomic DNA
ttttttctggtgtctcgctctgtcgccc

SEQ ID NO: 114369 - DNA, 27 bp, Homo sapiens
  misc_feature 1..27: note = chr18:13195819-13195846
  misc_feature 1..27: note = Hypo
  source 1..27: mol_type = genomic DNA
agccaccgcacccggccaagaagtaca

SEQ ID NO: 114370 - DNA, 346 bp, Homo sapiens; identical to SEQ ID NO: 81634
  misc_feature 1..346: note = chr18:13218173-13218519
  misc_feature 1..346: note = Hyper
  source 1..346: mol_type = genomic DNA

SEQ ID NO: 114371 - DNA, 30 bp, Homo sapiens; identical to SEQ ID NO: 81635
  misc_feature 1..30: note = chr18:13219094-13219124
  misc_feature 1..30: note = Hyper
  source 1..30: mol_type = genomic DNA

SEQ ID NO: 114372 - DNA, 30 bp, Homo sapiens; identical to SEQ ID NO: 81636
  misc_feature 1..30: note = chr18:13228292-13228322
  misc_feature 1..30: note = Hypo
  source 1..30: mol_type = genomic DNA

SEQ ID NO: 114373 - DNA, 119 bp, Homo sapiens; identical to SEQ ID NO: 81637
  misc_feature 1..119: note = chr18:13231199-13231318
  misc_feature 1..119: note = Hypo
  source 1..119: mol_type = genomic DNA

SEQ ID NO: 114374 - DNA, 40 bp, Homo sapiens; identical to SEQ ID NO: 81638
  misc_feature 1..40: note = chr18:13233142-13233182
  misc_feature 1..40: note = Hypo
  source 1..40: mol_type = genomic DNA

SEQ ID NO: 114375 - DNA, 127 bp, Homo sapiens; identical to SEQ ID NO: 81639
  misc_feature 1..127: note = chr18:13241262-13241389
  misc_feature 1..127: note = Hypo
  source 1..127: mol_type = genomic DNA

SEQ ID NO: 114376 - DNA, 102 bp, Homo sapiens; identical to SEQ ID NO: 81640
  misc_feature 1..102: note = chr18:13241775-13241877
  misc_feature 1..102: note = Hypo
  source 1..102: mol_type = genomic DNA

SEQ ID NO: 114377 - DNA, 64 bp, Homo sapiens; identical to SEQ ID NO: 81641
  misc_feature 1..64: note = chr18:13277290-13277354
  misc_feature 1..64: note = Hypo
  source 1..64: mol_type = genomic DNA

SEQ ID NO: 114378 - DNA, 35 bp, Homo sapiens; identical to SEQ ID NO: 81642
  misc_feature 1..35: note = chr18:13295972-13296007
  misc_feature 1..35: note = Hypo
  source 1..35: mol_type = genomic DNA

SEQ ID NO: 114379 - DNA, 115 bp, Homo sapiens; identical to SEQ ID NO: 81643
  misc_feature 1..115: note = chr18:13319261-13319376
  misc_feature 1..115: note = Hypo
  source 1..115: mol_type = genomic DNA

SEQ ID NO: 114380 - DNA, 48 bp, Homo sapiens; identical to SEQ ID NO: 81644
  misc_feature 1..48: note = chr18:13369153-13369201
  misc_feature 1..48: note = Hypo
  source 1..48: mol_type = genomic DNA

SEQ ID NO: 114381 - DNA, 102 bp, Homo sapiens; identical to SEQ ID NO: 81645
  misc_feature 1..102: note = chr18:13404829-13404931
  misc_feature 1..102: note = Hypo
  source 1..102: mol_type = genomic DNA

SEQ ID NO: 114382 - DNA, 33 bp, Homo sapiens; identical to SEQ ID NO: 81646
  misc_feature 1..33: note = chr18:13405710-13405743
  misc_feature 1..33: note = Hypo
  source 1..33: mol_type = genomic DNA

SEQ ID NO: 114383 - DNA, 20 bp, Homo sapiens
  misc_feature 1..20: note = chr18:13417718-13417738
  misc_feature 1..20: note = Hypo
  source 1..20: mol_type = genomic DNA
caccacgcccagccagtttg

SEQ ID NO: 114384 - DNA, 127 bp, Homo sapiens; identical to SEQ ID NO: 81648
  misc_feature 1..127: note = chr18:13425990-13426117
  misc_feature 1..127: note = Hypo
  source 1..127: mol_type = genomic DNA

SEQ ID NO: 114385 - DNA, 52 bp, Homo sapiens; identical to SEQ ID NO: 81649
  misc_feature 1..52: note = chr18:13430352-13430404
  misc_feature 1..52: note = Hypo
  source 1..52: mol_type = genomic DNA

SEQ ID NO: 114386 - DNA, 33 bp, Homo sapiens; identical to SEQ ID NO: 81650
  misc_feature 1..33: note = chr18:13432064-13432097
  misc_feature 1..33: note = Hypo
  source 1..33: mol_type = genomic DNA

SEQ ID NO: 114387 - DNA, 46 bp, Homo sapiens; identical to SEQ ID NO: 81651
  misc_feature 1..46: note = chr18:13452310-13452356
  misc_feature 1..46: note = Hypo
  source 1..46: mol_type = genomic DNA

SEQ ID NO: 114388 - DNA, 111 bp, Homo sapiens; identical to SEQ ID NO: 45355
  misc_feature 1..111: note = chr18:13452723-13452834
  misc_feature 1..111: note = Hypo
  source 1..111: mol_type = genomic DNA

SEQ ID NO: 114389 - DNA, 30 bp, Homo sapiens; identical to SEQ ID NO: 81653
  misc_feature 1..30: note = chr18:13457997-13458027
  misc_feature 1..30: note = Hypo
  source 1..30: mol_type = genomic DNA

SEQ ID NO: 114390 - DNA, 283 bp, Homo sapiens; identical to SEQ ID NO: 45356
  misc_feature 1..283: note = chr18:13461100-13461383
  misc_feature 1..283: note = Hypo
  source 1..283: mol_type = genomic DNA

SEQ ID NO: 114391 - DNA, 156 bp, Homo sapiens; identical to SEQ ID NO: 81655
  misc_feature 1..156: note = chr18:13477773-13477929
  misc_feature 1..156: note = Hypo
  source 1..156: mol_type = genomic DNA

SEQ ID NO: 114392 - DNA, 30 bp, Homo sapiens; identical to SEQ ID NO: 81656
  misc_feature 1..30: note = chr18:13485138-13485168
  misc_feature 1..30: note = Hypo
  source 1..30: mol_type = genomic DNA

SEQ ID NO: 114393 - DNA, 32 bp, Homo sapiens; identical to SEQ ID NO: 45357
  misc_feature 1..32: note = chr18:13486501-13486533
  misc_feature 1..32: note = Hypo
  source 1..32: mol_type = genomic DNA

SEQ ID NO: 114394 - DNA, 30 bp, Homo sapiens; identical to SEQ ID NO: 45358
  misc_feature 1..30: note = chr18:13486818-13486848
  misc_feature 1..30: note = Hypo
  source 1..30: mol_type = genomic DNA

SEQ ID NO: 114395 - DNA, 30 bp, Homo sapiens; identical to SEQ ID NO: 81659
  misc_feature 1..30: note = chr18:13491518-13491548
  misc_feature 1..30: note = Hypo
  source 1..30: mol_type = genomic DNA

SEQ ID NO: 114396 - DNA, 164 bp, Homo sapiens; identical to SEQ ID NO: 81660
  misc_feature 1..164: note = chr18:13516316-13516480
  misc_feature 1..164: note = Hypo
  source 1..164: mol_type = genomic DNA

SEQ ID NO: 114397 - DNA, 30 bp, Homo sapiens; identical to SEQ ID NO: 81661
  misc_feature 1..30: note = chr18:13523082-13523112
  misc_feature 1..30: note = Hypo
  source 1..30: mol_type = genomic DNA

SEQ ID NO: 114398 - DNA, 115 bp, Homo sapiens; identical to SEQ ID NO: 81662
  misc_feature 1..115: note = chr18:13531749-13531864
  misc_feature 1..115: note = Hypo
  source 1..115: mol_type = genomic DNA

SEQ ID NO: 114399 - DNA, 30 bp, Homo sapiens; identical to SEQ ID NO: 81663
  misc_feature 1..30: note = chr18:13543948-13543978
  misc_feature 1..30: note = Hypo
  source 1..30: mol_type = genomic DNA

SEQ ID NO: 114400 - DNA, 30 bp, Homo sapiens; identical to SEQ ID NO: 81664
  misc_feature 1..30: note = chr18:13545314-13545344
  misc_feature 1..30: note = Hypo
  source 1..30: mol_type = genomic DNA

SEQ ID NO: 114401 - DNA, 85 bp, Homo sapiens; identical to SEQ ID NO: 45359
  misc_feature 1..85: note = chr18:13583740-13583825
  misc_feature 1..85: note = Hypo
  source 1..85: mol_type = genomic DNA

SEQ ID NO: 114402 - DNA, 30 bp, Homo sapiens; identical to SEQ ID NO: 45360
  misc_feature 1..30: note = chr18:13603756-13603786
  misc_feature 1..30: note = Hypo
  source 1..30: mol_type = genomic DNA

SEQ ID NO: 114403 - DNA, 30 bp, Homo sapiens; identical to SEQ ID NO: 81667
  misc_feature 1..30: note = chr18:13605780-13605810
  misc_feature 1..30: note = Hypo
  source 1..30: mol_type = genomic DNA

SEQ ID NO: 114404 - DNA, 30 bp, Homo sapiens; identical to SEQ ID NO: 81668
  misc_feature 1..30: note = chr18:13621196-13621226
  misc_feature 1..30: note = Hypo
  source 1..30: mol_type = genomic DNA

SEQ ID NO: 114405 - DNA, 67 bp, Homo sapiens; identical to SEQ ID NO: 45361
  misc_feature 1..67: note = chr18:13621659-13621726
  misc_feature 1..67: note = Hypo
  source 1..67: mol_type = genomic DNA

SEQ ID NO: 114406 - DNA, 237 bp, Homo sapiens; identical to SEQ ID NO: 45362
  misc_feature 1..237: note = chr18:13621998-13622235
  misc_feature 1..237: note = Hypo
  source 1..237: mol_type = genomic DNA

SEQ ID NO: 114407 - DNA, 30 bp, Homo sapiens; identical to SEQ ID NO: 81671
  misc_feature 1..30: note = chr18:13645211-13645241
  misc_feature 1..30: note = Hypo
  source 1..30: mol_type = genomic DNA

SEQ ID NO: 114408 - DNA, 59 bp, Homo sapiens; identical to SEQ ID NO: 81672
  misc_feature 1..59: note = chr18:13824214-13824273
  misc_feature 1..59: note = Hyper
  source 1..59: mol_type = genomic DNA

SEQ ID NO: 114409 - DNA, 289 bp, Homo sapiens; identical to SEQ ID NO: 81673
  misc_feature 1..289: note = chr18:13826303-13826592
  misc_feature 1..289: note = Hypo
  source 1..289: mol_type = genomic DNA

SEQ ID NO: 114410 - DNA, 267 bp, Homo sapiens; identical to SEQ ID NO: 81674
  misc_feature 1..267: note = chr18:13836758-13837025
  misc_feature 1..267: note = Hypo
  source 1..267: mol_type = genomic DNA

SEQ ID NO: 114411 - DNA, 30 bp, Homo sapiens; identical to SEQ ID NO: 81675
  misc_feature 1..30: note = chr18:13837373-13837403
  misc_feature 1..30: note = Hypo
  source 1..30: mol_type = genomic DNA

SEQ ID NO: 114412 - DNA, 33 bp, Homo sapiens; identical to SEQ ID NO: 81676
  misc_feature 1..33: note = chr18:13839105-13839138
  misc_feature 1..33: note = Hypo
  source 1..33: mol_type = genomic DNA

SEQ ID NO: 114413 - DNA, 784 bp, Homo sapiens
  misc_feature 1..784: note = chr18:13868546-13869330
  misc_feature 1..784: note = Hyper
  source 1..784: mol_type = genomic DNA
agcaagaatgcagcacggagcggagtccaggatgctcagcgtgggcctcggagtctgtgtgcgatcagctggagtccaggatgctcagcgtggacctcggagaccgtgtgggctctgcgctctgcagctgagacacagtcacccgcccgatgggcggagaaaggggcagctttgaaaacaagcgcaaggagatgcatccaaaagacaaccgaacccatcagggtaaggagcgcagcggtggagtgtgagggggaaccagaagggcggccagggccggcggcatgccatgccaggcagccccgcgccaccccggaacactgggacactctcatattcccaaagggacttctccatgcggcgctctgaccaggcatcgccgcaggacgcataacagagagagcgagcgcagggcacccggcccatcagctcttccttcacctgaactgccccggcctcgctgagacgcggattttaaaaccgccctgcacctatgtgctggcagccaggccctgggaacttcctccaaacactcccatgagttcgggatgactagcatcagttttcagctggagagcagacggcaactgaacgctgcgaagtcccacgatggggatgagaggaccagagccccgaggccagtcgcccccctcccgcccatccgcccgcccgcccgccacgcagggctgctctagcgcctgcctcttcctcttccatagaaacagggttggggagagaaatgttatgttgctggcccaggattggcattgagcgttgttcaattaag

SEQ ID NO: 114414 - DNA, 30 bp, Homo sapiens; identical to SEQ ID NO: 81679
  misc_feature 1..30: note = chr18:13886627-13886657
  misc_feature 1..30: note = Hypo
  source 1..30: mol_type = genomic DNA

SEQ ID NO: 114415 - DNA, 121 bp, Homo sapiens; identical to SEQ ID NO: 81680
  misc_feature 1..121: note = chr18:13940522-13940643
  misc_feature 1..121: note = Hypo
  source 1..121: mol_type = genomic DNA

SEQ ID NO: 114416 - DNA, 122 bp, Homo sapiens; identical to SEQ ID NO: 81681
  misc_feature 1..122: note = chr18:14450326-14450448
  misc_feature 1..122: note = Hyper
  source 1..122: mol_type = genomic DNA

SEQ ID NO: 114417 - DNA, 80 bp, Homo sapiens; identical to SEQ ID NO: 81682
  misc_feature 1..80: note = chr18:14450712-14450792
  misc_feature 1..80: note = Hyper
  source 1..80: mol_type = genomic DNA

SEQ ID NO: 114418 - DNA, 16 bp, Homo sapiens
  misc_feature 1..16: note = chr18:14475514-14475530
  misc_feature 1..16: note = Hypo
  source 1..16: mol_type = genomic DNA
gaggacccagctcccc

SEQ ID NO: 114419 - DNA, 38 bp, Homo sapiens
  misc_feature 1..38: note = chr18:14748159-14748197
  misc_feature 1..38: note = Hyper
  source 1..38: mol_type = genomic DNA
gagctgctgctgtaacgctctaacgttagagcagctaa

SEQ ID NO: 114420 - DNA, 44 bp, Homo sapiens; identical to SEQ ID NO: 81684
  misc_feature 1..44: note = chr18:15003453-15003497
  misc_feature 1..44: note = Hypo
  source 1..44: mol_type = genomic DNA

SEQ ID NO: 114421 - DNA, 34 bp, Homo sapiens; identical to SEQ ID NO: 81685
  misc_feature 1..34: note = chr18:15017364-15017398
  misc_feature 1..34: note = Hypo
  source 1..34: mol_type = genomic DNA

SEQ ID NO: 114422 - DNA, 101 bp, Homo sapiens; identical to SEQ ID NO: 81686
  misc_feature 1..101: note = chr18:15198000-15198101
  misc_feature 1..101: note = Hyper
  source 1..101: mol_type = genomic DNA

SEQ ID NO: 114423 - DNA, 120 bp, Homo sapiens
  misc_feature 1..120: note = chr18:15198161-15198281
  misc_feature 1..120: note = Hyper
  source 1..120: mol_type = genomic DNA
aaaagcagcggtggcgctgacaaaaagccgcaaaaagcagcggcagcgggggtaaaaagctgcaaaaagccgcggaggcgcgggcgataagccgcggcggcgtggagcaaaaagccgcgg

SEQ ID NO: 114424 - DNA, 85 bp, Homo sapiens; identical to SEQ ID NO: 81688
  misc_feature 1..85: note = chr18:18821400-18821485
  misc_feature 1..85: note = Hyper
  source 1..85: mol_type = genomic DNA

SEQ ID NO: 114425 - DNA, 1284 bp, Homo sapiens
  misc_feature 1..1284: note = chr18:18821698-18822982
  misc_feature 1..1284: note = Hyper
  source 1..1284: mol_type = genomic DNA
cagagaaagcaattgcgcagaggcgagagcaggctgaatgaacgcgggctccaggggaaataatttttcctcctggcttcgcgcgtcagcacactggggtgcagccctccctcacagaagaccccccccccgcacgaccccctgtacacccccgcggggctgcgcgttcgtctgtgcggcggggtttgggaatggaggcgtgaggaccgcgcatcgagggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggaggtgagaggtcgcgaaccgggcgcgggagctcgcctgtgaccggcaggagctgccctttggcgggctggacgccctggccgcgcggggaagcgccgcagcggacttttccggagggatgggaagctcagcgggggtgtgagcggagcgcgtgcgggtggcgagggagcgccagtgccaacctgggagccgtgcctgccttccctgccgcctcgcgtcgcccaccgaagggacccggccgtgctgtccgcgcccagaggccgaaggcctgtcaccgggctctactcgctgcctttgtggcgggagcgagacggcccgggggtgggacgagggagctgcggcgcgccgagtagcgcggggtcccccggcggaggcggcgagggggcacctggttcgtctccccgagcccaggggcagtgagggggtgccgggcaggcgggcgggcgacaggtagggcgccgcggaggtggcggggagaggatggatggagttcagcctgggaaagttgagaacgtccagaggtggctgggcgctcgctcggcgtctgtgggtttttttcctcaacaccaaatgtcacttcgtcacgagcgggcg

SEQ ID NO: 114426 - DNA, 292 bp, Homo sapiens; identical to SEQ ID NO: 81691
  misc_feature 1..292: note = chr18:18823194-18823486
  misc_feature 1..292: note = Hyper
  source 1..292: mol_type = genomic DNA

SEQ ID NO: 114427 - DNA, 86 bp, Homo sapiens; identical to SEQ ID NO: 81692
  misc_feature 1..86: note = chr18:18939050-18939136
  misc_feature 1..86: note = Hypo
  source 1..86: mol_type = genomic DNA

SEQ ID NO: 114428 - DNA, 20 bp, Homo sapiens
  misc_feature 1..20: note = chr18:19181448-19181468
  misc_feature 1..20: note = Hypo
  source 1..20: mol_type = genomic DNA
ctggacgagtgagaccctgt

SEQ ID NO: 114429 - DNA, 18 bp, Homo sapiens
  misc_feature 1..18: note = chr18:19191607-19191625
  misc_feature 1..18: note = Hypo
  source 1..18: mol_type = genomic DNA
cagcgcctggcccattgt

SEQ ID NO: 114430 - DNA, 30 bp, Homo sapiens; identical to SEQ ID NO: 45366
  misc_feature 1..30: note = chr18:19243727-19243757
  misc_feature 1..30: note = Hypo
  source 1..30: mol_type = genomic DNA

SEQ ID NO: 114431 - DNA, 88 bp, Homo sapiens; identical to SEQ ID NO: 36922
  misc_feature 1..88: note = chr18:19748288-19748376
  misc_feature 1..88: note = Hyper
  source 1..88: mol_type = genomic DNA

SEQ ID NO: 114432 - DNA, 30 bp, Homo sapiens; identical to SEQ ID NO: 81697
  misc_feature 1..30: note = chr18:19748854-19748884
  misc_feature 1..30: note = Hyper
  source 1..30: mol_type = genomic DNA

SEQ ID NO: 114433 - DNA, 37 bp, Homo sapiens; identical to SEQ ID NO: 81698
  misc_feature 1..37: note = chr18:19749409-19749446
  misc_feature 1..37: note = Hyper
  source 1..37: mol_type = genomic DNA

SEQ ID NO: 114434 - DNA, 60 bp, Homo sapiens; identical to SEQ ID NO: 36923
  misc_feature 1..60: note = chr18:19749864-19749924
  misc_feature 1..60: note = Hyper
  source 1..60: mol_type = genomic DNA

SEQ ID NO: 114435 - DNA, 30 bp, Homo sapiens; identical to SEQ ID NO: 81700
  misc_feature 1..30: note = chr18:19750360-19750390
  misc_feature 1..30: note = Hyper
  source 1..30: mol_type = genomic DNA

SEQ ID NO: 114436 - DNA, 67 bp, Homo sapiens; identical to SEQ ID NO: 81701
  misc_feature 1..67: note = chr18:19750739-19750806
  misc_feature 1..67: note = Hyper
  source 1..67: mol_type = genomic DNA

SEQ ID NO: 114437 - DNA, 77 bp, Homo sapiens; identical to SEQ ID NO: 81702
  misc_feature 1..77: note = chr18:20109538-20109615
  misc_feature 1..77: note = Hypo
  source 1..77: mol_type = genomic DNA

SEQ ID NO: 114438 - DNA, 30 bp, Homo sapiens; identical to SEQ ID NO: 81704
  misc_feature 1..30: note = chr18:20680329-20680359
  misc_feature 1..30: note = Hypo
  source 1..30: mol_type = genomic DNA

SEQ ID NO: 114439 - DNA, 135 bp, Homo sapiens; identical to SEQ ID NO: 81705
  misc_feature 1..135: note = chr18:20685485-20685620
  misc_feature 1..135: note = Hypo
  source 1..135: mol_type = genomic DNA

SEQ ID NO: 114440 - DNA, 118 bp, Homo sapiens; identical to SEQ ID NO: 81706
  misc_feature 1..118: note = chr18:20716572-20716690
  misc_feature 1..118: note = Hyper
  source 1..118: mol_type = genomic DNA

SEQ ID NO: 114441 - DNA, 32 bp, Homo sapiens; identical to SEQ ID NO: 81707
  misc_feature 1..32: note = chr18:20734199-20734231
  misc_feature 1..32: note = Hypo
  source 1..32: mol_type = genomic DNA

SEQ ID NO: 114442 - DNA, 350 bp, Homo sapiens; identical to SEQ ID NO: 81708
  misc_feature 1..350: note = chr18:20911344-20911694
  misc_feature 1..350: note = Hypo
  source 1..350: mol_type = genomic DNA

SEQ ID NO: 114443 - DNA, 187 bp, Homo sapiens; identical to SEQ ID NO: 81709
  misc_feature 1..187: note = chr18:21163405-21163592
  misc_feature 1..187: note = Hypo
  source 1..187: mol_type = genomic DNA

SEQ ID NO: 114444 - DNA, 24 bp, Homo sapiens
  misc_feature 1..24: note = chr18:21164586-21164610
  misc_feature 1..24: note = Hypo
  source 1..24: mol_type = genomic DNA
aagaggagggcggatcgctagagg

SEQ ID NO: 114445 - DNA, 39 bp, Homo sapiens; identical to SEQ ID NO: 81711
  misc_feature 1..39: note = chr18:21168942-21168981
  misc_feature 1..39: note = Hypo
  source 1..39: mol_type = genomic DNA

SEQ ID NO: 114446 - DNA, 55 bp, Homo sapiens; identical to SEQ ID NO: 81712
  misc_feature 1..55: note = chr18:21242816-21242871
  misc_feature 1..55: note = Hyper
  source 1..55: mol_type = genomic DNA

SEQ ID NO: 114447 - DNA, 260 bp, Homo sapiens; identical to SEQ ID NO: 81713
  misc_feature 1..260: note = chr18:21269423-21269683
  misc_feature 1..260: note = Hyper
  source 1..260: mol_type = genomic DNA

SEQ ID NO: 114448 - DNA, 164 bp, Homo sapiens
  misc_feature 1..164: note = chr18:21269971-21270135
  misc_feature 1..164: note = Hyper
  source 1..164: mol_type = genomic DNA
gcgccttttccttcccgcgccggccagacacccggagaagggatcgggccctttcctcacgcgcgctagtggctccgggcgactgggaagggcagcccccatccccgcgcgcgagggcccacgacccaggagcgatctcgtggaagcaccgcaccggcaccacc

SEQ ID NO: 114449 - DNA, 30 bp, Homo sapiens; identical to SEQ ID NO: 81715
  misc_feature 1..30: note = chr18:21456470-21456500
  misc_feature 1..30: note = Hypo
  source 1..30: mol_type = genomic DNA

SEQ ID NO: 114450 - DNA, 144 bp, Homo sapiens; identical to SEQ ID NO: 81716
  misc_feature 1..144: note = chr18:21789694-21789838
  misc_feature 1..144: note = Hypo
  source 1..144: mol_type = genomic DNA

SEQ ID NO: 114451 - DNA, 19 bp, Homo sapiens
  misc_feature 1..19: note = chr18:21796452-21796471
  misc_feature 1..19: note = Hypo
  source 1..19: mol_type = genomic DNA
agagcgagactgtgtctcc

SEQ ID NO: 114452 - DNA, 53 bp, Homo sapiens; identical to SEQ ID NO: 81718
  misc_feature 1..53: note = chr18:21808513-21808566
  misc_feature 1..53: note = Hypo
  source 1..53: mol_type = genomic DNA

SEQ ID NO: 114453 - DNA, 540 bp, Homo sapiens; identical to SEQ ID NO: 81719
  misc_feature 1..540: note = chr18:21977137-21977677
  misc_feature 1..540: note = Hyper
  source 1..540: mol_type = genomic DNA

SEQ ID NO: 114454 - DNA, 32 bp, Homo sapiens; identical to SEQ ID NO: 81720
  misc_feature 1..32: note = chr18:21978002-21978034
  misc_feature 1..32: note = Hyper
  source 1..32: mol_type = genomic DNA

SEQ ID NO: 114455 - DNA, 35 bp, Homo sapiens; identical to SEQ ID NO: 81721
  misc_feature 1..35: note = chr18:22006639-22006674
  misc_feature 1..35: note = Hyper
  source 1..35: mol_type = genomic DNA

SEQ ID NO: 114456 - DNA, 162 bp, Homo sapiens; identical to SEQ ID NO: 81722
  misc_feature 1..162: note = chr18:22006877-22007039
  misc_feature 1..162: note = Hyper
  source 1..162: mol_type = genomic DNA

SEQ ID NO: 114457 - DNA, 47 bp, Homo sapiens; identical to SEQ ID NO: 81723
  misc_feature 1..47: note = chr18:22136813-22136860
  misc_feature 1..47: note = Hypo
  source 1..47: mol_type = genomic DNA

SEQ ID NO: 114458 - DNA, 102 bp, Homo sapiens; identical to SEQ ID NO: 81724
  misc_feature 1..102: note = chr18:22596688-22596790
  misc_feature 1..102: note = Hypo
  source 1..102: mol_type = genomic DNA

SEQ ID NO: 114459 - DNA, 18 bp, Homo sapiens
  misc_feature 1..18: note = chr18:22736912-22736930
  misc_feature 1..18: note = Hypo
  source 1..18: mol_type = genomic DNA
agaactttaagaggccga

SEQ ID NO: 114460 - DNA, 30 bp, Homo sapiens; identical to SEQ ID NO: 81726
  misc_feature 1..30: note = chr18:22756643-22756673
  misc_feature 1..30: note = Hypo
  source 1..30: mol_type = genomic DNA

SEQ ID NO: 114461 - DNA, 30 bp, Homo sapiens; identical to SEQ ID NO: 81727
  misc_feature 1..30: note = chr18:22782434-22782464
  misc_feature 1..30: note = Hypo
  source 1..30: mol_type = genomic DNA

SEQ ID NO: 114462 - DNA, 100 bp, Homo sapiens; identical to SEQ ID NO: 81728
  misc_feature 1..100: note = chr18:22799423-22799523
  misc_feature 1..100: note = Hypo
  source 1..100: mol_type = genomic DNA

SEQ ID NO: 114463 - DNA, 30 bp, Homo sapiens; identical to SEQ ID NO: 81729
  misc_feature 1..30: note = chr18:22805066-22805096
  misc_feature 1..30: note = Hypo
  source 1..30: mol_type = genomic DNA

SEQ ID NO: 114464 - DNA, 19 bp, Homo sapiens
  misc_feature 1..19: note = chr18:22900421-22900440
  misc_feature 1..19: note = Hypo
  source 1..19: mol_type = genomic DNA
accgcgcctggcctaaagg

SEQ ID NO: 114465 - DNA, 2389 bp, Homo sapiens
  misc_feature 1..2389: note = chr18:22928965-22931354
  misc_feature 1..2389: note = Hyper
  source 1..2389: mol_type = genomic DNA
aatgctcagaagctgcgagtgaacaaaactgccaatcgtgcaaactttaataaacttttttttttttgaaaagaaaaatccctcccaaattccttcacggggtttcagaagcttcttggagccctttccaccggacaggcactaaccgctatcctacttcaactcggaaagttcttctttccaagtgactaggaagaggtttgtcctggtacttcgctcagcgttactttcaagaaagccggggtctcgggcaagtctcgccggcgcgagcctggtccaccgttaccctgacacccgcgcacgcccgtggcgtttcttttttcactgtcgacacttggatctttcaggccctgggtctaggtttcccccagaaaaatgaggggcccatgtgacggaaaccaccagacacactgtgtggagacacatgccaatgattcacctcgttcccgaactaaaacttctgcgctttaggaaaaaagcaagcgttccaatctgcgaggccctcccccaccccgtcccttcccaggagaagaaagaaagggctttgtgtgtgcggtgagggctccgttcatcgagttcaaaaatgcacagcggccgggggccgggaggcgtggggcgccgggccctgcccaccccttttccccgggccggcggcgagtcgggaagctggtgcgggaaccggggccacggggcgccgcggcccggcagccaggaggaagaggatgctgcgccgccggggaccagagggcggggccgggccgcgcggacctcggcgggacccagcgggcccgggcgggcgcaccagccgccctttgtcctccgcctccgggtcgcgggggccgcggccgcctccagcgctggccccctggccctcgccccggttccccgtcctgcccgcgcgcccctcctccggccctcgcgctccgccgcccgccctccccgctctccgcctcggagcgccggacctcgcggctcccctcggccgcccgcccccgatttcctcggaaggaggctcgcgaaggtggaggaggcggccgaggaggaggaggaggccgccacgtgactctcctcgccacattccaacacagccatcagatcgataacttcagggacccccgcccccgccgcagccagctagtgcgcccccaaaatcccgcacgcacgccccgcaacttccctctccaacagggacgacggagagctggaccccaccgcgaaacgcaaaggactccaggggcggcggggagaagtaggggcgaggggcggtcaacttctgggaatggccaagaggggtgctctgaggcccgagccggggtccggtgcccgcggccggcggccggggtctgtttactccggcgacgtgcggagaggacccaagcaggacgcgggcgggcgggaggcggcggccgggaccccgggccacgtttgtcacgagcgggggctgctccccacctccgagatgacttttttcttcttccaaagaaaaggaaaaaagaagcaccgcacggttttgcatatttattctttgcgaaaacacacaacagaaactttttcctccagcccagatgtagatctcagacgggatatttttttttcctccctctccggataatttcgtttctttctctctctctctctttttttttttcggttgttgttgtcttttctcgcccactttctaccgccgccccattcggggatcctcctcccgtcttcgtctccccccaccccgacacctcaccctcactccacctaggggctcagcggggaggggagcgcgcgcgcccccgcactcacactcacactcacgcgcgcacacgcctcgcagccacgcagccctcgctccgctacccacagtgacactcgcggatgggggaaagcggggagcagggggttcctccttacctttgagggatctcggtttcgcttgcttgcggcgagacatcctaaaagcaaacagctgaagttgtttcaattcagccctgaaagaaactatacttcctcgtggccgcgcgcccctcgggccgcggcgcctcgcgccctccgctcggcctccctcgcgccctcgctccgcgctccgctcctcgctccggctccggctcgcgctcgcgcgcggggctcgcggctgcccgagctccgcgctctgcacgacggcggcggcggcggcggcggctgctgcaccaaactttcccagccttcgacccccacccccaatctccaagaaaaaaaaaaaaaaaggaaaaagaaaaaaggaaaggagggaaaaaaagctaaaaaaaaaaccccaaagacaatgtttgaagagccgtcagctacactaaaaagagaaaatccgttactatttccacctcaatcaaaattcacatagttcatgcgaatagaaaaaaac

SEQ ID NO: 114466 - DNA, 30 bp, Homo sapiens; identical to SEQ ID NO: 81735
  misc_feature 1..30: note = chr18:23686462-23686492
  misc_feature 1..30: note = Hypo
  source 1..30: mol_type = genomic DNA

SEQ ID NO: 114467 - DNA, 94 bp, Homo sapiens; identical to SEQ ID NO: 81736
  misc_feature 1..94: note = chr18:23745191-23745285
  misc_feature 1..94: note = Hypo
  source 1..94: mol_type = genomic DNA

SEQ ID NO: 114468 - DNA, 40 bp, Homo sapiens; identical to SEQ ID NO: 45369
  misc_feature 1..40: note = chr18:23841433-23841473
  misc_feature 1..40: note = Hypo
  source 1..40: mol_type = genomic DNA

SEQ ID NO: 114469 - DNA, 531 bp, Homo sapiens; identical to SEQ ID NO: 81738
  misc_feature 1..531: note = chr18:24127654-24128185
  misc_feature 1..531: note = Hyper
  source 1..531: mol_type = genomic DNA

SEQ ID NO: 114470 - DNA, 800 bp, Homo sapiens
  misc_feature 1..800: note = chr18:24130387-24131187
  misc_feature 1..800: note = Hyper
  source 1..800: mol_type = genomic DNA
acgctgctggtcctccgcgtgcctgcccggccctggacgccacccgagcttcggggaaaccgcgccaggtgtgaaacaagttagagcaagtccctgcctcgcgggccgcctccggctccttagggaaacacaagacacacagacacacacacacacacacacacacacacacacacacacaccacgctctcatccgcccggctctccgcggagaaccgtccgggaatcgtccccgaggtgcggcgcgggaggtggccggctttgttcacaatgcactgcccgccgcacccgccctggacacgtgcagaaaggcgtgctcgtttctccgaggctgcggtgagcagctaagttagttgcacactgggacccccacatacgagctggcacacactagtcacacacggctaattccagagggctggccctttgtcctgggacgctcccaggttttcgggccgcggtgcggagaactcaggtgggtgcccggcaagttacctaccaggggctgttcccccgcgaccctcgccataagcgcagggacccgggggccgcgctggctccgggctgcgctcctggcttggcaggggaccaggcccacgctgcagcctgggagcggagccgccccccaggtctccccacctctgcgggcggcggggtccacccccctcccaccagctcccctccctactgggcgagctgctttgaattgctcgcagtttgccggaggcggtgtgctgggttggacgctccgggaaacaaagcaacccaaaacagctcccagttgacgtcaacttatttcc

SEQ ID NO: 114471 - DNA, 30 bp, Homo sapiens; identical to SEQ ID NO: 45370
  misc_feature 1..30: note = chr18:24465773-24465803
  misc_feature 1..30: note = Hypo
  source 1..30: mol_type = genomic DNA

SEQ ID NO: 114472 - DNA, 553 bp, Homo sapiens; identical to SEQ ID NO: 81743
  misc_feature 1..553: note = chr18:24764615-24765168
  misc_feature 1..553: note = Hyper
  source 1..553: mol_type = genomic DNA

SEQ ID NO: 114473 - DNA, 43 bp, Homo sapiens; identical to SEQ ID NO: 81744
  misc_feature 1..43: note = chr18:24765377-24765420
  misc_feature 1..43: note = Hyper
  source 1..43: mol_type = genomic DNA

SEQ ID NO: 114474 - DNA, 36 bp, Homo sapiens; identical to SEQ ID NO: 45371
  misc_feature 1..36: note = chr18:25089977-25090013
  misc_feature 1..36: note = Hypo
  source 1..36: mol_type = genomic DNA

SEQ ID NO: 114475 - DNA, 798 bp, Homo sapiens
  misc_feature 1..798: note = chr18:25755242-25756040
  misc_feature 1..798: note = Hyper
  source 1..798: mol_type = genomic DNA
tagttctgaaatccccgagtcaggagagagccgagtggcggatggcgagtgggggaagggagaaagaccggtaggagactaaagaacaaaagaagaaatccaagaaagggaaaaggaacgctgggaccctggcctgggaggcaggggtggggagagacaaagtgagagagcacgacccgggaggagagcgtggagccgggcagggacaggcgtgccgcaccatggcgcaccatggacagggctccgcgcggcggcggcccacgaccgtctaggggttgcgggagaaagcgcgagagactgcggaggccagccccgtccagcccctgcccccgccccagcagcactcaccccccggcgggccggagcgcgccaggccctgacccgtgaagaccacggagcggggtaatccacaccacctgtctccacccccggagcaggcacttccgagctgcgtccgcacttttcggggctgccagctggcagtagagcacctctccccttgccccgagggcgacaggcagggggaccctccgtggattttcctgccccgcggcgagggtgggcacgcccctttcccgcaaccttcgagggaccccacggcaggcggagaccgacttgggaccagggcactgcacccgcccagctagagggtcccggccgaggctgtgtgaagtggcctccaggcctgggctggctggtcgggaggagcctgggggcatcctcgggttggaggcggcggaaagttgggctgcccccgggctgggaacccgcagcgtgcagtggcgagggaacctgcgc

SEQ ID NO: 114476 - DNA, 351 bp, Homo sapiens; identical to SEQ ID NO: 81748
  misc_feature 1..351: note = chr18:25756635-25756986
  misc_feature 1..351: note = Hyper
  source 1..351: mol_type = genomic DNA

SEQ ID NO: 114477 - DNA, 1234 bp, Homo sapiens
  misc_feature 1..1234: note = chr18:25757253-25758487
  misc_feature 1..1234: note = Hyper
  source 1..1234: mol_type = genomic DNA
gagctggggagggggcgggggaacagggagggagagcgtgtgagcgtctgcgagtgtgtggaggcggctgctgtggcagcgcaggcggctcggctccggcccggagcgcagcggaagccgcgagggatgcagcggcggggaccttggccggtggaggatgtggaggtggaagtggagcggatggcgctccccaagagctccgccacgcgaggtttcgggctcgtggttttgcttcctccgggtccccgctccagggccgctcggcgcgacgaagacgccggggacagcgccgcggggagggcgctccgggtcgtgcgtgctgcacccacaaagagcagcagtcccgccactccgcgcctccgctgcgtgggggccgaggggcgcttctcggctcctctttccggtcccccggcgagttggagactgttctccggcctcggccgcaagggggtgaggcgaggggccggcgcggtctctcccgccgcggctccgtcccgcgcagctgctgccgcagccgcccctgctgcccgcgcaccggcacccgcccgccggtcctcgccctgcgccgctcactcgcgcgcgccgccctccgtcgccgaccgcgcaccccgctcggcctccgctgcgcgacctgggcgagccgccgccgctctccccgcgctcgccccacgcgctgcctggctgcgcggcccgctcccctctcctattcctcccgccgccgccgccgccctcgcccccgcctccctcctccgccgagcctccccgcccgcgtcgtggccaatcggaggccaccaagctgcggctgtagccggccggatccgcggcagccgcccgcccccgccccgccgaagcgccccgtattttgctgcagcccgcggggggtcgccggagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctgga

SEQ ID NO: 114478 - DNA, 345 bp, Homo sapiens
  misc_feature 1..345: note = chr18:28620831-28621176
  misc_feature 1..345: note = Hyper
  source 1..345: mol_type = genomic DNA
gttaatttacccatccggtccgaaattgcaagtgtttgtaaactgacaattgcagatgaaatagtcattttctgtgcactttccggtatttaagtctccagatacagcatttaacctaaactcaacggaattattttaaaaaaaaaaaatcttaaacgagtatgtgctagatcaaagctgaagcttcctccgtttagatttacgcgcaccttcttccttgccacagctcgacacccccacccatgccttgccgggaaagctcctggtcttccatggcctctgggagcctcgagcgaatgcgagaaattctgagagcagcacccgtagtttcgttccccatcctca

SEQ ID NO: 114479 - DNA, 655 bp, Homo sapiens
  misc_feature 1..655: note = chr18:28621474-28622129
  misc_feature 1..655: note = Hyper
  source 1..655: mol_type = genomic DNA
gaagcagtaagaatccgcgagaccagactcggctcactgccgacgcgggtatagacctcgctcccatcggaccccatgcgcatccatggatgcgggtaagtcgcgggtccgcggctcctttctgggcgtgcggaatgaaactctgttgaagcctgaagcttcgcgtgtaaccgcgccgccagagttccgaacacttcaagtctcccgtgttctcagagcatcgtctctaacttcctctcctagaggatttcgtcctgggcggcaggtttccgtagactcgaaaccccaggctgtgctccggccgcgcagtcctccccggagccggagtaagtacgacgcaaccccaccgcatccatcatcccccaccactgtcaccctctacccgcctccacacctcggcagcatccccaaaacacaacacgaccccaacccccattctggcccggtcttcccacactttcgcgcccccggcacatcccgcccccagctgggtggctggcgggggtggaccgcttgggtgagcttctgaataccctttaggggagataccgagaaacccacttctcaggggcagccccaccaagggacccagggacacagccccggctccactcactaacgaaccaatccgggtcaactgcgacccagagctggg

SEQ ID NO: 114480 - DNA, 455 bp, Homo sapiens; identical to SEQ ID NO: 81760
  misc_feature 1..455: note = chr18:28622419-28622874
  misc_feature 1..455: note = Hyper
  source 1..455: mol_type = genomic DNA

SEQ ID NO: 114481 - DNA, 149 bp, Homo sapiens; identical to SEQ ID NO: 81761
  misc_feature 1..149: note = chr18:28681064-28681213
  misc_feature 1..149: note = Hyper
  source 1..149: mol_type = genomic DNA

SEQ ID NO: 114482 - DNA, 35 bp, Homo sapiens; identical to SEQ ID NO: 81762
  misc_feature 1..35: note = chr18:28681994-28682029
  misc_feature 1..35: note = Hyper
  source 1..35: mol_type = genomic DNA

SEQ ID NO: 114483 - DNA, 124 bp, Homo sapiens; identical to SEQ ID NO: 81766
  misc_feature 1..124: note = chr18:29078131-29078255
  misc_feature 1..124: note = Hyper
  source 1..124: mol_type = genomic DNA

SEQ ID NO: 114484 - DNA, 35 bp, Homo sapiens; identical to SEQ ID NO: 81769
  misc_feature 1..35: note = chr18:29521127-29521162
  misc_feature 1..35: note = Hypo
  source 1..35: mol_type = genomic DNA

SEQ ID NO: 114485 - DNA, 157 bp, Homo sapiens; identical to SEQ ID NO: 81770
  misc_feature 1..157: note = chr18:29599667-29599824
  misc_feature 1..157: note = Hyper
  source 1..157: mol_type = genomic DNA

SEQ ID NO: 114486 - DNA, 58 bp, Homo sapiens; identical to SEQ ID NO: 81771
  misc_feature 1..58: note = chr18:30349723-30349781
  misc_feature 1..58: note = Hyper
  source 1..58: mol_type = genomic DNA

SEQ ID NO: 114487 - DNA, 1012 bp, Homo sapiens; identical to SEQ ID NO: 81772
  misc_feature 1..1012: note = chr18:30350062-30351074
  misc_feature 1..1012: note = Hyper
  source 1..1012: mol_type = genomic DNA

SEQ ID NO: 114488 - DNA, 43 bp, Homo sapiens; identical to SEQ ID NO: 81773
  misc_feature 1..43: note = chr18:30351356-30351399
  misc_feature 1..43: note = Hyper
  source 1..43: mol_type = genomic DNA

SEQ ID NO: 114489 - DNA, 30 bp, Homo sapiens; identical to SEQ ID NO: 81774
  misc_feature 1..30: note = chr18:30351670-30351700
  misc_feature 1..30: note = Hyper
  source 1..30: mol_type = genomic DNA

SEQ ID NO: 114490 - DNA, 344 bp, Homo sapiens; identical to SEQ ID NO: 81775
  misc_feature 1..344: note = chr18:30351913-30352257
  misc_feature 1..344: note = Hyper
  source 1..344: mol_type = genomic DNA

SEQ ID NO: 114491 - DNA, 30 bp, Homo sapiens; identical to SEQ ID NO: 81776
  misc_feature 1..30: note = chr18:30781529-30781559
  misc_feature 1..30: note = Hyper
  source 1..30: mol_type = genomic DNA

SEQ ID NO: 114492 - DNA, 531 bp, Homo sapiens
  misc_feature 1..531: note = chr18:31020324-31020855
  misc_feature 1..531: note = Hyper
  source 1..531: mol_type = genomic DNA
tgggaaactggaggacggagaacagggggacaaaacgactgggggactggggaattatgggactggggatttggggaattgttttcaaacgcgcggggcaaggactccccaccgcctctggaaggggtgaagaactagtcgactctaactccctcagggtggccagggaattgcatttggttctcccgcgggagtcgcgcaggcgggcggccagggggagtgggcgccgcccggcagcgccccgcgccgaggcacaagcgcccgcgccgaggcacaagcgcccccgactcaccggctccgcgcgtttccccgcgcgtctcccggacccgcgcctgcccacccctccggctctgctgcggtcgaggccccaagtcggttatcccgtgtccaggcaaccgcgggggcggcggcggcggcgtgaggagcgggcggctgctgctccggggcctcctggctcgagcccttagcccccgactcccggcgtttcggcgcccgatcagcgctccaggccgcccccgctccgccttctcc

SEQ ID NO: 114493 - DNA, 97 bp, Homo sapiens; identical to SEQ ID NO: 81778
  misc_feature 1..97: note = chr18:31157850-31157947
  misc_feature 1..97: note = Hyper
  source 1..97: mol_type = genomic DNA

SEQ ID NO: 114494 - DNA, 561 bp, Homo sapiens; identical to SEQ ID NO: 81779
  misc_feature 1..561: note = chr18:31158489-31159050
  misc_feature 1..561: note = Hyper
  source 1..561: mol_type = genomic DNA

SEQ ID NO: 114495 - DNA, 632 bp, Homo sapiens
  misc_feature 1..632: note = chr18:31739032-31739664
  misc_feature 1..632: note = Hyper
  source 1..632: mol_type = genomic DNA
ctgtttctacttcagcggcggcggctggagcagcgggtacaggtgaggttgccctggcggtgtccatagcaacgctggagggggtggcagggagaaaggcgccctccaccctgtcagcctcctcctcgcctcccccgacctgcaggcgcgctaagcgctccgggcgccgcgctccgcgagggggagcagtgctcccaacccgcgaccctccgcctcagacatcacagttgccgcggcaacggccggaggaggaaggccaaggcttttctcccgctgacgtcccccgccaccagtacccagagtgctggggcctggatgagatctgcgtccgcttcacccgagcatgagcttgggtctctcggaggagcaggagacgcgggctcgaagccgcgggcctgaccctgatccgtggatgccgccgccgccttctcctcccctgggtggtgggggacagggcctgggaggcacggtcacgccgagtttgagcacgtgaccttccaagagcttgagagtcccctagagagcaggccccaccccaatccatcccgcctcgccggaggggtccctctggctttagtccttctcttctaattccctgtatgtcccgacccgaccaacggcagcacactctc

SEQ ID NO: 114496 - DNA, 329 bp, Homo sapiens; identical to SEQ ID NO: 36954
  misc_feature 1..329: note = chr18:31802052-31802381
  misc_feature 1..329: note = Hyper
  source 1..329: mol_type = genomic DNA

SEQ ID NO: 114497 - DNA, 427 bp, Homo sapiens; identical to SEQ ID NO: 81784
  misc_feature 1..427: note = chr18:31802675-31803102
  misc_feature 1..427: note = Hyper
  source 1..427: mol_type = genomic DNA

SEQ ID NO: 114498 - DNA, 338 bp, Homo sapiens
  misc_feature 1..338: note = chr18:31803302-31803640
  misc_feature 1..338: note = Hyper
  source 1..338: mol_type = genomic DNA
cacgttgcagggatgcgaggtcccggccgcagcgggagcctgctttgggtgggggaagggatgggaagaggggaggagggtccggttgggcaccagcaatcaatgccccgtgctaccaagtctggtccattcgtaattgcaacggctgtctcggacgtttttcctgttcccttagcggtcggtctctttaatattttgtgaccaggaccatcccaacaccattctggcccagaggagctgggttttcaataattaaaatcccattccttggtttattaaaaatcccaatattgaattggggtggtccctagacgcctcgcccccgggctgcgtccggg

SEQ ID NO: 114499 - DNA, 30 bp, Homo sapiens; identical to SEQ ID NO: 81787
  misc_feature 1..30: note = chr18:31804123-31804153
  misc_feature 1..30: note = Hyper
  source 1..30: mol_type = genomic DNA

SEQ ID NO: 114500 - DNA, 335 bp, Homo sapiens; identical to SEQ ID NO: 81788
  misc_feature 1..335: note = chr18:31804809-31805144
  misc_feature 1..335: note = Hyper
  source 1..335: mol_type = genomic DNA

SEQ ID NO: 114501 - DNA, 183 bp, Homo sapiens; identical to SEQ ID NO: 81789
  misc_feature 1..183: note = chr18:31902672-31902855
  misc_feature 1..183: note = Hyper
  source 1..183: mol_type = genomic DNA

SEQ ID NO: 114502 - DNA, 1058 bp, Homo sapiens
  misc_feature 1..1058: note = chr18:32073235-32074293
  misc_feature 1..1058: note = Hyper
  source 1..1058: mol_type = genomic DNA
cgggggaggcggatgaggaggatgagatcatagtttcaggatcctcaggaaaccctggtactggcagcagccagcctctgctgtgcccacatgacccacaactctggcagcggacccggcacttccaacattattaaataataagaaagcggctcctactccaggctcaaacctccctgcagaccaatggacaccttctaagagtttggcgagtcagtgactgaagcgcccgtccattccaaggtgtgtgcacggcgttttcttctttgacagctccggagtgggggagggcgcgggggtggagggggtccgtgtgccgggcgaggagtgggcgcgaggccgggctgccgcgctgcccccggccgcccggtgcagaggagcccgccgcggggcgggaggtgcacatgacgcgcagccccggctgcgcagggaccgcagccgcccacggcgccggggcgcggacacaggcggctcggcgctggagcaagggcaggcgccgcgcaccgagcaaagtcaagagtggaagcgggcggagagcgccggcgggggcagggattcgcctcaacgcccactcacggggttcccacctgtgcgccggcgccggccgcggctagcgcgaagcatgtgccgggcgccgcagccaggactgcggcgcggcgcctccccgggcggcgggcggcgcctcaggcccgcggggcggcggtagcggctgctgcaggatgtccggcccgggggcgcggggccgcgcaggtaaatctcccccgccctcgaaggccttcgcagcgccgcagcccctgctgctgccgcggcgccgctcggggggtggctatggcagccggctccttcgcgtcgcgggttgagttgttttcgttgtggtcgctgccctcttggtcatcctctcgggctgagctggtgggaggtggagtgtctacctccattagggatgatactcacgtcggggaacagtctgaggggtactgactgggacatccgcgttgggttcctttgcagccagcggcgtcctttcgtgttgcagtgcactgcggtgcccgggccga

SEQ ID NO: 114503 - DNA, 75 bp, Homo sapiens; identical to SEQ ID NO: 81793
  misc_feature 1..75: note = chr18:32557928-32558003
  misc_feature 1..75: note = Hyper
  source 1..75: mol_type = genomic DNA

SEQ ID NO: 114504 - DNA, 146 bp, Homo sapiens; identical to SEQ ID NO: 81794
  misc_feature 1..146: note = chr18:32957667-32957813
  misc_feature 1..146: note = Hypo
  source 1..146: mol_type = genomic DNA

SEQ ID NO: 114505 - DNA, 30 bp, Homo sapiens; identical to SEQ ID NO: 81795
  misc_feature 1..30: note = chr18:33078363-33078393
  misc_feature 1..30: note = Hypo
  source 1..30: mol_type = genomic DNA

SEQ ID NO: 114506 - DNA, 29 bp, Homo sapiens
  misc_feature 1..29: note = chr18:33078633-33078662
  misc_feature 1..29: note = Hypo
  source 1..29: mol_type = genomic DNA
ggcgtaagccaccacgcccggccggttct

SEQ ID NO: 114507 - DNA, 140 bp, Homo sapiens
  misc_feature 1..140: note = chr18:33529995-33530135
  misc_feature 1..140: note = Hyper
  source 1..140: mol_type = genomic DNA
gcgtctggctctccacgccaacccattctgcccgctgactgcttgagtcctaagcccgacgaccctgccccagaccctggagacgctggacgctggctcacctggatcccactcagacccgggcgcgggctcacctggtc

SEQ ID NO: 114508 - DNA, 487 bp, Homo sapiens; identical to SEQ ID NO: 81799
  misc_feature 1..487: note = chr18:33767425-33767912
  misc_feature 1..487: note = Hyper
  source 1..487: mol_type = genomic DNA

SEQ ID NO: 114509 - DNA, 171 bp, Homo sapiens; identical to SEQ ID NO: 81800
  misc_feature 1..171: note = chr18:33876948-33877119
  misc_feature 1..171: note = Hyper
  source 1..171: mol_type = genomic DNA

SEQ ID NO: 114510 - DNA, 52 bp, Homo sapiens; identical to SEQ ID NO: 81801
  misc_feature 1..52: note = chr18:33877877-33877929
  misc_feature 1..52: note = Hyper
  source 1..52: mol_type = genomic DNA

SEQ ID NO: 114511 - DNA, 260 bp, Homo sapiens; identical to SEQ ID NO: 81802
  misc_feature 1..260: note = chr18:33878296-33878556
  misc_feature 1..260: note = Hyper
  source 1..260: mol_type = genomic DNA

SEQ ID NO: 114512 - DNA, 68 bp, Homo sapiens
  misc_feature 1..68: note = chr18:34823783-34823851
  misc_feature 1..68: note = Hyper
  source 1..68: mol_type = genomic DNA
agtctctggagcaagcgtggaaggcgagtgaagcggaaggtgagtgaagcgcgcgcagctcccagagg

SEQ ID NO: 114513 - DNA, 991 bp, Homo sapiens
  misc_feature 1..991: note = chr18:34833539-34834530
  misc_feature 1..991: note = Hyper
  source 1..991: mol_type = genomic DNA
caggcccatttctgccggggtgacggcagctctgcgcctggcccgaggagcagggcgaggagcaggttgagccgggcgcagcgggtccaaggcaccagtgagggtccggcccacggaggccggaggaggcggcgggtccgtctggttccctcccaacccccgtccccgcgccccggccgcccccggttacctgtgcgagtcctggtctcccccgggggacgctcccgccggcgctcagtacgggcgattggcgtctttgggccgcttcagctgcaccttgagcctcttcatgccgatctggaagccgttcatggcctggatggcggtctgcgcgctggccgggttgtcgaagctcacgaagcctggcgagacacgagggacgagggcctgggtttccacggggccgcccggggcgctgccggcggggaggggtcgggggacaggggggcggggcgggcctgaggctctccccctcgggccccgcccccggccccgccccggtgcccgcccctctccagcccgcgcgcgcgtgctaggcccctccgggggcaggcgctggcggggacccggctcgctgacctgcgcctagtctctggccgcgtcactcgcccggcgcccgctccccaagtggggcccgcggccgggcggcgctgggagaggcgcccgccccccacccccgccggccccggcacctcagccctcgcctcggcgggagagggcggacacacctgcgggtggaggagtttattggacactgtcctccctgacaggagggggcctggcagcgcgcgggcacagggtgccggcctggggagagagacgagtgcgaggggccgggagggaggcgccgccgagaaacttctccaccgccggcccggccgcccccctcgccaccgcaggtgcccggctgtcggaggaggcccagaggctgagccctcgcgggccctccgcccccactcccggcctctgcccgccccgccaggctccgggt

SEQ ID NO: 114514 - DNA, 30 bp, Homo sapiens; identical to SEQ ID NO: 81806
  misc_feature 1..30: note = chr18:34842164-34842194
  misc_feature 1..30: note = Hypo
  source 1..30: mol_type = genomic DNA

SEQ ID NO: 114515 - DNA, 38 bp, Homo sapiens; identical to SEQ ID NO: 81807
  misc_feature 1..38: note = chr18:34855289-34855327
  misc_feature 1..38: note = Hyper
  source 1..38: mol_type = genomic DNA

SEQ ID NO: 114516 - DNA, 454 bp, Homo sapiens; identical to SEQ ID NO: 81808
  misc_feature 1..454: note = chr18:34973974-34974428
  misc_feature 1..454: note = Hyper
  source 1..454: mol_type = genomic DNA

SEQ ID NO: 114517 - DNA, 1007 bp, Homo sapiens
  misc_feature 1..1007: note = chr18:35064851-35065858
  misc_feature 1..1007: note = Hyper
  source 1..1007: mol_type = genomic DNA
ctcccccctcaccaccgccccatctctctgaacccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctggctccttaaataaaccgcggtgatctcacttgcggcgccccctcccacgccggccccctcctcccccactagagcggcccgcgtcgactcgatgggcggactcgatcgcgcacgcggcccgcgggcccggcggaggcagctcccgctccggggacccgggacgcgccgctcccccgccccaggctgcccgcgcaggaacttcacggccacggccaagtggggcccctgtcccggatcccgttgggcccggacggccgagagcccagggatttgggggggcgcgcgggctcccgagctcaggcggggcggcgggcgccctgccgtcctctccccgcgcgccgcgccgccgcccggcctcccgaagtcgccccctgtcggcgcgtcggccgcttgcgccacggcgggcgccacttaccccgggcagagtcttctgctcgtgcagcgcgctctgggccttcagcgctgactcacgctcgcagtaggtgaggaaggcgcagcctggggaggaaagcaagcgccaagaagggtcagtggggcgcccccgggcccgccgacgcgccctgccgcccgccctccaggctcccgcccctccctgccgctcggtccctgtccccacctctctttctctcccgtgcactgttctcggagcttctctgcctctcggtgttcccggctgtctgcctctcgtacctccctttgcttttctattttgctccctccgcggagtctccccaccctgcatcttccccccaccacacccccctctccttacggttctctccttac

SEQ ID NO: 114518 - DNA, 61 bp, Homo sapiens; identical to SEQ ID NO: 36967
  misc_feature 1..61: note = chr18:35067550-35067611
  misc_feature 1..61: note = Hyper
  source 1..61: mol_type = genomic DNA

SEQ ID NO: 114519 - DNA, 527 bp, Homo sapiens
  misc_feature 1..527: note = chr18:35104518-35105045
  misc_feature 1..527: note = Hyper
  source 1..527: mol_type = genomic DNA
ccaaaggtaaattttcggccggcggggcagccccggagcgggaagatccacaccgcggagcagccgtaggaaatattgatattagccgacctctggcgccgtccgcccgcggtgaaaataagacgcggggccaatcaattaccgagccattaagggcgggaacgcggagggagcggcccacagcccctgctccccagccgaacatcccccgagccgcaggccgctggggtgcgcagctgcgctctacgccctccgcgccccggccgcggctcccggcagcgaccgcagcgcccagcaggagaatggggcgcagccgggctgggctggggcgcgggggtcgcggcggctgcgccccagtcccgagctcggtttcccgcttcgctctttgagccccgcttcctctccctgaagcgtctcgccctcggccctccctttcttctctctccgcctgccctcctcccttctcctttgttaaccacctctctttcctaggggcctcttgcttggccagccgaccacccttctgg

SEQ ID NO: 114520 - DNA, 989 bp, Homo sapiens
  misc_feature 1..989: note = chr18:35144820-35145809
  misc_feature 1..989: note = Hyper
  source 1..989: mol_type = genomic DNA
tctctcccttttagacggctgcgctcctgctactctagcccggagcaaaggatgaggagaccacctcctttagtattttcagcaccacggcgatggacagcaccctcggtcctcggccggccaggagcccgcgagtccgtccgctcagcgtcctgggctcgaccggtgcagccttccccatccccatctttcaggtcgctgtacccaaaaatccaagccccgtctcctcgatcccctctctctttctcttcatcggcgcccgctgctctctccatggcatcgttcctatcagcacctcgcccaaaacccagtcttgccccagcgaacagctccccacgcaccccagctctggtctccgctgcccgagcgcctccctccaccgcgcccgcccgaggcttcctctcgcttagtccgccgctcgtcagtcgccggccggccggtcggcccgccagcccgctcctgctccccggcaaagttgggagggaaaggtgtactcacctttgtgcatgcctgtgaacctgtccttcagaaccgtaagctcgtagattttgccaaactcctcgaagaggggcttgaggtccttctcatccaggttgcgggggatctgcccaatgaacagcttgatggcatcgtggtccttcatgggaatggtcgacgggttccccgggctgtggcttaatccgttcatgtgcccggcactgcccgggctgctgccgagcccgttggtactgaggcttgcgttgtcagcctgtccgtttgctaacgtggccatctttatatacatagagaaaatcttctttccttttattctttctcgctcacactctctcgctcctctctctcgctcgctcgcgctcacacacgcacacgcatacacacactcgggttctctccccctcggtttctctacacctcgctctccgctcgctctctgctctctctctttctcctcttctctcgctcgctcgcgctcgcgctctctctctgct

SEQ ID NO: 114521 - DNA, 139 bp, Homo sapiens; identical to SEQ ID NO: 81817
  misc_feature 1..139: note = chr18:35146102-35146241
  misc_feature 1..139: note = Hyper
  source 1..139: mol_type = genomic DNA

SEQ ID NO: 114522 - DNA, 597 bp, Homo sapiens
  misc_feature 1..597: note = chr18:35146652-35147249
  misc_feature 1..597: note = Hyper
  source 1..597: mol_type = genomic DNA
agacaagagctctctcgcgcgcgctctctccctgtctctctgtgtgtgtctttctctgtttttttttcctcctcgcacccccaacctgccagagcagccccacatcttcctcccgcccggcatctaccgccacccaagccacctgccaggatggggctgggagctgtcgggccgcgccggggggcagagggacggggagtagagactcggggtccgacccccgccccaacccgcttccgaaggcggaaggtgggggtccccgtcccgggcggcctcccccgccccggagagcgcggctggtcccccggtggctggcgggaggaaggtaggagtcgggcgcccctgcccgctcgcccgccggagggggaggaaggcgctgggcgcggtggccggtgagccagcgcgggggatggcttgatttgccctcgtctgctttacgggttcaaatagaatatatttttttaatcaccatcaaaagaataaagcccctgaatcgctatctgggttgccgccggaccgagactcgcgcggcgtgcgctgcccccgcgggtttcgttttcggcacctacagctcccgaggtgcgaggctgagtcgtt

SEQ ID NO: 114523 - DNA, 419 bp, Homo sapiens
  misc_feature 1..419: note = chr18:35147449-35147868
  misc_feature 1..419: note = Hyper
  source 1..419: mol_type = genomic DNA
tatttacctgcaccccgtcctctctcatgtttgctttttcagggcagcctcttcgcttcagaagcctggcaaattgaaataacgcgcccgctcccccgcgggctgcggggctggggagctggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggttcgcagccccaggccccgagtccgctcaggacgcctctctctgaggatcccgggcccaaaccaaa

SEQ ID NO: 114524 - DNA, 217 bp, Homo sapiens; identical to SEQ ID NO: 81825
  misc_feature 1..217: note = chr18:37421625-37421842
  misc_feature 1..217: note = Hyper
  source 1..217: mol_type = genomic DNA

SEQ ID NO: 114525 - DNA, 30 bp, Homo sapiens; identical to SEQ ID NO: 81827
  misc_feature 1..30: note = chr18:38952391-38952421
  misc_feature 1..30: note = Hypo
  source 1..30: mol_type = genomic DNA

SEQ ID NO: 114526 - DNA, 30 bp, Homo sapiens; identical to SEQ ID NO: 36978
  misc_feature 1..30: note = chr18:40857392-40857422
  misc_feature 1..30: note = Hyper
  source 1..30: mol_type = genomic DNA

SEQ ID NO: 114527 - DNA, 83 bp, Homo sapiens; identical to SEQ ID NO: 81830
  misc_feature 1..83: note = chr18:42259738-42259821
  misc_feature 1..83: note = Hyper
  source 1..83: mol_type = genomic DNA

SEQ ID NO: 114528 - DNA, 142 bp, Homo sapiens; identical to SEQ ID NO: 81831
  misc_feature 1..142: note = chr18:42259941-42260083
  misc_feature 1..142: note = Hyper
  source 1..142: mol_type = genomic DNA

SEQ ID NO: 114529 - DNA, 30 bp, Homo sapiens; identical to SEQ ID NO: 45372
  misc_feature 1..30: note = chr18:43254053-43254083
  misc_feature 1..30: note = Hypo
  source 1..30: mol_type = genomic DNA

SEQ ID NO: 114530 - DNA, 15 bp, Homo sapiens
  misc_feature 1..15: note = chr18:43325220-43325235
  misc_feature 1..15: note = Hypo
  source 1..15: mol_type = genomic DNA
cgactgtaggttgtt

SEQ ID NO: 114531 - DNA, 45 bp, Homo sapiens; identical to SEQ ID NO: 81835
  misc_feature 1..45: note = chr18:43545729-43545774
  misc_feature 1..45: note = Hypo
  source 1..45: mol_type = genomic DNA

SEQ ID NO: 114532 - DNA, 30 bp, Homo sapiens; identical to SEQ ID NO: 81836
  misc_feature 1..30: note = chr18:43651623-43651653
  misc_feature 1..30: note = Hyper
  source 1..30: mol_type = genomic DNA

SEQ ID NO: 114533 - DNA, 172 bp, Homo sapiens; identical to SEQ ID NO: 81837
  misc_feature 1..172: note = chr18:43651956-43652128
  misc_feature 1..172: note = Hyper
  source 1..172: mol_type = genomic DNA

SEQ ID NO: 114534 - DNA, 20 bp, Homo sapiens
  misc_feature 1..20: note = chr18:43779297-43779317
  misc_feature 1..20: note = Hypo
  source 1..20: mol_type = genomic DNA
tgagatggaatctctcgctg

SEQ ID NO: 114535 - DNA, 1241 bp, Homo sapiens
  misc_feature 1..1241: note = chr18:43913367-43914608
  misc_feature 1..1241: note = Hyper
  source 1..1241: mol_type = genomic DNA
agcctggggagtgtgcgtgtcttacctgtgtctgcatcgtgtgttccctctgtgtgtctctgagaatgcgttcttggcacgcgtcctgcgttaacaaggcgtttggtgtgtgcatgtctgtgtgacagtgcctgggtcctgtttgcggctgcttgttcgcattccagcttcccttgtgcccgcagtcaggctctacacgtgcgccagcctccgagcgcacgtccccgagtgacccgtgcgcggtgtgcagggacctcagggtcgtgtgcactaagggcgctcgtgcccgtctctctgcactaaggaacgcacctccacatgtctgagtgcacgtccctctccatgtgtgcacgttccgtgttcacgccgcccatgtctgtgcaggggcgcttcacgcgcgccctctccggcccgcgggcggccagggacccgcgctgggctccacgcttcccgtggggctgacccctccctcgcgccccgcagcgggccgcagcgattggccgccggcccccttccagccgtcacccctccctccctccgccacccgcgcgcccgcggtccccgctgtcccccgcggttccggcgaggccgcgccgcgctgcgctccgctcccattggctgcgcgcgcctttgtgtggcggcagctgcggccccagcgcctttgaatgtcgagaggggccgggaagggagcctttccatgggccatctgtctccccgccagccgccgccccaccgccgcccgcgccccgcgctccgcctcccgccccggcggctcccgcagccccgccgccgcccgcgcccgcgccccggagccgcgccacaaagggcccgcgcgcagccgccgccgccgccgccgcgcgaggagccaggatggtcctggtccacgtcggctatctcgtgcttccagtgtttggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtat

SEQ ID NO: 114536 - DNA, 403 bp, Homo sapiens; identical to SEQ ID NO: 81842
  misc_feature 1..403: note = chr18:43914882-43915285
  misc_feature 1..403: note = Hyper
  source 1..403: mol_type = genomic DNA

SEQ ID NO: 114537 - DNA, 30 bp, Homo sapiens; identical to SEQ ID NO: 81844
  misc_feature 1..30: note = chr18:44032745-44032775
  misc_feature 1..30: note = Hypo
  source 1..30: mol_type = genomic DNA

SEQ ID NO: 114538 - DNA, 121 bp, Homo sapiens; identical to SEQ ID NO: 81845
  misc_feature 1..121: note = chr18:44140380-44140501
  misc_feature 1..121: note = Hypo
  source 1..121: mol_type = genomic DNA

SEQ ID NO: 114539 - DNA, 40 bp, Homo sapiens; identical to SEQ ID NO: 81846
  misc_feature 1..40: note = chr18:44260010-44260050
  misc_feature 1..40: note = Hypo
  source 1..40: mol_type = genomic DNA

SEQ ID NO: 114540 - DNA, 1036 bp, Homo sapiens
  misc_feature 1..1036: note = chr18:44336102-44337138
  misc_feature 1..1036: note = Hyper
  source 1..1036: mol_type = genomic DNA
cttcatttttcacagcggaacaaagttgtctggaccctccagccagcgctgggcagaagcaagcaaggatgctcttggaaacgcggtggcccaagcctaagcggccatgctcggggctaggagcggaccccacggccactcaccccggggcgctgcgaccgaagctgccgcggccactgccacccgggggctcgccggccggctccgcgcatcccgccctctcaatggactttcttacctcttaatgtagttcctgccatacaggatctgttgcagcaaggtcaccaaggcaaaggcgcagatgaagatgaagagcaaagttcggctccccaacaaatcccggttggccgaggggtccgcgtagcgcatcctggctaccgggcgccgcgggcgcggggtacggggcggccaggcaatgactcgcggggttccggggccccggggggcgcgcggccgacttggcgcctcacggtgcggtcaggcaggcgggggacttcgaggggcaaagtttctggttggcgcggccggagctgggggcatccaagcgtcgcaggcgctggggcggcaagcaggacagggccggtggcagggagctctgccgcggccaggggccttccccacccccgggtacctttacctccaggcgccggtgccgggtagccgccgatttccccgcggaggggagacgccaggtgccacgagccggaggcggcccctcccgccgaggtggcggccaatggggagcaagacccgggctccgtcccctgtgcgccccagcgcgccgcgcatcgacccctccagtccggcgccggatcgcggttgcccagcgcgctgtgccctgccgggggcgggccacgtttgatctccgggcccgcagcaagggatcgcgaaggttggcctccggttctgccgatagggacggggggagggggcgtacaaaacacccgcgcagtctggctaatgataggcgggccgtggggagggggaggggcggagcgcaaaacgccgggtttgaatcttggaattaaaaagaggg

SEQ ID NO: 114541 - DNA, 675 bp, Homo sapiens
  misc_feature 1..675: note = chr18:44337438-44338113
  misc_feature 1..675: note = Hyper
  source 1..675: mol_type = genomic DNA
aaaaagaaaaaaaagagggcaggaagaggaaacaacagttgcggagctggacttgatggaagggagcatttgcgtgcggcgcgcagggcactgagtcaccatcgtggccgcgtcctcgcgctctcctagcgatttctccggagaaagcggagcaaggtcagccgggcagcccttcaaggacggcgcgccgctcctgcatgctgatggcctgcggggctgcctgcccgtgccccggcgcccaactcctacaaggaagaaattcaggggctccccgcccccgccacagtcctcttccccctccccagctgcaactcggcagccgttcgtcaaagaccctgttgtcaccgagacactgggaccttgtctcatccttggaaccactcgtaaatcttaggtcaggcagccggcagccttcggggaccacagtccccccaaagctttaggaagccagttactacatccggaaagattcgtgcttcagaacgcaagccagggagaataatcacagaaacgcaatgcgaatgtcgtgcctctcagaaattcttagcctgaaataccgtccccaccccccaacccggccaggcgacagtcctgtcatcctaacaccgcagaggctccaagcgctgggagtcgtgtgcccgcggcgctcgccactgaggccggttggaagattct

SEQ ID NO: 114542 - DNA, 30 bp, Homo sapiens; identical to SEQ ID NO: 81852
  misc_feature 1..30: note = chr18:44448392-44448422
  misc_feature 1..30: note = Hypo
  source 1..30: mol_type = genomic DNA

SEQ ID NO: 114543 - DNA, 52 bp, Homo sapiens; identical to SEQ ID NO: 81858
  misc_feature 1..52: note = chr18:44772704-44772756
  misc_feature 1..52: note = Hyper
  source 1..52: mol_type = genomic DNA

SEQ ID NO: 114544 - DNA, 1734 bp, Homo sapiens
  misc_feature 1..1734: note = chr18:44772977-44774711
  misc_feature 1..1734: note = Hyper
  source 1..1734: mol_type = genomic DNA
gtgaactgggctgcccgggctgctgctgccgccgccactcgccttctggggggccaggggcggcggcgggggcgggggcaggtccgagccggggtccccgagtttcccgtcttcctgcagcagcctggaggagttcaggccgagcgggaacgcgcccgcgacggccggcgcgcggtcccggctgctccccttctccgacggccctcggccctggaggaaccggccgcccccgactaaggggtcgccgagtaggacctccgtctcctcgtcctcttcctcgtcgtcgtcagggtctcgaccttcctcctcttcctcgccctcggggggcttgtggccctccacgtccacctcctgctcttcttcctcgtcgtcctcgtcctcggagctgtcctcgctggggtagcagcagctggttcccccgggagacagaaggcctcggtggtgcgggtgctgggccagagggggcggcgggggcggcggcggcggcggcggcggggccgggtggtggcgctcggaacccggctcgtcgggctgcgggggcagcagcagaagcggcgacggcggctgcggggggtggtggtggtggtggtggtggtgagggtggtgatggtggtggggatgcgtctgggccgagtggggcgcgcccgccgacgccccgtgcagcttggccaggctctccgcgtcgtccttgccgcccactggccggaaggcgctggaatggtggtagctgccaccgcccgctttgcgcccctccagaaggtgcggatggtggggcgccggaacccgggagcccgcggggccagacccggcggccgcggcccctgccccggcagctgccacagagtccgcgggcggcgtggagcccgcgctgcagtccccgccgctgccgcccgggggcgactcgaagagcgcgtcgcgagagccggcgcccccggcaggaggaggtgggccggagcccgggccgttggccactacctgcgggggctgccccggcgggggcgcggcctcggcgctcccagcagcaccgcctggctcagccaggtccaggaaggcctggcgcagcagggccgggctttcgcctagcgcgcagcctagcgccgagggcggctgaggcgggggctgcaggtaggtgggcaccgggagcccgccaggggtccgcggcggccagaacatgcagaagggcggatagaaggcgtccttgcggcccgcgggccagaagaggccggacaagccggccttgggcgccgcgcccgcgccgcctgcgcccgcgccccccagggcctcagcggcggcacccgcatcctctttcttatggcacaagctgaaggcggcggccgcggcagggaaggtgtaggggtgcgggaagagcccgccgcagcccgggaacttctgcaggacgcccccgaacgagcccttgctgggcaccgggatgactgggtagctgcgcgggcctttggcccctgccccggcacccgcccccgcgcccgcgcccacgcccacgccggccacacagccacccccagcgccgcccccaccagtccccgcgccgcccgaagcagcagccacagagaggctggcggctgcggccgagaggctggcggcggccactacggcggcctcctgcaaggagtcgtcgtcgtcgtcgaagcgcggccgcttgtgatgggcgtgcggggcaccagccagctctgccaagggcggcggtggcggcggcggcggcgggggcgcacccag

SEQ ID NO: 114545 - DNA, 205 bp, Homo sapiens; identical to SEQ ID NO: 81862
  misc_feature 1..205: note = chr18:44775385-44775590
  misc_feature 1..205: note = Hyper
  source 1..205: mol_type = genomic DNA

SEQ ID NO: 114546 - DNA, 549 bp, Homo sapiens; identical to SEQ ID NO: 81863
  misc_feature 1..549: note = chr18:44776834-44777383
  misc_feature 1..549: note = Hyper
  source 1..549: mol_type = genomic DNA

SEQ ID NO: 114547 - DNA, 730 bp, Homo sapiens
  misc_feature 1..730: note = chr18:44777596-44778326
  misc_feature 1..730: note = Hyper
  source 1..730: mol_type = genomic DNA
ccaacttagttctcccgactcccaaaccagtcaccacggaagcccaccgctgcccctcaacctaacgcggaaaatcctaccgctggggatctcaaataggtgcccagcaagctgtgtgccggattggggcggccggttccggcaatacctggtaacctctgggtgtctttaggcgtgtggctgccggcccatcttccgagggcgctcggaggcgaagcatccaagcgggtcctcgtatccagcgggcgggactctggcgggctccgcgcgaagatccgggctctggcccgagcgaatggcgctcaaaccccggcctggggagaatgacggcctgaattgcggcggggcgtcccctccaccgcagaaagtgtgggtacgcagaaacccgcggcaggagagccccaagtggagcgcagtctgacagcgtctgtctctgaactcgtgtcggaccgaggggacgccacccagcgggcagggtgacgtcaccgtctccctgacactccacattaaagggctggcatgttacagggagggagggggagagcgaaagccagcgcgagcaacagagagatcctttctcagcaggcacgaaagctaccaacctaaccaactcgcaattgacaacaacctcctcagccccggagtaaactgcagcaatggtgctggagccgcagatctgatttaggagtggaaagcgaacagtctgcctgcatcccgggacctagatcct

SEQ ID NO: 114548 - DNA, 622 bp, Homo sapiens; identical to SEQ ID NO: 81866
  misc_feature 1..622: note = chr18:44780619-44781241
  misc_feature 1..622: note = Hyper
  source 1..622: mol_type = genomic DNA

SEQ ID NO: 114549 - DNA, 294 bp, Homo sapiens; identical to SEQ ID NO: 81867
  misc_feature 1..294: note = chr18:44786853-44787147
  misc_feature 1..294: note = Hyper
  source 1..294: mol_type = genomic DNA

SEQ ID NO: 114550 - DNA, 359 bp, Homo sapiens; identical to SEQ ID NO: 81868
  misc_feature 1..359: note = chr18:44787492-44787851
  misc_feature 1..359: note = Hyper
  source 1..359: mol_type = genomic DNA

SEQ ID NO: 114551 - DNA, 30 bp, Homo sapiens; identical to SEQ ID NO: 36998
  misc_feature 1..30: note = chr18:44788251-44788281
  misc_feature 1..30: note = Hyper
  source 1..30: mol_type = genomic DNA

SEQ ID NO: 114552 - DNA, 699 bp, Homo sapiens
  misc_feature 1..699: note = chr18:44789474-44790173
  misc_feature 1..699: note = Hyper
  source 1..699: mol_type = genomic DNA
aagaaatggagacagcgttgcagagcgaatcactcatggtctttccatttcataatcgagggagacagcgcaagcaggtcagactcgaccggttcgcttcctcccacccctaacttggcgggatctgagaagaaagttcccgcatgtttgagcgtcctagggcttggataggacagacctcgtaggtccccaagctccagcttggagttcccaaggagaagggaagcgctagtgctatggagcgaggttttggtgaagaaaagggcctcgcgcccccttagtgccgtcgctctggggaatcttctttcgctgggaggatgaatggggcgctcgccgcggctcatggcgccccctaggagcggcaggaaacttctcctgcagggcagcgcgggccgggctccgcctccggaaggcgggcggggagggtagttgctgggggtccctaggccgggccccaggacatctaggacatgccgggggctgtttgctacggcttcatcccggagctcctgctcggggttgccggctgcctctgctggcgtccctcttcccttcctttgcgtaagcggcaactcctccaggaagccaggggaaggacgggatttcctctccacgtagggtagtagatcgcatagcccagccggatcgcccagcaggagtgcagggcgcgcgtcggggtgtctccggcttgtgggtgtg

SEQ ID NO: 114553 - DNA, 380 bp, Homo sapiens; identical to SEQ ID NO: 81872
  misc_feature 1..380: note = chr18:44790571-44790951
  misc_feature 1..380: note = Hyper
  source 1..380: mol_type = genomic DNA

SEQ ID NO: 114554 - DNA, 30 bp, Homo sapiens; identical to SEQ ID NO: 81873
  misc_feature 1..30: note = chr18:44852515-44852545
  misc_feature 1..30: note = Hypo
  source 1..30: mol_type = genomic DNA

SEQ ID NO: 114555 - DNA, 193 bp, Homo sapiens; identical to SEQ ID NO: 81874
  misc_feature 1..193: note = chr18:44977278-44977471
  misc_feature 1..193: note = Hypo
  source 1..193: mol_type = genomic DNA

SEQ ID NO: 114556 - DNA, 371 bp, Homo sapiens
  misc_feature 1..371: note = chr18:45058076-45058447
  misc_feature 1..371: note = Hyper
  source 1..371: mol_type = genomic DNA
aatgactccggtctccgcgccgctggtgttgcacaacttgtctgtgctggcttgagaccccggtgatccccttctaattgaaatcactttcccctgacctcccccgtaagcctgggagcttgttgctctctgcgccaacactcgggctgcggaggtcgggggaaatcctggctgggcaccagagctgcacgcacgccgcatccatcttccggccgcccgcgctcttggccgcgccaggtgcccagccagggtgggcgtcggggcagccccctggaaggcggccctgctggatcaccggctgcttggaagctcgcagcggggctgacactgccccctaaggggcattttggacatttcgtgggggggcttgt

SEQ ID NO: 114557 - DNA, 30 bp, Homo sapiens; identical to SEQ ID NO: 81877
  misc_feature 1..30: note = chr18:45120847-45120877
  misc_feature 1..30: note = Hyper
  source 1..30: mol_type = genomic DNA

SEQ ID NO: 114558 - DNA, 182 bp, Homo sapiens; identical to SEQ ID NO: 81878
  misc_feature 1..182: note = chr18:45275551-45275733
  misc_feature 1..182: note = Hyper
  source 1..182: mol_type = genomic DNA

SEQ ID NO: 114559 - DNA, 41 bp, Homo sapiens; identical to SEQ ID NO: 81879
  misc_feature 1..41: note = chr18:45534935-45534976
  misc_feature 1..41: note = Hyper
  source 1..41: mol_type = genomic DNA

SEQ ID NO: 114560 - DNA, 115 bp, Homo sapiens; identical to SEQ ID NO: 81880
  misc_feature 1..115: note = chr18:45662236-45662351
  misc_feature 1..115: note = Hyper
  source 1..115: mol_type = genomic DNA

SEQ ID NO: 114561 - DNA, 496 bp, Homo sapiens; identical to SEQ ID NO: 81881
  misc_feature 1..496: note = chr18:45662583-45663079
  misc_feature 1..496: note = Hyper
  source 1..496: mol_type = genomic DNA

SEQ ID NO: 114562 - DNA, 267 bp, Homo sapiens; identical to SEQ ID NO: 81882
  misc_feature 1..267: note = chr18:45663337-45663604
  misc_feature 1..267: note = Hyper
  source 1..267: mol_type = genomic DNA

SEQ ID NO: 114563 - DNA, 37 bp, Homo sapiens; identical to SEQ ID NO: 81883
  misc_feature 1..37: note = chr18:45934773-45934810
  misc_feature 1..37: note = Hyper
  source 1..37: mol_type = genomic DNA

SEQ ID NO: 114564 - DNA, 165 bp, Homo sapiens; identical to SEQ ID NO: 81884
  misc_feature 1..165: note = chr18:45935031-45935196
  misc_feature 1..165: note = Hyper
  source 1..165: mol_type = genomic DNA

SEQ ID NO: 114565 - DNA, 30 bp, Homo sapiens; identical to SEQ ID NO: 81885
  misc_feature 1..30: note = chr18:45937081-45937111
  misc_feature 1..30: note = Hyper
  source 1..30: mol_type = genomic DNA

SEQ ID NO: 114566 - DNA, 213 bp, Homo sapiens; identical to SEQ ID NO: 81886
  misc_feature 1..213: note = chr18:46142398-46142611
  misc_feature 1..213: note = Hypo
  source 1..213: mol_type = genomic DNA

SEQ ID NO: 114567 - DNA, 24 bp, Homo sapiens
  misc_feature 1..24: note = chr18:46713260-46713284
  misc_feature 1..24: note = Hypo
  source 1..24: mol_type = genomic DNA
tcatatattcactgccggtacaca

SEQ ID NO: 114568 - DNA, 82 bp, Homo sapiens; identical to SEQ ID NO: 81888
  misc_feature 1..82: note = chr18:47012303-47012385
  misc_feature 1..82: note = Hypo
  source 1..82: mol_type = genomic DNA

SEQ ID NO: 114569 - DNA, 86 bp, Homo sapiens; identical to SEQ ID NO: 81889
  misc_feature 1..86: note = chr18:47019807-47019893
  misc_feature 1..86: note = Hypo
  source 1..86: mol_type = genomic DNA

SEQ ID NO: 114570 - DNA, 557 bp, Homo sapiens; identical to SEQ ID NO: 81890
  misc_feature 1..557: note = chr18:47087147-47087704
  misc_feature 1..557: note = Hyper
  source 1..557: mol_type = genomic DNA

SEQ ID NO: 114571 - DNA, 441 bp, Homo sapiens; identical to SEQ ID NO: 81891
  misc_feature 1..441: note = chr18:47088061-47088502
  misc_feature 1..441: note = Hyper
  source 1..441: mol_type = genomic DNA

SEQ ID NO: 114572 - DNA, 152 bp, Homo sapiens; identical to SEQ ID NO: 81892
  misc_feature 1..152: note = chr18:47339606-47339758
  misc_feature 1..152: note = Hyper
  source 1..152: mol_type = genomic DNA

SEQ ID NO: 114573 - DNA, 81 bp, Homo sapiens; identical to SEQ ID NO: 45374
  misc_feature 1..81: note = chr18:47344091-47344172
  misc_feature 1..81: note = Hypo
  source 1..81: mol_type = genomic DNA

SEQ ID NO: 114574 - DNA, 136 bp, Homo sapiens; identical to SEQ ID NO: 81894
  misc_feature 1..136: note = chr18:47720183-47720319
  misc_feature 1..136: note = Hyper
  source 1..136: mol_type = genomic DNA

SEQ ID NO: 114575 - DNA, 107 bp, Homo sapiens; identical to SEQ ID NO: 81895
  misc_feature 1..107: note = chr18:47720801-47720908
  misc_feature 1..107: note = Hyper
  source 1..107: mol_type = genomic DNA

SEQ ID NO: 114576 - DNA, 449 bp, Homo sapiens; identical to SEQ ID NO: 81896
  misc_feature 1..449: note = chr18:47792530-47792979
  misc_feature 1..449: note = Hyper
  source 1..449: mol_type = genomic DNA

SEQ ID NO: 114577 - DNA, 193 bp, Homo sapiens; identical to SEQ ID NO: 81897
  misc_feature 1..193: note = chr18:48320158-48320351
  misc_feature 1..193: note = Hypo
  source 1..193: mol_type = genomic DNA

SEQ ID NO: 114578 - DNA, 215 bp, Homo sapiens; identical to SEQ ID NO: 81898
  misc_feature 1..215: note = chr18:48493710-48493925
  misc_feature 1..215: note = Hypo
  source 1..215: mol_type = genomic DNA

SEQ ID NO: 114579 - DNA, 29 bp, Homo sapiens
  misc_feature 1..29: note = chr18:49866392-49866421
  misc_feature 1..29: note = Hyper
  source 1..29: mol_type = genomic DNA
cctggaagcctcctcggtccgctcttttt

SEQ ID NO: 114580 - DNA, 216 bp, Homo sapiens; identical to SEQ ID NO: 81899
  misc_feature 1..216: note = chr18:49866847-49867063
  misc_feature 1..216: note = Hyper
  source 1..216: mol_type = genomic DNA

SEQ ID NO: 114581 - DNA, 276 bp, Homo sapiens; identical to SEQ ID NO: 81900
  misc_feature 1..276: note = chr18:49867123-49867399
  misc_feature 1..276: note = Hyper
  source 1..276: mol_type = genomic DNA

SEQ ID NO: 114582 - DNA, 57 bp, Homo sapiens; identical to SEQ ID NO: 81901
  misc_feature 1..57: note = chr18:49868299-49868356
  misc_feature 1..57: note = Hyper
  source 1..57: mol_type = genomic DNA

SEQ ID NO: 114583 - DNA, 96 bp, Homo sapiens; identical to SEQ ID NO: 81902
  misc_feature 1..96: note = chr18:49868671-49868767
  misc_feature 1..96: note = Hyper
  source 1..96: mol_type = genomic DNA

SEQ ID NO: 114584 - DNA, 81 bp, Homo sapiens; identical to SEQ ID NO: 81903
  misc_feature 1..81: note = chr18:49945126-49945207
  misc_feature 1..81: note = Hypo
  source 1..81: mol_type = genomic DNA

SEQ ID NO: 114585 - DNA, 19 bp, Homo sapiens
  misc_feature 1..19: note = chr18:50382419-50382438
  misc_feature 1..19: note = Hypo
  source 1..19: mol_type = genomic DNA
ccaccgcgccccgccatta

SEQ ID NO: 114586 - DNA, 120 bp, Homo sapiens; identical to SEQ ID NO: 81907
  misc_feature 1..120: note = chr18:51209753-51209873
  misc_feature 1..120: note = Hypo
  source 1..120: mol_type = genomic DNA

SEQ ID NO: 114587 - DNA, 127 bp, Homo sapiens; identical to SEQ ID NO: 81913
  misc_feature 1..127: note = chr18:52495893-52496020
  misc_feature 1..127: note = Hyper
  source 1..127: mol_type = genomic DNA

SEQ ID NO: 114588 - DNA, 92 bp, Homo sapiens; identical to SEQ ID NO: 81914
  misc_feature 1..92: note = chr18:52627015-52627107
  misc_feature 1..92: note = Hypo
  source 1..92: mol_type = genomic DNA

SEQ ID NO: 114589 - DNA, 30 bp, Homo sapiens; identical to SEQ ID NO: 81915
  misc_feature 1..30: note = chr18:52946077-52946107
  misc_feature 1..30: note = Hypo
  source 1..30: mol_type = genomic DNA

SEQ ID NO: 114590 - DNA, 81 bp, Homo sapiens; identical to SEQ ID NO: 81916
  misc_feature 1..81: note = chr18:52961504-52961585
  misc_feature 1..81: note = Hypo
  source 1..81: mol_type = genomic DNA

SEQ ID NO: 114591 - DNA, 103 bp, Homo sapiens; identical to SEQ ID NO: 45377
  misc_feature 1..103: note = chr18:52961793-52961896
  misc_feature 1..103: note = Hypo
  source 1..103: mol_type = genomic DNA

SEQ ID NO: 114592 - DNA, 371 bp, Homo sapiens
  misc_feature 1..371: note = chr18:52988920-52989291
  misc_feature 1..371: note = Hyper
  source 1..371: mol_type = genomic DNA
acatcaaagagttgccgcccatgcccgggattgtgtatgcgcagtacatggtctcggattcttttttctcctcagtaccactctaacaacttttatttcaaactcgctgtcccttttttcacaacaattccttcagttgcattttcccatatggccgggccaagcgtggtgaatatgcaaagcaggaagagaccattcctggcgggcgggggaggccgcggcgctgctgtcagacgctcaactttgcgcagcggagctggaaggcagcccggccctgatggagctcgaaatcctaatgcatacgcgagatcgattcaacttttccgaggggtttttattagttcctcgaataatgccgattcttacaaatt

SEQ ID NO: 114593 - DNA, 212 bp, Homo sapiens; identical to SEQ ID NO: 81920
  misc_feature 1..212: note = chr18:52989741-52989953
  misc_feature 1..212: note = Hyper
  source 1..212: mol_type = genomic DNA

SEQ ID NO: 114594 - DNA, 180 bp, Homo sapiens; identical to SEQ ID NO: 45378
  misc_feature 1..180: note = chr18:53074296-53074476
  misc_feature 1..180: note = Hypo
  source 1..180: mol_type = genomic DNA

SEQ ID NO: 114595 - DNA, 82 bp, Homo sapiens; identical to SEQ ID NO: 81922
  misc_feature 1..82: note = chr18:53233489-53233571
  misc_feature 1..82: note = Hypo
  source 1..82: mol_type = genomic DNA

SEQ ID NO: 114596 - DNA, 1403 bp, Homo sapiens; identical to SEQ ID NO: 81923
  misc_feature 1..1403: note = chr18:53254614-53256017
  misc_feature 1..1403: note = Hyper
  source 1..1403: mol_type = genomic DNA

SEQ ID NO: 114597 - DNA, 380 bp, Homo sapiens; identical to SEQ ID NO: 37017
  misc_feature 1..380: note = chr18:53256942-53257322
  misc_feature 1..380: note = Hyper
  source 1..380: mol_type = genomic DNA

SEQ ID NO: 114598 - DNA, 1083 bp, Homo sapiens
  misc_feature 1..1083: note = chr18:53446827-53447910
  misc_feature 1..1083: note = Hyper
  source 1..1083: mol_type = genomic DNA
ccccacactcttcttcgctggcacattcactgatgtagaaaatgccaggagccccgggggtgtgatgtttccggtggataatgtctcccgttccctgccccggggcccagacagttggtgcttaagcgtctacaatgtagagtttcctgcattttcctcgggccgccatttgtctacttgtcccatccaggacatctccctaaataatctctaagtggaaaaatcacggtcctctaggagatttatccgggaacgaacgtgcgtggggcagttcaaattcctgagctcagatttcgtttcccgcggtcagatggtgcggtcggtggggcccgagggatgcgcacagctgtgcctgagaggtgctgctctcccgccaccgaagtcgctgggaaattctgctgcactgagacattttaatgtcggatgttctaatcctgcgggcaaaaaaaaaaaaaaagtttgaaccaggtactgggcttttgtcacggtgaaccccacccgcgccccgcgccgtcccttcattcactcaggcgaggtggcttggatttgcacctcgttgaagaagcctcccatgcgacatctccgccagcaccccgcgcggacttggctgggcggcggcggggagtcagcttgtcaccgcacggcggccgggaccgcagcccctgggtgcgcagtgcgcctctcgctgcgccctcctagagcgcgggtcccgtgcctgtgcccggcgcgacgcgatctccctgctagtcgggctccgcgtgctccccgcgcttcccgcagcctccgcgcagcccgcagcgccctccagccccgcctcgcggccgcgggaacccggcgcctgcagccccgcccggaaccgaccgccaggcgctgttgccgccggccacgcaacgcggggcctctgcctggcaccagccccaggtgccttgtctcgggtcgtgctgtcgcgcgacactggggacccaacaggccgccggctactcagctggccccgcagcttccctgcggctcagcggcctcccacccaggagaaaaccacatttgatgagagttttgaatcaagccgagcgttcccccagatgt

SEQ ID NO: 114599 - DNA, 36 bp, Homo sapiens; identical to SEQ ID NO: 81927
  misc_feature 1..36: note = chr18:53960321-53960357
  misc_feature 1..36: note = Hypo
  source 1..36: mol_type = genomic DNA

SEQ ID NO: 114600 - DNA, 202 bp, Homo sapiens; identical to SEQ ID NO: 81928
  misc_feature 1..202: note = chr18:53968903-53969105
  misc_feature 1..202: note = Hypo
  source 1..202: mol_type = genomic DNA

SEQ ID NO: 114601 - DNA, 50 bp, Homo sapiens; identical to SEQ ID NO: 81929
  misc_feature 1..50: note = chr18:53989683-53989733
  misc_feature 1..50: note = Hypo
  source 1..50: mol_type = genomic DNA

SEQ ID NO: 114602 - DNA, 30 bp, Homo sapiens; identical to SEQ ID NO: 81930
  misc_feature 1..30: note = chr18:53989950-53989980
  misc_feature 1..30: note = Hypo
  source 1..30: mol_type = genomic DNA

SEQ ID NO: 114603 - DNA, 47 bp, Homo sapiens; identical to SEQ ID NO: 45380
  misc_feature 1..47: note = chr18:54483265-54483312
  misc_feature 1..47: note = Hypo
  source 1..47: mol_type = genomic DNA

SEQ ID NO: 114604 - DNA, 275 bp, Homo sapiens; identical to SEQ ID NO: 81932
  misc_feature 1..275: note = chr18:54789012-54789287
  misc_feature 1..275: note = Hyper
  source 1..275: mol_type = genomic DNA

SEQ ID NO: 114605 - DNA, 265 bp, Homo sapiens
  misc_feature 1..265: note = chr18:55019653-55019918
  misc_feature 1..265: note = Hyper
  source 1..265: mol_type = genomic DNA
atcctgtgcttagatcgaactgtaacattattccaatcacatttatcttgcaggcggcggaggagatggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctcccc

SEQ ID NO: 114606 - DNA, 85 bp, Homo sapiens
  misc_feature 1..85: note = chr18:55019978-55020063
  misc_feature 1..85: note = Hyper
  source 1..85: mol_type = genomic DNA
acacacacacacacacacacacatatatacacgccagcgagctgctggccgctcaatggaccgatttccccggtttccctgaacc

SEQ ID NO: 114607 - DNA, 991 bp, Homo sapiens
  misc_feature 1..991: note = chr18:55020439-55021430
  misc_feature 1..991: note = Hyper
  source 1..991: mol_type = genomic DNA
aaagcccctagaagccgctgtccaaatcgatgtgattgcatttctcgtattcttcctcagcatcccttccctcatttcagaaatgggggttgggggaggctttcaggagggtgagggtggagggaaagacggtgtgtttgttcgggagggggcggcgagcagagatggacaggcgtgaggggagcgccctccccgcgccctgtccgcagactccgcgggccgggcccggggcggtgctggcggtttaatggcgcaggcgccggactcccctcgcgccctcctcctttactcccccacgcctatcaaaggacacgcgggtttattctcaggaagcccctggggcgttctctctcaaccctttcccccgcagccaccgccccccaccagctttccgggatttctgcaattcccccgccccctgcgggaagcgagcctcggaagggccgcccaccctcgccaggtcggagtcaccgctccgcgctgggccggcctgtgaaggctccaggcgcagcttgacgccgctctgcgagagcccccgccccgctctgtgaccccgggaactctcccagcagggcctcctgacgggcaggtggcaactacaaagtgccacctgtggtccaagctgggaccgaggcgaggaacccagaggagcctcgcctggaccgaggagcggagtaggccggcggcccccgggggtccccagccaagttataggaagtgaaatcggacgtgggtttgggaaggaagaggttaaggcaggaaccacccccagactttccctgggtctccggtttcctctgccctttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccattttatggtctctccggcacccggagggatggacaa

SEQ ID NO: 114608 - DNA, 126 bp, Homo sapiens
  misc_feature 1..126: note = chr18:55095963-55096089
  misc_feature 1..126: note = Hyper
  source 1..126: mol_type = genomic DNA
agcggacctagggtacgccgggctccgccgagcgggcaaagggagcggcctgcgccgccaccccgcgcccgcggcctcgacgccgcagccgccacgccaacaccgattcctcgtggccaacaggtt

SEQ ID NO: 114609 - DNA, 117 bp, Homo sapiens
  misc_feature 1..117: note = chr18:55101949-55102066
  misc_feature 1..117: note = Hyper
  source 1..117: mol_type = genomic DNA
tgcattactgctgcccgcgccgcccgtgggccgccggccggccgcagctcgctggcgacgagggcactacagttgctctgaccgcgtagattatgcatgtcccggcctcgggaattt

SEQ ID NO: 114610 - DNA, 416 bp, Homo sapiens
  misc_feature 1..416: note = chr18:55103337-55103753
  misc_feature 1..416: note = Hyper
  source 1..416: mol_type = genomic DNA
catgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgcca

SEQ ID NO: 114611 - DNA, 30 bp, Homo sapiens; identical to SEQ ID NO: 81940
  misc_feature 1..30: note = chr18:55104062-55104092
  misc_feature 1..30: note = Hyper
  source 1..30: mol_type = genomic DNA

SEQ ID NO: 114612 - DNA, 345 bp, Homo sapiens; identical to SEQ ID NO: 81941
  misc_feature 1..345: note = chr18:55104840-55105185
  misc_feature 1..345: note = Hyper
  source 1..345: mol_type = genomic DNA

SEQ ID NO: 114613 - DNA, 626 bp, Homo sapiens; identical to SEQ ID NO: 81942
  misc_feature 1..626: note = chr18:55105464-55106090
  misc_feature 1..626: note = Hyper
  source 1..626: mol_type = genomic DNA

SEQ ID NO: 114614 - DNA, 108 bp, Homo sapiens; identical to SEQ ID NO: 81943
  misc_feature 1..108: note = chr18:55114536-55114644
  misc_feature 1..108: note = Hyper
  source 1..108: mol_type = genomic DNA

SEQ ID NO: 114615 - DNA, 220 bp, Homo sapiens; identical to SEQ ID NO: 81948
  misc_feature 1..220: note = chr18:55469444-55469664
  misc_feature 1..220: note = Hyper
  source 1..220: mol_type = genomic DNA

SEQ ID NO: 114616 - DNA, 30 bp, Homo sapiens; identical to SEQ ID NO: 81949
  misc_feature 1..30: note = chr18:55470924-55470954
  misc_feature 1..30: note = Hyper
  source 1..30: mol_type = genomic DNA

SEQ ID NO: 114617 - DNA, 164 bp, Homo sapiens; identical to SEQ ID NO: 81951
  misc_feature 1..164: note = chr18:55850823-55850987
  misc_feature 1..164: note = Hypo
  source 1..164: mol_type = genomic DNA

SEQ ID NO: 114618 - DNA, 30 bp, Homo sapiens; identical to SEQ ID NO: 81952
  misc_feature 1..30: note = chr18:55852270-55852300
  misc_feature 1..30: note = Hypo
  source 1..30: mol_type = genomic DNA

SEQ ID NO: 114619 - DNA, 71 bp, Homo sapiens; identical to SEQ ID NO: 81953
  misc_feature 1..71: note = chr18:55992525-55992596
  misc_feature 1..71: note = Hypo
  source 1..71: mol_type = genomic DNA

SEQ ID NO: 114620 - DNA, 30 bp, Homo sapiens; identical to SEQ ID NO: 81954
  misc_feature 1..30: note = chr18:56022817-56022847
  misc_feature 1..30: note = Hypo
  source 1..30: mol_type = genomic DNA

SEQ ID NO: 114621 - DNA, 30 bp, Homo sapiens; identical to SEQ ID NO: 45382
  misc_feature 1..30: note = chr18:56483562-56483592
  misc_feature 1..30: note = Hypo
  source 1..30: mol_type = genomic DNA

SEQ ID NO: 114622 - DNA, 25 bp, Homo sapiens
  misc_feature 1..25: note = chr18:56483918-56483943
  misc_feature 1..25: note = Hypo
  source 1..25: mol_type = genomic DNA
aagtttgaaattccccggccgggcg

SEQ ID NO: 114623 - DNA, 30 bp, Homo sapiens; identical to SEQ ID NO: 81962
  misc_feature 1..30: note = chr18:56737815-56737845
  misc_feature 1..30: note = Hyper
  source 1..30: mol_type = genomic DNA

SEQ ID NO: 114624 - DNA, 24 bp, Homo sapiens
  misc_feature 1..24: note = chr18:56815852-56815876
  misc_feature 1..24: note = Hypo
  source 1..24: mol_type = genomic DNA
tttttttttttgagacggagtctc

SEQ ID NO: 114625 - DNA, 24 bp, Homo sapiens
  misc_feature 1..24: note = chr18:56816116-56816140
  misc_feature 1..24: note = Hypo
  source 1..24: mol_type = genomic DNA
gattacaggcgtgagccactgtgc

SEQ ID NO: 114626 - DNA, 342 bp, Homo sapiens; identical to SEQ ID NO: 37028
  misc_feature 1..342: note = chr18:56887076-56887418
  misc_feature 1..342: note = Hyper
  source 1..342: mol_type = genomic DNA

SEQ ID NO: 114627 - DNA, 990 bp, Homo sapiens
  misc_feature 1..990: note = chr18:56887704-56888694
  misc_feature 1..990: note = Hyper
  source 1..990: mol_type = genomic DNA
ctccccatttctttgcgtttccctggcccagctttgggagctgggtttgttgtgacctttctatcggcaaacaccttccccgttctcctaaaactccaccccacctttccccattctagggagcccatgagtccctagtcagccgcaggctggtccgctgatcctttcccgctcgcttccagcctgtcttccccagggcacccgagctcccaacagccaaccccggtgcagatcaccttccctctgcgcccatcctacatctccttttgtccgcctagtctcaacctgtctggcacggtactctcctagaataatcttggggagcgttgtcccttgaaagcatctcagaaccctggtccagctcggtggcctcaacagcgactggcatgggctgaaatctaagctgcgcctatgctccccgcaaagccacaggtgtggggacctagggtgcagcgctcccgccccgggtttcacatctgttcagtgcgcagtgccctgaatcccgcctgtctgtgactctctggagtttcctcagtccttctcttcgctttgcagcgatattcttttccctgcccttttgccctccctctttccagccagcaggctctgagcttggggaatctcgcctgctctccaagctcatcccgatctctctgcccctctgagctccgctctttctccgcccttcttgacccacgacttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggtcaggattccgccctgcgcgcactcgctgctttcgctcagctgggaggcaggaagcgcctggcagcctcggctcacccagcatcaccccagggctctcggcgtcgccgagcatagcttccagcaaacgcagagcgtccaac

SEQ ID NO: 114628 - DNA, 17 bp, Homo sapiens
  misc_feature 1..17: note = chr18:56911116-56911133
  misc_feature 1..17: note = Hypo
  source 1..17: mol_type = genomic DNA
cccggcctctttgtata

SEQ ID NO: 114629 - DNA, 878 bp, Homo sapiens; identical to SEQ ID NO: 81971
  misc_feature 1..878: note = chr18:56931541-56932419
  misc_feature 1..878: note = Hyper
  source 1..878: mol_type = genomic DNA

SEQ ID NO: 114630 - DNA, 457 bp, Homo sapiens; identical to SEQ ID NO: 81972
  misc_feature 1..457: note = chr18:56932659-56933116
  misc_feature 1..457: note = Hyper
  source 1..457: mol_type = genomic DNA

SEQ ID NO: 114631 - DNA, 30 bp, Homo sapiens; identical to SEQ ID NO: 81973
  misc_feature 1..30: note = chr18:56933508-56933538
  misc_feature 1..30: note = Hyper
  source 1..30: mol_type = genomic DNA

SEQ ID NO: 114632 - DNA, 719 bp, Homo sapiens
  misc_feature 1..719: note = chr18:56934900-56935619
  misc_feature 1..719: note = Hyper
  source 1..719: mol_type = genomic DNA
tccaggttctgctggcggtcgcccagcttccagtgtcaacggtggatatcgagcacgctcaggcgggagtccgggactctccttcttcagagagtctcaggagattgtgaagcgggctgagatttcgagattccttcctcgccctagagccggcgccaaagaactgcagatactgtccagggcacgcccgcaagaactagctctcggggcggtggcgtagggcgctccaggacactctccgagcgcggcacctcaccagacgcgccttttaccgaactctgggttggcgagtgtggagcgagttggggaggttagagagtctcgcggctccgaaaaggaaaagcatctctttgcctcagttcttgtaccgctggtgatcaaccttgggtgttagggactggcaccgaaccggagatctgcttggtgaactgagaggagtccttaggagagcggggacgccaggggccgggggacacttcgctctcgccctagggaaggtggtcttgacgctttctattgaagtcaaacttgaaaatatcagctgccgctggactatggggctagcgggggaactgggagcgcgctagcatctgagccttagccccatccactccggaccccaagcgcgcacgccggctccagggaagggcgcctctggtctaggccgccgaagcgttcggaatggggacgattctctgctgcagcgaagtgtccctaga

SEQ ID NO: 114633 - DNA, 1141 bp, Homo sapiens; identical to SEQ ID NO: 81976
  misc_feature 1..1141: note = chr18:56935921-56937062
  misc_feature 1..1141: note = Hyper
  source 1..1141: mol_type = genomic DNA

SEQ ID NO: 114634 - DNA, 3137 bp, Homo sapiens
  misc_feature 1..3137: note = chr18:56939052-56942189
  misc_feature 1..3137: note = Hyper
  source 1..3137: mol_type = genomic DNA
aaaaggcctttgcagcgagaagtttggttggatgtgcaccagaaaaggaaaagtcagtttcttaaataaatccacccgaagtttcaactgcgaggtgccaggcccttcgcaaggaaacagggttttcgtttccaactcggtattcgcagctagtgacgagggtggcatttggggccccaatcctgtcaccctcgatcactacctgcattccatttccactcagcaacccccaaccccttcctggctatgtctaatgagctgtcggcctcttcatcttgcaagtcattcccatcttctattttgagtttagaagagggaaacccccaaaggggagctcgtactacaaactggaacagactgcttgaagggcgatgcacagggaacatcgaagatctgtgcctctcccttgagactctgggcatgccaagtcgaggaaggacagtaataaatgcatggacacccgtgaattccgagaagcattggctgcaatttgggcctcgggccctcccagatcccagttcctcaacctgggcgctttacctggacccggacctctggtaggttgaccttgccggccagctcctcgcggctgtacacgtccgggtagtgggacttctcgaacgcgcgctccagctcatgcagctggtacgtggtgaaagtcgtgcggttccgccgatgctttttcttgggctgttcctcctctgacagtttcgcttcgccggtggctggcccgacgggcagccctgggctcggccgtgcctccccgggctccttggggcagtagggtcgaggggctggggcgacgaggcccgggagggtcagatgcactccccaaaacacccttgggccgaccccgcctcgctgtgggcactggccagcccgcctgcgggctccgagatggcccggggaggtccgtggtgagggcggcgatgggtcctaagctttctctgaatgcaaattggaagctcccgccatagacggtccccaaccccgcgcccagttgccttaataaaagttaaggaaggggcgctctcgtctggccaactcctaagctcgggcgcccgaacggcctcgcacagccaggggtgcgcactcaccttcgtactcgggggcgggcgccggggctggcggcggggagggctcggagccttcctcgggcgccttggggcaggcgggccgcgcgcccagcctcctatcccgctccttcgcgccccgggcgccccgctccgccgggaaggtgccgaggatcccgtcgtccttggtaaaccccaggatggcctcgatgctgtgaagtcgcgaggtgctcccgcccgggctgcggagcaggtggccggcaagcgagaagctcccgtcggccatggctggcgcgcagcccggcaggtgcatggggagcgccgggaggcgggagggcgctttggagacggagaggagaggctcgaagccgggtcttcccgagtgcggcggtgcaacccgacgggtcccgaccctaggtcaagctccgcgggcgaagcccgcccgggctgcgcacgctgggggtggccgagcgctcagcccgctgccgccttagtcccagaagtcggaagttcgggctcggggtagctggggctctcggcgctaaaggcggggagccaactggccctcggctcctcccctctcgccctggacccagccccttctctcggcccctccctccacagaggggcgtgtcctcacccggcccagccacagggtcctctagtggccacccctgggccggcactaggaatattccccttccacctcttgatccgttttaagctttacaaacacactccggggatccgcggcgggatgcctgatgggctcgggaacctggtcgcggcgcacccctagtcctgcctcagtggggccgacgcccttgggctcatctctccccttgcgtttgtctccctctacttcgggcttaccctctcacttcagactaccccctgggggtcacctccctccttggacgcacccctccccagcttcagactcgcccctctagccccctctggctcacctccgcggggccgccaccctggcctgtgccccctggaagcgccgagacccagccgaaggcttcccagccccgcactcgtcgcagtttgaatttcccctcgctggctcccttttcgggacccactcctttcttggctgggttgtacgaagtcccggacctcgcgtttagtttgtccgtctatatctgttgtaactcctcccagtcccctcggacttgagcgccggcagcctccctccttccccgcagcgcccaccccagggccatttatgtccgcaagtccggtgacctctagcgcccgatcgcccagcaggagactgggagccccgagtcggatgtgctgccgggctcaggtcccgcaggagacccacctggagttcctcgctcccgccccttgtcctgcggggagggcgggctcctttactgatgagcagcggtgtcgcactcccgcctccctccaacactccgggccaaggagatggcccagagctggctggggaaggaccttctcccggggaagaggcctctcgcctccccgagggttcaggagtaattggcttgcagttctttctcctttggaccccctcgaggcttccgtggcccacagtgactgatcggccacttggaaagatgattggatagggtgagtgtgtttcacctccagcagcgcggatggacaatggcgctgtgaacgtctcacccctcaaatctgaggcgagacccgaggcgagcgcttggccttccctgaactggtggcctgaaccgtgaattaaaatgctttcctataaaagctcaaggacctagaggacaatatccctaaaatctccttttcagtaggcgctctgatctccacagcaggggtgtcttctttatcccgcttgcgttcagacaagcgtttgctgcgtccctttagagggcaaggcaaccgtcgagggccacgtcgtgggcatcaaacaaattgggaaaggccagggccgttggcctggtggagtttaacgtccagtctggaagacaagacaaaggaagagggaaaacacacatcctcagatccccaacctttaaattggtgttagaaggatgtttgcggaggacaagtcaa

SEQ ID NO: 114635 - DNA, 75 bp, Homo sapiens; identical to SEQ ID NO: 81981
  misc_feature 1..75: note = chr18:56976125-56976200
  misc_feature 1..75: note = Hyper
  source 1..75: mol_type = genomic DNA

SEQ ID NO: 114636 - DNA, 36 bp, Homo sapiens; identical to SEQ ID NO: 81982
  misc_feature 1..36: note = chr18:57061262-57061298
  misc_feature 1..36: note = Hypo
  source 1..36: mol_type = genomic DNA

SEQ ID NO: 114637 - DNA, 52 bp, Homo sapiens; identical to SEQ ID NO: 81983
  misc_feature 1..52: note = chr18:57069866-57069918
  misc_feature 1..52: note = Hyper
  source 1..52: mol_type = genomic DNA

SEQ ID NO: 114638 - DNA, 30 bp, Homo sapiens; identical to SEQ ID NO: 81984
  misc_feature 1..30: note = chr18:57138384-57138414
  misc_feature 1..30: note = Hypo
  source 1..30: mol_type = genomic DNA

SEQ ID NO: 114639 - DNA, 1305 bp, Homo sapiens
  misc_feature 1..1305: note = chr18:57363675-57364980
  misc_feature 1..1305: note = Hyper
  source 1..1305: mol_type = genomic DNA
gtgttgctctgactccgatccaaccaaccctcaaagattcgcaccgcgcggcacgcacccagcaggttccagcgtaaaagctgctccggtcccaagcgcgtctccaaacccctcctttacagcgccgcctccccagccagccccggtgcgcagtggcgaacagcccgcagagcccccaggcttacctgtagcatgtggtgagctcgcctgaagacttcagacacgggtatttagtcgtcgcgattttgctctctgagcagatttctctatgaaaaagtgcagaggaaatgttcgattctcagcgggagagcggaggcgggcagcgcgcgctggggaatccctggcgcgtggggatcgccaggctccccgtcccggcgctctgggcaggggctggtccccaaacgcgtacgcggggcagactccggccacagggacgagccacgcgagggtcacgacgaagcgaaccagctccaggagaaaggaagcggggttcacgagctgtgccagccagtgtggcacccggggggaggcaggaacgcggggcgaagggtatccctgacgcgacccacggatggcagggcgcaaaggctgatacccgggagcggagggaagtgtcgcccaggacagctgagcactctccttatccccggagaagtgagggcgtgcggatcgctgtgggagtgggcgccggggaggaccgcccgcaccccgcgagccgggcgcgcatcaagcaggagctcgccctccgctggggcttgcagcgcttacctgtcgccgtcctccggctcctctctgtaggtccacgtgtgtcccaacgccaggagcagcagcagcggacccaggctcctgcccagctggcccctggcagctcctccccggctcggaggcggcggcaccatcagggaagctcccggcttcttcccagcgccgagctccgtccggaccaagcgtcctgctcctccgcggccgccgccgccttccctcttcccggcagggggcgccggagagcaggggcgtttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattt

SEQ ID NO: 114640 - DNA, 183 bp, Homo sapiens; identical to SEQ ID NO: 81987
  misc_feature 1..183: note = chr18:57365455-57365638
  misc_feature 1..183: note = Hyper
  source 1..183: mol_type = genomic DNA

SEQ ID NO: 114641 - DNA, 184 bp, Homo sapiens; identical to SEQ ID NO: 81988
  misc_feature 1..184: note = chr18:57652615-57652799
  misc_feature 1..184: note = Hypo
  source 1..184: mol_type = genomic DNA

SEQ ID NO: 114642 - DNA, 116 bp, Homo sapiens; identical to SEQ ID NO: 81989
  misc_feature 1..116: note = chr18:57677751-57677867
  misc_feature 1..116: note = Hypo
  source 1..116: mol_type = genomic DNA

SEQ ID NO: 114643 - DNA, 30 bp, Homo sapiens; identical to SEQ ID NO: 81990
  misc_feature 1..30: note = chr18:57684712-57684742
  misc_feature 1..30: note = Hypo
  source 1..30: mol_type = genomic DNA

SEQ ID NO: 114644 - DNA, 38 bp, Homo sapiens; identical to SEQ ID NO: 81991
  misc_feature 1..38: note = chr18:58330518-58330556
  misc_feature 1..38: note = Hypo
  source 1..38: mol_type = genomic DNA

SEQ ID NO: 114645 - DNA, 1214 bp, Homo sapiens
  misc_feature 1..1214: note = chr18:59000691-59001905
  misc_feature 1..1214: note = Hyper
  source 1..1214: mol_type = genomic DNA
aggggaagcggaccgcgcgccacgctcgggggacggtgaccgcgaccagggggctcttctcactggacaggccgaacgcggtggccgcgggagggcagggcagggcatcggcggggttggtgcacttggcagtaccccccaactcctggcaaccgcacggagactttgcgaaacatccgaaggcagaaaagctgtgacacttctgacagagggggtaggggggtggggggcggggacagcgccgcgagcaggggtgaagagacccagcggggcaccagccgcccagtgggggaggcagctacgtgagcagaacgcccgccctggagcagttaggaccgaaggtctccggagagtcgccggcggtgccaggtaacgcagagggctcgggtcgggccccgcttctggggcttgggactccgggcgcgcggagccagccctctggggcgaaatccccgggcggcgtgcgcggtccctctccgcgctgtgctctcccagcaactccctgccacctcgacgagcctaccggccgctccgagttcgacttcctcggacttagtgggagaaggggttggaaatgggctgccgggactgggggagctgctctctggaagcagggaagctggggcgcaccggggcaggtggaggacgtggcgcgctgggagcggggactgcgcgcgcctggggatggtgactggggatccaggagcgcggcttgtgggggcgcttggcacggcttcaccctcgctggccccgcaggcggtggcgcctccctccgcctgcagaggggacagggtggccgcgtccctcgcacagagatgtgcgccgggaaggggaccagagagccaggctccggggaggcgcaggcacctacggggccgatccctggtccgtgcctcgcgccgcgcccccgccggagctcggctgtgggaggagaatgtggtgggtactcgagtccccgccacctgccggacttcgccaactccccggatttcctgtcctcgggccctgacactcccaaggaaagctctgaattgcgctcgctgtttggtttttgcttgttgtagttactctgggggaagagccgggggcaagggggtcaaatggggctaaagtttcagatttgcaaagagaacgttaccgaggactctcaacgtgtccttagcaatcggagagactgcagcagcctttgcctagctatccgcctctggggcagc

SEQ ID NO: 114646 - DNA, 30 bp, Homo sapiens; identical to SEQ ID NO: 45386
  misc_feature 1..30: note = chr18:59137607-59137637
  misc_feature 1..30: note = Hypo
  source 1..30: mol_type = genomic DNA

SEQ ID NO: 114647 - DNA, 404 bp, Homo sapiens
  misc_feature 1..404: note = chr18:59560168-59560572
  misc_feature 1..404: note = Hyper
  source 1..404: mol_type = genomic DNA
aggaagggttagatacgcgccgcggagaaggaaatccaagcgccctcctgggcagacggggctggagcgggtgcactagggaggtggagcaaggcagatgaggtgtggagggctggcggccgagaagggggcgtcacggctcctaattgtctctacaggataaataaccacctcccccctcctccgcagtctcccccgcccacgagttcccctctggtggcagagcgcctactagcaacagtaagccctaggaaagaaagaaatcggagcaggtggggaataacatcttggggcaaagacacactggcaaaatctaccaggtaacccggtcatatgggaatgcggggcgcctagtcagccgcgcagacaggcacacagcgcggcaatcccgagcatctttcttt

SEQ ID NO: 114648 - DNA, 37 bp, Homo sapiens; identical to SEQ ID NO: 82005
  misc_feature 1..37: note = chr18:59992186-59992223
  misc_feature 1..37: note = Hyper
  source 1..37: mol_type = genomic DNA

SEQ ID NO: 114649 - DNA, 30 bp, Homo sapiens; identical to SEQ ID NO: 45387
  misc_feature 1..30: note = chr18:60056441-60056471
  misc_feature 1..30: note = Hypo
  source 1..30: mol_type = genomic DNA

SEQ ID NO: 114650 - DNA, 848 bp, Homo sapiens
  misc_feature 1..848: note = chr18:60263506-60264354
  misc_feature 1..848: note = Hyper
  source 1..848: mol_type = genomic DNA
tcgcgttcagatcctcgaagtggctccctccgggacctcgctggctttcctgttcccgacccctcggccaagccgtgcgaccgggtgggctctgcttccccgggaccccactctgaccccatcccctaagccgctcccgcgagcacctcagctccgctcccgcgcgggtcagcaattcgaagtccgccccagacccctgggccttcgggcgcccccggaagccgcagggactgtcggactgagcggcccccttgcttgggtgggagctggggtgcagagaggggctgttctcgcacccttccgctgcatcggtccccgggccagtgcggagactcctctttgcgtttccaaatcacttttacgaacaaaagaggcgcccagaggatatcaccccgggcgcaccgccctccaggggtgtttgaaacgtgagctgttgtcaggcccagggccaaggatgctaaatgtccgggaaaatgcgcgcggcagccggccacactcaggacgatggtccgtccccgagagccagcagggctgcggagaggaagatccagccgccgagcgcagcgcgcacggagcgggacgcctgcggcgatgcctgcccgggtggccgctgtcctctgcccgggcgccgctggagccgcgcgtccccatcgccgcgccggctagtcccacaggtgcccggagagggaggcacggaggcatacccaaccttgagtgcgtccagcatacgtgggtgtggacgaaggtgagaaagggttctttccaaaggttcaagacagagcttccagtaccttctaaatccccagaaagtagtggtctagaagttgcttctccgcttcccaacgcca

SEQ ID NO: 114651 - DNA, 216 bp, Homo sapiens; identical to SEQ ID NO: 82009
  misc_feature 1..216: note = chr18:60467824-60468040
  misc_feature 1..216: note = Hypo
  source 1..216: mol_type = genomic DNA

SEQ ID NO: 114652 - DNA, 94 bp, Homo sapiens; identical to SEQ ID NO: 82010
  misc_feature 1..94: note = chr18:60557763-60557857
  misc_feature 1..94: note = Hypo
  source 1..94: mol_type = genomic DNA

SEQ ID NO: 114653 - DNA, 49 bp, Homo sapiens; identical to SEQ ID NO: 82011
  misc_feature 1..49: note = chr18:60730449-60730498
  misc_feature 1..49: note = Hypo
  source 1..49: mol_type = genomic DNA

SEQ ID NO: 114654 - DNA, 30 bp, Homo sapiens; identical to SEQ ID NO: 82012
  misc_feature 1..30: note = chr18:60741411-60741441
  misc_feature 1..30: note = Hypo
  source 1..30: mol_type = genomic DNA

SEQ ID NO: 114655 - DNA, 30 bp, Homo sapiens; identical to SEQ ID NO: 82013
  misc_feature 1..30: note = chr18:60756521-60756551
  misc_feature 1..30: note = Hypo
  source 1..30: mol_type = genomic DNA

SEQ ID NO: 114656 - DNA, 85 bp, Homo sapiens; identical to SEQ ID NO: 82014
  misc_feature 1..85: note = chr18:60759912-60759997
  misc_feature 1..85: note = Hypo
  source 1..85: mol_type = genomic DNA

SEQ ID NO: 114657 - DNA, 455 bp, Homo sapiens
  misc_feature 1..455: note = chr18:60985518-60985973
  misc_feature 1..455: note = Hyper
  source 1..455: mol_type = genomic DNA
ccgcgcggtgaagggcgtcaggtgcagctggctggacatctcggcgaagtcgcggcggtagcggcgggagaagtcgtcgccggcctggcggagggtcaggtggaccacaggtggcaccgggctgagcgcaggccccgcggcggcgccgggggcagccggggtctgcagcggcgaggtcctggcgaccgggtcccgggatgcggctggatggggcgtgtgcccgggctgggaggagaagatgcccggtgcgggggcggcccccgggggcgcggcgcccacatctcccgcatcccactcgtagcccctctgcgacagcttataatggatgtacttcatcactatctcccggttatcgtaccctgttctcccagcgtgcgccatccttcccagaggaaaagcaacgggggccaacggcacctctcgccccagctcccaccccacggcccccagagaaa

SEQ ID NO: 114658 - DNA, 30 bp, Homo sapiens; identical to SEQ ID NO: 82018
  misc_feature 1..30: note = chr18:61200515-61200545
  misc_feature 1..30: note = Hypo
  source 1..30: mol_type = genomic DNA

SEQ ID NO: 114659 - DNA, 217 bp, Homo sapiens; identical to SEQ ID NO: 82019
  misc_feature 1..217: note = chr18:61603484-61603701
  misc_feature 1..217: note = Hyper
  source 1..217: mol_type = genomic DNA

SEQ ID NO: 114660 - DNA, 84 bp, Homo sapiens; identical to SEQ ID NO: 82020
  misc_feature 1..84: note = chr18:61603901-61603985
  misc_feature 1..84: note = Hyper
  source 1..84: mol_type = genomic DNA

SEQ ID NO: 114661 - DNA, 31 bp, Homo sapiens; identical to SEQ ID NO: 45390
  misc_feature 1..31: note = chr18:62165289-62165320
  misc_feature 1..31: note = Hypo
  source 1..31: mol_type = genomic DNA

SEQ ID NO: 114662 - DNA, 19 bp, Homo sapiens
  misc_feature 1..19: note = chr18:63276828-63276847
  misc_feature 1..19: note = Hypo
  source 1..19: mol_type = genomic DNA
actccgtctcaaaaaaaaa

SEQ ID NO: 114663 - DNA, 160 bp, Homo sapiens; identical to SEQ ID NO: 82023
  misc_feature 1..160: note = chr18:63417736-63417896
  misc_feature 1..160: note = Hyper
  source 1..160: mol_type = genomic DNA

SEQ ID NO: 114664 - DNA, 65 bp, Homo sapiens
  misc_feature 1..65: note = chr18:63418222-63418287
  misc_feature 1..65: note = Hyper
  source 1..65: mol_type = genomic DNA
gagcgggtgtcgagccggttcctccagtctgccccgcgcgcggagctgcgcgcactgggtcccca

SEQ ID NO: 114665 - DNA, 30 bp, Homo sapiens; identical to SEQ ID NO: 82024
  misc_feature 1..30: note = chr18:63418956-63418986
  misc_feature 1..30: note = Hyper
  source 1..30: mol_type = genomic DNA

SEQ ID NO: 114666 - DNA, 40 bp, Homo sapiens; identical to SEQ ID NO: 82026
  misc_feature 1..40: note = chr18:65085708-65085748
  misc_feature 1..40: note = Hypo
  source 1..40: mol_type = genomic DNA

SEQ ID NO: 114667 - DNA, 1848 bp, Homo sapiens
  misc_feature 1..1848: note = chr18:67067444-67069292
  misc_feature 1..1848: note = Hyper
  source 1..1848: mol_type = genomic DNA
cattgataacaaccacgttctccattttcccagaagagccaggagccactttcagtcctagttaacgaaaacgcatgcataaatcaaccactcgggtcggtcggtcttctccactccttcagcagaggacgtcggcgcccggctgcctcgcccgcctgcctgtctctaggctgcgggaggattagacacatgcgcacgattggtctctttgtgtgcaccaggaagggtctggcgtcgatttacacttcctaacggggcagagacctggaacggccgcgagtgcttgggaataaaaatgtactgtaaacaaggccaatgaaataagtgtctcgctcccgctggccttccgcgttggaagtgtccccactgccctttccccgctgcacagcttgcgagtggagatttagagcccgggaatgaggcgccgtgtccttaggaatctcgcgcccggggagcgctgagggaccggggagccgggtggggagcgggcctcggggcgcccggcggcggaggcgctcccacccgcgcggagagggatggagcgcgtcttgcgagcgtctccgagcccagccaccccacgggccagggggagggagcggggccggcgcatcagcccgccccccccggcccgccccctccccccgcgccggggagccgcggtggtgcgctccggccagctgtgcgccgccgagcgaggcgccagcccgtgggtgctgccgggggcggcggcgcggtgggggctcccgcagctggcggaggcgcgggccgcggcgctgggctcgcggcggggagcgaaggtgagcgccagaacgcggagggctggcgcggctcgcggcgccgggccccgttccccgtccgcggcggccctgcaggcgaccccgcgtccccaccggcgggagctcggggaagagcgggcggcggcgctgctgctggcggcggccggctggatgcgagacccgcgcagacccggcggcggacggcggctctcgactccggagagcggatcgcggggcgcaggagcccgatcgcgctggccatggcctccaactttaacgacatagtcaagcagggctacgtgaaaatccgcagcaggaagcttggggtgagtggctcgctcggcttgctccttccccggcgctcgttcggcccggctggctgcctggggggggggcagggagaggtgacccgtgcgggtacagggcagagagggacccggcccttaggcggatggcccgcttgttgcttggccaggtgggggcccacacctgccggggggctccgcagacggacctggggactccaggagcgcctgagtccccatcctcgagtgcaccgggctgtcttcgaccgtgcggggaagtcagtagacgaaaggggttgtcagttccaacgaggaacgtgccttggaggaggtttctttgcggtgctatccacgatggtctgttctcaaaagtgtgcgcctttcgggtggaactgctgtgtgtggcgacgctcgcgtgtgtttagaatcaccattttctggtctccgcttcccaagctcaattcgaaattcccgtctgatgccctcccagcgccgcgcgtccctgccggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctggcttgggagggaaaccgtgtagaacccaagggttcaaaactattctagtgaccagacgaggcggtaggagggactc

SEQ ID NO: 114668 - DNA, 48 bp, Homo sapiens; identical to SEQ ID NO: 82031
  misc_feature 1..48: note = chr18:67163583-67163631
  misc_feature 1..48: note = Hypo
  source 1..48: mol_type = genomic DNA

SEQ ID NO: 114669 - DNA, 30 bp, Homo sapiens; identical to SEQ ID NO: 82032
  misc_feature 1..30: note = chr18:67266861-67266891
  misc_feature 1..30: note = Hypo
  source 1..30: mol_type = genomic DNA

SEQ ID NO: 114670 - DNA, 172 bp, Homo sapiens; identical to SEQ ID NO: 82035
  misc_feature 1..172: note = chr18:67592818-67592990
  misc_feature 1..172: note = Hypo
  source 1..172: mol_type = genomic DNA

SEQ ID NO: 114671 - DNA, 93 bp, Homo sapiens; identical to SEQ ID NO: 82036
  misc_feature 1..93: note = chr18:67918076-67918169
  misc_feature 1..93: note = Hypo
  source 1..93: mol_type = genomic DNA

SEQ ID NO: 114672 - DNA, 35 bp, Homo sapiens; identical to SEQ ID NO: 45391
  misc_feature 1..35: note = chr18:68051409-68051444
  misc_feature 1..35: note = Hypo
  source 1..35: mol_type = genomic DNA

SEQ ID NO: 114673 - DNA, 34 bp, Homo sapiens; identical to SEQ ID NO: 82038
  misc_feature 1..34: note = chr18:68180996-68181030
  misc_feature 1..34: note = Hypo
  source 1..34: mol_type = genomic DNA

SEQ ID NO: 114674 - DNA, 44 bp, Homo sapiens; identical to SEQ ID NO: 82039
  misc_feature 1..44: note = chr18:68206456-68206500
  misc_feature 1..44: note = Hypo
  source 1..44: mol_type = genomic DNA

SEQ ID NO: 114675 - DNA, 24 bp, Homo sapiens
  misc_feature 1..24: note = chr18:68699229-68699253
  misc_feature 1..24: note = Hypo
  source 1..24: mol_type = genomic DNA
ctcccagtgcggggcccgccaacc

SEQ ID NO: 114676 - DNA, 842 bp, Homo sapiens
  misc_feature 1..842: note = chr18:70209091-70209933
  misc_feature 1..842: note = Hyper
  source 1..842: mol_type = genomic DNA
tggtgctccgcgtggcggagaaggccaccttggcgctgccggagcgcacggagatgcctagggaggaggtgacggcgccgtccgccgacgggctggagtcgcacaccaccaggcacttgccctccagcacgatgggctccgtgtcgttctgcgcccgcacggggcagcaggcgggcagtagcagcaacagcagggccagcgccacccccaggcaggatccgcagccgcccggctcgcgcagcgccccccggcgcccgggcatcatcagccgcagcccgagtggcccccggccgggcgcctgcatcgggactggtgggaggcggcgcgcgggggtggaggccggcgccggcgcgagcggcgcggaagggcgcgaaggaacgcgcggagctcgcagcagcctccgggggccttcgtccccggctctgacgttcaaggccagggtcgttctcagaagaaaggcgcctgtgaacctgtcagggcacagaacccaaagccttacaccgggaggtggagccaccgggaagaagggggactgggagcaggtgcctgcggctcgggggttctccccgaaggccacccccttggtcccgcgcacagccaacccgctttccgatctggcacaacaggtccggagaaacgcccgggcgcagctggcagcgcatccctgaaggctcccgagcagcgcgcggggctgcgacgagggagggggccgcgcttctgcaggtcctcgtcgctaagacgggccccgagaccctcagaaggcgtcaccgccaccccgcccattcaccagcgcggagggggctaagacgcaggcaaagaaaaacctacgaatgcttgccttc

SEQ ID NO: 114677 - DNA, 1164 bp, Homo sapiens
  misc_feature 1..1164: note = chr18:70210560-70211724
  misc_feature 1..1164: note = Hyper
  source 1..1164: mol_type = genomic DNA
ctcttgataaatatccgctgtccgcagccccgatcctacatgatttcccttctctctctccacctcctccacccctcgatctggaccagggagagtcttcgttaaaatccacgcagaaggcgcttgcatgcggaggggagggcaggtcgggggtggttacctggaacatccatgctgggcgagctccgctgtccgcgaagttgctctgcttagagaaaatgaggcgagtgggagctgtcgggaggaggacacggagcgcgaccctgctcccagcgcgtggccaataaccgcgccgccccgccctgccgctttcccgcgccagcctgcgccgcttcaggggtgcaccacgccccgcgcgcccgcttaggcgccgcgcccgggaccgggaaccccgcgtctcgcccggctcagcgccccgcgctgtgcgcccaggtgcctccaacccctgggcttcgcgcccgcaccgctgcctggggcccctcgagctcccgcgctcagcgcgtccgcagcgcggctccctcgcgggtcccctcggccccgcagccccgccagtctccagagggcatagccgagcgctgccgcctccctaggactcggaaccttccctgctcccaagcccgccgcaccctccaacgccccggtcctgctcacccaaacgcccagagcaaaatactcccagacgtctcttttgaaaattagacacccttaaaagcaccggtcgcttctcttcttttagattctttcttttctttccccaattccctccaagtcttaatattgaatggcgtgaccactttcataatgacaggagcgaaaaaaacaataagttaaaaaaaaaaaaaagaagaagaagactgggatggctgggacgaagagagggaaaaaaaaagcttgagaatttgatgatttaggagctgtggttccagagtcccagttggggaactgtccggttcccgcagggctagaagaggggcctccggcccgggtctgtgtgtctgctcctctggacctcggactggtggagcggctggcgcttgcgcttatttattaaattgcggtgtccgcgctcgctcaaaggacccggggagacgcgctgggtttcccagctgcgcctggagctcggctgagggcgcaaacacggacgtggggcgccacctgcgggtg

SEQ ID NO: 114678 - DNA, 627 bp, Homo sapiens
  misc_feature 1..627: note = chr18:70533982-70534609
  misc_feature 1..627: note = Hyper
  source 1..627: mol_type = genomic DNA
ataaagcgacatcagcggtctccagggcggaaaggggtggaagctgaccctcgcccttccctccagcgctggcttcaggtgtgccttctgctacctcctgtactgcgaacaggggcccgccgagctccgggagcccctagaagaggaagactcctctggccccactaggtatcatccgcgctctcccgctttccacctgcgccctcgcttgggccaatctctgccgcacgtgtccatccctgaactgcacgctatcctccacccccggggggttcctgcgcactgaaagaccgttctccggcaggttttgggatccggcgacggctgaccgcgcgccgcccccacgcccggttccacgatgctgcaatacagaaagtttacgtcggccccgacccgcgcgggactgcagggtccgccggagcgcggcgcagaggcttttcctgcgcgttcggccccgggaaaggggcgggagggctggctccgggagcgcacgggcgcggcggggagggtactcactgtgaagcacgctgcgcccatggatcatgtctgtgcgttacaccagaggctccgggctccactaattccatttagagacgggaagacttccagtggcggggggaggacagg

SEQ ID NO: 114679 - DNA, 2175 bp, Homo sapiens
  misc_feature 1..2175: note = chr18:70534850-70537025
  misc_feature 1..2175: note = Hyper
  source 1..2175: mol_type = genomic DNA
cctcctcccgggcatcgtcgccgccgcggggtcgggaggacgcggcgcgcgggaggcggcggtcgcagggcgagccccgggacgccccgagccggggccggggccggggagagggcgcagcgaggtgggggccagtccagaccgacggcagcgacggagcgggcggcggcggcggcgccggcggcggcggggtggctcagtccccagtctcagacgcgccgcgcagcaggtcggagcagcctccccgggaggatgtccagcggcagcgctcctcgctccagcccttggggatcttccgctgaggcattgaaggcaggaagaaggggtccgtcatcggctcgccgggctgcgcgccacctctgctatcttgcggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatccgcggctcggcccgccagggcgcagagagaggatgcagccgcaaatcccgagccggatcctcgtgccggacggaaggcgtggaagcgggaggggccttcgtgtgaaaatcccttgtggggtttggtgtttcactttttaaaggttagaccttgcgggctctctgcctcccaccccttcttttccatccgcgtaaaggaactgggcgccccctctccctccctccctggggcgcaggtttcgccgcggactccgcgctcagcttgggagacacggcaggggcgcgccccagggaaaggcggccgtaaaagtttcgcggttgagcactgggcctgatgtccagtccccccaccaaattactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaagagcccgggcttgtaaaatgcgaatcaatgaatacgaaataagggcaaccgcgaggcagcgccgggaagggctggagcgcgcgggggtgcagggagtccctccctgggcgccgcaacggcacctcctccctttcccggctccgtcccgccctccctcggcctctgcggacgcgacccacgcagaccacagccgagcccgccggaccccgggactacggaagccatcccgtccggccacccacacccgcgccgcggctggggcttgggttggggactgtggcggcgaagaagccggggtaggaagagctaatggcaatggcggggtcgccggggggcggggggtcagcagcagacgctgagctgtgaagactagggtggccccgaaaggccgaggaaaggagaaagggccatgagaagagtctggcgagcgctcgaggccggggggctgcctcccggctctggcccggcctccgcttcccggcacctgctgctggggcgcccacgtgcgcgcggggctgcgcggggcgttgggtgctcgtcgcagtcctgcccacgcctagcgcagcggctgtgagtgggtggaggtctcctgccagtaagttgggatgagggacgatgaggtgacccccaagtctggaagggattcagagtctcacacgcgcccccaagcctcctaccaccacaccaaagtgctggttcctcgatttccagggtggggtaaagtgaccgagcaaaggggatggtgtgtttgtgtgtgcgcgcgcatatacgcgcgcgcgtgttgtgcatccgtgtaatgaaagttgggtcatgggtcaacccgggagtagagcgagatggagacctaaagagagaaagctgagagaagggggaagacatggacagggtaagagagagagaaaggagagagagaagaaagggaaaagaggagcggggagagaaaaga

SEQ ID NO: 114680 - DNA, 33 bp, Homo sapiens; identical to SEQ ID NO: 13107
  misc_feature 1..33: note = chr18:70537332-70537365
  misc_feature 1..33: note = Hyper
  source 1..33: mol_type = genomic DNA

SEQ ID NO: 114681 - DNA, 27 bp, Homo sapiens
  misc_feature 1..27: note = chr18:70711868-70711895
  misc_feature 1..27: note = Hypo
  source 1..27: mol_type = genomic DNA
taaaacacatagtttcggccgggcgcg

SEQ ID NO: 114682 - DNA, 53 bp, Homo sapiens; identical to SEQ ID NO: 82061
  misc_feature 1..53: note = chr18:71840738-71840791
  misc_feature 1..53: note = Hypo
  source 1..53: mol_type = genomic DNA

SEQ ID NO: 114683 - DNA, 30 bp, Homo sapiens; identical to SEQ ID NO: 82062
  misc_feature 1..30: note = chr18:71844331-71844361
  misc_feature 1..30: note = Hypo
  source 1..30: mol_type = genomic DNA

SEQ ID NO: 114684 - DNA, 56 bp, Homo sapiens; identical to SEQ ID NO: 82063
  misc_feature 1..56: note = chr18:71983677-71983733
  misc_feature 1..56: note = Hypo
  source 1..56: mol_type = genomic DNA

SEQ ID NO: 114685 - DNA, 168 bp, Homo sapiens; identical to SEQ ID NO: 82064
  misc_feature 1..168: note = chr18:71989323-71989491
  misc_feature 1..168: note = Hypo
  source 1..168: mol_type = genomic DNA

SEQ ID NO: 114686 - DNA, 845 bp, Homo sapiens
  misc_feature 1..845: note = chr18:72123440-72124285
  misc_feature 1..845: note = Hyper
  source 1..845: mol_type = genomic DNA
ctgaagtctcctttgcgcctgaaagaacggctagccaagtttccaatcaactaaaggtgggcgtttcattcatatgatgtgagcccagcgtacgcagcagtctgcaaaatgcgaaatgtttctttctctccctaattctctggctcagctgaggagctgctgggtgcgagctttcgggccctcccaggttaggaggcgcctgtcgaggaccgggacccgggatcctcccggtcccagccgcctccgcagcgctctctgctcgcccgagcgcacactgcgtcggttcccacagaccgcgaccgcggagagcctgggctctggagcgcaggggggccggggtcagaccagccctccgcatgggctcggtgagatagggggtgacctggcagctcagggtggaatcacagaacgcgggctgggctggagcgctgcggacccgagagacagaggcgtggcaccccggatcccgaaccccgcactggcttgcgccccgagcccggcggcctgacaccggacgcggcacctccctggacactcggatcagacccgcaaactttcttccggagctcgggctcaggggtggcgagggtaggacggagaggctgtctggggacaaagggcgaattctggcgaaaaggggagagacacccccagcgcgcccacagagcactgccggctgcgtccccattcgggggaccggggcgtgcgcctctggcactccacgcaggtgtcgggaacccatgtccccggcgggtgccaccgccacccaagtccccgggaaggctggggaccgggagcgggtgtgatcccccctccccggacgcgcggcgcggggcagagcggcg

SEQ ID NO: 114687 - DNA, 93 bp, Homo sapiens; identical to SEQ ID NO: 82067
  misc_feature 1..93: note = chr18:72220044-72220137
  misc_feature 1..93: note = Hypo
  source 1..93: mol_type = genomic DNA

SEQ ID NO: 114688 - DNA, 23 bp, Homo sapiens
  misc_feature 1..23: note = chr18:72263664-72263687
  misc_feature 1..23: note = Hypo
  source 1..23: mol_type = genomic DNA
atgatttttttgagacggaatct

SEQ ID NO: 114689 - DNA, 23 bp, Homo sapiens
  misc_feature 1..23: note = chr18:72263927-72263950
  misc_feature 1..23: note = Hypo
  source 1..23: mol_type = genomic DNA
agccaccccgcctggccagtgat

SEQ ID NO: 114690 - DNA, 42 bp, Homo sapiens; identical to SEQ ID NO: 82070
  misc_feature 1..42: note = chr18:72335160-72335202
  misc_feature 1..42: note = Hypo
  source 1..42: mol_type = genomic DNA

SEQ ID NO: 114691 - DNA, 77 bp, Homo sapiens; identical to SEQ ID NO: 82071
  misc_feature 1..77: note = chr18:72347499-72347576
  misc_feature 1..77: note = Hypo
  source 1..77: mol_type = genomic DNA

SEQ ID NO: 114692 - DNA, 30 bp, Homo sapiens; identical to SEQ ID NO: 82072
  misc_feature 1..30: note = chr18:72592835-72592865
  misc_feature 1..30: note = Hypo
  source 1..30: mol_type = genomic DNA

SEQ ID NO: 114693 - DNA, 30 bp, Homo sapiens; identical to SEQ ID NO: 82073
  misc_feature 1..30: note = chr18:72647545-72647575
  misc_feature 1..30: note = Hypo
  source 1..30: mol_type = genomic DNA

SEQ ID NO: 114694 - DNA, 30 bp, Homo sapiens; identical to SEQ ID NO: 82074
  misc_feature 1..30: note = chr18:72827696-72827726
  misc_feature 1..30: note = Hypo
  source 1..30: mol_type = genomic DNA

SEQ ID NO: 114695 - DNA, 45 bp, Homo sapiens; identical to SEQ ID NO: 82075
  misc_feature 1..45: note = chr18:72844763-72844808
  misc_feature 1..45: note = Hypo
  source 1..45: mol_type = genomic DNA

SEQ ID NO: 114696 - DNA, 45 bp, Homo sapiens; identical to SEQ ID NO: 45396
  misc_feature 1..45: note = chr18:72896219-72896264
  misc_feature 1..45: note = Hypo
  source 1..45: mol_type = genomic DNA

SEQ ID NO: 114697 - DNA, 609 bp, Homo sapiens
  misc_feature 1..609: note = chr18:73167406-73168015
  misc_feature 1..609: note = Hyper
  source 1..609: mol_type = genomic DNA
gcgactgttgaaagtcggacagcacccgccttgtgctcaccccgccgggatacacggggacggttcctttccaaggaggcccggggccgcctctgcgccgggacagcctgggaagccgcgcaggcctggccgacttccccttcccagccccgctgcgccctgcggggccctgtcggcggtgggggctgcggacccgggagcgcgcggccgcgctgcacgtgcagggaccggtaggcgccggggtcagcgccagcgtttgatgtgcggcggggagcgggccgagccccgggaggccgcttcgcacctcccagtgtgtccgggttgagcgcgaggtcaggaggggacgcagagttcacggcgaagacggatcgcgggggctcgtcccgcccgggttgcgcgcagcgggggccgcgtgatggatgggccgggccgggcacccgggaacccgcgagcgcggggctgggctctgggctgcgtccgggggccccgacttggttattgatcggcccaagcgcaggagaactgactctataatgcatcgcctgaccaggaaaagtgtttgcttttgtgggagcaaaagacaactttctgccccgccagagcgttgct

SEQ ID NO: 114698 - DNA, 174 bp, Homo sapiens; identical to SEQ ID NO: 82078
  misc_feature 1..174: note = chr18:73438900-73439074
  misc_feature 1..174: note = Hypo
  source 1..174: mol_type = genomic DNA

SEQ ID NO: 114699 - DNA, 32 bp, Homo sapiens; identical to SEQ ID NO: 37074
  misc_feature 1..32: note = chr18:73628017-73628049
  misc_feature 1..32: note = Hyper
  source 1..32: mol_type = genomic DNA

SEQ ID NO: 114700 - DNA, 370 bp, Homo sapiens
  misc_feature 1..370: note = chr18:73628259-73628629
  misc_feature 1..370: note = Hyper
  source 1..370: mol_type = genomic DNA
gcccgcagcgcggcgcggcgtggggggctaagtcactgcgaaccctcgcccggagctggggttcggggtcccactccatttcggcaggagcggggcgcgagggtggcgcgggtagtggcgaccgggactgccaggggctccggcaaaggaggccgcgggttgggaggggctcccgacgtggcgcgcacgttaccatggcgacgcgtttccctggttacctgcggggccgcgtcccggaggagcctgagggccaagagggccggcgcgcggtgggcgcggcctgcggggatgccgggctctacggagcagcgcggggtcccgaagccccctaccgcgaggcctcagaaggggatggcgacctcttgcagcg

SEQ ID NO: 114701 - DNA, 39 bp, Homo sapiens; identical to SEQ ID NO: 82081
  misc_feature 1..39: note = chr18:73769111-73769150
  misc_feature 1..39: note = Hypo
  source 1..39: mol_type = genomic DNA

SEQ ID NO: 114702 - DNA, 30 bp, Homo sapiens; identical to SEQ ID NO: 82082
  misc_feature 1..30: note = chr18:73843051-73843081
  misc_feature 1..30: note = Hypo
  source 1..30: mol_type = genomic DNA

SEQ ID NO: 114703 - DNA, 30 bp, Homo sapiens; identical to SEQ ID NO: 82083
  misc_feature 1..30: note = chr18:73885138-73885168
  misc_feature 1..30: note = Hypo
  source 1..30: mol_type = genomic DNA

SEQ ID NO: 114704 - DNA, 30 bp, Homo sapiens; identical to SEQ ID NO: 82084
  misc_feature 1..30: note = chr18:74023665-74023695
  misc_feature 1..30: note = Hypo
  source 1..30: mol_type = genomic DNA

SEQ ID NO: 114705 - DNA, 135 bp, Homo sapiens; identical to SEQ ID NO: 82085
  misc_feature 1..135: note = chr18:74062180-74062315
  misc_feature 1..135: note = Hypo
  source 1..135: mol_type = genomic DNA

SEQ ID NO: 114706 - DNA, 39 bp, Homo sapiens; identical to SEQ ID NO: 82086
  misc_feature 1..39: note = chr18:74062539-74062578
  misc_feature 1..39: note = Hypo
  source 1..39: mol_type = genomic DNA

SEQ ID NO: 114707 - DNA, 30 bp, Homo sapiens; identical to SEQ ID NO: 82087
  misc_feature 1..30: note = chr18:74063052-74063082
  misc_feature 1..30: note = Hypo
  source 1..30: mol_type = genomic DNA

SEQ ID NO: 114708 - DNA, 88 bp, Homo sapiens; identical to SEQ ID NO: 45398
  misc_feature 1..88: note = chr18:74107215-74107303
  misc_feature 1..88: note = Hypo
  source 1..88: mol_type = genomic DNA

SEQ ID NO: 114709 - DNA, 30 bp, Homo sapiens; identical to SEQ ID NO: 82089
  misc_feature 1..30: note = chr18:74113912-74113942
  misc_feature 1..30: note = Hypo
  source 1..30: mol_type = genomic DNA

SEQ ID NO: 114710 - DNA, 210 bp, Homo sapiens; identical to SEQ ID NO: 82090
  misc_feature 1..210: note = chr18:74114002-74114212
  misc_feature 1..210: note = Hypo
  source 1..210: mol_type = genomic DNA

SEQ ID NO: 114711 - DNA, 30 bp, Homo sapiens; identical to SEQ ID NO: 82091
  misc_feature 1..30: note = chr18:74195561-74195591
  misc_feature 1..30: note = Hypo
  source 1..30: mol_type = genomic DNA

SEQ ID NO: 114712 - DNA, 30 bp, Homo sapiens; identical to SEQ ID NO: 82092
  misc_feature 1..30: note = chr18:74196348-74196378
  misc_feature 1..30: note = Hypo
  source 1..30: mol_type = genomic DNA

SEQ ID NO: 114713 - DNA, 77 bp, Homo sapiens; identical to SEQ ID NO: 82093
  misc_feature 1..77: note = chr18:74206606-74206683
  misc_feature 1..77: note = Hyper
  source 1..77: mol_type = genomic DNA

SEQ ID NO: 114714 - DNA, 285 bp, Homo sapiens; identical to SEQ ID NO: 82094
  misc_feature 1..285: note = chr18:74207730-74208015
  misc_feature 1..285: note = Hyper
  source 1..285: mol_type = genomic DNA

SEQ ID NO: 114715 - DNA, 107 bp, Homo sapiens; identical to SEQ ID NO: 82095
  misc_feature 1..107: note = chr18:74208293-74208400
  misc_feature 1..107: note = Hyper
  source 1..107: mol_type = genomic DNA

SEQ ID NO: 114716 - DNA, 30 bp, Homo sapiens; identical to SEQ ID NO: 82096
  misc_feature 1..30: note = chr18:74313492-74313522
  misc_feature 1..30: note = Hypo
  source 1..30: mol_type = genomic DNA

SEQ ID NO: 114717 - DNA, 190 bp, Homo sapiens; identical to SEQ ID NO: 82097
  misc_feature 1..190: note = chr18:74325748-74325938
  misc_feature 1..190: note = Hypo
  source 1..190: mol_type = genomic DNA

SEQ ID NO: 114718 - DNA, 46 bp, Homo sapiens; identical to SEQ ID NO: 82098
  misc_feature 1..46: note = chr18:74396499-74396545
  misc_feature 1..46: note = Hypo
  source 1..46: mol_type = genomic DNA

SEQ ID NO: 114719 - DNA, 30 bp, Homo sapiens; identical to SEQ ID NO: 82099
  misc_feature 1..30: note = chr18:74399925-74399955
  misc_feature 1..30: note = Hypo
  source 1..30: mol_type = genomic DNA

SEQ ID NO: 114720 - DNA, 30 bp, Homo sapiens; identical to SEQ ID NO: 82100
  misc_feature 1..30: note = chr18:74405452-74405482
  misc_feature 1..30: note = Hypo
  source 1..30: mol_type = genomic DNA

SEQ ID NO: 114721 - DNA, 166 bp, Homo sapiens; identical to SEQ ID NO: 82102
  misc_feature 1..166: note = chr18:74495900-74496066
  misc_feature 1..166: note = Hypo
  source 1..166: mol_type = genomic DNA

SEQ ID NO: 114722 - DNA, 30 bp, Homo sapiens; identical to SEQ ID NO: 45402
  misc_feature 1..30: note = chr18:74497491-74497521
  misc_feature 1..30: note = Hypo
  source 1..30: mol_type = genomic DNA

SEQ ID NO: 114723 - DNA, 222 bp, Homo sapiens; identical to SEQ ID NO: 82104
  misc_feature 1..222: note = chr18:74501045-74501267
  misc_feature 1..222: note = Hypo
  source 1..222: mol_type = genomic DNA

SEQ ID NO: 114724 - DNA, 654 bp, Homo sapiens; identical to SEQ ID NO: 82105
  misc_feature 1..654: note = chr18:74503878-74504532
  misc_feature 1..654: note = Hypo
  source 1..654: mol_type = genomic DNA

SEQ ID NO: 114725 - DNA, 35 bp, Homo sapiens; identical to SEQ ID NO: 82106
  misc_feature 1..35: note = chr18:74553356-74553391
  misc_feature 1..35: note = Hypo
  source 1..35: mol_type = genomic DNA

SEQ ID NO: 114726 - DNA, 30 bp, Homo sapiens; identical to SEQ ID NO: 82107
  misc_feature 1..30: note = chr18:74606649-74606679
  misc_feature 1..30: note = Hypo
  source 1..30: mol_type = genomic DNA

SEQ ID NO: 114727 - DNA, 30 bp, Homo sapiens; identical to SEQ ID NO: 45405
  misc_feature 1..30: note = chr18:74695927-74695957
  misc_feature 1..30: note = Hypo
  source 1..30: mol_type = genomic DNA

SEQ ID NO: 114728 - DNA, 38 bp, Homo sapiens; identical to SEQ ID NO: 82109
  misc_feature 1..38: note = chr18:74710319-74710357
  misc_feature 1..38: note = Hypo
  source 1..38: mol_type = genomic DNA

SEQ ID NO: 114729 - DNA, 30 bp, Homo sapiens; identical to SEQ ID NO: 82110
  misc_feature 1..30: note = chr18:74721760-74721790
  misc_feature 1..30: note = Hypo
  source 1..30: mol_type = genomic DNA

SEQ ID NO: 114730 - DNA, 30 bp, Homo sapiens; identical to SEQ ID NO: 45406
  misc_feature 1..30: note = chr18:74755472-74755502
  misc_feature 1..30: note = Hypo
  source 1..30: mol_type = genomic DNA

SEQ ID NO: 114731 - DNA, 30 bp, Homo sapiens; identical to SEQ ID NO: 82112
  misc_feature 1..30: note = chr18:74756555-74756585
  misc_feature 1..30: note = Hypo
  source 1..30: mol_type = genomic DNA

SEQ ID NO: 114732 - DNA, 30 bp, Homo sapiens; identical to SEQ ID NO: 82113
  misc_feature 1..30: note = chr18:74857784-74857814
  misc_feature 1..30: note = Hypo
  source 1..30: mol_type = genomic DNA

SEQ ID NO: 114733 - DNA, 30 bp, Homo sapiens; identical to SEQ ID NO: 82114
  misc_feature 1..30: note = chr18:74867247-74867277
  misc_feature 1..30: note = Hypo
  source 1..30: mol_type = genomic DNA

SEQ ID NO: 114734 - DNA, 120 bp, Homo sapiens; identical to SEQ ID NO: 82115
  misc_feature 1..120: note = chr18:74870956-74871076
  misc_feature 1..120: note = Hypo
  source 1..120: mol_type = genomic DNA

SEQ ID NO: 114735 - DNA, 43 bp, Homo sapiens; identical to SEQ ID NO: 82116
  misc_feature 1..43: note = chr18:74877173-74877216
  misc_feature 1..43: note = Hypo
  source 1..43: mol_type = genomic DNA

SEQ ID NO: 114736 - DNA, 84 bp, Homo sapiens; identical to SEQ ID NO: 82117
  misc_feature 1..84: note = chr18:74884614-74884698
  misc_feature 1..84: note = Hypo
  source 1..84: mol_type = genomic DNA

SEQ ID NO: 114737 - DNA, 17 bp, Homo sapiens
  misc_feature 1..17: note = chr18:74895202-74895219
  misc_feature 1..17: note = Hypo
  source 1..17: mol_type = genomic DNA
atcgagttctacacttc

SEQ ID NO: 114738 - DNA, 34 bp, Homo sapiens; identical to SEQ ID NO: 82119
  misc_feature 1..34: note = chr18:74906008-74906042
  misc_feature 1..34: note = Hypo
  source 1..34: mol_type = genomic DNA

SEQ ID NO: 114739 - DNA, 2598 bp, Homo sapiens
  misc_feature 1..2598: note = chr18:74961344-74963942
  misc_feature 1..2598: note = Hyper
  source 1..2598: mol_type = genomic DNA
ctatagagaagctcacgcggccctttccctttgcacttctctcctctgtagcaggccgcggggtgagggtgggattaggcggccaattttacaaaactccagggagcgtcgccagcctcgatttcctggggttattcctgggagagaggcgttctcacggacagccaccctggggaggaggaggaggaaaggcactaatggatgaggaggcccgcgcacccctccgcctcccaccccggcgcgccctggaacgccctggagcgcgcccggcttccctcgcccgcctggcccgcggcatccggcagccccgccttcagcccgccgggcaggtccgcactccgcagaggcgagcgcgctccggttccagccgggaggtgggcggcgacccatcccgctagaatccgtccagtctctgctcgcgcaccgtgacttctaaggggcgcggatttcagccgagctgttttcgcctctcagttgcagcagagaagcccctggcacccgactctatccaccaccaggaagcctcccaaaagagctctcgccctgtggacgactcggaatccctggaaaagccgggagggagtcggaggcgccagcccactggggaggtggcgctgggcgcgcgggatgcgcggggagccttctctgcaggagccgcacagtgcactgctgcgcgctgggcagtgcggggaagcgccgcgggaaggagcggctccgagcaacaggtgcagcacgcagcccctccgggagccagggaaaaccgccggcgaagatctggagcggtaaggcggagagaagggtctttccacctgcgcggctgcagccggcggatccctcttcccaggctccgtggtcgcgcagcgggcggaggcgcccgggaaggggaccccagtgctctcgagatcaccgtcccttcccgagaaggtccagctccgggctcccgaacccaccctctctcagaaggtcccggcgcaaagacggtgccaccaggcacggccaccggatccccgctcccgctggctcgcgcctcgggggaagctcagactcctaaactcgcactctccgtgctttgcgccgggacccctggccacccccggcgcctactatcccgccctccctccccgcgcgccccgccgctcgccgggacagccccgcgggccatggagctggcggtcgggaacctcagcgagggcaacgcgagctggccggagccccccgccccggagcccgggccgctgttcggcatcggcgtggagaacttcgtcacgctggtggtgttcggcctgatcttcgcgctgggtgtgctgggcaacagcctagtgatcaccgtgctggcgcgcagcaagccgggcaagccgcggagcaccaccaacctgttcatcctcaacctgagcatcgccgacctggcctacctgctcttctgcatccccttccaggccaccgtgtacgcgctgcccacctgggtgctgggcgccttcatctgcaagttcatccactacttcttcaccgtgtccatgctggtgagcatcttcaccctggccgcgatgtccgtggaccgctacgtggccatcgtgcactcgcggcgctcctcctccctcagggtgtcccgcaacgcgctgctgggcgtgggctgcatctgggcgctgtccattgccatggcctcgcccgtggcctaccaccagggcctcttccacccgcgcgccagcaaccagaccttctgctgggagcagtggcccgaccctcgccacaagaaggcctacgtggtgtgcaccttcgtcttcggctacctgctgccgctcctgctcatctgcttctgctatgccaaggtgcacgccggtcgcggggccgagacgcgcgagggagggcggagggccggtgggggccctggggtctcagtgtcccgcggccctgccggagccttggcggcagcctggccccggtggtccccactctggcggcgctggtacggatctgtgcagagaggcttcctggccgctgctggagcgtgccattggcttgcgcaagaaagttacttggagtctgagagatgctggggaaagtttgcagttcacttcgcatggtccagtagaaccagtttctcctcccctccccttcctcggccctgcggcccttcaacgcccccaggttgcctgggcggtaggtaggcgggcgctgccgcatccttcccggtacagcaaaccccgctcggttccagcaactcttcaaccagatcagctgcgcggggaggttaccgccgcggcgctgtgggacctgaggagagctctggtggtcaccagagcgcggaccttttgcgagggtgacgggtccccacagctccctcccgggctctcagctggccgtggcgggggggactcgcggggcggcccctctcccccggggtgcgcagtttgccctcgctccgaaggctttgcgcacaccgggctctgtgaagccgctgctcccggggacagagcctcgaattttattttattctgaagcttagctttgtaaacccaagtgcaaaagggtgtttctttacagagtcttgaccgcaggctccaggaacttggaatggaatggactcgagctttcggcttc

SEQ ID NO: 114740 - DNA, 168 bp, Homo sapiens; identical to SEQ ID NO: 82126
  misc_feature 1..168: note = chr18:75088086-75088254
  misc_feature 1..168: note = Hypo
  source 1..168: mol_type = genomic DNA

SEQ ID NO: 114741 - DNA, 253 bp, Homo sapiens; identical to SEQ ID NO: 82127
  misc_feature 1..253: note = chr18:75229713-75229966
  misc_feature 1..253: note = Hypo
  source 1..253: mol_type = genomic DNA

SEQ ID NO: 114742 - DNA, 810 bp, Homo sapiens; identical to SEQ ID NO: 82128
  misc_feature 1..810: note = chr18:75230170-75230980
  misc_feature 1..810: note = Hypo
  source 1..810: mol_type = genomic DNA

SEQ ID NO: 114743 - DNA, 168 bp, Homo sapiens; identical to SEQ ID NO: 82129
  misc_feature 1..168: note = chr18:75339191-75339359
  misc_feature 1..168: note = Hypo
  source 1..168: mol_type = genomic DNA

SEQ ID NO: 114744 - DNA, 312 bp, Homo sapiens; identical to SEQ ID NO: 82130
  misc_feature 1..312: note = chr18:75362784-75363096
  misc_feature 1..312: note = Hyper
  source 1..312: mol_type = genomic DNA

SEQ ID NO: 114745 - DNA, 30 bp, Homo sapiens; identical to SEQ ID NO: 82131
  misc_feature 1..30: note = chr18:75363596-75363626
  misc_feature 1..30: note = Hypo
  source 1..30: mol_type = genomic DNA

SEQ ID NO: 114746 - DNA, 42 bp, Homo sapiens; identical to SEQ ID NO: 82132
  misc_feature 1..42: note = chr18:75369603-75369645
  misc_feature 1..42: note = Hypo
  source 1..42: mol_type = genomic DNA

SEQ ID NO: 114747 - DNA, 115 bp, Homo sapiens; identical to SEQ ID NO: 82133
  misc_feature 1..115: note = chr18:75455894-75456009
  misc_feature 1..115: note = Hypo
  source 1..115: mol_type = genomic DNA

SEQ ID NO: 114748 - DNA, 30 bp, Homo sapiens; identical to SEQ ID NO: 82134
  misc_feature 1..30: note = chr18:75551271-75551301
  misc_feature 1..30: note = Hypo
  source 1..30: mol_type = genomic DNA

SEQ ID NO: 114749 - DNA, 684 bp, Homo sapiens; identical to SEQ ID NO: 82135
  misc_feature 1..684: note = chr18:75611969-75612653
  misc_feature 1..684: note = Hyper
  source 1..684: mol_type = genomic DNA

SEQ ID NO: 114750 - DNA, 46 bp, Homo sapiens; identical to SEQ ID NO: 45410
  misc_feature 1..46: note = chr18:75617810-75617856
  misc_feature 1..46: note = Hypo
  source 1..46: mol_type = genomic DNA

SEQ ID NO: 114751 - DNA, 30 bp, Homo sapiens; identical to SEQ ID NO: 45411
  misc_feature 1..30: note = chr18:75631688-75631718
  misc_feature 1..30: note = Hypo
  source 1..30: mol_type = genomic DNA

SEQ ID NO: 114752 - DNA, 111 bp, Homo sapiens; identical to SEQ ID NO: 82143
  misc_feature 1..111: note = chr18:75685755-75685866
  misc_feature 1..111: note = Hypo
  source 1..111: mol_type = genomic DNA

SEQ ID NO: 114753 - DNA, 48 bp, Homo sapiens; identical to SEQ ID NO: 82145
  misc_feature 1..48: note = chr18:75688179-75688227
  misc_feature 1..48: note = Hypo
  source 1..48: mol_type = genomic DNA

SEQ ID NO: 114754 - DNA, 30 bp, Homo sapiens; identical to SEQ ID NO: 82146
  misc_feature 1..30: note = chr18:75690504-75690534
  misc_feature 1..30: note = Hypo
  source 1..30: mol_type = genomic DNA

SEQ ID NO: 114755 - DNA, 30 bp, Homo sapiens; identical to SEQ ID NO: 82147
  misc_feature 1..30: note = chr18:75696322-75696352
  misc_feature 1..30: note = Hypo
  source 1..30: mol_type = genomic DNA

SEQ ID NO: 114756 - DNA, 37 bp, Homo sapiens; identical to SEQ ID NO: 82148
  misc_feature 1..37: note = chr18:75845486-75845523
  misc_feature 1..37: note = Hypo
  source 1..37: mol_type = genomic DNA

SEQ ID NO: 114757 - DNA, 163 bp, Homo sapiens; identical to SEQ ID NO: 82149
  misc_feature 1..163: note = chr18:75845747-75845910
  misc_feature 1..163: note = Hypo
  source 1..163: mol_type = genomic DNA

SEQ ID NO: 114758 - DNA, 52 bp, Homo sapiens; identical to SEQ ID NO: 82150
  misc_feature 1..52: note = chr18:75886360-75886412
  misc_feature 1..52: note = Hypo
  source 1..52: mol_type = genomic DNA

SEQ ID NO: 114759 - DNA, 30 bp, Homo sapiens; identical to SEQ ID NO: 82151
  misc_feature 1..30: note = chr18:75901015-75901045
  misc_feature 1..30: note = Hypo
  source 1..30: mol_type = genomic DNA

SEQ ID NO: 114760 - DNA, 812 bp, Homo sapiens; identical to SEQ ID NO: 82152
  misc_feature 1..812: note = chr18:75998622-75999434
  misc_feature 1..812: note = Hypo
  source 1..812: mol_type = genomic DNA

SEQ ID NO: 114761 - DNA, 321 bp, Homo sapiens; identical to SEQ ID NO: 82153
  misc_feature 1..321: note = chr18:76073199-76073520
  misc_feature 1..321: note = Hypo
  source 1..321: mol_type = genomic DNA

SEQ ID NO: 114762 - DNA, 200 bp, Homo sapiens; identical to SEQ ID NO: 82154
  misc_feature 1..200: note = chr18:76123694-76123894
  misc_feature 1..200: note = Hypo
  source 1..200: mol_type = genomic DNA

SEQ ID NO: 114763 - DNA, 30 bp, Homo sapiens; identical to SEQ ID NO: 82155
  misc_feature 1..30: note = chr18:76129420-76129450
  misc_feature 1..30: note = Hypo
  source 1..30: mol_type = genomic DNA

SEQ ID NO: 114764 - DNA, 183 bp, Homo sapiens; identical to SEQ ID NO: 82156
  misc_feature 1..183: note = chr18:76161397-76161580
  misc_feature 1..183: note = Hypo
  source 1..183: mol_type = genomic DNA

SEQ ID NO: 114765 - DNA, 79 bp, Homo sapiens; identical to SEQ ID NO: 82157
  misc_feature 1..79: note = chr18:76189793-76189872
  misc_feature 1..79: note = Hypo
  source 1..79: mol_type = genomic DNA

SEQ ID NO: 114766 - DNA, 63 bp, Homo sapiens; identical to SEQ ID NO: 82158
  misc_feature 1..63: note = chr18:76190665-76190728
  misc_feature 1..63: note = Hypo
  source 1..63: mol_type = genomic DNA

SEQ ID NO: 114767 - DNA, 30 bp, Homo sapiens; identical to SEQ ID NO: 82159
  misc_feature 1..30: note = chr18:76206022-76206052
  misc_feature 1..30: note = Hypo
  source 1..30: mol_type = genomic DNA

SEQ ID NO: 114768 - DNA, 150 bp, Homo sapiens; identical to SEQ ID NO: 82160
  misc_feature 1..150: note = chr18:76210870-76211020
  misc_feature 1..150: note = Hypo
  source 1..150: mol_type = genomic DNA

SEQ ID NO: 114769 - DNA, 277 bp, Homo sapiens; identical to SEQ ID NO: 82161
  misc_feature 1..277: note = chr18:76239446-76239723
  misc_feature 1..277: note = Hypo
  source 1..277: mol_type = genomic DNA

SEQ ID NO: 114770 - DNA, 159 bp, Homo sapiens; identical to SEQ ID NO: 82162
  misc_feature 1..159: note = chr18:76412599-76412758
  misc_feature 1..159: note = Hypo
  source 1..159: mol_type = genomic DNA

SEQ ID NO: 114771 - DNA, 98 bp, Homo sapiens; identical to SEQ ID NO: 82163
  misc_feature 1..98: note = chr18:76415368-76415466
  misc_feature 1..98: note = Hypo
  source 1..98: mol_type = genomic DNA

SEQ ID NO: 114772 - DNA, 32 bp, Homo sapiens; identical to SEQ ID NO: 82164
  misc_feature 1..32: note = chr18:76436423-76436455
  misc_feature 1..32: note = Hypo
  source 1..32: mol_type = genomic DNA

SEQ ID NO: 114773 - DNA, 30 bp, Homo sapiens; identical to SEQ ID NO: 82165
  misc_feature 1..30: note = chr18:76463445-76463475
  misc_feature 1..30: note = Hypo
  source 1..30: mol_type = genomic DNA

SEQ ID NO: 114774 - DNA, 158 bp, Homo sapiens; identical to SEQ ID NO: 45420
  misc_feature 1..158: note = chr18:76477472-76477630
  misc_feature 1..158: note = Hypo
  source 1..158: mol_type = genomic DNA

SEQ ID NO: 114775 - DNA, 74 bp, Homo sapiens; identical to SEQ ID NO: 45421
  misc_feature 1..74: note = chr18:76486799-76486873
  misc_feature 1..74: note = Hypo
  source 1..74: mol_type = genomic DNA

SEQ ID NO: 114776 - DNA, 215 bp, Homo sapiens; identical to SEQ ID NO: 45422
  misc_feature 1..215: note = chr18:76501459-76501674
  misc_feature 1..215: note = Hypo
  source 1..215: mol_type = genomic DNA

SEQ ID NO: 114777 - DNA, 30 bp, Homo sapiens; identical to SEQ ID NO: 82169
  misc_feature 1..30: note = chr18:76513376-76513406
  misc_feature 1..30: note = Hypo
  source 1..30: mol_type = genomic DNA

SEQ ID NO: 114778 - DNA, 30 bp, Homo sapiens; identical to SEQ ID NO: 82170
  misc_feature 1..30: note = chr18:76514550-76514580
  misc_feature 1..30: note = Hypo
  source 1..30: mol_type = genomic DNA

SEQ ID NO: 114779 - DNA, 52 bp, Homo sapiens; identical to SEQ ID NO: 82171
  misc_feature 1..52: note = chr18:76540366-76540418
  misc_feature 1..52: note = Hypo
  source 1..52: mol_type = genomic DNA

SEQ ID NO: 114780 - DNA, 36 bp, Homo sapiens; identical to SEQ ID NO: 45424
  misc_feature 1..36: note = chr18:76541554-76541590
  misc_feature 1..36: note = Hypo
  source 1..36: mol_type = genomic DNA

SEQ ID NO: 114781 - DNA, 39 bp, Homo sapiens; identical to SEQ ID NO: 82173
  misc_feature 1..39: note = chr18:76557065-76557104
  misc_feature 1..39: note = Hypo
  source 1..39: mol_type = genomic DNA

SEQ ID NO: 114782 - DNA, 143 bp, Homo sapiens; identical to SEQ ID NO: 82174
  misc_feature 1..143: note = chr18:76564557-76564700
  misc_feature 1..143: note = Hypo
  source 1..143: mol_type = genomic DNA

SEQ ID NO: 114783 - DNA, 16 bp, Homo sapiens
  misc_feature 1..16: note = chr18:76571588-76571604
  misc_feature 1..16: note = Hypo
  source 1..16: mol_type = genomic DNA
ccgctcatctcctgct

SEQ ID NO: 114784 - DNA, 143 bp, Homo sapiens; identical to SEQ ID NO: 82176
  misc_feature 1..143: note = chr18:76589501-76589644
  misc_feature 1..143: note = Hypo
  source 1..143: mol_type = genomic DNA

SEQ ID NO: 114785 - DNA, 159 bp, Homo sapiens; identical to SEQ ID NO: 45427
  misc_feature 1..159: note = chr18:76626246-76626405
  misc_feature 1..159: note = Hypo
  source 1..159: mol_type = genomic DNA

SEQ ID NO: 114786 - DNA, 248 bp, Homo sapiens; identical to SEQ ID NO: 82178
  misc_feature 1..248: note = chr18:76653442-76653690
  misc_feature 1..248: note = Hypo
  source 1..248: mol_type = genomic DNA

SEQ ID NO: 114787 - DNA, 346 bp, Homo sapiens; identical to SEQ ID NO: 82179
  misc_feature 1..346: note = chr18:76685490-76685836
  misc_feature 1..346: note = Hypo
  source 1..346: mol_type = genomic DNA

SEQ ID NO: 114788 - DNA, 145 bp, Homo sapiens; identical to SEQ ID NO: 82180
  misc_feature 1..145: note = chr18:76686134-76686279
  misc_feature 1..145: note = Hypo
  source 1..145: mol_type = genomic DNA

SEQ ID NO: 114789 - DNA, 41 bp, Homo sapiens; identical to SEQ ID NO: 82181
  misc_feature 1..41: note = chr18:76693984-76694025
  misc_feature 1..41: note = Hypo
  source 1..41: mol_type = genomic DNA

SEQ ID NO: 114790 - DNA, 173 bp, Homo sapiens; identical to SEQ ID NO: 82182
  misc_feature 1..173: note = chr18:77043590-77043763
  misc_feature 1..173: note = Hypo
  source 1..173: mol_type = genomic DNA

SEQ ID NO: 114791 - DNA, 51 bp, Homo sapiens; identical to SEQ ID NO: 82183
  misc_feature 1..51: note = chr18:77143458-77143509
  misc_feature 1..51: note = Hypo
  source 1..51: mol_type = genomic DNA

SEQ ID NO: 114792 - DNA, 332 bp, Homo sapiens; identical to SEQ ID NO: 37085
  misc_feature 1..332: note = chr18:77153184-77153516
  misc_feature 1..332: note = Hyper
  source 1..332: mol_type = genomic DNA

SEQ ID NO: 114793 - DNA, 66 bp, Homo sapiens; identical to SEQ ID NO: 82185
  misc_feature 1..66: note = chr18:77156762-77156828
  misc_feature 1..66: note = Hyper
  source 1..66: mol_type = genomic DNA

SEQ ID NO: 114794 - DNA, 199 bp, Homo sapiens; identical to SEQ ID NO: 82186
  misc_feature 1..199: note = chr18:77159823-77160022
  misc_feature 1..199: note = Hyper
  source 1..199: mol_type = genomic DNA

SEQ ID NO: 114795 - DNA, 56 bp, Homo sapiens; identical to SEQ ID NO: 82187
  misc_feature 1..56: note = chr18:77160605-77160661
  misc_feature 1..56: note = Hyper
  source 1..56: mol_type = genomic DNA

SEQ ID NO: 114796 - DNA, 103 bp, Homo sapiens; identical to SEQ ID NO: 82188
  misc_feature 1..103: note = chr18:77167751-77167854
  misc_feature 1..103: note = Hypo
  source 1..103: mol_type = genomic DNA

SEQ ID NO: 114797 - DNA, 167 bp, Homo sapiens; identical to SEQ ID NO: 82189
  misc_feature 1..167: note = chr18:77176557-77176724
  misc_feature 1..167: note = Hypo
  source 1..167: mol_type = genomic DNA

SEQ ID NO: 114798 - DNA, 157 bp, Homo sapiens; identical to SEQ ID NO: 45431
  misc_feature 1..157: note = chr18:77181269-77181426
  misc_feature 1..157: note = Hypo
  source 1..157: mol_type = genomic DNA

SEQ ID NO: 114799 - DNA, 79 bp, Homo sapiens; identical to SEQ ID NO: 82191
  misc_feature 1..79: note = chr18:77181779-77181858
  misc_feature 1..79: note = Hypo
  source 1..79: mol_type = genomic DNA

SEQ ID NO: 114800 - DNA, 112 bp, Homo sapiens; identical to SEQ ID NO: 82192
  misc_feature 1..112: note = chr18:77185612-77185724
  misc_feature 1..112: note = Hypo
  source 1..112: mol_type = genomic DNA

SEQ ID NO: 114801 - DNA, 22 bp, Homo sapiens
  misc_feature 1..22: note = chr18:77185948-77185970
  misc_feature 1..22: note = Hypo
  source 1..22: mol_type = genomic DNA
cacctggaatcccagcgctttg

SEQ ID NO: 114802 - DNA, 35 bp, Homo sapiens; identical to SEQ ID NO: 82194
  misc_feature 1..35: note = chr18:77186431-77186466
  misc_feature 1..35: note = Hypo
  source 1..35: mol_type = genomic DNA

SEQ ID NO: 114803 - DNA, 30 bp, Homo sapiens; identical to SEQ ID NO: 82195
  misc_feature 1..30: note = chr18:77187147-77187177
  misc_feature 1..30: note = Hypo
  source 1..30: mol_type = genomic DNA

SEQ ID NO: 114804 - DNA, 50 bp, Homo sapiens; identical to SEQ ID NO: 82196
  misc_feature 1..50: note = chr18:77193378-77193428
  misc_feature 1..50: note = Hypo
  source 1..50: mol_type = genomic DNA

SEQ ID NO: 114805 - DNA, 42 bp, Homo sapiens; identical to SEQ ID NO: 82197
  misc_feature 1..42: note = chr18:77194936-77194978
  misc_feature 1..42: note = Hypo
  source 1..42: mol_type = genomic DNA

SEQ ID NO: 114806 - DNA, 567 bp, Homo sapiens; identical to SEQ ID NO: 82198
  misc_feature 1..567: note = chr18:77201923-77202490
  misc_feature 1..567: note = Hypo
  source 1..567: mol_type = genomic DNA

SEQ ID NO: 114807 - DNA, 74 bp, Homo sapiens; identical to SEQ ID NO: 82199
  misc_feature 1..74: note = chr18:77203641-77203715
  misc_feature 1..74: note = Hypo
  source 1..74: mol_type = genomic DNA

SEQ ID NO: 114808 - DNA, 284 bp, Homo sapiens; identical to SEQ ID NO: 82200
  misc_feature 1..284: note = chr18:77205447-77205731
  misc_feature 1..284: note = Hypo
  source 1..284: mol_type = genomic DNA

SEQ ID NO: 114809 - DNA, 205 bp, Homo sapiens; identical to SEQ ID NO: 82201
  misc_feature 1..205: note = chr18:77209940-77210145
  misc_feature 1..205: note = Hypo
  source 1..205: mol_type = genomic DNA

SEQ ID NO: 114810 - DNA, 41 bp, Homo sapiens; identical to SEQ ID NO: 82202
  misc_feature 1..41: note = chr18:77216863-77216904
  misc_feature 1..41: note = Hypo
  source 1..41: mol_type = genomic DNA

SEQ ID NO: 114811 - DNA, 57 bp, Homo sapiens; identical to SEQ ID NO: 82203
  misc_feature 1..57: note = chr18:77221921-77221978
  misc_feature 1..57: note = Hypo
  source 1..57: mol_type = genomic DNA

SEQ ID NO: 114812 - DNA, 135 bp, Homo sapiens; identical to SEQ ID NO: 82204
  misc_feature 1..135: note = chr18:77227605-77227740
  misc_feature 1..135: note = Hypo
  source 1..135: mol_type = genomic DNA

SEQ ID NO: 114813 - DNA, 30 bp, Homo sapiens; identical to SEQ ID NO: 82205
  misc_feature 1..30: note = chr18:77228944-77228974
  misc_feature 1..30: note = Hypo
  source 1..30: mol_type = genomic DNA

SEQ ID NO: 114814 - DNA, 76 bp, Homo sapiens; identical to SEQ ID NO: 82206
  misc_feature 1..76: note = chr18:77229422-77229498
  misc_feature 1..76: note = Hypo
  source 1..76: mol_type = genomic DNA

SEQ ID NO: 114815 - DNA, 56 bp, Homo sapiens; identical to SEQ ID NO: 82207
  misc_feature 1..56: note = chr18:77230030-77230086
  misc_feature 1..56: note = Hypo
  source 1..56: mol_type = genomic DNA

SEQ ID NO: 114816 - DNA, 631 bp, Homo sapiens; identical to SEQ ID NO: 82208
  misc_feature 1..631: note = chr18:77236039-77236670
  misc_feature 1..631: note = Hypo
  source 1..631: mol_type = genomic DNA

SEQ ID NO: 114817 - DNA, 156 bp, Homo sapiens; identical to SEQ ID NO: 82209
  misc_feature 1..156: note = chr18:77239886-77240042
  misc_feature 1..156: note = Hypo
  source 1..156: mol_type = genomic DNA

SEQ ID NO: 114818 - DNA, 43 bp, Homo sapiens; identical to SEQ ID NO: 82210
  misc_feature 1..43: note = chr18:77240573-77240616
  misc_feature 1..43: note = Hypo
  source 1..43: mol_type = genomic DNA

SEQ ID NO: 114819 - DNA, 519 bp, Homo sapiens; identical to SEQ ID NO: 82211
  misc_feature 1..519: note = chr18:77246353-77246872
  misc_feature 1..519: note = Hypo
  source 1..519: mol_type = genomic DNA

SEQ ID NO: 114820 - DNA, 58 bp, Homo sapiens; identical to SEQ ID NO: 82212
  misc_feature 1..58: note = chr18:77247301-77247359
  misc_feature 1..58: note = Hypo
  source 1..58: mol_type = genomic DNA

SEQ ID NO: 114821 - DNA, 43 bp, Homo sapiens; identical to SEQ ID NO: 82213
  misc_feature 1..43: note = chr18:77250896-77250939
  misc_feature 1..43: note = Hypo
  source 1..43: mol_type = genomic DNA

SEQ ID NO: 114822 - DNA, 36 bp, Homo sapiens; identical to SEQ ID NO: 82214
  misc_feature 1..36: note = chr18:77255748-77255784
  misc_feature 1..36: note = Hypo
  source 1..36: mol_type = genomic DNA

SEQ ID NO: 114823 - DNA, 89 bp, Homo sapiens; identical to SEQ ID NO: 82215
  misc_feature 1..89: note = chr18:77271000-77271089
  misc_feature 1..89: note = Hypo
  source 1..89: mol_type = genomic DNA

SEQ ID NO: 114824 - DNA, 448 bp, Homo sapiens; identical to SEQ ID NO: 82216
  misc_feature 1..448: note = chr18:77271863-77272311
  misc_feature 1..448: note = Hypo
  source 1..448: mol_type = genomic DNA

SEQ ID NO: 114825 - DNA, 325 bp, Homo sapiens; identical to SEQ ID NO: 82217
  misc_feature 1..325: note = chr18:77272937-77273262
  misc_feature 1..325: note = Hypo
  source 1..325: mol_type = genomic DNA

SEQ ID NO: 114826 - DNA, 244 bp, Homo sapiens; identical to SEQ ID NO: 45446
  misc_feature 1..244: note = chr18:77285870-77286114
  misc_feature 1..244: note = Hypo
  source 1..244: mol_type = genomic DNA

SEQ ID NO: 114827 - DNA, 202 bp, Homo sapiens; identical to SEQ ID NO: 82219
  misc_feature 1..202: note = chr18:77288237-77288439
  misc_feature 1..202: note = Hypo
  source 1..202: mol_type = genomic DNA

SEQ ID NO: 114828 - DNA, 30 bp, Homo sapiens; identical to SEQ ID NO: 82220
  misc_feature 1..30: note = chr18:77289162-77289192
  misc_feature 1..30: note = Hypo
  source 1..30: mol_type = genomic DNA

SEQ ID NO: 114829 - DNA, 212 bp, Homo sapiens; identical to SEQ ID NO: 82221
  misc_feature 1..212: note = chr18:77290787-77290999
  misc_feature 1..212: note = Hypo
  source 1..212: mol_type = genomic DNA

SEQ ID NO: 114830 - DNA, 30 bp, Homo sapiens; identical to SEQ ID NO: 82222
  misc_feature 1..30: note = chr18:77305341-77305371
  misc_feature 1..30: note = Hypo
  source 1..30: mol_type = genomic DNA

SEQ ID NO: 114831 - DNA, 207 bp, Homo sapiens; identical to SEQ ID NO: 82223
  misc_feature 1..207: note = chr18:77307603-77307810
  misc_feature 1..207: note = Hypo
  source 1..207: mol_type = genomic DNA

SEQ ID NO: 114832 - DNA, 241 bp, Homo sapiens; identical to SEQ ID NO: 82224
  misc_feature 1..241: note = chr18:77308327-77308568
  misc_feature 1..241: note = Hypo
  source 1..241: mol_type = genomic DNA

SEQ ID NO: 114833 - DNA, 201 bp, Homo sapiens; identical to SEQ ID NO: 82225
  misc_feature 1..201: note = chr18:77309533-77309734
  misc_feature 1..201: note = Hypo
  source 1..201: mol_type = genomic DNA

SEQ ID NO: 114834 - DNA, 136 bp, Homo sapiens; identical to SEQ ID NO: 82226
  misc_feature 1..136: note = chr18:77312103-77312239
  misc_feature 1..136: note = Hypo
  source 1..136: mol_type = genomic DNA

SEQ ID NO: 114835 - DNA, 49 bp, Homo sapiens; identical to SEQ ID NO: 82227
  misc_feature 1..49: note = chr18:77312878-77312927
  misc_feature 1..49: note = Hypo
  source 1..49: mol_type = genomic DNA

SEQ ID NO: 114836 - DNA, 149 bp, Homo sapiens; identical to SEQ ID NO: 82228
  misc_feature 1..149: note = chr18:77313872-77314021
  misc_feature 1..149: note = Hypo
  source 1..149: mol_type = genomic DNA

SEQ ID NO: 114837 - DNA, 32 bp, Homo sapiens; identical to SEQ ID NO: 82229
  misc_feature 1..32: note = chr18:77315506-77315538
  misc_feature 1..32: note = Hypo
  source 1..32: mol_type = genomic DNA

SEQ ID NO: 114838 - DNA, 30 bp, Homo sapiens; identical to SEQ ID NO: 82230
  misc_feature 1..30: note = chr18:77315989-77316019
  misc_feature 1..30: note = Hypo
  source 1..30: mol_type = genomic DNA

SEQ ID NO: 114839 - DNA, 212 bp, Homo sapiens; identical to SEQ ID NO: 82231
  misc_feature 1..212: note = chr18:77320311-77320523
  misc_feature 1..212: note = Hypo
  source 1..212: mol_type = genomic DNA

SEQ ID NO: 114840 - DNA, 373 bp, Homo sapiens; identical to SEQ ID NO: 82232
  misc_feature 1..373: note = chr18:77329644-77330017
  misc_feature 1..373: note = Hypo
  source 1..373: mol_type = genomic DNA

SEQ ID NO: 114841 - DNA, 30 bp, Homo sapiens; identical to SEQ ID NO: 82233
  misc_feature 1..30: note = chr18:77331718-77331748
  misc_feature 1..30: note = Hypo
  source 1..30: mol_type = genomic DNA

SEQ ID NO: 114842 - DNA, 30 bp, Homo sapiens; identical to SEQ ID NO: 82234
  misc_feature 1..30: note = chr18:77339091-77339121
  misc_feature 1..30: note = Hypo
  source 1..30: mol_type = genomic DNA

SEQ ID NO: 114843 - DNA, 30 bp, Homo sapiens; identical to SEQ ID NO: 82235
  misc_feature 1..30: note = chr18:77345226-77345256
  misc_feature 1..30: note = Hypo
  source 1..30: mol_type = genomic DNA

SEQ ID NO: 114844 - DNA, 34 bp, Homo sapiens; identical to SEQ ID NO: 82236
  misc_feature 1..34: note = chr18:77346594-77346628
  misc_feature 1..34: note = Hypo
  source 1..34: mol_type = genomic DNA

SEQ ID NO: 114845 - DNA, 139 bp, Homo sapiens; identical to SEQ ID NO: 82237
  misc_feature 1..139: note = chr18:77357869-77358008
  misc_feature 1..139: note = Hypo
  source 1..139: mol_type = genomic DNA

SEQ ID NO: 114846 - DNA, 30 bp, Homo sapiens; identical to SEQ ID NO: 82238
  misc_feature 1..30: note = chr18:77363914-77363944
  misc_feature 1..30: note = Hypo
  source 1..30: mol_type = genomic DNA

SEQ ID NO: 114847 - DNA, 261 bp, Homo sapiens; identical to SEQ ID NO: 45454
  misc_feature 1..261: note = chr18:77364366-77364627
  misc_feature 1..261: note = Hypo
  source 1..261: mol_type = genomic DNA

SEQ ID NO: 114848 - DNA, 35 bp, Homo sapiens; identical to SEQ ID NO: 82240
  misc_feature 1..35: note = chr18:77364942-77364977
  misc_feature 1..35: note = Hypo
  source 1..35: mol_type = genomic DNA

SEQ ID NO: 114849 - DNA, 35 bp, Homo sapiens; identical to SEQ ID NO: 82241
  misc_feature 1..35: note = chr18:77365157-77365192
  misc_feature 1..35: note = Hypo
  source 1..35: mol_type = genomic DNA

SEQ ID NO: 114850 - DNA, 154 bp, Homo sapiens; identical to SEQ ID NO: 82242
  misc_feature 1..154: note = chr18:77365670-77365824
  misc_feature 1..154: note = Hypo
  source 1..154: mol_type = genomic DNA

SEQ ID NO: 114851 - DNA, 78 bp, Homo sapiens; identical to SEQ ID NO: 82243
  misc_feature 1..78: note = chr18:77371430-77371508
  misc_feature 1..78: note = Hypo
  source 1..78: mol_type = genomic DNA

SEQ ID NO: 114852 - DNA, 30 bp, Homo sapiens; identical to SEQ ID NO: 82244
  misc_feature 1..30: note = chr18:77393026-77393056
  misc_feature 1..30: note = Hypo
  source 1..30: mol_type = genomic DNA

SEQ ID NO: 114853 - DNA, 178 bp, Homo sapiens; identical to SEQ ID NO: 82245
  misc_feature 1..178: note = chr18:77410020-77410198
  misc_feature 1..178: note = Hypo
  source 1..178: mol_type = genomic DNA

SEQ ID NO: 114854 - DNA, 32 bp, Homo sapiens; identical to SEQ ID NO: 82246
  misc_feature 1..32: note = chr18:77417240-77417272
  misc_feature 1..32: note = Hypo
  source 1..32: mol_type = genomic DNA

SEQ ID NO: 114855 - DNA, 30 bp, Homo sapiens; identical to SEQ ID NO: 82247
  misc_feature 1..30: note = chr18:77502354-77502384
  misc_feature 1..30: note = Hypo
  source 1..30: mol_type = genomic DNA

SEQ ID NO: 114856 - DNA, 47 bp, Homo sapiens; identical to SEQ ID NO: 82248
  misc_feature 1..47: note = chr18:77508899-77508946
  misc_feature 1..47: note = Hypo
  source 1..47: mol_type = genomic DNA

SEQ ID NO: 114857 - DNA, 335 bp, Homo sapiens; identical to SEQ ID NO: 82249
  misc_feature 1..335: note = chr18:77509344-77509679
  misc_feature 1..335: note = Hypo
  source 1..335: mol_type = genomic DNA

SEQ ID NO: 114858 - DNA, 58 bp, Homo sapiens; identical to SEQ ID NO: 82250
  misc_feature 1..58: note = chr18:77531551-77531609
  misc_feature 1..58: note = Hypo
  source 1..58: mol_type = genomic DNA

SEQ ID NO: 114859 - DNA, 48 bp, Homo sapiens; identical to SEQ ID NO: 82251
  misc_feature 1..48: note = chr18:77532151-77532199
  misc_feature 1..48: note = Hypo
  source 1..48: mol_type = genomic DNA

SEQ ID NO: 114860 - DNA, 77 bp, Homo sapiens; identical to SEQ ID NO: 82252
  misc_feature 1..77: note = chr18:77533370-77533447
  misc_feature 1..77: note = Hypo
  source 1..77: mol_type = genomic DNA

SEQ ID NO: 114861 - DNA, 71 bp, Homo sapiens; identical to SEQ ID NO: 82253
  misc_feature 1..71: note = chr18:77534949-77535020
  misc_feature 1..71: note = Hypo
  source 1..71: mol_type = genomic DNA

SEQ ID NO: 114862 - DNA, 46 bp, Homo sapiens; identical to SEQ ID NO: 45460
  misc_feature 1..46: note = chr18:77542905-77542951
  misc_feature 1..46: note = Hypo
  source 1..46: mol_type = genomic DNA

SEQ ID NO: 114863 - DNA, 155 bp, Homo sapiens; identical to SEQ ID NO: 82255
  misc_feature 1..155: note = chr18:77543221-77543376
  misc_feature 1..155: note = Hypo
  source 1..155: mol_type = genomic DNA

SEQ ID NO: 114864 - DNA, 124 bp, Homo sapiens; identical to SEQ ID NO: 82256
  misc_feature 1..124: note = chr18:77543700-77543824
  misc_feature 1..124: note = Hypo
  source 1..124: mol_type = genomic DNA

SEQ ID NO: 114865 - DNA, 147 bp, Homo sapiens; identical to SEQ ID NO: 82257
  misc_feature 1..147: note = chr18:77544654-77544801
  misc_feature 1..147: note = Hypo
  source 1..147: mol_type = genomic DNA

SEQ ID NO: 114866 - DNA, 778 bp, Homo sapiens
  misc_feature 1..778: note = chr18:77547831-77548609
  misc_feature 1..778: note = Hyper
  source 1..778: mol_type = genomic DNA
tttattttagtcctccgcgaaggagcctctcaaatattcccggagcacaggctaatttagaacgtgttatcctgacaaggcggcccagccagggaggagacgccggggtccgcgccgcggggcgggcgcttccccggacccgggggaggcgggacgcaggcgaaggccgccccgggagagcggggtcccgggagagcggggtcccggctgtgggggacgcgggccgaggctgtcgcgaagccgctgacggccgaggcgctcccggttttcgcggcgcacaagggttgcccgagcgctcagagcaggggccgccacgcgggcgcccggtccaacccgcggcctcccgggtccctcctagcggggccgcagacgcccgcgagccgcgtccccggagcgcagaagatccccgcgcacagcgcaggccccgccggcccggtggacccgcttgaggacgcggagggggcgcgtttcctctgcggcgcccgcacggcctctgcccgcctgtcccgcgctcccgcccggcaggcccagctcggacgaggctcagctgccgcccccgttgcctttgtgggtttttctgcggaagccccttttcctcgggtggatgggaccctgcgcgtggaaccccgcacagcccccgctccgccgcgggccgcaggacccattccttctccacggtggcgctggggaggggctgcttccacccaggagattcgcgagggagagaaaacatgcggctcacatccggacggcagccccgccccgcttagaaacaata

SEQ ID NO: 114867 - DNA, 470 bp, Homo sapiens; identical to SEQ ID NO: 82260
  misc_feature 1..470: note = chr18:77549960-77550430
  misc_feature 1..470: note = Hypo
  source 1..470: mol_type = genomic DNA

SEQ ID NO: 114868 - DNA, 1441 bp, Homo sapiens
  misc_feature 1..1441: note = chr18:77557808-77559249
  misc_feature 1..1441: note = Hyper
  source 1..1441: mol_type = genomic DNA
ggctccaaacccagccgagggtcggctcgctcctggggacccgcggatgtcgcgagggggcgccgcgccactgaaggctgggacgggggcggtgcgcggggcggcgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtgggcggtggggcggggggcgcgggctcctgtctgatggttccgcgcgcagcttcttctccgggtgcgcggtgcgcgcgggcgcgggagggtcgaaggggaccttggaatccccctgttcgggccaagggggcgggggcggctcggggccgggcggggctggtgcctccccctcccgctcagcgcccagagtccgggagtcgaggggggcgtcgggccggaggcgctcgccggtctggccgcgccgcgcgcgtggatggaggtctcggccgcggatcgccccgtctattcgcgctggtcctgcgggagcccgggtgagccgaaggcgaggaaggggcgcgggtctcgggaaaacccgactctcccggcgcccgccccggttcggttgggggcgcacccggctcgcgcggagagcgggcggggtgtgggcgaatgctcggcgcgctgcgcctttcccggtcccccttctccccggagatgaacgccccactcccgctcggacacacggccgcacccctactctgcctcctccgaccagccggggcgcggcccgaattgggggagagaagacccagctcccgcagccgcgaattctgcaaacccggagcccatgcgccccgtcctccggcccggggagctcccagccttgcccgccgagcgcagcccgggtccggactgtggtcactggggacgagaagggtccctcctgcggggctcccgggttcggatggacggagggggcgtccggcaggtgaactgggcccgctccgcgtcccgaacgttcccctaaacccacaagtcccggagaccctggggcattctgcgatttcggagtgaccggtggagcccccgcccgcgcgcctggctcccggggtctccccacacagcaggggctgcggggaccccctctgtcacctcctccaaagggtctgggagcaattcgacctgcctggagaattccaggaagtcctttccctgcgggagcctcatgggtccccccttctctgcctgcagagacctctggcttccgcgtgcgctcaaagtgagcgccgggcagattgtaaataatggattttgacccagctgggagatctcagagtgattaagtggagaggctgttccaccctcagccctgcccaggcagctgggtgaccccgcgggccacatgccac

SEQ ID NO: 114869 - DNA, 25 bp, Homo sapiens
  misc_feature 1..25: note = chr18:77569611-77569636
  misc_feature 1..25: note = Hypo
  source 1..25: mol_type = genomic DNA
ccagagtcctcgccctgaggagctg

SEQ ID NO: 114870 - DNA, 256 bp, Homo sapiens; identical to SEQ ID NO: 82265
  misc_feature 1..256: note = chr18:77576934-77577190
  misc_feature 1..256: note = Hypo
  source 1..256: mol_type = genomic DNA

SEQ ID NO: 114871 - DNA, 47 bp, Homo sapiens; identical to SEQ ID NO: 82266
  misc_feature 1..47: note = chr18:77578855-77578902
  misc_feature 1..47: note = Hypo
  source 1..47: mol_type = genomic DNA

SEQ ID NO: 114872 - DNA, 30 bp, Homo sapiens; identical to SEQ ID NO: 82267
  misc_feature 1..30: note = chr18:77582757-77582787
  misc_feature 1..30: note = Hypo
  source 1..30: mol_type = genomic DNA

SEQ ID NO: 114873 - DNA, 30 bp, Homo sapiens; identical to SEQ ID NO: 82268
  misc_feature 1..30: note = chr18:77605211-77605241
  misc_feature 1..30: note = Hypo
  source 1..30: mol_type = genomic DNA

SEQ ID NO: 114874 - DNA, 92 bp, Homo sapiens; identical to SEQ ID NO: 82269
  misc_feature 1..92: note = chr18:77609586-77609678
  misc_feature 1..92: note = Hypo
  source 1..92: mol_type = genomic DNA

SEQ ID NO: 114875 - DNA, 40 bp, Homo sapiens; identical to SEQ ID NO: 45467
  misc_feature 1..40: note = chr18:77612204-77612244
  misc_feature 1..40: note = Hypo
  source 1..40: mol_type = genomic DNA

SEQ ID NO: 114876 - DNA, 30 bp, Homo sapiens; identical to SEQ ID NO: 82271
  misc_feature 1..30: note = chr18:77612868-77612898
  misc_feature 1..30: note = Hypo
  source 1..30: mol_type = genomic DNA

SEQ ID NO: 114877 - DNA, 222 bp, Homo sapiens; identical to SEQ ID NO: 82272
  misc_feature 1..222: note = chr18:77622385-77622607
  misc_feature 1..222: note = Hypo
  source 1..222: mol_type = genomic DNA

SEQ ID NO: 114878 - DNA, 52 bp, Homo sapiens; identical to SEQ ID NO: 82273
  misc_feature 1..52: note = chr18:77627776-77627828
  misc_feature 1..52: note = Hypo
  source 1..52: mol_type = genomic DNA

SEQ ID NO: 114879 - DNA, 136 bp, Homo sapiens; identical to SEQ ID NO: 82274
  misc_feature 1..136: note = chr18:77628334-77628470
  misc_feature 1..136: note = Hypo
  source 1..136: mol_type = genomic DNA

SEQ ID NO: 114880 - DNA, 124 bp, Homo sapiens; identical to SEQ ID NO: 82275
  misc_feature 1..124: note = chr18:77628901-77629025
  misc_feature 1..124: note = Hypo
  source 1..124: mol_type = genomic DNA

SEQ ID NO: 114881 - DNA, 56 bp, Homo sapiens; identical to SEQ ID NO: 82276
  misc_feature 1..56: note = chr18:77631027-77631083
  misc_feature 1..56: note = Hypo
  source 1..56: mol_type = genomic DNA

SEQ ID NO: 114882 - DNA, 218 bp, Homo sapiens; identical to SEQ ID NO: 82277
  misc_feature 1..218: note = chr18:77631760-77631978
  misc_feature 1..218: note = Hypo
  source 1..218: mol_type = genomic DNA

SEQ ID NO: 114883 - DNA, 44 bp, Homo sapiens; identical to SEQ ID NO: 82278
  misc_feature 1..44: note = chr18:77635572-77635616
  misc_feature 1..44: note = Hypo
  source 1..44: mol_type = genomic DNA

SEQ ID NO: 114884 - DNA, 30 bp, Homo sapiens; identical to SEQ ID NO: 82279
  misc_feature 1..30: note = chr18:77635848-77635878
  misc_feature 1..30: note = Hypo
  source 1..30: mol_type = genomic DNA

SEQ ID NO: 114885 - DNA, 40 bp, Homo sapiens; identical to SEQ ID NO: 45473
  misc_feature 1..40: note = chr18:77636150-77636190
  misc_feature 1..40: note = Hypo
  source 1..40: mol_type = genomic DNA

SEQ ID NO: 114886 - DNA, 265 bp, Homo sapiens; identical to SEQ ID NO: 82281
  misc_feature 1..265: note = chr18:77636534-77636799
  misc_feature 1..265: note = Hypo
  source 1..265: mol_type = genomic DNA

SEQ ID NO: 114887 - DNA, 217 bp, Homo sapiens; identical to SEQ ID NO: 82282
  misc_feature 1..217: note = chr18:77644664-77644881
  misc_feature 1..217: note = Hypo
  source 1..217: mol_type = genomic DNA

SEQ ID NO: 114888 - DNA, 36 bp, Homo sapiens; identical to SEQ ID NO: 82283
  misc_feature 1..36: note = chr18:77664997-77665033
  misc_feature 1..36: note = Hypo
  source 1..36: mol_type = genomic DNA

SEQ ID NO: 114889 - DNA, 30 bp, Homo sapiens; identical to SEQ ID NO: 82284
  misc_feature 1..30: note = chr18:77685415-77685445
  misc_feature 1..30: note = Hypo
  source 1..30: mol_type = genomic DNA

SEQ ID NO: 114890 - DNA, 32 bp, Homo sapiens; identical to SEQ ID NO: 82285
  misc_feature 1..32: note = chr18:77713122-77713154
  misc_feature 1..32: note = Hypo
  source 1..32: mol_type = genomic DNA

SEQ ID NO: 114891 - DNA, 16 bp, Homo sapiens
  misc_feature 1..16: note = chr18:77718382-77718398
  misc_feature 1..16: note = Hypo
  source 1..16: mol_type = genomic DNA
gcgcccggccaacctc

SEQ ID NO: 114892 - DNA, 24 bp, Homo sapiens
  misc_feature 1..24: note = chr18:77725938-77725962
  misc_feature 1..24: note = Hypo
  source 1..24: mol_type = genomic DNA
ttttattttttgagacggagtgtc

SEQ ID NO: 114893 - DNA, 16 bp, Homo sapiens
  misc_feature 1..16: note = chr18:77728894-77728910
  misc_feature 1..16: note = Hypo
  source 1..16: mol_type = genomic DNA
gattcagaagccaggc

SEQ ID NO: 114894 - DNA, 30 bp, Homo sapiens; identical to SEQ ID NO: 82289
  misc_feature 1..30: note = chr18:77795658-77795688
  misc_feature 1..30: note = Hypo
  source 1..30: mol_type = genomic DNA

SEQ ID NO: 114895 - DNA, 30 bp, Homo sapiens; identical to SEQ ID NO: 82290
  misc_feature 1..30: note = chr18:77809156-77809186
  misc_feature 1..30: note = Hypo
  source 1..30: mol_type = genomic DNA

SEQ ID NO: 114896 - DNA, 171 bp, Homo sapiens; identical to SEQ ID NO: 82291
  misc_feature 1..171: note = chr18:78004571-78004742
  misc_feature 1..171: note = Hyper
  source 1..171: mol_type = genomic DNA

SEQ ID NO: 114897 - DNA, 78 bp, Homo sapiens; identical to SEQ ID NO: 82292
  misc_feature 1..78: note = chr18:78005084-78005162
  misc_feature 1..78: note = Hyper
  source 1..78: mol_type = genomic DNA

SEQ ID NO: 114898 - DNA, 98 bp, Homo sapiens; identical to SEQ ID NO: 82293
  misc_feature 1..98: note = chr18:78005567-78005665
  misc_feature 1..98: note = Hyper
  source 1..98: mol_type = genomic DNA

SEQ ID NO: 114899 - DNA, 76 bp, Homo sapiens
  misc_feature 1..76: note = chr19:267161-267237
  misc_feature 1..76: note = Hyper
  source 1..76: mol_type = genomic DNA
gcgttgctcctttctcggcgccaggatctctccccaggaaccagcgcagatccggaggccacgctgcgctgcgctg

SEQ ID NO: 114900 - DNA, 90 bp, Homo sapiens; identical to SEQ ID NO: 83022
  misc_feature 1..90: note = chr19:267567-267657
  misc_feature 1..90: note = Hyper
  source 1..90: mol_type = genomic DNA

SEQ ID NO: 114901 - DNA, 87 bp, Homo sapiens; identical to SEQ ID NO: 83038
  misc_feature 1..87: note = chr19:290965-291052
  misc_feature 1..87: note = Hyper
  source 1..87: mol_type = genomic DNA

SEQ ID NO: 114902 - DNA, 231 bp, Homo sapiens; identical to SEQ ID NO: 83040
  misc_feature 1..231: note = chr19:292054-292285
  misc_feature 1..231: note = Hypo
  source 1..231: mol_type = genomic DNA

SEQ ID NO: 114903 - DNA, 33 bp, Homo sapiens; identical to SEQ ID NO: 83047
  misc_feature 1..33: note = chr19:295054-295087
  misc_feature 1..33: note = Hyper
  source 1..33: mol_type = genomic DNA

SEQ ID NO: 114904 - DNA, 30 bp, Homo sapiens; identical to SEQ ID NO: 83101
  misc_feature 1..30: note = chr19:307368-307398
  misc_feature 1..30: note = Hypo
  source 1..30: mol_type = genomic DNA

SEQ ID NO: 114905 - DNA, 30 bp, Homo sapiens; identical to SEQ ID NO: 83217
  misc_feature 1..30: note = chr19:347146-347176
  misc_feature 1..30: note = Hypo
  source 1..30: mol_type = genomic DNA

SEQ ID NO: 114906 - DNA, 120 bp, Homo sapiens; identical to SEQ ID NO: 83219
  misc_feature 1..120: note = chr19:349135-349255
  misc_feature 1..120: note = Hypo
  source 1..120: mol_type = genomic DNA

SEQ ID NO: 114907 - DNA, 118 bp, Homo sapiens; identical to SEQ ID NO: 45479
  misc_feature 1..118: note = chr19:400972-401090
  misc_feature 1..118: note = Hypo
  source 1..118: mol_type = genomic DNA

SEQ ID NO: 114908 - DNA, 52 bp, Homo sapiens; identical to SEQ ID NO: 83523
  misc_feature 1..52: note = chr19:401481-401533
  misc_feature 1..52: note = Hypo
  source 1..52: mol_type = genomic DNA

SEQ ID NO: 114909 - DNA, 442 bp, Homo sapiens; identical to SEQ ID NO: 45481
  misc_feature 1..442: note = chr19:403367-403809
  misc_feature 1..442: note = Hypo
  source 1..442: mol_type = genomic DNA

SEQ ID NO: 114910 - DNA, 708 bp, Homo sapiens; identical to SEQ ID NO: 83539
  misc_feature 1..708: note = chr19:407124-407832
  misc_feature 1..708: note = Hypo
  source 1..708: mol_type = genomic DNA

SEQ ID NO: 114911 - DNA, 51 bp, Homo sapiens; identical to SEQ ID NO: 83578
  misc_feature 1..51: note = chr19:413211-413262
  misc_feature 1..51: note = Hypo
  source 1..51: mol_type = genomic DNA

SEQ ID NO: 114912 - DNA, 30 bp, Homo sapiens; identical to SEQ ID NO: 83607
  misc_feature 1..30: note = chr19:422922-422952
  misc_feature 1..30: note = Hypo
  source 1..30: mol_type = genomic DNA

SEQ ID NO: 114913 - DNA, 186 bp, Homo sapiens; identical to SEQ ID NO: 83628
  misc_feature 1..186: note = chr19:426825-427011
  misc_feature 1..186: note = Hypo
  source 1..186: mol_type = genomic DNA

SEQ ID NO: 114914 - DNA, 34 bp, Homo sapiens; identical to SEQ ID NO: 83659
  misc_feature 1..34: note = chr19:436312-436346
  misc_feature 1..34: note = Hypo
  source 1..34: mol_type = genomic DNA

SEQ ID NO: 114915 - DNA, 30 bp, Homo sapiens; identical to SEQ ID NO: 83661
  misc_feature 1..30: note = chr19:436614-436644
  misc_feature 1..30: note = Hypo
  source 1..30: mol_type = genomic DNA

SEQ ID NO: 114916 - DNA, 94 bp, Homo sapiens; identical to SEQ ID NO: 83759
  misc_feature 1..94: note = chr19:460027-460121
  misc_feature 1..94: note = Hyper
  source 1..94: mol_type = genomic DNA

SEQ ID NO: 114917 - DNA, 51 bp, Homo sapiens; identical to SEQ ID NO: 83761
  misc_feature 1..51: note = chr19:460675-460726
  misc_feature 1..51: note = Hyper
  source 1..51: mol_type = genomic DNA

SEQ ID NO: 114918 - DNA, 56 bp, Homo sapiens; identical to SEQ ID NO: 83764
  misc_feature 1..56: note = chr19:461131-461187
  misc_feature 1..56: note = Hyper
  source 1..56: mol_type = genomic DNA

SEQ ID NO: 114919 - DNA, 58 bp, Homo sapiens; identical to SEQ ID NO: 83770
  misc_feature 1..58: note = chr19:461788-461846
  misc_feature 1..58: note = Hyper
  source 1..58: mol_type = genomic DNA

SEQ ID NO: 114920 - DNA, 30 bp, Homo sapiens; identical to SEQ ID NO: 83772
  misc_feature 1..30: note = chr19:462130-462160
  misc_feature 1..30: note = Hyper
  source 1..30: mol_type = genomic DNA

SEQ ID NO: 114921 - DNA, 84 bp, Homo sapiens; identical to SEQ ID NO: 83798
  misc_feature 1..84: note = chr19:468719-468803
  misc_feature 1..84: note = Hypo
  source 1..84: mol_type = genomic DNA

SEQ ID NO: 114922 - DNA, 318 bp, Homo sapiens; identical to SEQ ID NO: 83817
  misc_feature 1..318: note = chr19:470831-471149
  misc_feature 1..318: note = Hypo
  source 1..318: mol_type = genomic DNA

SEQ ID NO: 114923 - DNA, 30 bp, Homo sapiens; identical to SEQ ID NO: 83885
  misc_feature 1..30: note = chr19:484049-484079
  misc_feature 1..30: note = Hypo
  source 1..30: mol_type = genomic DNA

SEQ ID NO: 114924 - DNA, 275 bp, Homo sapiens; identical to SEQ ID NO: 83887
  misc_feature 1..275: note = chr19:485119-485394
  misc_feature 1..275: note = Hypo
  source 1..275: mol_type = genomic DNA

SEQ ID NO: 114925 - DNA, 229 bp, Homo sapiens; identical to SEQ ID NO: 83923
  misc_feature 1..229: note = chr19:491311-491540
  misc_feature 1..229: note = Hypo
  source 1..229: mol_type = genomic DNA

SEQ ID NO: 114926 - DNA, 78 bp, Homo sapiens; identical to SEQ ID NO: 37093
  misc_feature 1..78: note = chr19:496464-496542
  misc_feature 1..78: note = Hyper
  source 1..78: mol_type = genomic DNA

SEQ ID NO: 114927 - DNA, 49 bp, Homo sapiens; identical to SEQ ID NO: 83953
  misc_feature 1..49: note = chr19:497872-497921
  misc_feature 1..49: note = Hyper
  source 1..49: mol_type = genomic DNA

SEQ ID NO: 114928 - DNA, 79 bp, Homo sapiens; identical to SEQ ID NO: 83968
  misc_feature 1..79: note = chr19:499757-499836
  misc_feature 1..79: note = Hypo
  source 1..79: mol_type = genomic DNA

SEQ ID NO: 114929 - DNA, 83 bp, Homo sapiens; identical to SEQ ID NO: 84030
  misc_feature 1..83: note = chr19:508329-508412
  misc_feature 1..83: note = Hypo
  source 1..83: mol_type = genomic DNA

SEQ ID NO: 114930 - DNA, 16 bp, Homo sapiens
  misc_feature 1..16: note = chr19:520802-520818
  misc_feature 1..16: note = Hypo
  source 1..16: mol_type = genomic DNA
ccgtctcaaaaaaata

SEQ ID NO: 114931 - DNA, 45 bp, Homo sapiens; identical to SEQ ID NO: 84127
  misc_feature 1..45: note = chr19:522927-522972
  misc_feature 1..45: note = Hypo
  source 1..45: mol_type = genomic DNA

SEQ ID NO: 114932 - DNA, 274 bp, Homo sapiens; identical to SEQ ID NO: 84129
  misc_feature 1..274: note = chr19:524057-524331
  misc_feature 1..274: note = Hypo
  source 1..274: mol_type = genomic DNA

SEQ ID NO: 114933 - DNA, 261 bp, Homo sapiens; identical to SEQ ID NO: 84169
  misc_feature 1..261: note = chr19:530219-530480
  misc_feature 1..261: note = Hypo
  source 1..261: mol_type = genomic DNA

SEQ ID NO: 114934 - DNA, 30 bp, Homo sapiens; identical to SEQ ID NO: 84315
  misc_feature 1..30: note = chr19:547205-547235
  misc_feature 1..30: note = Hypo
  source 1..30: mol_type = genomic DNA

SEQ ID NO: 114935 - DNA, 49 bp, Homo sapiens; identical to SEQ ID NO: 84316
  misc_feature 1..49: note = chr19:547453-547502
  misc_feature 1..49: note = Hypo
  source 1..49: mol_type = genomic DNA

SEQ ID NO: 114936 - DNA, 230 bp, Homo sapiens; identical to SEQ ID NO: 84317
  misc_feature 1..230: note = chr19:548473-548703
  misc_feature 1..230: note = Hypo
  source 1..230: mol_type = genomic DNA

SEQ ID NO: 114937 - DNA, 737 bp, Homo sapiens; identical to SEQ ID NO: 84318
  misc_feature 1..737: note = chr19:549291-550028
  misc_feature 1..737: note = Hypo
  source 1..737: mol_type = genomic DNA

SEQ ID NO: 114938 - DNA, 134 bp, Homo sapiens; identical to SEQ ID NO: 84319
  misc_feature 1..134: note = chr19:550388-550522
  misc_feature 1..134: note = Hypo
  source 1..134: mol_type = genomic DNA

SEQ ID NO: 114939 - DNA, 42 bp, Homo sapiens; identical to SEQ ID NO: 84320
  misc_feature 1..42: note = chr19:550909-550951
  misc_feature 1..42: note = Hypo
  source 1..42: mol_type = genomic DNA

SEQ ID NO: 114940 - DNA, 105 bp, Homo sapiens; identical to SEQ ID NO: 84321
  misc_feature 1..105: note = chr19:553021-553126
  misc_feature 1..105: note = Hypo
  source 1..105: mol_type = genomic DNA

SEQ ID NO: 114941 - DNA, 20 bp, Homo sapiens
  misc_feature 1..20: note = chr19:555505-555525
  misc_feature 1..20: note = Hypo
  source 1..20: mol_type = genomic DNA
gccaccgtacccagcggaag

SEQ ID NO: 114942 - DNA, 296 bp, Homo sapiens; identical to SEQ ID NO: 84333
  misc_feature 1..296: note = chr19:557059-557355
  misc_feature 1..296: note = Hypo
  source 1..296: mol_type = genomic DNA

SEQ ID NO: 114943 - DNA, 24 bp, Homo sapiens
  misc_feature 1..24: note = chr19:558037-558061
  misc_feature 1..24: note = Hypo
  source 1..24: mol_type = genomic DNA
gatgccaaggtcaggcgccgtcgc

SEQ ID NO: 114944 - DNA, 30 bp, Homo sapiens; identical to SEQ ID NO: 84351
  misc_feature 1..30: note = chr19:559290-559320
  misc_feature 1..30: note = Hypo
  source 1..30: mol_type = genomic DNA

SEQ ID NO: 114945 - DNA, 77 bp, Homo sapiens; identical to SEQ ID NO: 84360
  misc_feature 1..77: note = chr19:559731-559808
  misc_feature 1..77: note = Hypo
  source 1..77: mol_type = genomic DNA

SEQ ID NO: 114946 - DNA, 45 bp, Homo sapiens; identical to SEQ ID NO: 84515
  misc_feature 1..45: note = chr19:582760-582805
  misc_feature 1..45: note = Hypo
  source 1..45: mol_type = genomic DNA

SEQ ID NO: 114947 - DNA, 343 bp, Homo sapiens; identical to SEQ ID NO: 84592
  misc_feature 1..343: note = chr19:591245-591588
  misc_feature 1..343: note = Hyper
  source 1..343: mol_type = genomic DNA

SEQ ID NO: 114948 - DNA, 192 bp, Homo sapiens; identical to SEQ ID NO: 84596
  misc_feature 1..192: note = chr19:592378-592570
  misc_feature 1..192: note = Hypo
  source 1..192: mol_type = genomic DNA

SEQ ID NO: 114949 - DNA, 201 bp, Homo sapiens; identical to SEQ ID NO: 84597
  misc_feature 1..201: note = chr19:593124-593325
  misc_feature 1..201: note = Hypo
  source 1..201: mol_type = genomic DNA

SEQ ID NO: 114950 - DNA, 267 bp, Homo sapiens; identical to SEQ ID NO: 84601
  misc_feature 1..267: note = chr19:599192-599459
  misc_feature 1..267: note = Hypo
  source 1..267: mol_type = genomic DNA

SEQ ID NO: 114951 - DNA, 72 bp, Homo sapiens; identical to SEQ ID NO: 84603
  misc_feature 1..72: note = chr19:601680-601752
  misc_feature 1..72: note = Hypo
  source 1..72: mol_type = genomic DNA

SEQ ID NO: 114952 - DNA, 61 bp, Homo sapiens; identical to SEQ ID NO: 84607
  misc_feature 1..61: note = chr19:602546-602607
  misc_feature 1..61: note = Hypo
  source 1..61: mol_type = genomic DNA

SEQ ID NO: 114953 - DNA, 30 bp, Homo sapiens; identical to SEQ ID NO: 84608
  misc_feature 1..30: note = chr19:603816-603846
  misc_feature 1..30: note = Hypo
  source 1..30: mol_type = genomic DNA

SEQ ID NO: 114954 - DNA, 30 bp, Homo sapiens; identical to SEQ ID NO: 84611
  misc_feature 1..30: note = chr19:617617-617647
  misc_feature 1..30: note = Hypo
  source 1..30: mol_type = genomic DNA

SEQ ID NO: 114955 - DNA, 52 bp, Homo sapiens; identical to SEQ ID NO: 84614
  misc_feature 1..52: note = chr19:623973-624025
  misc_feature 1..52: note = Hypo
  source 1..52: mol_type = genomic DNA

SEQ ID NO: 114956 - DNA, 62 bp, Homo sapiens; identical to SEQ ID NO: 84616
  misc_feature 1..62: note = chr19:629547-629609
  misc_feature 1..62: note = Hypo
  source 1..62: mol_type = genomic DNA

SEQ ID NO: 114957 - DNA, 84 bp, Homo sapiens; identical to SEQ ID NO: 45504
  misc_feature 1..84: note = chr19:634304-634388
  misc_feature 1..84: note = Hypo
  source 1..84: mol_type = genomic DNA

SEQ ID NO: 114958 - DNA, 30 bp, Homo sapiens; identical to SEQ ID NO: 84621
  misc_feature 1..30: note = chr19:635350-635380
  misc_feature 1..30: note = Hypo
  source 1..30: mol_type = genomic DNA

SEQ ID NO: 114959 - DNA, 94 bp, Homo sapiens; identical to SEQ ID NO: 84623
  misc_feature 1..94: note = chr19:638382-638476
  misc_feature 1..94: note = Hypo
  source 1..94: mol_type = genomic DNA

SEQ ID NO: 114960 - DNA, 241 bp, Homo sapiens; identical to SEQ ID NO: 84625
  misc_feature 1..241: note = chr19:639897-640138
  misc_feature 1..241: note = Hyper
  source 1..241: mol_type = genomic DNA

SEQ ID NO: 114961 - DNA, 94 bp, Homo sapiens; identical to SEQ ID NO: 84626
  misc_feature 1..94: note = chr19:640913-641007
  misc_feature 1..94: note = Hypo
  source 1..94: mol_type = genomic DNA

SEQ ID NO: 114962 - DNA, 103 bp, Homo sapiens; identical to SEQ ID NO: 37096
  misc_feature 1..103: note = chr19:661158-661261
  misc_feature 1..103: note = Hyper
  source 1..103: mol_type = genomic DNA

SEQ ID NO: 114963 - DNA, 134 bp, Homo sapiens; identical to SEQ ID NO: 84635
  misc_feature 1..134: note = chr19:661586-661720
  misc_feature 1..134: note = Hyper
  source 1..134: mol_type = genomic DNA

SEQ ID NO: 114964 - DNA, 35 bp, Homo sapiens; identical to SEQ ID NO: 84638
  misc_feature 1..35: note = chr19:676411-676446
  misc_feature 1..35: note = Hyper
  source 1..35: mol_type = genomic DNA

SEQ ID NO: 114965 - DNA, 48 bp, Homo sapiens; identical to SEQ ID NO: 84642
  misc_feature 1..48: note = chr19:689360-689408
  misc_feature 1..48: note = Hypo
  source 1..48: mol_type = genomic DNA

SEQ ID NO: 114966 - DNA, 180 bp, Homo sapiens; identical to SEQ ID NO: 84643
  misc_feature 1..180: note = chr19:696811-696991
  misc_feature 1..180: note = Hypo
  source 1..180: mol_type = genomic DNA

SEQ ID NO: 114967 - DNA, 76 bp, Homo sapiens; identical to SEQ ID NO: 84647
  misc_feature 1..76: note = chr19:704330-704406
  misc_feature 1..76: note = Hyper
  source 1..76: mol_type = genomic DNA

SEQ ID NO: 114968 - DNA, 191 bp, Homo sapiens; identical to SEQ ID NO: 84648
  misc_feature 1..191: note = chr19:709228-709419
  misc_feature 1..191: note = Hyper
  source 1..191: mol_type = genomic DNA

SEQ ID NO: 114969 - DNA, 94 bp, Homo sapiens; identical to SEQ ID NO: 84649
  misc_feature 1..94: note = chr19:709624-709718
  misc_feature 1..94: note = Hyper
  source 1..94: mol_type = genomic DNA

SEQ ID NO: 114970 - DNA, 30 bp, Homo sapiens; identical to SEQ ID NO: 84654
  misc_feature 1..30: note = chr19:724198-724228
  misc_feature 1..30: note = Hypo
  source 1..30: mol_type = genomic DNA

SEQ ID NO: 114971 - DNA, 50 bp, Homo sapiens; identical to SEQ ID NO: 84656
  misc_feature 1..50: note = chr19:727011-727061
  misc_feature 1..50: note = Hypo
  source 1..50: mol_type = genomic DNA

SEQ ID NO: 114972 - DNA, 30 bp, Homo sapiens; identical to SEQ ID NO: 84658
  misc_feature 1..30: note = chr19:743036-743066
  misc_feature 1..30: note = Hypo
  source 1..30: mol_type = genomic DNA

SEQ ID NO: 114973 - DNA, 309 bp, Homo sapiens; identical to SEQ ID NO: 84659
  misc_feature 1..309: note = chr19:748300-748609
  misc_feature 1..309: note = Hypo
  source 1..309: mol_type = genomic DNA

SEQ ID NO: 114974 - DNA, 36 bp, Homo sapiens; identical to SEQ ID NO: 84660
  misc_feature 1..36: note = chr19:750921-750957
  misc_feature 1..36: note = Hypo
  source 1..36: mol_type = genomic DNA

SEQ ID NO: 114975 - DNA, 278 bp, Homo sapiens; identical to SEQ ID NO: 84661
  misc_feature 1..278: note = chr19:752081-752359
  misc_feature 1..278: note = Hypo
  source 1..278: mol_type = genomic DNA

SEQ ID NO: 114976 - DNA, 98 bp, Homo sapiens; identical to SEQ ID NO: 84662
  misc_feature 1..98: note = chr19:752539-752637
  misc_feature 1..98: note = Hypo
  source 1..98: mol_type = genomic DNA

SEQ ID NO: 114977 - DNA, 122 bp, Homo sapiens; identical to SEQ ID NO: 84688
  misc_feature 1..122: note = chr19:793725-793847
  misc_feature 1..122: note = Hypo
  source 1..122: mol_type = genomic DNA

SEQ ID NO: 114978 - DNA, 30 bp, Homo sapiens; identical to SEQ ID NO: 84699
  misc_feature 1..30: note = chr19:803736-803766
  misc_feature 1..30: note = Hypo
  source 1..30: mol_type = genomic DNA

SEQ ID NO: 114979 - DNA, 82 bp, Homo sapiens; identical to SEQ ID NO: 84703
  misc_feature 1..82: note = chr19:807376-807458
  misc_feature 1..82: note = Hypo
  source 1..82: mol_type = genomic DNA

SEQ ID NO: 114980 - DNA, 38 bp, Homo sapiens; identical to SEQ ID NO: 84707
  misc_feature 1..38: note = chr19:811976-812014
  misc_feature 1..38: note = Hypo
  source 1..38: mol_type = genomic DNA

SEQ ID NO: 114981 - DNA, 134 bp, Homo sapiens; identical to SEQ ID NO: 84709
  misc_feature 1..134: note = chr19:813696-813830
  misc_feature 1..134: note = Hypo
  source 1..134: mol_type = genomic DNA

SEQ ID NO: 114982 - DNA, 312 bp, Homo sapiens; identical to SEQ ID NO: 84710
  misc_feature 1..312: note = chr19:814429-814741
  misc_feature 1..312: note = Hypo
  source 1..312: mol_type = genomic DNA

SEQ ID NO: 114983 - DNA, 89 bp, Homo sapiens; identical to SEQ ID NO: 84713
  misc_feature 1..89: note = chr19:815479-815568
  misc_feature 1..89: note = Hypo
  source 1..89: mol_type = genomic DNA

SEQ ID NO: 114984 - DNA, 32 bp, Homo sapiens; identical to SEQ ID NO: 84718
  misc_feature 1..32: note = chr19:821453-821485
  misc_feature 1..32: note = Hyper
  source 1..32: mol_type = genomic DNA

SEQ ID NO: 114985 - DNA, 214 bp, Homo sapiens; identical to SEQ ID NO: 84719
  misc_feature 1..214: note = chr19:821728-821942
  misc_feature 1..214: note = Hyper
  source 1..214: mol_type = genomic DNA

SEQ ID NO: 114986 - DNA, 401 bp, Homo sapiens; identical to SEQ ID NO: 84720
  misc_feature 1..401: note = chr19:822301-822702
  misc_feature 1..401: note = Hyper
  source 1..401: mol_type = genomic DNA

SEQ ID NO: 114987 - DNA, 37 bp, Homo sapiens; identical to SEQ ID NO: 84727
  misc_feature 1..37: note = chr19:850004-850041
  misc_feature 1..37: note = Hypo
  source 1..37: mol_type = genomic DNA

SEQ ID NO: 114988 - DNA, 30 bp, Homo sapiens; identical to SEQ ID NO: 84728
  misc_feature 1..30: note = chr19:851519-851549
  misc_feature 1..30: note = Hypo
  source 1..30: mol_type = genomic DNA

SEQ ID NO: 114989 - DNA, 46 bp, Homo sapiens; identical to SEQ ID NO: 84732
  misc_feature 1..46: note = chr19:869220-869266
  misc_feature 1..46: note = Hypo
  source 1..46: mol_type = genomic DNA

SEQ ID NO: 114990 - DNA, 51 bp, Homo sapiens; identical to SEQ ID NO: 84733
  misc_feature 1..51: note = chr19:870952-871003
  misc_feature 1..51: note = Hypo
  source 1..51: mol_type = genomic DNA

SEQ ID NO: 114991 - DNA, 30 bp, Homo sapiens; identical to SEQ ID NO: 84734
  misc_feature 1..30: note = chr19:877065-877095
  misc_feature 1..30: note = Hypo
  source 1..30: mol_type = genomic DNA

SEQ ID NO: 114992 - DNA, 729 bp, Homo sapiens; identical to SEQ ID NO: 84735
  misc_feature 1..729: note = chr19:883582-884311
  misc_feature 1..729: note = Hypo
  source 1..729: mol_type = genomic DNA

SEQ ID NO: 114993 - DNA, 60 bp, Homo sapiens; identical to SEQ ID NO: 84736
  misc_feature 1..60: note = chr19:885052-885112
  misc_feature 1..60: note = Hypo
  source 1..60: mol_type = genomic DNA

SEQ ID NO: 114994 - DNA, 100 bp, Homo sapiens; identical to SEQ ID NO: 84737
  misc_feature 1..100: note = chr19:891516-891616
  misc_feature 1..100: note = Hypo
  source 1..100: mol_type = genomic DNA

SEQ ID NO: 114995 - DNA, 30 bp, Homo sapiens; identical to SEQ ID NO: 84738
  misc_feature 1..30: note = chr19:892049-892079
  misc_feature 1..30: note = Hypo
  source 1..30: mol_type = genomic DNA

SEQ ID NO: 114996 - DNA, 41 bp, Homo sapiens; identical to SEQ ID NO: 45518
  misc_feature 1..41: note = chr19:893910-893951
  misc_feature 1..41: note = Hypo
  source 1..41: mol_type = genomic DNA

SEQ ID NO: 114997 - DNA, 258 bp, Homo sapiens; identical to SEQ ID NO: 84740
  misc_feature 1..258: note = chr19:900808-901066
  misc_feature 1..258: note = Hypo
  source 1..258: mol_type = genomic DNA

SEQ ID NO: 114998 - DNA, 30 bp, Homo sapiens; identical to SEQ ID NO: 84741
  misc_feature 1..30: note = chr19:911544-911574
  misc_feature 1..30: note = Hypo
  source 1..30: mol_type = genomic DNA

SEQ ID NO: 114999 - DNA, 30 bp, Homo sapiens; identical to SEQ ID NO: 84743
  misc_feature 1..30: note = chr19:919561-919591
  misc_feature 1..30: note = Hyper
  source 1..30: mol_type = genomic DNA

SEQ ID NO: 115000 - DNA, 30 bp, Homo sapiens; identical to SEQ ID NO: 84744
  misc_feature 1..30: note = chr19:920788-920818
  misc_feature 1..30: note = Hyper
  source 1..30: mol_type = genomic DNA

SEQ ID NO: 115001 - DNA, 22 bp, Homo sapiens
  misc_feature 1..22: note = chr19:939412-939434
  misc_feature 1..22: note = Hypo
  source 1..22: mol_type = genomic DNA
ggcctctcgatacacttttggt

SEQ ID NO: 115002 - DNA, 113 bp, Homo sapiens; identical to SEQ ID NO: 45520
  misc_feature 1..113: note = chr19:945999-946112
  misc_feature 1..113: note = Hypo
  source 1..113: mol_type = genomic DNA

SEQ ID NO: 115003 - DNA, 919 bp, Homo sapiens; identical to SEQ ID NO: 84754
  misc_feature 1..919: note = chr19:955719-956638
  misc_feature 1..919: note = Hypo
  source 1..919: mol_type = genomic DNA

SEQ ID NO: 115004 - DNA, 30 bp, Homo sapiens; identical to SEQ ID NO: 84755
  misc_feature 1..30: note = chr19:956878-956908
  misc_feature 1..30: note = Hypo
  source 1..30: mol_type = genomic DNA

SEQ ID NO: 115005 - DNA, 235 bp, Homo sapiens; identical to SEQ ID NO: 84756
  misc_feature 1..235: note = chr19:957166-957401
  misc_feature 1..235: note = Hypo
  source 1..235: mol_type = genomic DNA

SEQ ID NO: 115006 - DNA, 215 bp, Homo sapiens; identical to SEQ ID NO: 84757
  misc_feature 1..215: note = chr19:959587-959802
  misc_feature 1..215: note = Hypo
  source 1..215: mol_type = genomic DNA

SEQ ID NO: 115007 - DNA, 131 bp, Homo sapiens; identical to SEQ ID NO: 84759
  misc_feature 1..131: note = chr19:963944-964075
  misc_feature 1..131: note = Hypo
  source 1..131: mol_type = genomic DNA

SEQ ID NO: 115008 - DNA, 67 bp, Homo sapiens; identical to SEQ ID NO: 84761
  misc_feature 1..67: note = chr19:977345-977412
  misc_feature 1..67: note = Hypo
  source 1..67: mol_type = genomic DNA

SEQ ID NO: 115009 - DNA, 30 bp, Homo sapiens; identical to SEQ ID NO: 84764
  misc_feature 1..30: note = chr19:991396-991426
  misc_feature 1..30: note = Hypo
  source 1..30: mol_type = genomic DNA

SEQ ID NO: 115010 - DNA, 51 bp, Homo sapiens; identical to SEQ ID NO: 84767
  misc_feature 1..51: note = chr19:996004-996055
  misc_feature 1..51: note = Hypo
  source 1..51: mol_type = genomic DNA

SEQ ID NO: 115011 - DNA, 133 bp, Homo sapiens; identical to SEQ ID NO: 82334
  misc_feature 1..133: note = chr19:1000497-1000630
  misc_feature 1..133: note = Hyper
  source 1..133: mol_type = genomic DNA

SEQ ID NO: 115012 - DNA, 681 bp, Homo sapiens; identical to SEQ ID NO: 82337
  misc_feature 1..681: note = chr19:1003156-1003837
  misc_feature 1..681: note = Hypo
  source 1..681: mol_type = genomic DNA

SEQ ID NO: 115013 - DNA, 666 bp, Homo sapiens; identical to SEQ ID NO: 45526
  misc_feature 1..666: note = chr19:1004775-1005441
  misc_feature 1..666: note = Hypo
  source 1..666: mol_type = genomic DNA

SEQ ID NO: 115014 - DNA, 61 bp, Homo sapiens; identical to SEQ ID NO: 82339
  misc_feature 1..61: note = chr19:1007604-1007665
  misc_feature 1..61: note = Hypo
  source 1..61: mol_type = genomic DNA

SEQ ID NO: 115015 - DNA, 33 bp, Homo sapiens; identical to SEQ ID NO: 82340
  misc_feature 1..33: note = chr19:1007908-1007941
  misc_feature 1..33: note = Hypo
  source 1..33: mol_type = genomic DNA

SEQ ID NO: 115016 - DNA, 193 bp, Homo sapiens; identical to SEQ ID NO: 82350
  misc_feature 1..193: note = chr19:1030032-1030225
  misc_feature 1..193: note = Hypo
  source 1..193: mol_type = genomic DNA

SEQ ID NO: 115017 - DNA, 30 bp, Homo sapiens; identical to SEQ ID NO: 82368
  misc_feature 1..30: note = chr19:1041553-1041583
  misc_feature 1..30: note = Hypo
  source 1..30: mol_type = genomic DNA

SEQ ID NO: 115018 - DNA, 73 bp, Homo sapiens; identical to SEQ ID NO: 82369
  misc_feature 1..73: note = chr19:1041801-1041874
  misc_feature 1..73: note = Hypo
  source 1..73: mol_type = genomic DNA

SEQ ID NO: 115019 - DNA, 56 bp, Homo sapiens; identical to SEQ ID NO: 45528
  misc_feature 1..56: note = chr19:1042258-1042314
  misc_feature 1..56: note = Hypo
  source 1..56: mol_type = genomic DNA

SEQ ID NO: 115020 - DNA, 92 bp, Homo sapiens; identical to SEQ ID NO: 82371
  misc_feature 1..92: note = chr19:1047836-1047928
  misc_feature 1..92: note = Hypo
  source 1..92: mol_type = genomic DNA

SEQ ID NO: 115021 - DNA, 386 bp, Homo sapiens; identical to SEQ ID NO: 82373
  misc_feature 1..386: note = chr19:1051207-1051593
  misc_feature 1..386: note = Hypo
  source 1..386: mol_type = genomic DNA

SEQ ID NO: 115022 - DNA, 138 bp, Homo sapiens; identical to SEQ ID NO: 82374
  misc_feature 1..138: note = chr19:1051881-1052019
  misc_feature 1..138: note = Hypo
  source 1..138: mol_type = genomic DNA

SEQ ID NO: 115023 - DNA, 36 bp, Homo sapiens; identical to SEQ ID NO: 82398
  misc_feature 1..36: note = chr19:1080710-1080746
  misc_feature 1..36: note = Hypo
  source 1..36: mol_type = genomic DNA

SEQ ID NO: 115024 - DNA, 36 bp, Homo sapiens; identical to SEQ ID NO: 82400
  misc_feature 1..36: note = chr19:1082973-1083009
  misc_feature 1..36: note = Hypo
  source 1..36: mol_type = genomic DNA

SEQ ID NO: 115025 - DNA, 30 bp, Homo sapiens; identical to SEQ ID NO: 82401
  misc_feature 1..30: note = chr19:1083466-1083496
  misc_feature 1..30: note = Hypo
  source 1..30: mol_type = genomic DNA

SEQ ID NO: 115026 - DNA, 30 bp, Homo sapiens; identical to SEQ ID NO: 82402
  misc_feature 1..30: note = chr19:1083719-1083749
  misc_feature 1..30: note = Hypo
  source 1..30: mol_type = genomic DNA

SEQ ID NO: 115027 - DNA, 185 bp, Homo sapiens; identical to SEQ ID NO: 82404
  misc_feature 1..185: note = chr19:1085976-1086161
  misc_feature 1..185: note = Hypo
  source 1..185: mol_type = genomic DNA

SEQ ID NO: 115028 - DNA, 186 bp, Homo sapiens; identical to SEQ ID NO: 45533
  misc_feature 1..186: note = chr19:1105541-1105727
  misc_feature 1..186: note = Hypo
  source 1..186: mol_type = genomic DNA

SEQ ID NO: 115029 - DNA, 508 bp, Homo sapiens; identical to SEQ ID NO: 82421
  misc_feature 1..508: note = chr19:1112253-1112761
  misc_feature 1..508: note = Hypo
  source 1..508: mol_type = genomic DNA

SEQ ID NO: 115030 - DNA, 405 bp, Homo sapiens; identical to SEQ ID NO: 82424
  misc_feature 1..405: note = chr19:1113252-1113657
  misc_feature 1..405: note = Hyper
  source 1..405: mol_type = genomic DNA

SEQ ID NO: 115031 - DNA, 82 bp, Homo sapiens; identical to SEQ ID NO: 82426
  misc_feature 1..82: note = chr19:1123343-1123425
  misc_feature 1..82: note = Hypo
  source 1..82: mol_type = genomic DNA

SEQ ID NO: 115032 - DNA, 69 bp, Homo sapiens; identical to SEQ ID NO: 82438
  misc_feature 1..69: note = chr19:1156214-1156283
  misc_feature 1..69: note = Hypo
  source 1..69: mol_type = genomic DNA

SEQ ID NO: 115033 - DNA, 104 bp, Homo sapiens; identical to SEQ ID NO: 82439
  misc_feature 1..104: note = chr19:1156524-1156628
  misc_feature 1..104: note = Hypo
  source 1..104: mol_type = genomic DNA

SEQ ID NO: 115034 - DNA, 42 bp, Homo sapiens; identical to SEQ ID NO: 82441
  misc_feature 1..42: note = chr19:1157959-1158001
  misc_feature 1..42: note = Hypo
  source 1..42: mol_type = genomic DNA

SEQ ID NO: 115035 - DNA, 117 bp, Homo sapiens; identical to SEQ ID NO: 82449
  misc_feature 1..117: note = chr19:1167208-1167325
  misc_feature 1..117: note = Hypo
  source 1..117: mol_type = genomic DNA

SEQ ID NO: 115036 - DNA, 45 bp, Homo sapiens; identical to SEQ ID NO: 82451
  misc_feature 1..45: note = chr19:1170185-1170230
  misc_feature 1..45: note = Hypo
  source 1..45: mol_type = genomic DNA

SEQ ID NO: 115037 - DNA, 142 bp, Homo sapiens; identical to SEQ ID NO: 82452
  misc_feature 1..142: note = chr19:1170687-1170829
  misc_feature 1..142: note = Hypo
  source 1..142: mol_type = genomic DNA

SEQ ID NO: 115038 - DNA, 354 bp, Homo sapiens; identical to SEQ ID NO: 45539
  misc_feature 1..354: note = chr19:1171068-1171422
  misc_feature 1..354: note = Hypo
  source 1..354: mol_type = genomic DNA

SEQ ID NO: 115039 - DNA, 99 bp, Homo sapiens; identical to SEQ ID NO: 82456
  misc_feature 1..99: note = chr19:1181413-1181512
  misc_feature 1..99: note = Hypo
  source 1..99: mol_type = genomic DNA

SEQ ID NO: 115040 - DNA, 30 bp, Homo sapiens; identical to SEQ ID NO: 45540
  misc_feature 1..30: note = chr19:1208940-1208970
  misc_feature 1..30: note = Hypo
  source 1..30: mol_type = genomic DNA

SEQ ID NO: 115041 - DNA, 322 bp, Homo sapiens; identical to SEQ ID NO: 82478
  misc_feature 1..322: note = chr19:1220427-1220749
  misc_feature 1..322: note = Hypo
  source 1..322: mol_type = genomic DNA

SEQ ID NO: 115042 - DNA, 30 bp, Homo sapiens; identical to SEQ ID NO: 82479
  misc_feature 1..30: note = chr19:1221029-1221059
  misc_feature 1..30: note = Hypo
  source 1..30: mol_type = genomic DNA

SEQ ID NO: 115043 - DNA, 141 bp, Homo sapiens; identical to SEQ ID NO: 82482
  misc_feature 1..141: note = chr19:1226687-1226828
  misc_feature 1..141: note = Hypo
  source 1..141: mol_type = genomic DNA

SEQ ID NO: 115044 - DNA, 190 bp, Homo sapiens; identical to SEQ ID NO: 82485
  misc_feature 1..190: note = chr19:1227469-1227659
  misc_feature 1..190: note = Hypo
  source 1..190: mol_type = genomic DNA

SEQ ID NO: 115045 - DNA, 281 bp, Homo sapiens; identical to SEQ ID NO: 82486
  misc_feature 1..281: note = chr19:1227891-1228172
  misc_feature 1..281: note = Hypo
  source 1..281: mol_type = genomic DNA

SEQ ID NO: 115046 - DNA, 106 bp, Homo sapiens; identical to SEQ ID NO: 82490
  misc_feature 1..106: note = chr19:1231206-1231312
  misc_feature 1..106: note = Hypo
  source 1..106: mol_type = genomic DNA

SEQ ID NO: 115047 - DNA, 30 bp, Homo sapiens; identical to SEQ ID NO: 82491
  misc_feature 1..30: note = chr19:1234436-1234466
  misc_feature 1..30: note = Hypo
  source 1..30: mol_type = genomic DNA

SEQ ID NO: 115048 - DNA, 484 bp, Homo sapiens; identical to SEQ ID NO: 82492
  misc_feature 1..484: note = chr19:1234905-1235389
  misc_feature 1..484: note = Hypo
  source 1..484: mol_type = genomic DNA

SEQ ID NO: 115049 - DNA, 306 bp, Homo sapiens; identical to SEQ ID NO: 82493
  misc_feature 1..306: note = chr19:1236238-1236544
  misc_feature 1..306: note = Hypo
  source 1..306: mol_type = genomic DNA

SEQ ID NO: 115050 - DNA, 104 bp, Homo sapiens; identical to SEQ ID NO: 82496
  misc_feature 1..104: note = chr19:1257622-1257726
  misc_feature 1..104: note = Hypo
  source 1..104: mol_type = genomic DNA

SEQ ID NO: 115051 - DNA, 30 bp, Homo sapiens; identical to SEQ ID NO: 82499
  misc_feature 1..30: note = chr19:1268427-1268457
  misc_feature 1..30: note = Hypo
  source 1..30: mol_type = genomic DNA

SEQ ID NO: 115052 - DNA, 30 bp, Homo sapiens; identical to SEQ ID NO: 82500
  misc_feature 1..30: note = chr19:1271429-1271459
  misc_feature 1..30: note = Hypo
  source 1..30: mol_type = genomic DNA

SEQ ID NO: 115053 - DNA, 83 bp, Homo sapiens; identical to SEQ ID NO: 82501
  misc_feature 1..83: note = chr19:1274044-1274127
  misc_feature 1..83: note = Hypo
  source 1..83: mol_type = genomic DNA

SEQ ID NO: 115054 - DNA, 250 bp, Homo sapiens; identical to SEQ ID NO: 82502
  misc_feature 1..250: note = chr19:1274641-1274891
  misc_feature 1..250: note = Hypo
  source 1..250: mol_type = genomic DNA

SEQ ID NO: 115055 - DNA, 30 bp, Homo sapiens; identical to SEQ ID NO: 82509
  misc_feature 1..30: note = chr19:1288467-1288497
  misc_feature 1..30: note = Hypo
  source 1..30: mol_type = genomic DNA

SEQ ID NO: 115056 - DNA, 398 bp, Homo sapiens; identical to SEQ ID NO: 82510
  misc_feature 1..398: note = chr19:1289167-1289565
  misc_feature 1..398: note = Hypo
  source 1..398: mol_type = genomic DNA

SEQ ID NO: 115057 - DNA, 108 bp, Homo sapiens; identical to SEQ ID NO: 82511
  misc_feature 1..108: note = chr19:1290482-1290590
  misc_feature 1..108: note = Hypo
  source 1..108: mol_type = genomic DNA

SEQ ID NO: 115058 - DNA, 30 bp, Homo sapiens; identical to SEQ ID NO: 82513
  misc_feature 1..30: note = chr19:1291641-1291671
  misc_feature 1..30: note = Hypo
  source 1..30: mol_type = genomic DNA

SEQ ID NO: 115059 - DNA, 101 bp, Homo sapiens; identical to SEQ ID NO: 82515
  misc_feature 1..101: note = chr19:1293979-1294080
  misc_feature 1..101: note = Hypo
  source 1..101: mol_type = genomic DNA

SEQ ID NO: 115060 - DNA, 30 bp, Homo sapiens; identical to SEQ ID NO: 82519
  misc_feature 1..30: note = chr19:1294903-1294933
  misc_feature 1..30: note = Hypo
  source 1..30: mol_type = genomic DNA

SEQ ID NO: 115061 - DNA, 30 bp, Homo sapiens
  misc_feature 1..30: note = chr19:1295767-1295797
  misc_feature 1..30: note = Hyper
  source 1..30: mol_type = genomic DNA
ggccgctcaagttctcggagaagttccagc

SEQ ID NO: 115062 - DNA, 45 bp, Homo sapiens; identical to SEQ ID NO: 82530
  misc_feature 1..45: note = chr19:1301300-1301345
  misc_feature 1..45: note = Hypo
  source 1..45: mol_type = genomic DNA

SEQ ID NO: 115063 - DNA, 30 bp, Homo sapiens; identical to SEQ ID NO: 82532
  misc_feature 1..30: note = chr19:1306675-1306705
  misc_feature 1..30: note = Hypo
  source 1..30: mol_type = genomic DNA

SEQ ID NO: 115064 - DNA, 200 bp, Homo sapiens; identical to SEQ ID NO: 82534
  misc_feature 1..200: note = chr19:1308145-1308345
  misc_feature 1..200: note = Hypo
  source 1..200: mol_type = genomic DNA

SEQ ID NO: 115065 - DNA, 30 bp, Homo sapiens; identical to SEQ ID NO: 82536
  misc_feature 1..30: note = chr19:1310520-1310550
  misc_feature 1..30: note = Hypo
  source 1..30: mol_type = genomic DNA

SEQ ID NO: 115066 - DNA, 140 bp, Homo sapiens; identical to SEQ ID NO: 82539
  misc_feature 1..140: note = chr19:1311273-1311413
  misc_feature 1..140: note = Hypo
  source 1..140: mol_type = genomic DNA

SEQ ID NO: 115067 - DNA, 209 bp, Homo sapiens; identical to SEQ ID NO: 82549
  misc_feature 1..209: note = chr19:1325788-1325997
  misc_feature 1..209: note = Hypo
  source 1..209: mol_type = genomic DNA

SEQ ID NO: 115068 - DNA, 148 bp, Homo sapiens; identical to SEQ ID NO: 82550
  misc_feature 1..148: note = chr19:1329407-1329555
  misc_feature 1..148: note = Hypo
  source 1..148: mol_type = genomic DNA

SEQ ID NO: 115069 - DNA, 109 bp, Homo sapiens; identical to SEQ ID NO: 82553
  misc_feature 1..109: note = chr19:1339058-1339167
  misc_feature 1..109: note = Hypo
  source 1..109: mol_type = genomic DNA

SEQ ID NO: 115070 - DNA, 85 bp, Homo sapiens; identical to SEQ ID NO: 82555
  misc_feature 1..85: note = chr19:1340897-1340982
  misc_feature 1..85: note = Hypo
  source 1..85: mol_type = genomic DNA

SEQ ID NO: 115071 - DNA, 115 bp, Homo sapiens; identical to SEQ ID NO: 82556
  misc_feature 1..115: note = chr19:1357669-1357784
  misc_feature 1..115: note = Hypo
  source 1..115: mol_type = genomic DNA

SEQ ID NO: 115072 - DNA, 30 bp, Homo sapiens; identical to SEQ ID NO: 82562
  misc_feature 1..30: note = chr19:1379073-1379103
  misc_feature 1..30: note = Hypo
  source 1..30: mol_type = genomic DNA

SEQ ID NO: 115073 - DNA, 30 bp, Homo sapiens; identical to SEQ ID NO: 82563
  misc_feature 1..30: note = chr19:1379390-1379420
  misc_feature 1..30: note = Hypo
  source 1..30: mol_type = genomic DNA

SEQ ID NO: 115074 - DNA, 124 bp, Homo sapiens; identical to SEQ ID NO: 82571
  misc_feature 1..124: note = chr19:1401700-1401824
  misc_feature 1..124: note = Hyper
  source 1..124: mol_type = genomic DNA

SEQ ID NO: 115075 - DNA, 20 bp, Homo sapiens
  misc_feature 1..20: note = chr19:1403814-1403834
  misc_feature 1..20: note = Hypo
  source 1..20: mol_type = genomic DNA
gaacccgggaggcggaggtt

SEQ ID NO: 115076 - DNA, 40 bp, Homo sapiens; identical to SEQ ID NO: 45555
  misc_feature 1..40: note = chr19:1409921-1409961
  misc_feature 1..40: note = Hypo
  source 1..40: mol_type = genomic DNA

SEQ ID NO: 115077 - DNA, 39 bp, Homo sapiens; identical to SEQ ID NO: 45556
  misc_feature 1..39: note = chr19:1424255-1424294
  misc_feature 1..39: note = Hypo
  source 1..39: mol_type = genomic DNA

SEQ ID NO: 115078 - DNA, 30 bp, Homo sapiens; identical to SEQ ID NO: 45557
  misc_feature 1..30: note = chr19:1437261-1437291
  misc_feature 1..30: note = Hypo
  source 1..30: mol_type = genomic DNA

SEQ ID NO: 115079 - DNA, 91 bp, Homo sapiens; identical to SEQ ID NO: 82586
  misc_feature 1..91: note = chr19:1440112-1440203
  misc_feature 1..91: note = Hypo
  source 1..91: mol_type = genomic DNA

SEQ ID NO: 115080 - DNA, 30 bp, Homo sapiens; identical to SEQ ID NO: 82587
  misc_feature 1..30: note = chr19:1440545-1440575
  misc_feature 1..30: note = Hypo
  source 1..30: mol_type = genomic DNA

SEQ ID NO: 115081 - DNA, 30 bp, Homo sapiens; identical to SEQ ID NO: 82588
  misc_feature 1..30: note = chr19:1442939-1442969
  misc_feature 1..30: note = Hypo
  source 1..30: mol_type = genomic DNA

SEQ ID NO: 115082 - DNA, 44 bp, Homo sapiens; identical to SEQ ID NO: 82589
  misc_feature 1..44: note = chr19:1445113-1445157
  misc_feature 1..44: note = Hyper
  source 1..44: mol_type = genomic DNA

SEQ ID NO: 115083 - DNA, 648 bp, Homo sapiens; identical to SEQ ID NO: 82590
  misc_feature 1..648: note = chr19:1446431-1447079
  misc_feature 1..648: note = Hyper
  source 1..648: mol_type = genomic DNA

SEQ ID NO: 115084 - DNA, 454 bp, Homo sapiens; identical to SEQ ID NO: 82591
  misc_feature 1..454: note = chr19:1450041-1450495
  misc_feature 1..454: note = Hyper
  source 1..454: mol_type = genomic DNA

SEQ ID NO: 115085 - DNA, 281 bp, Homo sapiens
  misc_feature 1..281: note = chr19:1455211-1455492
  misc_feature 1..281: note = Hyper
  source 1..281: mol_type = genomic DNA
cagggcctgtccaagcgcctggacgagctgccgcacgtggagacggtgagccggccggggagccagggggcagcgcgcccgccccactcagggtgcgggaagcggcgtgggggaggaacggggcctggcccgggcgcccctcaccgtggcccgcccgcctgcctttgccagcagttctcgatgcagatggacctgatccggcagcagcttgagttcgaggcccagcacatccgctcgctgatggaggagcgcttcggcacctcggacgagatggtgcagcg

SEQ ID NO: 115086 - DNA, 30 bp, Homo sapiens; identical to SEQ ID NO: 82599
  misc_feature 1..30: note = chr19:1461213-1461243
  misc_feature 1..30: note = Hypo
  source 1..30: mol_type = genomic DNA

SEQ ID NO: 115087 - DNA, 1179 bp, Homo sapiens
  misc_feature 1..1179: note = chr19:1467196-1468375
  misc_feature 1..1179: note = Hyper
  source 1..1179: mol_type = genomic DNA
ggcctgccccgagcgcggcgggggcgccgggggcgccggcctccactttgcagggcaccggcggcgggaggaggggccggcgcccacgggttctcgccctcgcggcgccgcggaccaggagctggaactgctgcgggagtgcctgggagccgccgtgcctgcccggctgcgcaaggtggcctccgcgctggtgccaggtcgccgcgcactccccgtgcccgtctacatgttggtgcccgccccggccccggcccaggaggacgactcctgcactgactccgcggagggcacgccggtcaacttctctagcgccgcctcgctcagcgacgagacgctgcagggaccccccagggaccagcccgggggaccagcgggcaggcaaagacccaccggccgccccacctctgccagacaggccatggggcaccggcacaaggcgggaggcgccggccgcagcgcggagcagtctcggggcgcgggcaagaacagagcagggctggagctgcccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggccccccgtgtctggcctgcggcgccgcaagccccgagccacccggctggatgagcggcccgcagaggggtcccgggaacgcggcgaggaggcagcgggctcggaccgggcctccgacctggatagcgtggagtggcgcgccatccaggaggg

SEQ ID NO: 115088 - DNA, 1090 bp, Homo sapiens
  misc_feature 1..1090: note = chr19:1468649-1469739
  misc_feature 1..1090: note = Hyper
  source 1..1090: mol_type = genomic DNA
gtgccagctgtgctccggggacgaacagtgatctacgtccccagcccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccgggggcgcgcgggggccgcctgggcctggtgcgtgtggcctcagccctctccagcggcagcgagtcctccgaccgctcgggcttccggcgacagctaaccttcatcaaggagtcgccgggcttgcggcgccgccgctccgagctgtcctcggccgagtccgcggcctctgccccccagggcgcctcgccccgccgcggccggcccgcgctgcccgccgtcttcctctgctcctcgcgctgcgaagagctccgagcggcaccccggcagggcccggccccggcccggcagcggccccccgcggcccgacccagccctggcgagcgccctgcccggcgcaccacctccgagagcccgtcccgcctgcctgtgcgcgcgcccgccgcccggccggagactgtcaagcgctacgcgtcgctgccgcacatcagcgtggcccgcaggcccgacggcgccgtccccgcggcccctgcctcagccgacgccgcgcgccgcagcagcgacggggagccccggccgctccccagggtggccgcgccgggcacgacctggc

SEQ ID NO: 115089 - DNA, 46 bp, Homo sapiens; identical to SEQ ID NO: 82607
  misc_feature 1..46: note = chr19:1471164-1471210
  misc_feature 1..46: note = Hyper
  source 1..46: mol_type = genomic DNA

SEQ ID NO: 115090 - DNA, 841 bp, Homo sapiens; identical to SEQ ID NO: 82609
  misc_feature 1..841: note = chr19:1481985-1482826
  misc_feature 1..841: note = Hypo
  source 1..841: mol_type = genomic DNA

SEQ ID NO: 115091 - DNA, 49 bp, Homo sapiens; identical to SEQ ID NO: 82615
  misc_feature 1..49: note = chr19:1491380-1491429
  misc_feature 1..49: note = Hyper
  source 1..49: mol_type = genomic DNA

SEQ ID NO: 115092 - DNA, 399 bp, Homo sapiens; identical to SEQ ID NO: 82616
  misc_feature 1..399: note = chr19:1495001-1495400
  misc_feature 1..399: note = Hypo
  source 1..399: mol_type = genomic DNA

SEQ ID NO: 115093 - DNA, 30 bp, Homo sapiens; identical to SEQ ID NO: 82617
  misc_feature 1..30: note = chr19:1495607-1495637
  misc_feature 1..30: note = Hypo
  source 1..30: mol_type = genomic DNA

SEQ ID NO: 115094 - DNA, 332 bp, Homo sapiens; identical to SEQ ID NO: 82618
  misc_feature 1..332: note = chr19:1496340-1496672
  misc_feature 1..332: note = Hypo
  source 1..332: mol_type = genomic DNA

SEQ ID NO: 115095 - DNA, 152 bp, Homo sapiens; identical to SEQ ID NO: 82619
  misc_feature 1..152: note = chr19:1496732-1496884
  misc_feature 1..152: note = Hypo
  source 1..152: mol_type = genomic DNA

SEQ ID NO: 115096 - DNA, 73 bp, Homo sapiens; identical to SEQ ID NO: 82625
  misc_feature 1..73: note = chr19:1516288-1516361
  misc_feature 1..73: note = Hypo
  source 1..73: mol_type = genomic DNA

SEQ ID NO: 115097 - DNA, 30 bp, Homo sapiens; identical to SEQ ID NO: 82628
  misc_feature 1..30: note = chr19:1522696-1522726
  misc_feature 1..30: note = Hypo
  source 1..30: mol_type = genomic DNA

SEQ ID NO: 115098 - DNA, 256 bp, Homo sapiens
  misc_feature 1..256: note = chr19:1523753-1524009
  misc_feature 1..256: note = Hyper
  source 1..256: mol_type = genomic DNA
gcccccaaccccccacgcgcgagagagcctcagtttcccgctcggtaaagcgggcgtatcagcggttcccagccagcccgggtgtgcagggtcggaggagctcgcgggctgagcgcggcccctggcgcccggttggcgtgcgggactcgggcgcgctctggtccgtggaacttccccagccgcggcgtccccgccgctcacgcgccccccactccacggccgggcacctcccgcccctccccgggctggacctgcg

SEQ ID NO: 115099 - DNA, 345 bp, Homo sapiens
  misc_feature 1..345: note = chr19:1524223-1524568
  misc_feature 1..345: note = Hyper
  source 1..345: mol_type = genomic DNA
gcgcgggaagctgatcggcaaggtgggaggcccgcgccccgagtccgcgacggggccggaccgggctgggctggggtcccggggcgcgcgggcgatcctgcgcggtctacgcggcgcgtccctgcgagcgcggggtctggagcgggcgcgcgtccggagccgcggggcctcccgtgcggggtttcgcatggcgggaaccgtgttgagcgcgctgtgcgtcgtgtccgtgggttgcgtgtccggggtgtgggcgtgcggctcggcctcgggatgcgacgctgtgttgcccctgggtgtgtgtgcgagcctggcgagggtctgagtgtgccgcgtctgtgcccgctg

SEQ ID NO: 115100 - DNA, 32 bp, Homo sapiens; identical to SEQ ID NO: 82632
  misc_feature 1..32: note = chr19:1525191-1525223
  misc_feature 1..32: note = Hypo
  source 1..32: mol_type = genomic DNA

SEQ ID NO: 115101 - DNA, 364 bp, Homo sapiens; identical to SEQ ID NO: 82633
  misc_feature 1..364: note = chr19:1525617-1525981
  misc_feature 1..364: note = Hypo
  source 1..364: mol_type = genomic DNA

SEQ ID NO: 115102 - DNA, 305 bp, Homo sapiens; identical to SEQ ID NO: 82634
  misc_feature 1..305: note = chr19:1526247-1526552
  misc_feature 1..305: note = Hypo
  source 1..305: mol_type = genomic DNA

SEQ ID NO: 115103 - DNA, 147 bp, Homo sapiens; identical to SEQ ID NO: 82635
  misc_feature 1..147: note = chr19:1527160-1527307
  misc_feature 1..147: note = Hypo
  source 1..147: mol_type = genomic DNA

SEQ ID NO: 115104 - DNA, 115 bp, Homo sapiens; identical to SEQ ID NO: 82637
  misc_feature 1..115: note = chr19:1528065-1528180
  misc_feature 1..115: note = Hypo
  source 1..115: mol_type = genomic DNA

SEQ ID NO: 115105 - DNA, 48 bp, Homo sapiens; identical to SEQ ID NO: 82647
  misc_feature 1..48: note = chr19:1533726-1533774
  misc_feature 1..48: note = Hypo
  source 1..48: mol_type = genomic DNA

SEQ ID NO: 115106 - DNA, 33 bp, Homo sapiens; identical to SEQ ID NO: 82653
  misc_feature 1..33: note = chr19:1546860-1546893
  misc_feature 1..33: note = Hypo
  source 1..33: mol_type = genomic DNA

SEQ ID NO: 115107 - DNA, 62 bp, Homo sapiens; identical to SEQ ID NO: 82662
  misc_feature 1..62: note = chr19:1565891-1565953
  misc_feature 1..62: note = Hypo
  source 1..62: mol_type = genomic DNA

SEQ ID NO: 115108 - DNA, 30 bp, Homo sapiens; identical to SEQ ID NO: 82663
  misc_feature 1..30: note = chr19:1567524-1567554
  misc_feature 1..30: note = Hyper
  source 1..30: mol_type = genomic DNA

SEQ ID NO: 115109 - DNA, 45 bp, Homo sapiens; identical to SEQ ID NO: 82664
  misc_feature 1..45: note = chr19:1569221-1569266
  misc_feature 1..45: note = Hypo
  source 1..45: mol_type = genomic DNA

SEQ ID NO: 115110 - DNA, 33 bp, Homo sapiens; identical to SEQ ID NO: 82666
  misc_feature 1..33: note = chr19:1577654-1577687
  misc_feature 1..33: note = Hypo
  source 1..33: mol_type = genomic DNA

SEQ ID NO: 115111 - DNA, 269 bp, Homo sapiens; identical to SEQ ID NO: 82667
  misc_feature 1..269: note = chr19:1578234-1578503
  misc_feature 1..269: note = Hypo
  source 1..269: mol_type = genomic DNA

SEQ ID NO: 115112 - DNA, 49 bp, Homo sapiens; identical to SEQ ID NO: 45568
  misc_feature 1..49: note = chr19:1654563-1654612
  misc_feature 1..49: note = Hypo
  source 1..49: mol_type = genomic DNA

SEQ ID NO: 115113 - DNA, 40 bp, Homo sapiens; identical to SEQ ID NO: 82677
  misc_feature 1..40: note = chr19:1657945-1657985
  misc_feature 1..40: note = Hypo
  source 1..40: mol_type = genomic DNA

SEQ ID NO: 115114 - DNA, 135 bp, Homo sapiens; identical to SEQ ID NO: 82683
  misc_feature 1..135: note = chr19:1667706-1667841
  misc_feature 1..135: note = Hyper
  source 1..135: mol_type = genomic DNA

SEQ ID NO: 115115 - DNA, 201 bp, Homo sapiens; identical to SEQ ID NO: 82686
  misc_feature 1..201: note = chr19:1672902-1673103
  misc_feature 1..201: note = Hypo
  source 1..201: mol_type = genomic DNA

SEQ ID NO: 115116 - DNA, 84 bp, Homo sapiens; identical to SEQ ID NO: 82687
  misc_feature 1..84: note = chr19:1676120-1676204
  misc_feature 1..84: note = Hyper
  source 1..84: mol_type = genomic DNA

SEQ ID NO: 115117 - DNA, 48 bp, Homo sapiens; identical to SEQ ID NO: 82689
  misc_feature 1..48: note = chr19:1699130-1699178
  misc_feature 1..48: note = Hypo
  source 1..48: mol_type = genomic DNA

SEQ ID NO: 115118 - DNA, 96 bp, Homo sapiens; identical to SEQ ID NO: 82690
  misc_feature 1..96: note = chr19:1699504-1699600
  misc_feature 1..96: note = Hypo
  source 1..96: mol_type = genomic DNA

SEQ ID NO: 115119 - DNA, 90 bp, Homo sapiens; identical to SEQ ID NO: 82700
  misc_feature 1..90: note = chr19:1718840-1718930
  misc_feature 1..90: note = Hyper
  source 1..90: mol_type = genomic DNA

SEQ ID NO: 115120 - DNA, 32 bp, Homo sapiens; identical to SEQ ID NO: 82701
  misc_feature 1..32: note = chr19:1719135-1719167
  misc_feature 1..32: note = Hyper
  source 1..32: mol_type = genomic DNA

SEQ ID NO: 115121 - DNA, 682 bp, Homo sapiens
  misc_feature 1..682: note = chr19:1725526-1726208
  misc_feature 1..682: note = Hyper
  source 1..682: mol_type = genomic DNA
ggaggctccgcggcgcggtcccgcaggcgggaggcgatgctgccgacgctattgctgccattactattacggagagatggggcggggcgggagcaccgggcccttcccggaagcccttcctgagcttattcagtgcctggggccgcggcgatcgatgacagctgggcgccggccgagccccctccgggccgcgcgggggcgcatgcgcggggccgcgggatcgatcggccgcgctcgggcctccccgcacccgcccgaccccgcccccccggctcgttgcccggcaacctctgcccggcgcgctcccattggctggcggcggcccgggccccggccgcgcgtggtcacttggtcagcgcgggctcggcgtggccgggggcctggctccgggcgcgggtcgatgccgcctcgcatctgacctttcccggcgcggggagggggcccgagaggatggagagagctggaccatcttggaagaaaactttattgacccgtctcttatcttggggacgcacggttccagcggcggggggcgagggtacggctgggtgggggcaggggcggccaggaccttcctcccggacatgcacggaccccctgaccgccgccccggccatctccctgggcgggctgctctccattccctagacaggaaaattgaggctcacgagggcccggggat

SEQ ID NO: 115122 - DNA, 86 bp, Homo sapiens; identical to SEQ ID NO: 82705
  misc_feature 1..86: note = chr19:1729190-1729276
  misc_feature 1..86: note = Hypo
  source 1..86: mol_type = genomic DNA

SEQ ID NO: 115123 - DNA, 65 bp, Homo sapiens; identical to SEQ ID NO: 82718
  misc_feature 1..65: note = chr19:1746791-1746856
  misc_feature 1..65: note = Hyper
  source 1..65: mol_type = genomic DNA

SEQ ID NO: 115124 - DNA, 60 bp, Homo sapiens; identical to SEQ ID NO: 82719
  misc_feature 1..60: note = chr19:1748879-1748939
  misc_feature 1..60: note = Hyper
  source 1..60: mol_type = genomic DNA

SEQ ID NO: 115125 - DNA, 30 bp, Homo sapiens; identical to SEQ ID NO: 82720
  misc_feature 1..30: note = chr19:1749288-1749318
  misc_feature 1..30: note = Hyper
  source 1..30: mol_type = genomic DNA

SEQ ID NO: 115126 - DNA, 38 bp, Homo sapiens; identical to SEQ ID NO: 82721
  misc_feature 1..38: note = chr19:1749518-1749556
  misc_feature 1..38: note = Hyper
  source 1..38: mol_type = genomic DNA

SEQ ID NO: 115127 - DNA, 415 bp, Homo sapiens; identical to SEQ ID NO: 37107
  misc_feature 1..415: note = chr19:1749776-1750191
  misc_feature 1..415: note = Hyper
  source 1..415: mol_type = genomic DNA

SEQ ID NO: 115128 - DNA, 88 bp, Homo sapiens; identical to SEQ ID NO: 82724
  misc_feature 1..88: note = chr19:1751409-1751497
  misc_feature 1..88: note = Hyper
  source 1..88: mol_type = genomic DNA

SEQ ID NO: 115129 - DNA, 36 bp, Homo sapiens; identical to SEQ ID NO: 37108
  misc_feature 1..36: note = chr19:1752836-1752872
  misc_feature 1..36: note = Hyper
  source 1..36: mol_type = genomic DNA

SEQ ID NO: 115130 - DNA, 1448 bp, Homo sapiens
  misc_feature 1..1448: note = chr19:1753502-1754950
  misc_feature 1..1448: note = Hyper
  source 1..1448: mol_type = genomic DNA
ccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctcatgcgcgacgagcgggcggcgctcgcctccgtgggccacctctacggaccctacggcaaggagctgcccgccatggggtcgccgctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgctgcgcaaccccaagccgtggagcaagctcaaatccggccgcgagaccttccgcaggatgtggaagtggctgcaggagccagagttccagcgcatgtcggcgctgcgcttggcaggtaggagcgtggcgcgcagggccagaccctgggggcgccggctctggactcccgagcacctagcggggcggcggccgatgcccggggccagcgcccc

SEQ ID NO: 115131 - DNA, 50 bp, Homo sapiens; identical to SEQ ID NO: 82729
  misc_feature 1..50: note = chr19:1755177-1755227
  misc_feature 1..50: note = Hyper
  source 1..50: mol_type = genomic DNA

SEQ ID NO: 115132 - DNA, 62 bp, Homo sapiens; identical to SEQ ID NO: 82731
  misc_feature 1..62: note = chr19:1755964-1756026
  misc_feature 1..62: note = Hyper
  source 1..62: mol_type = genomic DNA

SEQ ID NO: 115133 - DNA, 840 bp, Homo sapiens; identical to SEQ ID NO: 82732
  misc_feature 1..840: note = chr19:1757222-1758062
  misc_feature 1..840: note = Hyper
  source 1..840: mol_type = genomic DNA

SEQ ID NO: 115134 - DNA, 87 bp, Homo sapiens; identical to SEQ ID NO: 82733
  misc_feature 1..87: note = chr19:1758717-1758804
  misc_feature 1..87: note = Hyper
  source 1..87: mol_type = genomic DNA

SEQ ID NO: 115135 - DNA, 648 bp, Homo sapiens
  misc_feature 1..648: note = chr19:1762172-1762820
  misc_feature 1..648: note = Hyper
  source 1..648: mol_type = genomic DNA
ccatctggagaccctcgtgctggctgctgggggtcctgcgtgccttccgcgcgcccccagctgcgcccgccagccctccaaccctcctgccctcctgccctcctgccctcctctctgggagtcgggacagaagctgctgggctctcctccctggagctggggctttgggaaggtcgagtagaccctcagtgagtgggatgcgcgagttggggacgctagttgcggggcagcaggggtccacgcatttccaagcgccctttcccgtccaaggacctgctggggggatgactgtgcctcagtttccatcacccagcaaacgccgtcccgcagcacccgggaagctgcggagtcgggctggggccgccgcgttgcgcacatcggtccttggcgggtgtgtggatcccagagcgcgcccggcccccaacagcctgacaggacctggacgcacgtgccccggcgccaggagacccgggacccgggaccacgcgcccgcggccttggagcctcagggtcactggtgcgggctccgcaggaaagcgcagcccccagcaggcacccaccatcccacccccgcatcccaccccaggggaaaccgcgccgcaccaggcgcgagtgttcttcttccttgtctggcgccccagaaccgcg

SEQ ID NO: 115136 - DNA, 30 bp, Homo sapiens; identical to SEQ ID NO: 37115
  misc_feature 1..30: note = chr19:1764269-1764299
  misc_feature 1..30: note = Hyper
  source 1..30: mol_type = genomic DNA

SEQ ID NO: 115137 - DNA, 391 bp, Homo sapiens; identical to SEQ ID NO: 82740
  misc_feature 1..391: note = chr19:1765633-1766024
  misc_feature 1..391: note = Hyper
  source 1..391: mol_type = genomic DNA

SEQ ID NO: 115138 - DNA, 30 bp, Homo sapiens; identical to SEQ ID NO: 37117
  misc_feature 1..30: note = chr19:1768342-1768372
  misc_feature 1..30: note = Hyper
  source 1..30: mol_type = genomic DNA

SEQ ID NO: 115139 - DNA, 230 bp, Homo sapiens; identical to SEQ ID NO: 37118
  misc_feature 1..230: note = chr19:1769737-1769967
  misc_feature 1..230: note = Hyper
  source 1..230: mol_type = genomic DNA

SEQ ID NO: 115140 - DNA, 320 bp, Homo sapiens; identical to SEQ ID NO: 82747
  misc_feature 1..320: note = chr19:1775116-1775436
  misc_feature 1..320: note = Hyper
  source 1..320: mol_type = genomic DNA

SEQ ID NO: 115141 - DNA, 575 bp, Homo sapiens
  misc_feature 1..575: note = chr19:1776168-1776743
  misc_feature 1..575: note = Hyper
  source 1..575: mol_type = genomic DNA
caccccatcccaggccgcaggggacggggggctcccacgtgcgggtaaattccagacgcccccgccccgccccgtctgttgagttcactttacctttaggcaccttcgtggagcgcaaggaaggacgcagctccggacacgggagaccacgcccaggctcccaggagaaggggacccggccggagaaggcgccgctggggccgcccggaggagcccctctgcacgggcccgtggagacgcttcctgcgtggaaccttctggaatccaccgcccccctttccgcccgcgtcagggtctgaactgggcttgcaggggggcagcggggttgaacgtggtgttggtttccactctcgccaaagagagaagacgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagcccgcctcctccgggggttcaagatccgagtctagaaggaa

SEQ ID NO: 115142 - DNA, 66 bp, Homo sapiens; identical to SEQ ID NO: 82753
  misc_feature 1..66: note = chr19:1776966-1777032
  misc_feature 1..66: note = Hyper
  source 1..66: mol_type = genomic DNA

SEQ ID NO: 115143 - DNA, 629 bp, Homo sapiens
  misc_feature 1..629: note = chr19:1799741-1800370
  misc_feature 1..629: note = Hypo
  source 1..629: mol_type = genomic DNA
agacagagtgagactctgcctcaaaaaaaaaaaaaaattttcctggccccctccaaaggaaaccaggccatctggctacggttccctggttcagattcgggcggaggtgctgggcatggggccagacgtggctctggttctcaggcaccctgagccccttgaagatcgaggacccagctgggagctcaggtgtcggggccgcaccatagacgcggccgctgatgcagcacttgttgaaggtcaagatgttctgcgtgagcgtgcccgtcttgtccgagaagatgtattccacctggcccaggtggtcgttgaggctggtgctgcgggccttggcaggcacgtcctgcggcttgtagtacatctgcacgtcccagtcgatgaagacgctgttccccaggtagatgaactcggacctgcagaggcactcagggtcacggtcagccccgcctgctgtgtgccatccccatgcctccccgttccgcgtttgcaccggggacgcagccggcggagactcacaggatgaacatggacatcgggatggtgacgctgagcaggatgaggaagctccagaagacgaagaaggactctgcggccacgctgctcccatgcacccccgagaggtagtagtg

SEQ ID NO: 115144 - DNA, 279 bp, Homo sapiens; identical to SEQ ID NO: 82766
  misc_feature 1..279: note = chr19:1802465-1802744
  misc_feature 1..279: note = Hypo
  source 1..279: mol_type = genomic DNA

SEQ ID NO: 115145 - DNA, 65 bp, Homo sapiens; identical to SEQ ID NO: 82769
  misc_feature 1..65: note = chr19:1805963-1806028
  misc_feature 1..65: note = Hypo
  source 1..65: mol_type = genomic DNA

SEQ ID NO: 115146 - DNA, 30 bp, Homo sapiens; identical to SEQ ID NO: 82773
  misc_feature 1..30: note = chr19:1806293-1806323
  misc_feature 1..30: note = Hypo
  source 1..30: mol_type = genomic DNA

SEQ ID NO: 115147 - DNA, 53 bp, Homo sapiens; identical to SEQ ID NO: 82775
  misc_feature 1..53: note = chr19:1807156-1807209
  misc_feature 1..53: note = Hypo
  source 1..53: mol_type = genomic DNA

SEQ ID NO: 115148 - DNA, 535 bp, Homo sapiens; identical to SEQ ID NO: 82777
  misc_feature 1..535: note = chr19:1807905-1808440
  misc_feature 1..535: note = Hypo
  source 1..535: mol_type = genomic DNA

SEQ ID NO: 115149 - DNA, 403 bp, Homo sapiens; identical to SEQ ID NO: 82780
  misc_feature 1..403: note = chr19:1809486-1809889
  misc_feature 1..403: note = Hypo
  source 1..403: mol_type = genomic DNA

SEQ ID NO: 115150 - DNA, 139 bp, Homo sapiens; identical to SEQ ID NO: 82784
  misc_feature 1..139: note = chr19:1810577-1810716
  misc_feature 1..139: note = Hypo
  source 1..139: mol_type = genomic DNA

SEQ ID NO: 115151 - DNA, 30 bp, Homo sapiens; identical to SEQ ID NO: 82785
  misc_feature 1..30: note = chr19:1811141-1811171
  misc_feature 1..30: note = Hypo
  source 1..30: mol_type = genomic DNA

SEQ ID NO: 115152 - DNA, 494 bp, Homo sapiens; identical to SEQ ID NO: 82820
  misc_feature 1..494: note = chr19:1856962-1857456
  misc_feature 1..494: note = Hyper
  source 1..494: mol_type = genomic DNA

SEQ ID NO: 115153 - DNA, 30 bp, Homo sapiens
  misc_feature 1..30: note = chr19:1876491-1876521
  misc_feature 1..30: note = Hyper
  source 1..30: mol_type = genomic DNA
ccaagcacctgccaccgccctctgctggac

SEQ ID NO: 115154 - DNA, 148 bp, Homo sapiens; identical to SEQ ID NO: 82856
  misc_feature 1..148: note = chr19:1896290-1896438
  misc_feature 1..148: note = Hypo
  source 1..148: mol_type = genomic DNA

SEQ ID NO: 115155 - DNA, 63 bp, Homo sapiens; identical to SEQ ID NO: 82867
  misc_feature 1..63: note = chr19:1908377-1908440
  misc_feature 1..63: note = Hypo
  source 1..63: mol_type = genomic DNA

SEQ ID NO: 115156 - DNA, 359 bp, Homo sapiens; identical to SEQ ID NO: 82869
  misc_feature 1..359: note = chr19:1912087-1912446
  misc_feature 1..359: note = Hypo
  source 1..359: mol_type = genomic DNA

SEQ ID NO: 115157 - DNA, 30 bp, Homo sapiens; identical to SEQ ID NO: 82870
  misc_feature 1..30: note = chr19:1914573-1914603
  misc_feature 1..30: note = Hypo
  source 1..30: mol_type = genomic DNA

SEQ ID NO: 115158 - DNA, 195 bp, Homo sapiens; identical to SEQ ID NO: 82894
  misc_feature 1..195: note = chr19:1969911-1970106
  misc_feature 1..195: note = Hypo
  source 1..195: mol_type = genomic DNA

SEQ ID NO: 115159 - DNA, 345 bp, Homo sapiens; identical to SEQ ID NO: 82895
  misc_feature 1..345: note = chr19:1970425-1970770
  misc_feature 1..345: note = Hypo
  source 1..345: mol_type = genomic DNA

SEQ ID NO: 115160 - DNA, 763 bp, Homo sapiens; identical to SEQ ID NO: 82898
  misc_feature 1..763: note = chr19:1978255-1979018
  misc_feature 1..763: note = Hypo
  source 1..763: mol_type = genomic DNA

SEQ ID NO: 115161 - DNA, 441 bp, Homo sapiens; identical to SEQ ID NO: 82902
  misc_feature 1..441: note = chr19:1992845-1993286
  misc_feature 1..441: note = Hypo
  source 1..441: mol_type = genomic DNA

SEQ ID NO: 115162 - DNA, 30 bp, Homo sapiens; identical to SEQ ID NO: 82914
  misc_feature 1..30: note = chr19:2097733-2097763
  misc_feature 1..30: note = Hypo
  source 1..30: mol_type = genomic DNA

SEQ ID NO: 115163 - DNA, 33 bp, Homo sapiens; identical to SEQ ID NO: 82915
  misc_feature 1..33: note = chr19:2098275-2098308
  misc_feature 1..33: note = Hypo
  source 1..33: mol_type = genomic DNA

SEQ ID NO: 115164 - DNA, 30 bp, Homo sapiens; identical to SEQ ID NO: 82917
  misc_feature 1..30: note = chr19:2154551-2154581
  misc_feature 1..30: note = Hypo
  source 1..30: mol_type = genomic DNA

SEQ ID NO: 115165 - DNA, 100 bp, Homo sapiens; identical to SEQ ID NO: 82929
  misc_feature 1..100: note = chr19:2191591-2191691
  misc_feature 1..100: note = Hypo
  source 1..100: mol_type = genomic DNA

SEQ ID NO: 115166 - DNA, 30 bp, Homo sapiens; identical to SEQ ID NO: 82943
  misc_feature 1..30: note = chr19:2213530-2213560
  misc_feature 1..30: note = Hypo
  source 1..30: mol_type = genomic DNA

SEQ ID NO: 115167 - DNA, 63 bp, Homo sapiens; identical to SEQ ID NO: 82944
  misc_feature 1..63: note = chr19:2214092-2214155
  misc_feature 1..63: note = Hypo
  source 1..63: mol_type = genomic DNA

SEQ ID NO: 115168 - DNA, 56 bp, Homo sapiens; identical to SEQ ID NO: 45588
  misc_feature 1..56: note = chr19:2243515-2243571
  misc_feature 1..56: note = Hypo
  source 1..56: mol_type = genomic DNA

SEQ ID NO: 115169 - DNA, 30 bp, Homo sapiens; identical to SEQ ID NO: 82947
  misc_feature 1..30: note = chr19:2244206-2244236
  misc_feature 1..30: note = Hypo
  source 1..30: mol_type = genomic DNA

SEQ ID NO: 115170 - DNA, 45 bp, Homo sapiens
  misc_feature 1..45: note = chr19:2250675-2250720
  misc_feature 1..45: note = Hyper
  source 1..45: mol_type = genomic DNA
gctacctggtgttagcggtggaccgccctgcgggggcctggcgcg

SEQ ID NO: 115171 - DNA, 2764 bp, Homo sapiens
  misc_feature 1..2764: note = chr19:2251088-2253852
  misc_feature 1..2764: note = Hyper
  source 1..2764: mol_type = genomic DNA
gggttccaggccatccgcggaactcgaggagtcgccacccagcgcagaccccttcctggagacgctcacgcgcctggtgcgggcgctgcgggtccccccggcccgggcctccgcgccgcgcctggccctggatccggacgcgctggccggcttcccgcagggcctagtcaacctgtcggaccccgcggcgctggagcgcctactcgacggcgaggagccgctgctgctgctgctgaggcccactgcggccaccaccggggatcctgcgcccctgcacgaccccacgtcggcgccgtgggccacggccctggcgcgccgcgtggctgctgaactgcaagcggcggctgccgagctgcgaagcctcccgggtctgcctccggccacagccccgctgctggcgcgcctgctcgcgctctgcccaggtggccccggcggcctcggcgatcccctgcgagcgctgctgctcctgaaggcgctgcagggcctgcgcgtggagtggcgcgggcgggatccgcgcgggccgggtcgggcacagcgcagcgcgggggccaccgccgccgacgggccgtgcgcgctgcgcgagctcagcgtagacctccgcgccgagcgctccgtactcatccccgagacctaccaggccaacaattgccagggcgtgtgcggctggcctcagtccgaccgcaacccgcgctacggcaaccacgtggtgctgctgctgaagatgcaggtccgtggggccgccctggcgcgcccaccctgctgcgtgcccaccgcctacgcgggcaagctgctcatcagcctgtcggaggagcgcatcagcgcgcaccacgtgcccaacatggtggccaccgagtgtggctgccggtgacccctgcgccgcgcggactcctgccccgagggtccggacgcgccccagctcgcgccccttcccatatttattcggaccccaagcatcgccccaataaagaccagcaagcaaccggctggggtgtccgtgcgtgttagggggcccgtgggacctcccttgccgtctctcctcgcgcacggcccgggtccgccctgtagcgctcgctgtctctcccctgcctgaagcgccccaccaccgtctttcaggccccggacttggtgccgggtccaggcgtaaaggagcaggtgactctgcggccgcagcactcgctttatttcgccagagtcgcggggcgtccagaaggggcccctggactccggcgcggggccggctcagtcccgccccttgcctgcgcggagcttctggcgactcccaggccgctgctcctcgtcgggacgcctcggggacacccaggcctgcttcttcctgggctcggcgtccctggagtcccgtgcccacggccggtggcccccttcgcgtgactcccagcgctggggtagggcttcccggggctccctggcggcccgtggcctctcctctttccgcggcctctctttcttaggtctctcctccttccgcggcttctccttccgcggcttcccctctctccgaggcctctccttgggtccccggtctgcgagggtcacacggtcctcccggacggcctctccggtggcctcgccgggctcctcttcgtcgttctctgcagcctcccgactcccgggaatcttgggtctgacctctgcctcggcccggggcgcaggcggcgctgatggaggcgcctgggcctcgaacttaggctgcaagacagagtggggtcctggggtaagcgcccaccttccccccggcccgggctccttctttccttggggatgaaggtcccaatgcccgcggtcagtggaaggaagctcttaccaggggcgacgatggctccctcggggctgagcttggcgggacccagggctcgggcacacgtgcttggagtgctgcctccccagggacggcgtctgcagcgacagggtcgggacccgagtcagctgggccgaggcacggtccacactgtccatccctccctcacccctagagcccccctccctggacagttggagtggggctcccccggtacggctgagactaaggatgcccccgagccgtgggaagggactccgggactccgctgccgcggcgccccttctccgaacctcgctctttcaattggtcattcttccccccgaccacgggctgtaggaggcccctagcaagggaggggtcgcaggagtgcccccggggggcgctcacgagctgagcggtccccagagagggcgcaggggaaaggcggcagaacgctacgaggcaggaggggttgcacaaggttcatccggaagccagaacctactcgcggcgaggggaatgggccccgcaaaaggtccacaccgggtgagaggggcgcgcaaggcccgtcacttaaggggagatgcacaaaccaactttgggggcgtgcaagacccagccctggagaggaggctcccagaccccaccctggcggcacagcgcctttccttggaggaataggcgcacaggtggaccccagcctcgccccacctctggggagcctgcgctcaccgcggcacagctggaaagccgagcccagcagcgccaccagcgaggcgagcaccaggcacttgttgagcgacaggtctccccagggcagctcctcgctcagggccgggggcggcggcggcggctgcaggggcggcgcggtctgcgccttcttgcgcgcggggacgctccgagggcctgcgggggcaagtgcgcgctgcgctgtggtcactggctctgtgccgcccccttccccgg

SEQ ID NO: 115172 - DNA, 21 bp, Homo sapiens
  misc_feature 1..21: note = chr19:2268114-2268135
  misc_feature 1..21: note = Hypo
  source 1..21: mol_type = genomic DNA
cgaaagacaggcaggcgcggt

SEQ ID NO: 115173 - DNA, 39 bp, Homo sapiens; identical to SEQ ID NO: 82959
  misc_feature 1..39: note = chr19:2273981-2274020
  misc_feature 1..39: note = Hyper
  source 1..39: mol_type = genomic DNA

SEQ ID NO: 115174 - DNA, 92 bp, Homo sapiens; identical to SEQ ID NO: 82960
  misc_feature 1..92: note = chr19:2274600-2274692
  misc_feature 1..92: note = Hypo
  source 1..92: mol_type = genomic DNA

SEQ ID NO: 115175 - DNA, 262 bp, Homo sapiens; identical to SEQ ID NO: 82961
  misc_feature 1..262: note = chr19:2275678-2275940
  misc_feature 1..262: note = Hypo
  source 1..262: mol_type = genomic DNA

SEQ ID NO: 115176 - DNA, 153 bp, Homo sapiens; identical to SEQ ID NO: 82962
  misc_feature 1..153: note = chr19:2276337-2276490
  misc_feature 1..153: note = Hypo
  source 1..153: mol_type = genomic DNA

SEQ ID NO: 115177 - DNA, 30 bp, Homo sapiens
  misc_feature 1..30: note = chr19:2282682-2282712
  misc_feature 1..30: note = Hyper
  source 1..30: mol_type = genomic DNA
ctcgctgtgtgactgcgggcaaatccccac

SEQ ID NO: 115178 - DNA, 1366 bp, Homo sapiens
  misc_feature 1..1366: note = chr19:2289693-2291059
  misc_feature 1..1366: note = Hyper
  source 1..1366: mol_type = genomic DNA
ccccgggttggtagacgggagcccatccccccatccttgcagcccgcacccccaccccccagctcagccaccatagcagggacaggaagacgggttgaaatctttagaaaacgcttgagaaactgcaaaaaagacgcatgctgatgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgcccggggtccggttggcggccggctcggggcgcacggtcagcgtggcgaagtaggtgtcgttgccgcccgcgttgctggccacgcacgtgtaggtgccgctgtcctgcggccgcgcgtcctggatctccagcgtccccccggggagcacgcgcgcccggcccgcgctggtggccgtcaccggccggtgctggggggtcacccaggccacggtgggcgccggctcgccctcggcgcggcagaggaagcggacgtcttcgcccgcggtggccgtgacgcgctgcagccgccgctcccggatcttgggtttgcggcacacgaagtactcgaacagcacggagtccggcaggtttcgcagcgcgtcgccgcgcacctcggccggggtggcgcaggccggcagccgcccgtcgaagttgagggtcttgcgacgctgcacgatccacagcaggcgacagtcgcaggccagcgggttcccgtccacgcgcagcgtctctagcgtgttcaccgagtggaaggtgctctcctccaacgtggagagcaggttgttggagaggttgagcaggcggatctggcgcaggcccaggaaggcctgcggctccaccacagccagcagggccccggccaggtgcagctcgcgcaggcggaccaggtcccggaacgacccccgcggcaccgtgctgatggggttgtgcgacagattgaggcaggtgaggtgcgcctggtgccgcagcgcggcggccggcacggcggtgatgttggtgtgggtgaccgacagcgaggtcaggttcaggccccgcaggctgcccgcc

SEQ ID NO: 115179 - DNA, 392 bp, Homo sapiens; identical to SEQ ID NO: 37129
  misc_feature 1..392: note = chr19:2302559-2302951
  misc_feature 1..392: note = Hyper
  source 1..392: mol_type = genomic DNA

SEQ ID NO: 115180 - DNA, 36 bp, Homo sapiens; identical to SEQ ID NO: 82972
  misc_feature 1..36: note = chr19:2308140-2308176
  misc_feature 1..36: note = Hyper
  source 1..36: mol_type = genomic DNA

SEQ ID NO: 115181 - DNA, 30 bp, Homo sapiens; identical to SEQ ID NO: 82975
  misc_feature 1..30: note = chr19:2324322-2324352
  misc_feature 1..30: note = Hypo
  source 1..30: mol_type = genomic DNA

SEQ ID NO: 115182 - DNA, 27 bp, Homo sapiens
  misc_feature 1..27: note = chr19:2330114-2330141
  misc_feature 1..27: note = Hypo
  source 1..27: mol_type = genomic DNA
tttttttttttgagacggagtctcgct

SEQ ID NO: 115183 - DNA, 26 bp, Homo sapiens
  misc_feature 1..26: note = chr19:2330381-2330407
  misc_feature 1..26: note = Hypo
  source 1..26: mol_type = genomic DNA
gggatgacaggcgtgagccaccgtgc

SEQ ID NO: 115184 - DNA, 170 bp, Homo sapiens; identical to SEQ ID NO: 45591
  misc_feature 1..170: note = chr19:2331273-2331443
  misc_feature 1..170: note = Hypo
  source 1..170: mol_type = genomic DNA

SEQ ID NO: 115185 - DNA, 131 bp, Homo sapiens; identical to SEQ ID NO: 82987
  misc_feature 1..131: note = chr19:2331903-2332034
  misc_feature 1..131: note = Hypo
  source 1..131: mol_type = genomic DNA

SEQ ID NO: 115186 - DNA, 74 bp, Homo sapiens; identical to SEQ ID NO: 82988
  misc_feature 1..74: note = chr19:2337296-2337370
  misc_feature 1..74: note = Hypo
  source 1..74: mol_type = genomic DNA

SEQ ID NO: 115187 - DNA, 99 bp, Homo sapiens; identical to SEQ ID NO: 82990
  misc_feature 1..99: note = chr19:2339493-2339592
  misc_feature 1..99: note = Hypo
  source 1..99: mol_type = genomic DNA

SEQ ID NO: 115188 - DNA, 249 bp, Homo sapiens; identical to SEQ ID NO: 82994
  misc_feature 1..249: note = chr19:2358937-2359186
  misc_feature 1..249: note = Hypo
  source 1..249: mol_type = genomic DNA

SEQ ID NO: 115189 - DNA, 118 bp, Homo sapiens; identical to SEQ ID NO: 82996
  misc_feature 1..118: note = chr19:2360226-2360344
  misc_feature 1..118: note = Hyper
  source 1..118: mol_type = genomic DNA

SEQ ID NO: 115190 - DNA, 108 bp, Homo sapiens
  misc_feature 1..108: note = chr19:2360711-2360819
  misc_feature 1..108: note = Hypo
  source 1..108: mol_type = genomic DNA
cgggggttatgtggacgcaggtgtggcgtgtggatgcggccggggttgtgtggactcaggtgtggtgtgtagatgcacgtagggttgtgtggacgcagccgggattgt

SEQ ID NO: 115191 - DNA, 185 bp, Homo sapiens; identical to SEQ ID NO: 82998
  misc_feature 1..185: note = chr19:2363009-2363194
  misc_feature 1..185: note = Hypo
  source 1..185: mol_type = genomic DNA

SEQ ID NO: 115192 - DNA, 41 bp, Homo sapiens; identical to SEQ ID NO: 83000
  misc_feature 1..41: note = chr19:2377007-2377048
  misc_feature 1..41: note = Hypo
  source 1..41: mol_type = genomic DNA

SEQ ID NO: 115193 - DNA, 71 bp, Homo sapiens; identical to SEQ ID NO: 83001
  misc_feature 1..71: note = chr19:2389713-2389784
  misc_feature 1..71: note = Hypo
  source 1..71: mol_type = genomic DNA

SEQ ID NO: 115194 - DNA, 30 bp, Homo sapiens; identical to SEQ ID NO: 83003
  misc_feature 1..30: note = chr19:2410895-2410925
  misc_feature 1..30: note = Hypo
  source 1..30: mol_type = genomic DNA

SEQ ID NO: 115195 - DNA, 30 bp, Homo sapiens; identical to SEQ ID NO: 83004
  misc_feature 1..30: note = chr19:2415373-2415403
  misc_feature 1..30: note = Hypo
  source 1..30: mol_type = genomic DNA

SEQ ID NO: 115196 - DNA, 30 bp, Homo sapiens; identical to SEQ ID NO: 83009
  misc_feature 1..30: note = chr19:2452047-2452077
  misc_feature 1..30: note = Hypo
  source 1..30: mol_type = genomic DNA

SEQ ID NO: 115197 - DNA, 42 bp, Homo sapiens; identical to SEQ ID NO: 45596
  misc_feature 1..42: note = chr19:2471261-2471303
  misc_feature 1..42: note = Hypo
  source 1..42: mol_type = genomic DNA

SEQ ID NO: 115198 - DNA, 23 bp, Homo sapiens
  misc_feature 1..23: note = chr19:2471700-2471723
  misc_feature 1..23: note = Hypo
  source 1..23: mol_type = genomic DNA
aaatacggtgactcacgcctgta

SEQ ID NO: 115199 - DNA, 130 bp, Homo sapiens; identical to SEQ ID NO: 83012
  misc_feature 1..130: note = chr19:2478809-2478939
  misc_feature 1..130: note = Hyper
  source 1..130: mol_type = genomic DNA

SEQ ID NO: 115200 - DNA, 241 bp, Homo sapiens; identical to SEQ ID NO: 83013
  misc_feature 1..241: note = chr19:2488448-2488689
  misc_feature 1..241: note = Hyper
  source 1..241: mol_type = genomic DNA

SEQ ID NO: 115201 - DNA, 30 bp, Homo sapiens; identical to SEQ ID NO: 83014
  misc_feature 1..30: note = chr19:2512801-2512831
  misc_feature 1..30: note = Hypo
  source 1..30: mol_type = genomic DNA

SEQ ID NO: 115202 - DNA, 427 bp, Homo sapiens; identical to SEQ ID NO: 83015
  misc_feature 1..427: note = chr19:2513079-2513506
  misc_feature 1..427: note = Hypo
  source 1..427: mol_type = genomic DNA

SEQ ID NO: 115203 - DNA, 95 bp, Homo sapiens; identical to SEQ ID NO: 83016
  misc_feature 1..95: note = chr19:2518480-2518575
  misc_feature 1..95: note = Hypo
  source 1..95: mol_type = genomic DNA

SEQ ID NO: 115204 - DNA, 196 bp, Homo sapiens; identical to SEQ ID NO: 83017
  misc_feature 1..196: note = chr19:2524739-2524935
  misc_feature 1..196: note = Hypo
  source 1..196: mol_type = genomic DNA

SEQ ID NO: 115205 - DNA, 49 bp, Homo sapiens; identical to SEQ ID NO: 83018
  misc_feature 1..49: note = chr19:2573995-2574044
  misc_feature 1..49: note = Hypo
  source 1..49: mol_type = genomic DNA

SEQ ID NO: 115206 - DNA, 70 bp, Homo sapiens; identical to SEQ ID NO: 83019
  misc_feature 1..70: note = chr19:2665387-2665457
  misc_feature 1..70: note = Hypo
  source 1..70: mol_type = genomic DNA

SEQ ID NO: 115207 - DNA, 59 bp, Homo sapiens; identical to SEQ ID NO: 83020
  misc_feature 1..59: note = chr19:2671304-2671363
  misc_feature 1..59: note = Hypo
  source 1..59: mol_type = genomic DNA

SEQ ID NO: 115208 - DNA, 30 bp, Homo sapiens; identical to SEQ ID NO: 83023
  misc_feature 1..30: note = chr19:2683414-2683444
  misc_feature 1..30: note = Hypo
  source 1..30: mol_type = genomic DNA

SEQ ID NO: 115209 - DNA, 155 bp, Homo sapiens; identical to SEQ ID NO: 83024
  misc_feature 1..155: note = chr19:2683891-2684046
  misc_feature 1..155: note = Hypo
  source 1..155: mol_type = genomic DNA

SEQ ID NO: 115210 - DNA, 36 bp, Homo sapiens; identical to SEQ ID NO: 83025
  misc_feature 1..36: note = chr19:2702517-2702553
  misc_feature 1..36: note = Hyper
  source 1..36: mol_type = genomic DNA

SEQ ID NO: 115211 - DNA, 42 bp, Homo sapiens; identical to SEQ ID NO: 83026
  misc_feature 1..42: note = chr19:2703070-2703112
  misc_feature 1..42: note = Hyper
  source 1..42: mol_type = genomic DNA

SEQ ID NO: 115212 - DNA, 30 bp, Homo sapiens; identical to SEQ ID NO: 83027
  misc_feature 1..30: note = chr19:2716528-2716558
  misc_feature 1..30: note = Hypo
  source 1..30: mol_type = genomic DNA

SEQ ID NO: 115213 - DNA, 30 bp, Homo sapiens; identical to SEQ ID NO: 83028
  misc_feature 1..30: note = chr19:2721203-2721233
  misc_feature 1..30: note = Hyper
  source 1..30: mol_type = genomic DNA

SEQ ID NO: 115214 - DNA, 30 bp, Homo sapiens; identical to SEQ ID NO: 83029
  misc_feature 1..30: note = chr19:2721705-2721735
  misc_feature 1..30: note = Hyper
  source 1..30: mol_type = genomic DNA

SEQ ID NO: 115215 - DNA, 100 bp, Homo sapiens; identical to SEQ ID NO: 83032
  misc_feature 1..100: note = chr19:2867431-2867531
  misc_feature 1..100: note = Hypo
  source 1..100: mol_type = genomic DNA

SEQ ID NO: 115216 - DNA, 16 bp, Homo sapiens
  misc_feature 1..16: note = chr19:2895805-2895821
  misc_feature 1..16: note = Hypo
  source 1..16: mol_type = genomic DNA
acgttgacatgggaaa

SEQ ID NO: 115217 - DNA, 22 bp, Homo sapiens
  misc_feature 1..22: note = chr19:2899962-2899984
  misc_feature 1..22: note = Hypo
  source 1..22: mol_type = genomic DNA
caggaggctgggaaacgtttgg

SEQ ID NO: 115218 - DNA, 30 bp, Homo sapiens; identical to SEQ ID NO: 83048
  misc_feature 1..30: note = chr19:2961218-2961248
  misc_feature 1..30: note = Hypo
  source 1..30: mol_type = genomic DNA

SEQ ID NO: 115219 - DNA, 183 bp, Homo sapiens; identical to SEQ ID NO: 83077
  misc_feature 1..183: note = chr19:3039729-3039912
  misc_feature 1..183: note = Hypo
  source 1..183: mol_type = genomic DNA

SEQ ID NO: 115220 - DNA, 30 bp, Homo sapiens; identical to SEQ ID NO: 83079
  misc_feature 1..30: note = chr19:3041560-3041590
  misc_feature 1..30: note = Hypo
  source 1..30: mol_type = genomic DNA

SEQ ID NO: 115221 - DNA, 22 bp, Homo sapiens
  misc_feature 1..22: note = chr19:3050735-3050757
  misc_feature 1..22: note = Hypo
  source 1..22: mol_type = genomic DNA
gggcgcggtggctcacgcctgt

SEQ ID NO: 115222 - DNA, 30 bp, Homo sapiens; identical to SEQ ID NO: 83117
  misc_feature 1..30: note = chr19:3131559-3131589
  misc_feature 1..30: note = Hypo
  source 1..30: mol_type = genomic DNA

SEQ ID NO: 115223 - DNA, 30 bp, Homo sapiens; identical to SEQ ID NO: 83120
  misc_feature 1..30: note = chr19:3170304-3170334
  misc_feature 1..30: note = Hypo
  source 1..30: mol_type = genomic DNA

SEQ ID NO: 115224 - DNA, 30 bp, Homo sapiens; identical to SEQ ID NO: 83131
  misc_feature 1..30: note = chr19:3187545-3187575
  misc_feature 1..30: note = Hypo
  source 1..30: mol_type = genomic DNA

SEQ ID NO: 115225 - DNA, 30 bp, Homo sapiens; identical to SEQ ID NO: 83132
  misc_feature 1..30: note = chr19:3187952-3187982
  misc_feature 1..30: note = Hypo
  source 1..30: mol_type = genomic DNA

SEQ ID NO: 115226 - DNA, 85 bp, Homo sapiens; identical to SEQ ID NO: 83138
  misc_feature 1..85: note = chr19:3218818-3218903
  misc_feature 1..85: note = Hypo
  source 1..85: mol_type = genomic DNA

SEQ ID NO: 115227 - DNA, 100 bp, Homo sapiens; identical to SEQ ID NO: 83139
  misc_feature 1..100: note = chr19:3219554-3219654
  misc_feature 1..100: note = Hypo
  source 1..100: mol_type = genomic DNA

SEQ ID NO: 115228 - DNA, 84 bp, Homo sapiens; identical to SEQ ID NO: 83141
  misc_feature 1..84: note = chr19:3223661-3223745
  misc_feature 1..84: note = Hypo
  source 1..84: mol_type = genomic DNA

SEQ ID NO: 115229 - DNA, 59 bp, Homo sapiens; identical to SEQ ID NO: 83142
  misc_feature 1..59: note = chr19:3225545-3225604
  misc_feature 1..59: note = Hyper
  source 1..59: mol_type = genomic DNA

SEQ ID NO: 115230 - DNA, 18 bp, Homo sapiens
  misc_feature 1..18: note = chr19:3241370-3241388
  misc_feature 1..18: note = Hypo
  source 1..18: mol_type = genomic DNA
gcccggcctaaagatcag

SEQ ID NO: 115231 - DNA, 30 bp, Homo sapiens; identical to SEQ ID NO: 37133
  misc_feature 1..30: note = chr19:3244155-3244185
  misc_feature 1..30: note = Hyper
  source 1..30: mol_type = genomic DNA

SEQ ID NO: 115232 - DNA, 249 bp, Homo sapiens; identical to SEQ ID NO: 83155
  misc_feature 1..249: note = chr19:3270483-3270732
  misc_feature 1..249: note = Hyper
  source 1..249: mol_type = genomic DNA

SEQ ID NO: 115233 - DNA, 41 bp, Homo sapiens; identical to SEQ ID NO: 83164
  misc_feature 1..41: note = chr19:3286043-3286084
  misc_feature 1..41: note = Hyper
  source 1..41: mol_type = genomic DNA

SEQ ID NO: 115234 - DNA, 167 bp, Homo sapiens; identical to SEQ ID NO: 83166
  misc_feature 1..167: note = chr19:3296598-3296765
  misc_feature 1..167: note = Hypo
  source 1..167: mol_type = genomic DNA

SEQ ID NO: 115235 - DNA, 87 bp, Homo sapiens; identical to SEQ ID NO: 83167
  misc_feature 1..87: note = chr19:3308060-3308147
  misc_feature 1..87: note = Hypo
  source 1..87: mol_type = genomic DNA

SEQ ID NO: 115236 - DNA, 145 bp, Homo sapiens; identical to SEQ ID NO: 83176
  misc_feature 1..145: note = chr19:3344915-3345060
  misc_feature 1..145: note = Hypo
  source 1..145: mol_type = genomic DNA

SEQ ID NO: 115237 - DNA, 546 bp, Homo sapiens
  misc_feature 1..546: note = chr19:3360952-3361498
  misc_feature 1..546: note = Hyper
  source 1..546: mol_type = genomic DNA
tctgccttccactcccggcctcgcctcccccagttccttttttcctgtaactggggactgcctgggcggcggaggaagagcgctccctccaccttttcaaaactctgtccctttatctttcccctacgtcccctccacttcccccagccttcggggtcccccatccgcttggcccgagggggtcctggctggaggttcgggcgcgaggtggcgccgggacgcgatcactcggcacgcagacgtcgctcgccaggggttgcgcttgcgcggggacctgccccgagaggggcggggcggcaggggttccccctccctgagaggccgtggaagtcccgaggggtgggtggttacagcagcacaggggttaggacgggcccgggaggtggctaaggagacccctattatcctatgctggggagagcgtaggggcaccgggactggtcccgcagtcccgcctccagcacttgcccccaatggaccagaggccgtgggcacagagagctgttttgtcacctccagggaaatccccgccgctctccaccccca

SEQ ID NO: 115238 - DNA, 30 bp, Homo sapiens; identical to SEQ ID NO: 83213
  misc_feature 1..30: note = chr19:3455766-3455796
  misc_feature 1..30: note = Hypo
  source 1..30: mol_type = genomic DNA

SEQ ID NO: 115239 - DNA, 34 bp, Homo sapiens; identical to SEQ ID NO: 83215
  misc_feature 1..34: note = chr19:3456167-3456201
  misc_feature 1..34: note = Hypo
  source 1..34: mol_type = genomic DNA

SEQ ID NO: 115240 - DNA, 140 bp, Homo sapiens; identical to SEQ ID NO: 83216
  misc_feature 1..140: note = chr19:3456440-3456580
  misc_feature 1..140: note = Hypo
  source 1..140: mol_type = genomic DNA

SEQ ID NO: 115241 - DNA, 30 bp, Homo sapiens; identical to SEQ ID NO: 83227
  misc_feature 1..30: note = chr19:3516425-3516455
  misc_feature 1..30: note = Hypo
  source 1..30: mol_type = genomic DNA

SEQ ID NO: 115242 - DNA, 36 bp, Homo sapiens; identical to SEQ ID NO: 83236
  misc_feature 1..36: note = chr19:3544842-3544878
  misc_feature 1..36: note = Hypo
  source 1..36: mol_type = genomic DNA

SEQ ID NO: 115243 - DNA, 360 bp, Homo sapiens; identical to SEQ ID NO: 45610
  misc_feature 1..360: note = chr19:3562248-3562608
  misc_feature 1..360: note = Hypo
  source 1..360: mol_type = genomic DNA

SEQ ID NO: 115244 - DNA, 30 bp, Homo sapiens; identical to SEQ ID NO: 83253
  misc_feature 1..30: note = chr19:3565540-3565570
  misc_feature 1..30: note = Hypo
  source 1..30: mol_type = genomic DNA

SEQ ID NO: 115245 - DNA, 32 bp, Homo sapiens; identical to SEQ ID NO: 45611
  misc_feature 1..32: note = chr19:3570187-3570219
  misc_feature 1..32: note = Hypo
  source 1..32: mol_type = genomic DNA

SEQ ID NO: 115246 - DNA, 28 bp, Homo sapiens
  misc_feature 1..28: note = chr19:3571493-3571521
  misc_feature 1..28: note = Hypo
  source 1..28: mol_type = genomic DNA
acgcttgtgtacacgcttttgtttgaac

SEQ ID NO: 115247 - DNA, 128 bp, Homo sapiens; identical to SEQ ID NO: 83256
  misc_feature 1..128: note = chr19:3576034-3576162
  misc_feature 1..128: note = Hypo
  source 1..128: mol_type = genomic DNA

SEQ ID NO: 115248 - DNA, 106 bp, Homo sapiens; identical to SEQ ID NO: 83257
  misc_feature 1..106: note = chr19:3577705-3577811
  misc_feature 1..106: note = Hypo
  source 1..106: mol_type = genomic DNA

SEQ ID NO: 115249 - DNA, 99 bp, Homo sapiens; identical to SEQ ID NO: 83259
  misc_feature 1..99: note = chr19:3578124-3578223
  misc_feature 1..99: note = Hypo
  source 1..99: mol_type = genomic DNA

SEQ ID NO: 115250 - DNA, 361 bp, Homo sapiens
  misc_feature 1..361: note = chr19:3585697-3586058
  misc_feature 1..361: note = Hyper
  source 1..361: mol_type = genomic DNA
ccgcgcctcgtcttccgcacgcagctggcgcacgggagccccacgggcaagatcgagggcttcaccaacgtccgcgagctgtacgccaagatcgccgaagccttcgggatcgcgcccaccgaggtaaggagcccggacaccggcgcccaagaccacccgcctgatggggtgaggggtagggagcttggaccctggacgggagaccccagatccccggatcccagacgtcggggtggccgcctaatcgccggatctcagagacccagccctcagatcccggggtgccacactcccaggggccccctttgcacgctctgcgcaaaagatgggcaggtcttaggactagcggacccctagatat

SEQ ID NO: 115251 - DNA, 118 bp, Homo sapiens; identical to SEQ ID NO: 83294
  misc_feature 1..118: note = chr19:3649925-3650043
  misc_feature 1..118: note = Hypo
  source 1..118: mol_type = genomic DNA

SEQ ID NO: 115252 - DNA, 93 bp, Homo sapiens; identical to SEQ ID NO: 83324
  misc_feature 1..93: note = chr19:3716365-3716458
  misc_feature 1..93: note = Hypo
  source 1..93: mol_type = genomic DNA

SEQ ID NO: 115253 - DNA, 128 bp, Homo sapiens; identical to SEQ ID NO: 83347
  misc_feature 1..128: note = chr19:3747892-3748020
  misc_feature 1..128: note = Hypo
  source 1..128: mol_type = genomic DNA

SEQ ID NO: 115254 - DNA, 84 bp, Homo sapiens; identical to SEQ ID NO: 83354
  misc_feature 1..84: note = chr19:3760214-3760298
  misc_feature 1..84: note = Hypo
  source 1..84: mol_type = genomic DNA

SEQ ID NO: 115255 - DNA, 20 bp, Homo sapiens
  misc_feature 1..20: note = chr19:3773897-3773917
  misc_feature 1..20: note = Hypo
  source 1..20: mol_type = genomic DNA
ccagtcgggttgctatgtta

SEQ ID NO: 115256 - DNA, 343 bp, Homo sapiens; identical to SEQ ID NO: 83359
  misc_feature 1..343: note = chr19:3778074-3778417
  misc_feature 1..343: note = Hypo
  source 1..343: mol_type = genomic DNA

SEQ ID NO: 115257 - DNA, 496 bp, Homo sapiens; identical to SEQ ID NO: 83360
  misc_feature 1..496: note = chr19:3778991-3779487
  misc_feature 1..496: note = Hypo
  source 1..496: mol_type = genomic DNA

SEQ ID NO: 115258 - DNA, 1129 bp, Homo sapiens
  misc_feature 1..1129: note = chr19:3785557-3786686
  misc_feature 1..1129: note = Hyper
  source 1..1129: mol_type = genomic DNA
ggcccctccaagatgcgcctcccatgaaatcctccagtcccacgtgtactcacacgcatacggatgcatgcacacgcacagaaacacacagggctcggacacagctgcgcgcagacaagcaaaggaccacgtccacgtggaaacaggtgtgcgcacacgtccccgcgcatccgcgcgcacaagcgctccacacctgggaacgtgcgcacctgtcccccgcccccggcacacacacagccgccccacactggaacacctgggcgccagcgccgggccactcgggcacgcagggcgctacgcagggccgcgcacacgcttttcggccacacgcgcacagccctccacgtggacgcgcgggtacacacgcccggggctcgtagccgcgcacacccgcacccaggaaaccccagccaccaccacgcggggtccgatcgcctctgagcaccctccgccccagccgcgcacccgctgcgcgcccgggacgcgcacactcgcgcacacaccggcccttcctgcgcacgtcccgggcccacccccgcctagagccctcggggtttccccccaccccggcctcggggtctctccacgtctccccgccgacgtgctcacctgctcagggggcgcccccgagccgcgccccgcgcccgcccccaggagggcctccgcgagccggctgcacaccccgaggcggtcccggctgcacaacttggagcgagttgctccgtttcctcattttgggggcgaagaagggtcggggagtgggggaaagcgggaggcgccgcggcctgggaggcccccgcgggtcctagcgccggccgcactgcggtctcctccgcgcgccgccgccgccgccggcccctccccgccccgcctccgcggcccccggcgcctcccgcgcgccccgggcggggtcccggggcgcacgcgggctccacgcctggccctgacctggccctgtcgggcgtgcaccccccacccaccctgggaagcggggttcttggagcgtggaacgggcgccgccagtgcgcgcggcggggaccgggggtgagggagagtgagctgcccgtccggggagataagcaaggcgccaagcccggactcccagaggacacttcgtactctgcaattc

SEQ ID NO: 115259 - DNA, 274 bp, Homo sapiens
  misc_feature 1..274: note = chr19:3801434-3801708
  misc_feature 1..274: note = Hyper
  source 1..274: mol_type = genomic DNA
gacagcctgcccttccgtttttgtctttccagtcccgcctgccggattgggttccagccctgcccacacgcccggtacatcccgcctacactcaccgatgtcgcctagcaacccggctcgcagctagcatccgcaaccgaggtccccgcgctccagttctctggcggggagggagaggggtgttgcttctccagccccctgcagcctggtgtcttcctgccacccgccggcctgctccgggaaccgcggcctggtgggacgagggttgcggagg

SEQ ID NO: 115260 - DNA, 30 bp, Homo sapiens; identical to SEQ ID NO: 83386
  misc_feature 1..30: note = chr19:3817232-3817262
  misc_feature 1..30: note = Hypo
  source 1..30: mol_type = genomic DNA

SEQ ID NO: 115261 - DNA, 250 bp, Homo sapiens; identical to SEQ ID NO: 83392
  misc_feature 1..250: note = chr19:3821004-3821254
  misc_feature 1..250: note = Hypo
  source 1..250: mol_type = genomic DNA

SEQ ID NO: 115262 - DNA, 320 bp, Homo sapiens
  misc_feature 1..320: note = chr19:3821971-3822291
  misc_feature 1..320: note = Hyper
  source 1..320: mol_type = genomic DNA
gttcgtcggatcacacgcgcggaagaggcccgaccacaggcctcccagcgcccgccgggccctagcacagcccggacgggtgtcggagctccccctgctggacgcacccggtactgcagccggtgccgccgccccctcacgtgcaggtccttcgcgttaaggtcgttgaaactgcactcgcacagcttgcagtggaagcgaagcactcgcccttcgtcgctgaacacctgagacacagaacagccgcacgcgcaccaggcacgaggcggggtgggatgtgagatgctaccgctgccaggtcgcggcggagccttcctcct

SEQ ID NO: 115263 - DNA, 47 bp, Homo sapiens; identical to SEQ ID NO: 83397
  misc_feature 1..47: note = chr19:3827483-3827530
  misc_feature 1..47: note = Hypo
  source 1..47: mol_type = genomic DNA

SEQ ID NO: 115264 - DNA, 297 bp, Homo sapiens; identical to SEQ ID NO: 83403
  misc_feature 1..297: note = chr19:3855407-3855704
  misc_feature 1..297: note = Hypo
  source 1..297: mol_type = genomic DNA

SEQ ID NO: 115265 - DNA, 32 bp, Homo sapiens; identical to SEQ ID NO: 83405
  misc_feature 1..32: note = chr19:3856184-3856216
  misc_feature 1..32: note = Hypo
  source 1..32: mol_type = genomic DNA

SEQ ID NO: 115266 - DNA, 37 bp, Homo sapiens; identical to SEQ ID NO: 83406
  misc_feature 1..37: note = chr19:3859512-3859549
  misc_feature 1..37: note = Hypo
  source 1..37: mol_type = genomic DNA

SEQ ID NO: 115267 - DNA, 352 bp, Homo sapiens
  misc_feature 1..352: note = chr19:3868851-3869203
  misc_feature 1..352: note = Hyper
  source 1..352: mol_type = genomic DNA
ggctgggactggggccgggccgggcgcacgcggcgggagaaggggtaggcggggtcccggccaggctgcaggggccgggactggcgggggctggcgcggcggggcagttacctgtactgcgggccgccgccctgcgcgaagtcgaaatactgactcgtcgccatcttggcgtcttccccgagcctggcggacccgcgacgtcacccgccccgcccccgagccgcgtgccgctcgcgcctggccacgcgccccaagctccgccccctgcgcgaagccctcaccttctcgcttccttctcttaggctagggagacaccgccccgcgaccacacctgccccgaggccccgcctcc

SEQ ID NO: 115268 - DNA, 404 bp, Homo sapiens; identical to SEQ ID NO: 83424
  misc_feature 1..404: note = chr19:3880457-3880861
  misc_feature 1..404: note = Hyper
  source 1..404: mol_type = genomic DNA

SEQ ID NO: 115269 - DNA, 512 bp, Homo sapiens; identical to SEQ ID NO: 83425
  misc_feature 1..512: note = chr19:3881335-3881847
  misc_feature 1..512: note = Hyper
  source 1..512: mol_type = genomic DNA

SEQ ID NO: 115270 - DNA, 230 bp, Homo sapiens; identical to SEQ ID NO: 83457
  misc_feature 1..230: note = chr19:3907717-3907947
  misc_feature 1..230: note = Hypo
  source 1..230: mol_type = genomic DNA

SEQ ID NO: 115271 - DNA, 162 bp, Homo sapiens; identical to SEQ ID NO: 83475
  misc_feature 1..162: note = chr19:3933098-3933260
  misc_feature 1..162: note = Hyper
  source 1..162: mol_type = genomic DNA

SEQ ID NO: 115272 - DNA, 318 bp, Homo sapiens; identical to SEQ ID NO: 83476
  misc_feature 1..318: note = chr19:3933461-3933779
  misc_feature 1..318: note = Hyper
  source 1..318: mol_type = genomic DNA

SEQ ID NO: 115273 - DNA, 182 bp, Homo sapiens; identical to SEQ ID NO: 83477
  misc_feature 1..182: note = chr19:3936566-3936748
  misc_feature 1..182: note = Hypo
  source 1..182: mol_type = genomic DNA

SEQ ID NO: 115274 - DNA, 59 bp, Homo sapiens; identical to SEQ ID NO: 83481
  misc_feature 1..59: note = chr19:3946634-3946693
  misc_feature 1..59: note = Hypo
  source 1..59: mol_type = genomic DNA

SEQ ID NO: 115275 - DNA, 86 bp, Homo sapiens; identical to SEQ ID NO: 83497
  misc_feature 1..86: note = chr19:3972561-3972647
  misc_feature 1..86: note = Hypo
  source 1..86: mol_type = genomic DNA

SEQ ID NO: 115276 - DNA, 30 bp, Homo sapiens; identical to SEQ ID NO: 83500
  misc_feature 1..30: note = chr19:3976461-3976491
  misc_feature 1..30: note = Hypo
  source 1..30: mol_type = genomic DNA

SEQ ID NO: 115277 - DNA, 30 bp, Homo sapiens; identical to SEQ ID NO: 83501
  misc_feature 1..30: note = chr19:3979506-3979536
  misc_feature 1..30: note = Hypo
  source 1..30: mol_type = genomic DNA

SEQ ID NO: 115278 - DNA, 44 bp, Homo sapiens; identical to SEQ ID NO: 83506
  misc_feature 1..44: note = chr19:3981879-3981923
  misc_feature 1..44: note = Hypo
  source 1..44: mol_type = genomic DNA

SEQ ID NO: 115279 - DNA, 30 bp, Homo sapiens; identical to SEQ ID NO: 83507
  misc_feature 1..30: note = chr19:3982143-3982173
  misc_feature 1..30: note = Hypo
  source 1..30: mol_type = genomic DNA

SEQ ID NO: 115280 - DNA, 362 bp, Homo sapiens; identical to SEQ ID NO: 83509
  misc_feature 1..362: note = chr19:3982733-3983095
  misc_feature 1..362: note = Hypo
  source 1..362: mol_type = genomic DNA

SEQ ID NO: 115281 - DNA, 30 bp, Homo sapiens; identical to SEQ ID NO: 83522
  misc_feature 1..30: note = chr19:4010876-4010906
  misc_feature 1..30: note = Hypo
  source 1..30: mol_type = genomic DNA

SEQ ID NO: 115282 - DNA, 108 bp, Homo sapiens; identical to SEQ ID NO: 83529
  misc_feature 1..108: note = chr19:4043222-4043330
  misc_feature 1..108: note = Hypo
  source 1..108: mol_type = genomic DNA

SEQ ID NO: 115283 - DNA, 30 bp, Homo sapiens; identical to SEQ ID NO: 83530
  misc_feature 1..30: note = chr19:4044591-4044621
  misc_feature 1..30: note = Hypo
  source 1..30: mol_type = genomic DNA

SEQ ID NO: 115284 - DNA, 30 bp, Homo sapiens; identical to SEQ ID NO: 83531
  misc_feature 1..30: note = chr19:4044972-4045002
  misc_feature 1..30: note = Hypo
  source 1..30: mol_type = genomic DNA

SEQ ID NO: 115285 - DNA, 30 bp, Homo sapiens; identical to SEQ ID NO: 83534
  misc_feature 1..30: note = chr19:4050407-4050437
  misc_feature 1..30: note = Hypo
  source 1..30: mol_type = genomic DNA

SEQ ID NO: 115286 - DNA, 206 bp, Homo sapiens; identical to SEQ ID NO: 45623
  misc_feature 1..206: note = chr19:4053834-4054040
  misc_feature 1..206: note = Hypo
  source 1..206: mol_type = genomic DNA

SEQ ID NO: 115287 - DNA, 75 bp, Homo sapiens; identical to SEQ ID NO: 83536
  misc_feature 1..75: note = chr19:4054305-4054380
  misc_feature 1..75: note = Hypo
  source 1..75: mol_type = genomic DNA

SEQ ID NO: 115288 - DNA, 276 bp, Homo sapiens; identical to SEQ ID NO: 83537
  misc_feature 1..276: note = chr19:4054641-4054917
  misc_feature 1..276: note = Hypo
  source 1..276: mol_type = genomic DNA

SEQ ID NO: 115289 - DNA, 81 bp, Homo sapiens; identical to SEQ ID NO: 37148
  misc_feature 1..81: note = chr19:4077899-4077980
  misc_feature 1..81: note = Hyper
  source 1..81: mol_type = genomic DNA

SEQ ID NO: 115290 - DNA, 30 bp, Homo sapiens; identical to SEQ ID NO: 83546
  misc_feature 1..30: note = chr19:4086323-4086353
  misc_feature 1..30: note = Hypo
  source 1..30: mol_type = genomic DNA

SEQ ID NO: 115291 - DNA, 109 bp, Homo sapiens; identical to SEQ ID NO: 83555
  misc_feature 1..109: note = chr19:4096416-4096525
  misc_feature 1..109: note = Hypo
  source 1..109: mol_type = genomic DNA

SEQ ID NO: 115292 - DNA, 45 bp, Homo sapiens; identical to SEQ ID NO: 83577
  misc_feature 1..45: note = chr19:4131483-4131528
  misc_feature 1..45: note = Hypo
  source 1..45: mol_type = genomic DNA

SEQ ID NO: 115293 - DNA, 80 bp, Homo sapiens; identical to SEQ ID NO: 83586
  misc_feature 1..80: note = chr19:4163466-4163546
  misc_feature 1..80: note = Hypo
  source 1..80: mol_type = genomic DNA

SEQ ID NO: 115294 - DNA, 206 bp, Homo sapiens; identical to SEQ ID NO: 83600
  misc_feature 1..206: note = chr19:4197993-4198199
  misc_feature 1..206: note = Hyper
  source 1..206: mol_type = genomic DNA

SEQ ID NO: 115295 - DNA, 197 bp, Homo sapiens; identical to SEQ ID NO: 83603
  misc_feature 1..197: note = chr19:4212352-4212549
  misc_feature 1..197: note = Hypo
  source 1..197: mol_type = genomic DNA

SEQ ID NO: 115296 - DNA, 77 bp, Homo sapiens; identical to SEQ ID NO: 83633
  misc_feature 1..77: note = chr19:4278832-4278909
  misc_feature 1..77: note = Hyper
  source 1..77: mol_type = genomic DNA

SEQ ID NO: 115297 - DNA, 469 bp, Homo sapiens
  misc_feature 1..469: note = chr19:4279316-4279785
  misc_feature 1..469: note = Hyper
  source 1..469: mol_type = genomic DNA
cgcccccctccccagcgtcccacctcccggcggcggcggggaaagtctctccgaaagcgtgaagggggattggaggaggtttttatttccctttgtgcgggtggctggggccggatcgaggcggcgggggccgcgggactgggggctccccgctgagccgagaggagcgcgacaaaggatgcgtcccgccggggtcacagtctccgcggcccaactttgcgcgcggcgcccgcgcccctggggagcccgcccgctgcgctgagaacccaggcgtccgggctgggagaggggccgggagcgtccgcaggtggcgctggcccggatctcccgaccccaggaagggatcccggagcttcctggaggcggcgggcggccgtgtcgctccagggaaccgcgctgcccgcggaaactccgcgcgcctccgcggatgcccctcgccctagcccccagcgcgcggggttcggggccc

SEQ ID NO: 115298 - DNA, 40 bp, Homo sapiens
  misc_feature 1..40: note = chr19:4280188-4280228
  misc_feature 1..40: note = Hyper
  source 1..40: mol_type = genomic DNA
ggacccctatgaggacgcggagagccgcttggagccggac

SEQ ID NO: 115299 - DNA, 20 bp, Homo sapiens
  misc_feature 1..20: note = chr19:4280809-4280829
  misc_feature 1..20: note = Hypo
  source 1..20: mol_type = genomic DNA
cactgcgcccggtggatatc

SEQ ID NO: 115300 - DNA, 40 bp, Homo sapiens; identical to SEQ ID NO: 83642
  misc_feature 1..40: note = chr19:4290546-4290586
  misc_feature 1..40: note = Hypo
  source 1..40: mol_type = genomic DNA

SEQ ID NO: 115301 - DNA, 26 bp, Homo sapiens
  misc_feature 1..26: note = chr19:4292523-4292549
  misc_feature 1..26: note = Hypo
  source 1..26: mol_type = genomic DNA
gtgtctggcctcgatccccccttttt

SEQ ID NO: 115302 - DNA, 270 bp, Homo sapiens; identical to SEQ ID NO: 83650
  misc_feature 1..270: note = chr19:4304414-4304684
  misc_feature 1..270: note = Hyper
  source 1..270: mol_type = genomic DNA

SEQ ID NO: 115303 - DNA, 30 bp, Homo sapiens; identical to SEQ ID NO: 83652
  misc_feature 1..30: note = chr19:4305492-4305522
  misc_feature 1..30: note = Hypo
  source 1..30: mol_type = genomic DNA

SEQ ID NO: 115304 - DNA, 42 bp, Homo sapiens; identical to SEQ ID NO: 83653
  misc_feature 1..42: note = chr19:4305764-4305806
  misc_feature 1..42: note = Hypo
  source 1..42: mol_type = genomic DNA

SEQ ID NO: 115305 - DNA, 36 bp, Homo sapiens; identical to SEQ ID NO: 83654
  misc_feature 1..36: note = chr19:4311212-4311248
  misc_feature 1..36: note = Hypo
  source 1..36: mol_type = genomic DNA

SEQ ID NO: 115306 - DNA, 76 bp, Homo sapiens; identical to SEQ ID NO: 83657
  misc_feature 1..76: note = chr19:4361174-4361250
  misc_feature 1..76: note = Hypo
  source 1..76: mol_type = genomic DNA

SEQ ID NO: 115307 - DNA, 161 bp, Homo sapiens; identical to SEQ ID NO: 83658
  misc_feature 1..161: note = chr19:4361539-4361700
  misc_feature 1..161: note = Hypo
  source 1..161: mol_type = genomic DNA

SEQ ID NO: 115308 - DNA, 52 bp, Homo sapiens; identical to SEQ ID NO: 83660
  misc_feature 1..52: note = chr19:4363354-4363406
  misc_feature 1..52: note = Hypo
  source 1..52: mol_type = genomic DNA

SEQ ID NO: 115309 - DNA, 78 bp, Homo sapiens; identical to SEQ ID NO: 83663
  misc_feature 1..78: note = chr19:4378773-4378851
  misc_feature 1..78: note = Hypo
  source 1..78: mol_type = genomic DNA

SEQ ID NO: 115310 - DNA, 35 bp, Homo sapiens; identical to SEQ ID NO: 37152
  misc_feature 1..35: note = chr19:4380549-4380584
  misc_feature 1..35: note = Hyper
  source 1..35: mol_type = genomic DNA

SEQ ID NO: 115311 - DNA, 48 bp, Homo sapiens; identical to SEQ ID NO: 45632
  misc_feature 1..48: note = chr19:4512122-4512170
  misc_feature 1..48: note = Hypo
  source 1..48: mol_type = genomic DNA

SEQ ID NO: 115312 - DNA, 30 bp, Homo sapiens; identical to SEQ ID NO: 83696
  misc_feature 1..30: note = chr19:4513397-4513427
  misc_feature 1..30: note = Hypo
  source 1..30: mol_type = genomic DNA

SEQ ID NO: 115313 - DNA, 30 bp, Homo sapiens; identical to SEQ ID NO: 83700
  misc_feature 1..30: note = chr19:4523538-4523568
  misc_feature 1..30: note = Hypo
  source 1..30: mol_type = genomic DNA

SEQ ID NO: 115314 - DNA, 21 bp, Homo sapiens
  misc_feature 1..21: note = chr19:4524273-4524294
  misc_feature 1..21: note = Hypo
  source 1..21: mol_type = genomic DNA
cacaatggggccggtcgcggt

SEQ ID NO: 115315 - DNA, 398 bp, Homo sapiens; identical to SEQ ID NO: 83712
  misc_feature 1..398: note = chr19:4547992-4548390
  misc_feature 1..398: note = Hypo
  source 1..398: mol_type = genomic DNA

SEQ ID NO: 115316 - DNA, 108 bp, Homo sapiens; identical to SEQ ID NO: 83713
  misc_feature 1..108: note = chr19:4550222-4550330
  misc_feature 1..108: note = Hypo
  source 1..108: mol_type = genomic DNA

SEQ ID NO: 115317 - DNA, 237 bp, Homo sapiens; identical to SEQ ID NO: 83714
  misc_feature 1..237: note = chr19:4550864-4551101
  misc_feature 1..237: note = Hypo
  source 1..237: mol_type = genomic DNA

SEQ ID NO: 115318 - DNA, 166 bp, Homo sapiens; identical to SEQ ID NO: 45635
  misc_feature 1..166: note = chr19:4554076-4554242
  misc_feature 1..166: note = Hypo
  source 1..166: mol_type = genomic DNA

SEQ ID NO: 115319 - DNA, 62 bp, Homo sapiens; identical to SEQ ID NO: 45636
  misc_feature 1..62: note = chr19:4554999-4555061
  misc_feature 1..62: note = Hypo
  source 1..62: mol_type = genomic DNA

SEQ ID NO: 115320 - DNA, 312 bp, Homo sapiens; identical to SEQ ID NO: 83718
  misc_feature 1..312: note = chr19:4555896-4556208
  misc_feature 1..312: note = Hypo
  source 1..312: mol_type = genomic DNA

SEQ ID NO: 115321 - DNA, 449 bp, Homo sapiens; identical to SEQ ID NO: 83719
  misc_feature 1..449: note = chr19:4556922-4557371
  misc_feature 1..449: note = Hypo
  source 1..449: mol_type = genomic DNA

SEQ ID NO: 115322 - DNA, 42 bp, Homo sapiens; identical to SEQ ID NO: 45639
  misc_feature 1..42: note = chr19:4572555-4572597
  misc_feature 1..42: note = Hypo
  source 1..42: mol_type = genomic DNA

SEQ ID NO: 115323 - DNA, 74 bp, Homo sapiens; identical to SEQ ID NO: 83754
  misc_feature 1..74: note = chr19:4597429-4597503
  misc_feature 1..74: note = Hyper
  source 1..74: mol_type = genomic DNA

SEQ ID NO: 115324 - DNA, 142 bp, Homo sapiens; identical to SEQ ID NO: 45640
  misc_feature 1..142: note = chr19:4670725-4670867
  misc_feature 1..142: note = Hypo
  source 1..142: mol_type = genomic DNA

SEQ ID NO: 115325 - DNA, 50 bp, Homo sapiens; identical to SEQ ID NO: 45641
  misc_feature 1..50: note = chr19:4672854-4672904
  misc_feature 1..50: note = Hypo
  source 1..50: mol_type = genomic DNA

SEQ ID NO: 115326 - DNA, 57 bp, Homo sapiens; identical to SEQ ID NO: 83794
  misc_feature 1..57: note = chr19:4679562-4679619
  misc_feature 1..57: note = Hypo
  source 1..57: mol_type = genomic DNA

SEQ ID NO: 115327 - DNA, 30 bp, Homo sapiens; identical to SEQ ID NO: 83815
  misc_feature 1..30: note = chr19:4700942-4700972
  misc_feature 1..30: note = Hypo
  source 1..30: mol_type = genomic DNA

SEQ ID NO: 115328 - DNA, 30 bp, Homo sapiens; identical to SEQ ID NO: 83821
  misc_feature 1..30: note = chr19:4714199-4714229
  misc_feature 1..30: note = Hypo
  source 1..30: mol_type = genomic DNA

SEQ ID NO: 115329 - DNA, 120 bp, Homo sapiens; identical to SEQ ID NO: 83825
  misc_feature 1..120: note = chr19:4725471-4725591
  misc_feature 1..120: note = Hypo
  source 1..120: mol_type = genomic DNA

SEQ ID NO: 115330 - DNA, 24 bp, Homo sapiens
  misc_feature 1..24: note = chr19:4725831-4725855
  misc_feature 1..24: note = Hypo
  source 1..24: mol_type = genomic DNA
gtgccaccacgccaggcctcttta

SEQ ID NO: 115331 - DNA, 96 bp, Homo sapiens; identical to SEQ ID NO: 83839
  misc_feature 1..96: note = chr19:4769594-4769690
  misc_feature 1..96: note = Hyper
  source 1..96: mol_type = genomic DNA

SEQ ID NO: 115332 - DNA, 120 bp, Homo sapiens; identical to SEQ ID NO: 83848
  misc_feature 1..120: note = chr19:4790000-4790120
  misc_feature 1..120: note = Hypo
  source 1..120: mol_type = genomic DNA

SEQ ID NO: 115333 - DNA, 363 bp, Homo sapiens; identical to SEQ ID NO: 83855
  misc_feature 1..363: note = chr19:4792849-4793212
  misc_feature 1..363: note = Hypo
  source 1..363: mol_type = genomic DNA

SEQ ID NO: 115334 - DNA, 38 bp, Homo sapiens; identical to SEQ ID NO: 83857
  misc_feature 1..38: note = chr19:4794081-4794119
  misc_feature 1..38: note = Hypo
  source 1..38: mol_type = genomic DNA

SEQ ID NO: 115335 - DNA, 201 bp, Homo sapiens; identical to SEQ ID NO: 83860
  misc_feature 1..201: note = chr19:4795123-4795324
  misc_feature 1..201: note = Hypo
  source 1..201: mol_type = genomic DNA

SEQ ID NO: 115336 - DNA, 137 bp, Homo sapiens; identical to SEQ ID NO: 83864
  misc_feature 1..137: note = chr19:4798614-4798751
  misc_feature 1..137: note = Hypo
  source 1..137: mol_type = genomic DNA

SEQ ID NO: 115337 - DNA, 109 bp, Homo sapiens; identical to SEQ ID NO: 83868
  misc_feature 1..109: note = chr19:4800481-4800590
  misc_feature 1..109: note = Hypo
  source 1..109: mol_type = genomic DNA

SEQ ID NO: 115338 - DNA, 85 bp, Homo sapiens; identical to SEQ ID NO: 83874
  misc_feature 1..85: note = chr19:4815691-4815776
  misc_feature 1..85: note = Hyper
  source 1..85: mol_type = genomic DNA

SEQ ID NO: 115339 - DNA, 79 bp, Homo sapiens; identical to SEQ ID NO: 83875
  misc_feature 1..79: note = chr19:4816471-4816550
  misc_feature 1..79: note = Hypo
  source 1..79: mol_type = genomic DNA

SEQ ID NO: 115340 - DNA, 53 bp, Homo sapiens; identical to SEQ ID NO: 83884
  misc_feature 1..53: note = chr19:4835677-4835730
  misc_feature 1..53: note = Hypo
  source 1..53: mol_type = genomic DNA

SEQ ID NO: 115341 - DNA, 30 bp, Homo sapiens; identical to SEQ ID NO: 83946
  misc_feature 1..30: note = chr19:4962354-4962384
  misc_feature 1..30: note = Hypo
  source 1..30: mol_type = genomic DNA

SEQ ID NO: 115342 - DNA, 120 bp, Homo sapiens; identical to SEQ ID NO: 83954
  misc_feature 1..120: note = chr19:4986513-4986633
  misc_feature 1..120: note = Hypo
  source 1..120: mol_type = genomic DNA

SEQ ID NO: 115343 - DNA, 30 bp, Homo sapiens; identical to SEQ ID NO: 83981
  misc_feature 1..30: note = chr19:5023215-5023245
  misc_feature 1..30: note = Hypo
  source 1..30: mol_type = genomic DNA

SEQ ID NO: 115344 - DNA, 63 bp, Homo sapiens; identical to SEQ ID NO: 84001
  misc_feature 1..63: note = chr19:5037561-5037624
  misc_feature 1..63: note = Hypo
  source 1..63: mol_type = genomic DNA

SEQ ID NO: 115345 - DNA, 30 bp, Homo sapiens; identical to SEQ ID NO: 84002
  misc_feature 1..30: note = chr19:5038391-5038421
  misc_feature 1..30: note = Hypo
  source 1..30: mol_type = genomic DNA

SEQ ID NO: 115346 - DNA, 142 bp, Homo sapiens; identical to SEQ ID NO: 84008
  misc_feature 1..142: note = chr19:5041033-5041175
  misc_feature 1..142: note = Hypo
  source 1..142: mol_type = genomic DNA

SEQ ID NO: 115347 - DNA, 200 bp, Homo sapiens; identical to SEQ ID NO: 45651
  misc_feature 1..200: note = chr19:5046161-5046361
  misc_feature 1..200: note = Hypo
  source 1..200: mol_type = genomic DNA

SEQ ID NO: 115348 - DNA, 30 bp, Homo sapiens; identical to SEQ ID NO: 84016
  misc_feature 1..30: note = chr19:5058670-5058700
  misc_feature 1..30: note = Hypo
  source 1..30: mol_type = genomic DNA

SEQ ID NO: 115349 - DNA, 30 bp, Homo sapiens; identical to SEQ ID NO: 84017
  misc_feature 1..30: note = chr19:5064302-5064332
  misc_feature 1..30: note = Hypo
  source 1..30: mol_type = genomic DNA

SEQ ID NO: 115350 - DNA, 30 bp, Homo sapiens; identical to SEQ ID NO: 84043
  misc_feature 1..30: note = chr19:5102740-5102770
  misc_feature 1..30: note = Hypo
  source 1..30: mol_type = genomic DNA

SEQ ID NO: 115351 - DNA, 30 bp, Homo sapiens; identical to SEQ ID NO: 84081
  misc_feature 1..30: note = chr19:5142538-5142568
  misc_feature 1..30: note = Hypo
  source 1..30: mol_type = genomic DNA

SEQ ID NO: 115352 - DNA, 30 bp, Homo sapiens; identical to SEQ ID NO: 84083
  misc_feature 1..30: note = chr19:5148235-5148265
  misc_feature 1..30: note = Hypo
  source 1..30: mol_type = genomic DNA

SEQ ID NO: 115353 - DNA, 296 bp, Homo sapiens; identical to SEQ ID NO: 84090
  misc_feature 1..296: note = chr19:5155117-5155413
  misc_feature 1..296: note = Hypo
  source 1..296: mol_type = genomic DNA

SEQ ID NO: 115354 - DNA, 30 bp, Homo sapiens; identical to SEQ ID NO: 84143
  misc_feature 1..30: note = chr19:5269609-5269639
  misc_feature 1..30: note = Hypo
  source 1..30: mol_type = genomic DNA

SEQ ID NO: 115355 - DNA, 1060 bp, Homo sapiens
  misc_feature 1..1060: note = chr19:5292613-5293673
  misc_feature 1..1060: note = Hyper
  source 1..1060: mol_type = genomic DNA
aaagcacagaggcaacgtggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctggcagcgaaggctgccccgcgcctggctccgcccccgggaggtgggggaggagagggggtggggggaggaggtcgggctgggggccaggcgggggaggggaccctgcggagcataacggtctggagttttccaaagtgcaagcgacgggcctgaatgggggggcgccaggcagcagcaggcccaagctggccctggagggcggccggcacggtcaggcccgcgctgggctgtggggacccccgtggtccccagcctcggagcctggagggggcgcgacaagagagacaaagcccggggcggcccgggcctcggggtggaagggggtcccgggcgcactcaccccgcggctcggagatcgggcccaggccccgcgaggcctccacagggcccgccgcagccgctccccgcgtccctcggtccgcccggagcgcggcgcgcagcgaagactcgggagaggcctcggcctggggagctcggcctgggggcggggcaaggggcggggctgtagggggcggggttgcagtgggcggggctgcaggggacgggccccgaggagggggattggggggcagggcggggccccggccggaagtggggcggggggaccagaggggagccccatctggaggcgcggagagcctccgcaggagtccatgaaacactgagcgaaggggcgccccagggagggcacgacccaagacccctccctcccgaagacgtctcacggggagcctctacactgctcctcgcttccccagctctgatcgtagccatggcaacgcatgaggaggctggatgccggacagggcggcggagggctccccaaacacacccaactacaggaggtcggagaaggggcaga

SEQ ID NO: 115356 - DNA, 222 bp, Homo sapiens
  misc_feature 1..222: note = chr19:5293976-5294198
  misc_feature 1..222: note = Hyper
  source 1..222: mol_type = genomic DNA
gccaatccgagccagcgttgcgcccggggtgcgggtttgaaaactccaccggaggggcccggaatgtagaagcccagcgggacctgggggtctggggacgggacaggggcagaggccgggatggagacccaagggctcccgcgtctgctcccatccctggaaaaaacgcctctcttcccagcattcgcgctgaggacgaagcccgaacgccaacgccaacgg

SEQ ID NO: 115357 - DNA, 53 bp, Homo sapiens; identical to SEQ ID NO: 84190
  misc_feature 1..53: note = chr19:5319680-5319733
  misc_feature 1..53: note = Hypo
  source 1..53: mol_type = genomic DNA

SEQ ID NO: 115358 - DNA, 30 bp, Homo sapiens; identical to SEQ ID NO: 84203
  misc_feature 1..30: note = chr19:5336366-5336396
  misc_feature 1..30: note = Hyper
  source 1..30: mol_type = genomic DNA

SEQ ID NO: 115359 - DNA, 418 bp, Homo sapiens
  misc_feature 1..418: note = chr19:5338746-5339164
  misc_feature 1..418: note = Hyper
  source 1..418: mol_type = genomic DNA
tgcaaatggcagattcgaccaagtccctgggccattaataaacgctccagcagctgccgctggtatcgcaggagcagaggagcgggatggcttccttctcccgggcgaaaggcggcagaaagagggaagaagggcgccccagacaaagaggcgccgtcaccctctgcaccccaaggacagcagcgatagggggccacccagaggaggccagaatcccagcagccaaagtccgggtggtggcggacgggagcccggagcgtgtgggtccctgtccttgggaccctaggggtctcttcctgcctcctccggcttctaggtatcatccctgctgctcagccgggactccgacacctcggacacccgcttcactagccgcggctgccgggatgtgtttttagggtctcggccagaggcagga

SEQ ID NO: 115360 - DNA, 30 bp, Homo sapiens; identical to SEQ ID NO: 37161
  misc_feature 1..30: note = chr19:5339394-5339424
  misc_feature 1..30: note = Hyper
  source 1..30: mol_type = genomic DNA

SEQ ID NO: 115361 - DNA, 41 bp, Homo sapiens; identical to SEQ ID NO: 84208
  misc_feature 1..41: note = chr19:5339625-5339666
  misc_feature 1..41: note = Hyper
  source 1..41: mol_type = genomic DNA

SEQ ID NO: 115362 - DNA, 681 bp, Homo sapiens; identical to SEQ ID NO: 84210
  misc_feature 1..681: note = chr19:5340438-5341119
  misc_feature 1..681: note = Hyper
  source 1..681: mol_type = genomic DNA

SEQ ID NO: 115363 - DNA, 45 bp, Homo sapiens; identical to SEQ ID NO: 84276
  misc_feature 1..45: note = chr19:5436734-5436779
  misc_feature 1..45: note = Hyper
  source 1..45: mol_type = genomic DNA

SEQ ID NO: 115364 - DNA, 284 bp, Homo sapiens; identical to SEQ ID NO: 84277
  misc_feature 1..284: note = chr19:5437029-5437313
  misc_feature 1..284: note = Hyper
  source 1..284: mol_type = genomic DNA

SEQ ID NO: 115365 - DNA, 53 bp, Homo sapiens; identical to SEQ ID NO: 84293
  misc_feature 1..53: note = chr19:5441350-5441403
  misc_feature 1..53: note = Hypo
  source 1..53: mol_type = genomic DNA

SEQ ID NO: 115366 - DNA, 30 bp, Homo sapiens; identical to SEQ ID NO: 84314
  misc_feature 1..30: note = chr19:5456281-5456311
  misc_feature 1..30: note = Hypo
  source 1..30: mol_type = genomic DNA

SEQ ID NO: 115367 - DNA, 219 bp, Homo sapiens; identical to SEQ ID NO: 84329
  misc_feature 1..219: note = chr19:5567484-5567703
  misc_feature 1..219: note = Hyper
  source 1..219: mol_type = genomic DNA

SEQ ID NO: 115368 - DNA, 918 bp, Homo sapiens; identical to SEQ ID NO: 84346
  misc_feature 1..918: note = chr19:5587305-5588223
  misc_feature 1..918: note = Hypo
  source 1..918: mol_type = genomic DNA

SEQ ID NO: 115369 - DNA, 30 bp, Homo sapiens; identical to SEQ ID NO: 84354
  misc_feature 1..30: note = chr19:5595231-5595261
  misc_feature 1..30: note = Hypo
  source 1..30: mol_type = genomic DNA

SEQ ID NO: 115370 - DNA, 30 bp, Homo sapiens; identical to SEQ ID NO: 84396
  misc_feature 1..30: note = chr19:5668242-5668272
  misc_feature 1..30: note = Hypo
  source 1..30: mol_type = genomic DNA

SEQ ID NO: 115371 - DNA, 124 bp, Homo sapiens; identical to SEQ ID NO: 84404
  misc_feature 1..124: note = chr19:5676787-5676911
  misc_feature 1..124: note = Hypo
  source 1..124: mol_type = genomic DNA

SEQ ID NO: 115372 - DNA, 30 bp, Homo sapiens; identical to SEQ ID NO: 84406
  misc_feature 1..30: note = chr19:5681360-5681390
  misc_feature 1..30: note = Hyper
  source 1..30: mol_type = genomic DNA

SEQ ID NO: 115373 - DNA, 30 bp, Homo sapiens; identical to SEQ ID NO: 45656
  misc_feature 1..30: note = chr19:5688079-5688109
  misc_feature 1..30: note = Hypo
  source 1..30: mol_type = genomic DNA

SEQ ID NO: 115374 - DNA, 35 bp, Homo sapiens; identical to SEQ ID NO: 84442
  misc_feature 1..35: note = chr19:5721426-5721461
  misc_feature 1..35: note = Hypo
  source 1..35: mol_type = genomic DNA

SEQ ID NO: 115375 - DNA, 34 bp, Homo sapiens; identical to SEQ ID NO: 84448
  misc_feature 1..34: note = chr19:5746446-5746480
  misc_feature 1..34: note = Hypo
  source 1..34: mol_type = genomic DNA

SEQ ID NO: 115376 - DNA, 180 bp, Homo sapiens; identical to SEQ ID NO: 84451
  misc_feature 1..180: note = chr19:5759631-5759811
  misc_feature 1..180: note = Hypo
  source 1..180: mol_type = genomic DNA

SEQ ID NO: 115377 - DNA, 23 bp, Homo sapiens
  misc_feature 1..23: note = chr19:5774263-5774286
  misc_feature 1..23: note = Hypo
  source 1..23: mol_type = genomic DNA
actgcgcccggtcggctctgttg

SEQ ID NO: 115378 - DNA, 237 bp, Homo sapiens; identical to SEQ ID NO: 84476
  misc_feature 1..237: note = chr19:5789690-5789927
  misc_feature 1..237: note = Hypo
  source 1..237: mol_type = genomic DNA

SEQ ID NO: 115379 - DNA, 45 bp, Homo sapiens; identical to SEQ ID NO: 84478
  misc_feature 1..45: note = chr19:5790168-5790213
  misc_feature 1..45: note = Hypo
  source 1..45: mol_type = genomic DNA

SEQ ID NO: 115380 - DNA, 70 bp, Homo sapiens; identical to SEQ ID NO: 84479
  misc_feature 1..70: note = chr19:5792712-5792782
  misc_feature 1..70: note = Hypo
  source 1..70: mol_type = genomic DNA

SEQ ID NO: 115381 - DNA, 48 bp, Homo sapiens; identical to SEQ ID NO: 84513
  misc_feature 1..48: note = chr19:5825314-5825362
  misc_feature 1..48: note = Hypo
  source 1..48: mol_type = genomic DNA

SEQ ID NO: 115382 - DNA, 35 bp, Homo sapiens; identical to SEQ ID NO: 84514
  misc_feature 1..35: note = chr19:5826174-5826209
  misc_feature 1..35: note = Hypo
  source 1..35: mol_type = genomic DNA

SEQ ID NO: 115383 - DNA, 520 bp, Homo sapiens; identical to SEQ ID NO: 84516
  misc_feature 1..520: note = chr19:5827795-5828315
  misc_feature 1..520: note = Hyper
  source 1..520: mol_type = genomic DNA

SEQ ID NO: 115384 - DNA, 30 bp, Homo sapiens; identical to SEQ ID NO: 84518
  misc_feature 1..30: note = chr19:5829268-5829298
  misc_feature 1..30: note = Hyper
  source 1..30: mol_type = genomic DNA

SEQ ID NO: 115385 - DNA, 21 bp, Homo sapiens
  misc_feature 1..21: note = chr19:5857651-5857672
  misc_feature 1..21: note = Hypo
  source 1..21: mol_type = genomic DNA
gacgtgcgtgacacaatgttt

SEQ ID NO: 115386 - DNA, 74 bp, Homo sapiens; identical to SEQ ID NO: 84582
  misc_feature 1..74: note = chr19:5896952-5897026
  misc_feature 1..74: note = Hypo
  source 1..74: mol_type = genomic DNA

SEQ ID NO: 115387 - DNA, 181 bp, Homo sapiens; identical to SEQ ID NO: 84583
  misc_feature 1..181: note = chr19:5897577-5897758
  misc_feature 1..181: note = Hypo
  source 1..181: mol_type = genomic DNA

SEQ ID NO: 115388 - DNA, 16 bp, Homo sapiens
  misc_feature 1..16: note = chr19:5902541-5902557
  misc_feature 1..16: note = Hypo
  source 1..16: mol_type = genomic DNA
ccggattacaggtgtg

SEQ ID NO: 115389 - DNA, 33 bp, Homo sapiens; identical to SEQ ID NO: 45663
  misc_feature 1..33: note = chr19:5905436-5905469
  misc_feature 1..33: note = Hypo
  source 1..33: mol_type = genomic DNA

SEQ ID NO: 115390 - DNA, 90 bp, Homo sapiens; identical to SEQ ID NO: 84591
  misc_feature 1..90: note = chr19:5910339-5910429
  misc_feature 1..90: note = Hypo
  source 1..90: mol_type = genomic DNA

SEQ ID NO: 115391 - DNA, 406 bp, Homo sapiens; identical to SEQ ID NO: 84593
  misc_feature 1..406: note = chr19:5914724-5915130
  misc_feature 1..406: note = Hypo
  source 1..406: mol_type = genomic DNA

SEQ ID NO: 115392 - DNA, 99 bp, Homo sapiens; identical to SEQ ID NO: 84594
  misc_feature 1..99: note = chr19:5915421-5915520
  misc_feature 1..99: note = Hypo
  source 1..99: mol_type = genomic DNA

SEQ ID NO: 115393 - DNA, 44 bp, Homo sapiens; identical to SEQ ID NO: 84595
  misc_feature 1..44: note = chr19:5915925-5915969
  misc_feature 1..44: note = Hypo
  source 1..44: mol_type = genomic DNA

SEQ ID NO: 115394 - DNA, 54 bp, Homo sapiens; identical to SEQ ID NO: 84598
  misc_feature 1..54: note = chr19:5957003-5957057
  misc_feature 1..54: note = Hypo
  source 1..54: mol_type = genomic DNA

SEQ ID NO: 115395 - DNA, 229 bp, Homo sapiens; identical to SEQ ID NO: 84599
  misc_feature 1..229: note = chr19:5960625-5960854
  misc_feature 1..229: note = Hypo
  source 1..229: mol_type = genomic DNA

SEQ ID NO: 115396 - DNA, 218 bp, Homo sapiens; identical to SEQ ID NO: 84600
  misc_feature 1..218: note = chr19:5962237-5962455
  misc_feature 1..218: note = Hyper
  source 1..218: mol_type = genomic DNA

SEQ ID NO: 115397 - DNA, 98 bp, Homo sapiens; identical to SEQ ID NO: 84602
  misc_feature 1..98: note = chr19:6007814-6007912
  misc_feature 1..98: note = Hypo
  source 1..98: mol_type = genomic DNA

SEQ ID NO: 115398 - DNA, 30 bp, Homo sapiens; identical to SEQ ID NO: 84604
  misc_feature 1..30: note = chr19:6017660-6017690
  misc_feature 1..30: note = Hypo
  source 1..30: mol_type = genomic DNA

SEQ ID NO: 115399 - DNA, 237 bp, Homo sapiens; identical to SEQ ID NO: 84605
  misc_feature 1..237: note = chr19:6020825-6021062
  misc_feature 1..237: note = Hypo
  source 1..237: mol_type = genomic DNA

SEQ ID NO: 115400 - DNA, 30 bp, Homo sapiens; identical to SEQ ID NO: 84606
  misc_feature 1..30: note = chr19:6023009-6023039
  misc_feature 1..30: note = Hypo
  source 1..30: mol_type = genomic DNA

SEQ ID NO: 115401 - DNA, 30 bp, Homo sapiens; identical to SEQ ID NO: 84609
  misc_feature 1..30: note = chr19:6042332-6042362
  misc_feature 1..30: note = Hypo
  source 1..30: mol_type = genomic DNA

SEQ ID NO: 115402 - DNA, 185 bp, Homo sapiens; identical to SEQ ID NO: 84610
  misc_feature 1..185: note = chr19:6145786-6145971
  misc_feature 1..185: note = Hypo
  source 1..185: mol_type = genomic DNA

SEQ ID NO: 115403 - DNA, 30 bp, Homo sapiens; identical to SEQ ID NO: 84612
  misc_feature 1..30: note = chr19:6198569-6198599
  misc_feature 1..30: note = Hypo
  source 1..30: mol_type = genomic DNA

SEQ ID NO: 115404 - DNA, 30 bp, Homo sapiens; identical to SEQ ID NO: 84613
  misc_feature 1..30: note = chr19:6237402-6237432
  misc_feature 1..30: note = Hypo
  source 1..30: mol_type = genomic DNA

SEQ ID NO: 115405 - DNA, 30 bp, Homo sapiens; identical to SEQ ID NO: 84615
  misc_feature 1..30: note = chr19:6280926-6280956
  misc_feature 1..30: note = Hypo
  source 1..30: mol_type = genomic DNA

SEQ ID NO: 115406 - DNA, 321 bp, Homo sapiens; identical to SEQ ID NO: 84617
  misc_feature 1..321: note = chr19:6333454-6333775
  misc_feature 1..321: note = Hypo
  source 1..321: mol_type = genomic DNA

SEQ ID NO: 115407 - DNA, 18 bp, Homo sapiens
  misc_feature 1..18: note = chr19:6345197-6345215
  misc_feature 1..18: note = Hypo
  source 1..18: mol_type = genomic DNA
gcccggcctccgtgtgtt

SEQ ID NO: 115408 - DNA, 22 bp, Homo sapiens
  misc_feature 1..22: note = chr19:6351083-6351105
  misc_feature 1..22: note = Hypo
  source 1..22: mol_type = genomic DNA
atatgagttataggccgggtgt

SEQ ID NO: 115409 - DNA, 215 bp, Homo sapiens; identical to SEQ ID NO: 45670
  misc_feature 1..215: note = chr19:6358251-6358466
  misc_feature 1..215: note = Hypo
  source 1..215: mol_type = genomic DNA

SEQ ID NO: 115410 - DNA, 101 bp, Homo sapiens; identical to SEQ ID NO: 84624
  misc_feature 1..101: note = chr19:6393986-6394087
  misc_feature 1..101: note = Hyper
  source 1..101: mol_type = genomic DNA

SEQ ID NO: 115411 - DNA, 30 bp, Homo sapiens; identical to SEQ ID NO: 84627
  misc_feature 1..30: note = chr19:6436032-6436062
  misc_feature 1..30: note = Hypo
  source 1..30: mol_type = genomic DNA

SEQ ID NO: 115412 - DNA, 15 bp, Homo sapiens
  misc_feature 1..15: note = chr19:6463907-6463922
  misc_feature 1..15: note = Hypo
  source 1..15: mol_type = genomic DNA
cgtgagccattgcgc

SEQ ID NO: 115413 - DNA, 145 bp, Homo sapiens; identical to SEQ ID NO: 84629
  misc_feature 1..145: note = chr19:6464334-6464479
  misc_feature 1..145: note = Hyper
  source 1..145: mol_type = genomic DNA

SEQ ID NO: 115414 - DNA, 87 bp, Homo sapiens; identical to SEQ ID NO: 84630
  misc_feature 1..87: note = chr19:6501827-6501914
  misc_feature 1..87: note = Hyper
  source 1..87: mol_type = genomic DNA

SEQ ID NO: 115415 - DNA, 93 bp, Homo sapiens; identical to SEQ ID NO: 84631
  misc_feature 1..93: note = chr19:6502684-6502777
  misc_feature 1..93: note = Hyper
  source 1..93: mol_type = genomic DNA

SEQ ID NO: 115416 - DNA, 231 bp, Homo sapiens; identical to SEQ ID NO: 84632
  misc_feature 1..231: note = chr19:6531064-6531295
  misc_feature 1..231: note = Hyper
  source 1..231: mol_type = genomic DNA

SEQ ID NO: 115417 - DNA, 556 bp, Homo sapiens; identical to SEQ ID NO: 84633
  misc_feature 1..556: note = chr19:6590325-6590881
  misc_feature 1..556: note = Hyper
  source 1..556: mol_type = genomic DNA

SEQ ID NO: 115418 - DNA, 21 bp, Homo sapiens
  misc_feature 1..21: note = chr19:6623980-6624001
  misc_feature 1..21: note = Hypo
  source 1..21: mol_type = genomic DNA
accctaagggccaggcgtggt

SEQ ID NO: 115419 - DNA, 30 bp, Homo sapiens; identical to SEQ ID NO: 84637
  misc_feature 1..30: note = chr19:6664938-6664968
  misc_feature 1..30: note = Hypo
  source 1..30: mol_type = genomic DNA

SEQ ID NO: 115420 - DNA, 111 bp, Homo sapiens; identical to SEQ ID NO: 84639
  misc_feature 1..111: note = chr19:6822252-6822363
  misc_feature 1..111: note = Hypo
  source 1..111: mol_type = genomic DNA

SEQ ID NO: 115421 - DNA, 21 bp, Homo sapiens
  misc_feature 1..21: note = chr19:6846939-6846960
  misc_feature 1..21: note = Hypo
  source 1..21: mol_type = genomic DNA
ttggagacagagtttcgcact

SEQ ID NO: 115422 - DNA, 71 bp, Homo sapiens; identical to SEQ ID NO: 84641
  misc_feature 1..71: note = chr19:6862981-6863052
  misc_feature 1..71: note = Hyper
  source 1..71: mol_type = genomic DNA

SEQ ID NO: 115423 - DNA, 30 bp, Homo sapiens; identical to SEQ ID NO: 84644
  misc_feature 1..30: note = chr19:6985326-6985356
  misc_feature 1..30: note = Hypo
  source 1..30: mol_type = genomic DNA

SEQ ID NO: 115424 - DNA, 401 bp, Homo sapiens; identical to SEQ ID NO: 84645
  misc_feature 1..401: note = chr19:6986177-6986578
  misc_feature 1..401: note = Hypo
  source 1..401: mol_type = genomic DNA

SEQ ID NO: 115425 - DNA, 30 bp, Homo sapiens; identical to SEQ ID NO: 84646
  misc_feature 1..30: note = chr19:7005228-7005258
  misc_feature 1..30: note = Hypo
  source 1..30: mol_type = genomic DNA

SEQ ID NO: 115426 - DNA, 76 bp, Homo sapiens; identical to SEQ ID NO: 84650
  misc_feature 1..76: note = chr19:7116391-7116467
  misc_feature 1..76: note = Hypo
  source 1..76: mol_type = genomic DNA

SEQ ID NO: 115427 - DNA, 38 bp, Homo sapiens; identical to SEQ ID NO: 45673
  misc_feature 1..38: note = chr19:7168432-7168470
  misc_feature 1..38: note = Hypo
  source 1..38: mol_type = genomic DNA

SEQ ID NO: 115428 - DNA, 396 bp, Homo sapiens; identical to SEQ ID NO: 84652
  misc_feature 1..396: note = chr19:7184240-7184636
  misc_feature 1..396: note = Hypo
  source 1..396: mol_type = genomic DNA

SEQ ID NO: 115429 - DNA, 329 bp, Homo sapiens; identical to SEQ ID NO: 84653
  misc_feature 1..329: note = chr19:7197100-7197429
  misc_feature 1..329: note = Hyper
  source 1..329: mol_type = genomic DNA

SEQ ID NO: 115430 - DNA, 44 bp, Homo sapiens; identical to SEQ ID NO: 84655
  misc_feature 1..44: note = chr19:7267703-7267747
  misc_feature 1..44: note = Hypo
  source 1..44: mol_type = genomic DNA

SEQ ID NO: 115431 - DNA, 219 bp, Homo sapiens; identical to SEQ ID NO: 84657
  misc_feature 1..219: note = chr19:7293527-7293746
  misc_feature 1..219: note = Hyper
  source 1..219: mol_type = genomic DNA

SEQ ID NO: 115432 - DNA, 104 bp, Homo sapiens; identical to SEQ ID NO: 45675
  misc_feature 1..104: note = chr19:7542252-7542356
  misc_feature 1..104: note = Hypo
  source 1..104: mol_type = genomic DNA

SEQ ID NO: 115433 - DNA, 48 bp, Homo sapiens; identical to SEQ ID NO: 84664
  misc_feature 1..48: note = chr19:7543263-7543311
  misc_feature 1..48: note = Hypo
  source 1..48: mol_type = genomic DNA

SEQ ID NO: 115434 - DNA, 30 bp, Homo sapiens; identical to SEQ ID NO: 45676
  misc_feature 1..30: note = chr19:7543713-7543743
  misc_feature 1..30: note = Hypo
  source 1..30: mol_type = genomic DNA

SEQ ID NO: 115435 - DNA, 279 bp, Homo sapiens; identical to SEQ ID NO: 84666
  misc_feature 1..279: note = chr19:7565964-7566243
  misc_feature 1..279: note = Hyper
  source 1..279: mol_type = genomic DNA

SEQ ID NO: 115436 - DNA, 165 bp, Homo sapiens; identical to SEQ ID NO: 84667
  misc_feature 1..165: note = chr19:7572022-7572187
  misc_feature 1..165: note = Hypo
  source 1..165: mol_type = genomic DNA

SEQ ID NO: 115437 - DNA, 202 bp, Homo sapiens; identical to SEQ ID NO: 84668
  misc_feature 1..202: note = chr19:7627647-7627849
  misc_feature 1..202: note = Hypo
  source 1..202: mol_type = genomic DNA

SEQ ID NO: 115438 - DNA, 30 bp, Homo sapiens; identical to SEQ ID NO: 84669
  misc_feature 1..30: note = chr19:7655702-7655732
  misc_feature 1..30: note = Hypo
  source 1..30: mol_type = genomic DNA

SEQ ID NO: 115439 - DNA, 30 bp, Homo sapiens; identical to SEQ ID NO: 84670
  misc_feature 1..30: note = chr19:7657876-7657906
  misc_feature 1..30: note = Hypo
  source 1..30: mol_type = genomic DNA

SEQ ID NO: 115440 - DNA, 391 bp, Homo sapiens; identical to SEQ ID NO: 84671
  misc_feature 1..391: note = chr19:7706453-7706844
  misc_feature 1..391: note = Hypo
  source 1..391: mol_type = genomic DNA

SEQ ID NO: 115441 - DNA, 127 bp, Homo sapiens; identical to SEQ ID NO: 45679
  misc_feature 1..127: note = chr19:7727784-7727911
  misc_feature 1..127: note = Hypo
  source 1..127: mol_type = genomic DNA

SEQ ID NO: 115442 - DNA, 340 bp, Homo sapiens; identical to SEQ ID NO: 84673
  misc_feature 1..340: note = chr19:7752247-7752587
  misc_feature 1..340: note = Hypo
  source 1..340: mol_type = genomic DNA

SEQ ID NO: 115443 - DNA, 30 bp, Homo sapiens; identical to SEQ ID NO: 84674
  misc_feature 1..30: note = chr19:7755197-7755227
  misc_feature 1..30: note = Hypo
  source 1..30: mol_type = genomic DNA

SEQ ID NO: 115444 - DNA, 556 bp, Homo sapiens; identical to SEQ ID NO: 84675
  misc_feature 1..556: note = chr19:7794710-7795266
  misc_feature 1..556: note = Hyper
  source 1..556: mol_type = genomic DNA

SEQ ID NO: 115445 - DNA, 299 bp, Homo sapiens
  misc_feature 1..299: note = chr19:7795513-7795812
  misc_feature 1..299: note = Hyper
  source 1..299: mol_type = genomic DNA
aaggtcagagtgcagcgtcagggtcaggacggggtgcatgatcggggtcgggggtcagcactcaggacggggtcggggtcgggggacgcggccagggctcagggccggggtcgcgtcgggccctcaccgcgctcacgcagttcccgcagggcgctctcctgctccatcagcttcgcctgcgcctccccaagctccgcgcgcgtggtctgcagctgcgcctgcgtccccgagcctgggagccgcagggtgagaggggcgagggcggcgaggatggggcgggacttcggagaccagccccc

SEQ ID NO: 115446 - DNA, 30 bp, Homo sapiens; identical to SEQ ID NO: 84678
  misc_feature 1..30: note = chr19:7815355-7815385
  misc_feature 1..30: note = Hypo
  source 1..30: mol_type = genomic DNA

SEQ ID NO: 115447 - DNA, 1028 bp, Homo sapiens
  misc_feature 1..1028: note = chr19:7852955-7853983
  misc_feature 1..1028: note = Hyper
  source 1..1028: mol_type = genomic DNA
ttgctcgcgtctgagcgtgagcagagtgtgtgtacatctttgggccgtttgcagtcacgcgtgtgcacatggcgtgcacgtatgtgtgcgagtccccacgcgtttgtctcccatcggcgtgtgtgcacatagtgtgcgctatatgcctgcctgcccgcccgctctgtggtcccgagtcgggggaccccgcaccccccgggcaagggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggtccctgagtctggccacggggtgtggaagggagtcccctgagtcctcccaagtgacccggcgggcatgcgttttgggatgggggtcgttccagcctcgaagcagacggcggcgctgggtgccctggaggaggaggtgggagcctgccacagctgctgtgagggggcgcggcccagactatgggcgcaagggtggggtcttgtggccgggatgggaggggggccggaggcgaggcctgcggcgagtggggcggcggggggctggtctccgaagtcccgccccatcctcgcctccctcgcccctctcaccccgcggctcccaggctcggggacgcaggcgctgctgcagaccacgagcgcggagcttggggaggcgcaggcgaagctgatggagcaggagagagccctgcgggaactgcgtgagcgcggtgagggcccgacgcgaccccagccctgagccctggccgcgtcccccgaccccgaccccgaccccgtcctgagtgctgacccctgacactgatcatgcaccccgtcctgaccctgacgctgcactctgaccttgactgccactcctagcgccggccacacccggaccctgcccaggtgtaaccgtccttgaccctgt

SEQ ID NO: 115448 - DNA, 281 bp, Homo sapiens
  misc_feature 1..281: note = chr19:7854218-7854499
  misc_feature 1..281: note = Hyper
  source 1..281: mol_type = genomic DNA
taagtggaccctgcccgtgtgcgtcgccggaccccctctttgaccttggcctggtcctgtggctccacccctgagcccgtggggccaaacccctaccccctgcatcctcttggtgcgctctccctggaagcactcgacctctctgacccttgccaccctacaggttcctgtgagccgtgccctacgtcgtggctgcccttcgggggctcctgctactatttctctgtgccgaagaccacgtgggcagaggcgcagggccactgcgccgatgccagcgcaca

SEQ ID NO: 115449 - DNA, 232 bp, Homo sapiens; identical to SEQ ID NO: 84684
  misc_feature 1..232: note = chr19:7914950-7915182
  misc_feature 1..232: note = Hypo
  source 1..232: mol_type = genomic DNA

SEQ ID NO: 115450 - DNA, 74 bp, Homo sapiens; identical to SEQ ID NO: 84685
  misc_feature 1..74: note = chr19:7926897-7926971
  misc_feature 1..74: note = Hyper
  source 1..74: mol_type = genomic DNA

SEQ ID NO: 115451 - DNA, 120 bp, Homo sapiens; identical to SEQ ID NO: 84686
  misc_feature 1..120: note = chr19:7927433-7927553
  misc_feature 1..120: note = Hyper
  source 1..120: mol_type = genomic DNA

SEQ ID NO: 115452 - DNA, 82 bp, Homo sapiens; identical to SEQ ID NO: 84687
  misc_feature 1..82: note = chr19:7934175-7934257
  misc_feature 1..82: note = Hyper
  source 1..82: mol_type = genomic DNA

SEQ ID NO: 115453 - DNA, 45 bp, Homo sapiens
  misc_feature 1..45: note = chr19:7938775-7938820
  misc_feature 1..45: note = Hyper
  source 1..45: mol_type = genomic DNA
agtcccaccccccaccgcttttccctaaagcgaagaggccctgcc

SEQ ID NO: 115454 - DNA, 79 bp, Homo sapiens; identical to SEQ ID NO: 84689
  misc_feature 1..79: note = chr19:7939141-7939220
  misc_feature 1..79: note = Hyper
  source 1..79: mol_type = genomic DNA

SEQ ID NO: 115455 - DNA, 35 bp, Homo sapiens; identical to SEQ ID NO: 84690
  misc_feature 1..35: note = chr19:7939421-7939456
  misc_feature 1..35: note = Hyper
  source 1..35: mol_type = genomic DNA

SEQ ID NO: 115456 - DNA, 114 bp, Homo sapiens; identical to SEQ ID NO: 84691
  misc_feature 1..114: note = chr19:7953384-7953498
  misc_feature 1..114: note = Hyper
  source 1..114: mol_type = genomic DNA

SEQ ID NO: 115457 - DNA, 30 bp, Homo sapiens; identical to SEQ ID NO: 84692
  misc_feature 1..30: note = chr19:7969667-7969697
  misc_feature 1..30: note = Hypo
  source 1..30: mol_type = genomic DNA

SEQ ID NO: 115458 - DNA, 30 bp, Homo sapiens; identical to SEQ ID NO: 84693
  misc_feature 1..30: note = chr19:7969931-7969961
  misc_feature 1..30: note = Hypo
  source 1..30: mol_type = genomic DNA

SEQ ID NO: 115459 - DNA, 48 bp, Homo sapiens; identical to SEQ ID NO: 45682
  misc_feature 1..48: note = chr19:7970450-7970498
  misc_feature 1..48: note = Hypo
  source 1..48: mol_type = genomic DNA

SEQ ID NO: 115460 - DNA, 64 bp, Homo sapiens; identical to SEQ ID NO: 84695
  misc_feature 1..64: note = chr19:7981019-7981083
  misc_feature 1..64: note = Hyper
  source 1..64: mol_type = genomic DNA

SEQ ID NO: 115461 - DNA, 30 bp, Homo sapiens; identical to SEQ ID NO: 84696
  misc_feature 1..30: note = chr19:7982356-7982386
  misc_feature 1..30: note = Hyper
  source 1..30: mol_type = genomic DNA

SEQ ID NO: 115462 - DNA, 184 bp, Homo sapiens; identical to SEQ ID NO: 84697
  misc_feature 1..184: note = chr19:7982589-7982773
  misc_feature 1..184: note = Hyper
  source 1..184: mol_type = genomic DNA

SEQ ID NO: 115463 - DNA, 144 bp, Homo sapiens; identical to SEQ ID NO: 84698
  misc_feature 1..144: note = chr19:8009493-8009637
  misc_feature 1..144: note = Hypo
  source 1..144: mol_type = genomic DNA

SEQ ID NO: 115464 - DNA, 75 bp, Homo sapiens; identical to SEQ ID NO: 84700
  misc_feature 1..75: note = chr19:8053017-8053092
  misc_feature 1..75: note = Hypo
  source 1..75: mol_type = genomic DNA

SEQ ID NO: 115465 - DNA, 99 bp, Homo sapiens; identical to SEQ ID NO: 84701
  misc_feature 1..99: note = chr19:8057697-8057796
  misc_feature 1..99: note = Hypo
  source 1..99: mol_type = genomic DNA

SEQ ID NO: 115466 - DNA, 30 bp, Homo sapiens; identical to SEQ ID NO: 84702
  misc_feature 1..30: note = chr19:8067340-8067370
  misc_feature 1..30: note = Hyper
  source 1..30: mol_type = genomic DNA

SEQ ID NO: 115467 - DNA, 42 bp, Homo sapiens; identical to SEQ ID NO: 84704
  misc_feature 1..42: note = chr19:8082518-8082560
  misc_feature 1..42: note = Hypo
  source 1..42: mol_type = genomic DNA

SEQ ID NO: 115468 - DNA, 46 bp, Homo sapiens; identical to SEQ ID NO: 84705
  misc_feature 1..46: note = chr19:8091663-8091709
  misc_feature 1..46: note = Hypo
  source 1..46: mol_type = genomic DNA

SEQ ID NO: 115469 - DNA, 366 bp, Homo sapiens; identical to SEQ ID NO: 84706
  misc_feature 1..366: note = chr19:8115235-8115601
  misc_feature 1..366: note = Hyper
  source 1..366: mol_type = genomic DNA

SEQ ID NO: 115470 - DNA, 60 bp, Homo sapiens; identical to SEQ ID NO: 84708
  misc_feature 1..60: note = chr19:8124525-8124585
  misc_feature 1..60: note = Hypo
  source 1..60: mol_type = genomic DNA

SEQ ID NO: 115471 - DNA, 98 bp, Homo sapiens; identical to SEQ ID NO: 84711
  misc_feature 1..98: note = chr19:8148225-8148323
  misc_feature 1..98: note = Hypo
  source 1..98: mol_type = genomic DNA

SEQ ID NO: 115472 - DNA, 120 bp, Homo sapiens; identical to SEQ ID NO: 84712
  misc_feature 1..120: note = chr19:8151687-8151807
  misc_feature 1..120: note = Hypo
  source 1..120: mol_type = genomic DNA

SEQ ID NO: 115473 - DNA, 30 bp, Homo sapiens; identical to SEQ ID NO: 84714
  misc_feature 1..30: note = chr19:8191057-8191087
  misc_feature 1..30: note = Hypo
  source 1..30: mol_type = genomic DNA

SEQ ID NO: 115474 - DNA, 34 bp, Homo sapiens; identical to SEQ ID NO: 45686
  misc_feature 1..34: note = chr19:8194085-8194119
  misc_feature 1..34: note = Hypo
  source 1..34: mol_type = genomic DNA

SEQ ID NO: 115475 - DNA, 70 bp, Homo sapiens; identical to SEQ ID NO: 84716
  misc_feature 1..70: note = chr19:8196678-8196748
  misc_feature 1..70: note = Hypo
  source 1..70: mol_type = genomic DNA

SEQ ID NO: 115476 - DNA, 71 bp, Homo sapiens; identical to SEQ ID NO: 84717
  misc_feature 1..71: note = chr19:8214391-8214462
  misc_feature 1..71: note = Hyper
  source 1..71: mol_type = genomic DNA

SEQ ID NO: 115477 - DNA, 180 bp, Homo sapiens; identical to SEQ ID NO: 84721
  misc_feature 1..180: note = chr19:8253645-8253825
  misc_feature 1..180: note = Hypo
  source 1..180: mol_type = genomic DNA

SEQ ID NO: 115478 - DNA, 30 bp, Homo sapiens; identical to SEQ ID NO: 84722
  misc_feature 1..30: note = chr19:8407763-8407793
  misc_feature 1..30: note = Hyper
  source 1..30: mol_type = genomic DNA

SEQ ID NO: 115479 - DNA, 644 bp, Homo sapiens; identical to SEQ ID NO: 84723
  misc_feature 1..644: note = chr19:8428713-8429357
  misc_feature 1..644: note = Hyper
  source 1..644: mol_type = genomic DNA

SEQ ID NO: 115480 - DNA, 32 bp, Homo sapiens; identical to SEQ ID NO: 84724
  misc_feature 1..32: note = chr19:8432333-8432365
  misc_feature 1..32: note = Hyper
  source 1..32: mol_type = genomic DNA

SEQ ID NO: 115481 - DNA, 30 bp, Homo sapiens; identical to SEQ ID NO: 84725
  misc_feature 1..30: note = chr19:8461662-8461692
  misc_feature 1..30: note = Hyper
  source 1..30: mol_type = genomic DNA

SEQ ID NO: 115482 - DNA, 83 bp, Homo sapiens; identical to SEQ ID NO: 84726
  misc_feature 1..83: note = chr19:8475442-8475525
  misc_feature 1..83: note = Hypo
  source 1..83: mol_type = genomic DNA

SEQ ID NO: 115483 - DNA, 30 bp, Homo sapiens; identical to SEQ ID NO: 84729
  misc_feature 1..30: note = chr19:8528381-8528411
  misc_feature 1..30: note = Hypo
  source 1..30: mol_type = genomic DNA

SEQ ID NO: 115484 - DNA, 341 bp, Homo sapiens; identical to SEQ ID NO: 84730
  misc_feature 1..341: note = chr19:8576789-8577130
  misc_feature 1..341: note = Hypo
  source 1..341: mol_type = genomic DNA

SEQ ID NO: 115485 - DNA, 30 bp, Homo sapiens; identical to SEQ ID NO: 84731
  misc_feature 1..30: note = chr19:8601272-8601302
  misc_feature 1..30: note = Hypo
  source 1..30: mol_type = genomic DNA

SEQ ID NO: 115486 - DNA, 116 bp, Homo sapiens; identical to SEQ ID NO: 84742
  misc_feature 1..116: note = chr19:9129113-9129229
  misc_feature 1..116: note = Hypo
  source 1..116: mol_type = genomic DNA

SEQ ID NO: 115487 - DNA, 111 bp, Homo sapiens; identical to SEQ ID NO: 84745
  misc_feature 1..111: note = chr19:9261611-9261722
  misc_feature 1..111: note = Hypo
  source 1..111: mol_type = genomic DNA

SEQ ID NO: 115488 - DNA, 158 bp, Homo sapiens; identical to SEQ ID NO: 84747
  misc_feature 1..158: note = chr19:9434811-9434969
  misc_feature 1..158: note = Hyper
  source 1..158: mol_type = genomic DNA

SEQ ID NO: 115489 - DNA, 30 bp, Homo sapiens; identical to SEQ ID NO: 84748
  misc_feature 1..30: note = chr19:9435206-9435236
  misc_feature 1..30: note = Hyper
  source 1..30: mol_type = genomic DNA

SEQ ID NO: 115490 - DNA, 404 bp, Homo sapiens
  misc_feature 1..404: note = chr19:9473652-9474056
  misc_feature 1..404: note = Hyper
  source 1..404: mol_type = genomic DNA
ctttcagctgctggccggaagcggaagtgggcgtccgtcgcctcgccatctcccatagctgtcgcctgcagctgagaaagggttgctgtcccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctgccattccgggcattggttcccgggaggaggcaagtgggttcatgtggtcagagtgcgtcggcggggccttttctccactttctgtacccttctctttaaacgtcgtccccagtaggag

SEQ ID NO: 115491 - DNA, 422 bp, Homo sapiens
  misc_feature 1..422: note = chr19:9517563-9517985
  misc_feature 1..422: note = Hyper
  source 1..422: mol_type = genomic DNA
gaagaagtgcggtgtcggcaggaagtcccagcgcgacgtccgggaaagccacaggaggaggcgacctgcaggaggctaccctttgaccccaaccctactctccagtcctcctagtctggtgggagcaaccttagactggttgatgtggaaggaggcgggcctgcacgcggagtacggcattcacttccgtttccgggagcgcacttccgtttccaggcatgagggcaacgggggaggggggggaggtgacctggaatgggctgagaaacaggagccacgagagccgcgtggtgacgttagaagggcgctacagccgcgactttccaaagctagtagagagatcccagcgtcccccgggaaaggcagaaggggcggggcgataccaagacggagacaatggggcggggcgatgccctggaggc

SEQ ID NO: 115492 - DNA, 30 bp, Homo sapiens; identical to SEQ ID NO: 84753
  misc_feature 1..30: note = chr19:9545256-9545286
  misc_feature 1..30: note = Hypo
  source 1..30: mol_type = genomic DNA

SEQ ID NO: 115493 - DNA, 585 bp, Homo sapiens; identical to SEQ ID NO: 84758
  misc_feature 1..585: note = chr19:9608851-9609436
  misc_feature 1..585: note = Hyper
  source 1..585: mol_type = genomic DNA

SEQ ID NO: 115494 - DNA, 259 bp, Homo sapiens; identical to SEQ ID NO: 84760
  misc_feature 1..259: note = chr19:9649131-9649390
  misc_feature 1..259: note = Hyper
  source 1..259: mol_type = genomic DNA

SEQ ID NO: 115495 - DNA, 92 bp, Homo sapiens; identical to SEQ ID NO: 84762
  misc_feature 1..92: note = chr19:9786287-9786379
  misc_feature 1..92: note = Hypo
  source 1..92: mol_type = genomic DNA

SEQ ID NO: 115496 - DNA, 429 bp, Homo sapiens; identical to SEQ ID NO: 84763
  misc_feature 1..429: note = chr19:9903599-9904028
  misc_feature 1..429: note = Hyper
  source 1..429: mol_type = genomic DNA

SEQ ID NO: 115497 - DNA, 158 bp, Homo sapiens; identical to SEQ ID NO: 45692
  misc_feature 1..158: note = chr19:9937353-9937511
  misc_feature 1..158: note = Hypo
  source 1..158: mol_type = genomic DNA

SEQ ID NO: 115498 - DNA, 35 bp, Homo sapiens; identical to SEQ ID NO: 84766
  misc_feature 1..35: note = chr19:9957583-9957618
  misc_feature 1..35: note = Hypo
  source 1..35: mol_type = genomic DNA

SEQ ID NO: 115499 - DNA, 252 bp, Homo sapiens; identical to SEQ ID NO: 82335
  misc_feature 1..252: note = chr19:10024331-10024583
  misc_feature 1..252: note = Hyper
  source 1..252: mol_type = genomic DNA

SEQ ID NO: 115500 - DNA, 195 bp, Homo sapiens; identical to SEQ ID NO: 82336
  misc_feature 1..195: note = chr19:10024804-10024999
  misc_feature 1..195: note = Hyper
  source 1..195: mol_type = genomic DNA

SEQ ID NO: 115501 - DNA, 30 bp, Homo sapiens; identical to SEQ ID NO: 82341
  misc_feature 1..30: note = chr19:10120011-10120041
  misc_feature 1..30: note = Hyper
  source 1..30: mol_type = genomic DNA

SEQ ID NO: 115502 - DNA, 184 bp, Homo sapiens; identical to SEQ ID NO: 82342
  misc_feature 1..184: note = chr19:10121048-10121232
  misc_feature 1..184: note = Hyper
  source 1..184: mol_type = genomic DNA

SEQ ID NO: 115503 - DNA, 30 bp, Homo sapiens; identical to SEQ ID NO: 82343
  misc_feature 1..30: note = chr19:10142022-10142052
  misc_feature 1..30: note = Hypo
  source 1..30: mol_type = genomic DNA

SEQ ID NO: 115504 - DNA, 147 bp, Homo sapiens; identical to SEQ ID NO: 82344
  misc_feature 1..147: note = chr19:10197672-10197819
  misc_feature 1..147: note = Hyper
  source 1..147: mol_type = genomic DNA

SEQ ID NO: 115505 - DNA, 214 bp, Homo sapiens; identical to SEQ ID NO: 82345
  misc_feature 1..214: note = chr19:10207229-10207443
  misc_feature 1..214: note = Hyper
  source 1..214: mol_type = genomic DNA

SEQ ID NO: 115506 - DNA, 145 bp, Homo sapiens; identical to SEQ ID NO: 82346
  misc_feature 1..145: note = chr19:10229584-10229729
  misc_feature 1..145: note = Hypo
  source 1..145: mol_type = genomic DNA

SEQ ID NO: 115507 - DNA, 31 bp, Homo sapiens; identical to SEQ ID NO: 82347
  misc_feature 1..31: note = chr19:10231211-10231242
  misc_feature 1..31: note = Hypo
  source 1..31: mol_type = genomic DNA

SEQ ID NO: 115508 - DNA, 30 bp, Homo sapiens; identical to SEQ ID NO: 16430
  misc_feature 1..30: note = chr19:10231504-10231534
  misc_feature 1..30: note = Hypo
  source 1..30: mol_type = genomic DNA

SEQ ID NO: 115509 - DNA, 42 bp, Homo sapiens; identical to SEQ ID NO: 82349
  misc_feature 1..42: note = chr19:10246211-10246253
  misc_feature 1..42: note = Hypo
  source 1..42: mol_type = genomic DNA

SEQ ID NO: 115510 - DNA, 125 bp, Homo sapiens; identical to SEQ ID NO: 82351
  misc_feature 1..125: note = chr19:10347133-10347258
  misc_feature 1..125: note = Hyper
  source 1..125: mol_type = genomic DNA

SEQ ID NO: 115511 - DNA, 31 bp, Homo sapiens; identical to SEQ ID NO: 45695
  misc_feature 1..31: note = chr19:10362045-10362076
  misc_feature 1..31: note = Hypo
  source 1..31: mol_type = genomic DNA

SEQ ID NO: 115512 - DNA, 265 bp, Homo sapiens; identical to SEQ ID NO: 82353
  misc_feature 1..265: note = chr19:10370310-10370575
  misc_feature 1..265: note = Hypo
  source 1..265: mol_type = genomic DNA

SEQ ID NO: 115513 - DNA, 39 bp, Homo sapiens; identical to SEQ ID NO: 82354
  misc_feature 1..39: note = chr19:10371536-10371575
  misc_feature 1..39: note = Hypo
  source 1..39: mol_type = genomic DNA

SEQ ID NO: 115514 - DNA, 70 bp, Homo sapiens; identical to SEQ ID NO: 82355
  misc_feature 1..70: note = chr19:10394284-10394354
  misc_feature 1..70: note = Hypo
  source 1..70: mol_type = genomic DNA

SEQ ID NO: 115515 - DNA, 842 bp, Homo sapiens
  misc_feature 1..842: note = chr19:10397626-10398468
  misc_feature 1..842: note = Hyper
  source 1..842: mol_type = genomic DNA
ccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgac

SEQ ID NO: 115516 - DNA, 469 bp, Homo sapiens; identical to SEQ ID NO: 82359
  misc_feature 1..469: note = chr19:10400292-10400761
  misc_feature 1..469: note = Hyper
  source 1..469: mol_type = genomic DNA

SEQ ID NO: 115517 - DNA, 233 bp, Homo sapiens; identical to SEQ ID NO: 82360
  misc_feature 1..233: note = chr19:10400975-10401208
  misc_feature 1..233: note = Hyper
  source 1..233: mol_type = genomic DNA

SEQ ID NO: 115518 - DNA, 1118 bp, Homo sapiens; identical to SEQ ID NO: 82361
  misc_feature 1..1118: note = chr19:10401486-10402604
  misc_feature 1..1118: note = Hyper
  source 1..1118: mol_type = genomic DNA

SEQ ID NO: 115519 - DNA, 66 bp, Homo sapiens; identical to SEQ ID NO: 82362
  misc_feature 1..66: note = chr19:10402894-10402960
  misc_feature 1..66: note = Hyper
  source 1..66: mol_type = genomic DNA

SEQ ID NO: 115520 - DNA, 30 bp, Homo sapiens; identical to SEQ ID NO: 82363
  misc_feature 1..30: note = chr19:10403300-10403330
  misc_feature 1..30: note = Hyper
  source 1..30: mol_type = genomic DNA

SEQ ID NO: 115521 - DNA, 472 bp, Homo sapiens
  misc_feature 1..472: note = chr19:10405939-10406411
  misc_feature 1..472: note = Hyper
  source 1..472: mol_type = genomic DNA
tcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcggaggcctggcctccagcccagatcagctggcgcgcgcccccgggggccctcaacatcggcctgtcgagcaacaacagcacactgagcgtggcaggcgccatgggaagccacggcggcgagtacgagtgcgcagccaccaacgcgcacgggcgccacgcgcggcgcatcacggtgcgcgtggccggtaagtggcagctggggagaggcggggcgaggtatctgagagggggcgtgacctgggtcttggggcggccggccccgcctgcctccctctcggtcccggtagactagacggaagtgggacaga

SEQ ID NO: 115522 - DNA, 275 bp, Homo sapiens
  misc_feature 1..275: note = chr19:10406899-10407174
  misc_feature 1..275: note = Hyper
  source 1..275: mol_type = genomic DNA
agacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctgaacgg

SEQ ID NO: 115523 - DNA, 47 bp, Homo sapiens; identical to SEQ ID NO: 82372
  misc_feature 1..47: note = chr19:10495335-10495382
  misc_feature 1..47: note = Hypo
  source 1..47: mol_type = genomic DNA

SEQ ID NO: 115524 - DNA, 205 bp, Homo sapiens; identical to SEQ ID NO: 82375
  misc_feature 1..205: note = chr19:10526999-10527204
  misc_feature 1..205: note = Hyper
  source 1..205: mol_type = genomic DNA

SEQ ID NO: 115525 - DNA, 393 bp, Homo sapiens; identical to SEQ ID NO: 82376
  misc_feature 1..393: note = chr19:10530133-10530526
  misc_feature 1..393: note = Hyper
  source 1..393: mol_type = genomic DNA

SEQ ID NO: 115526 - DNA, 862 bp, Homo sapiens; identical to SEQ ID NO: 82377
  misc_feature 1..862: note = chr19:10531284-10532146
  misc_feature 1..862: note = Hyper
  source 1..862: mol_type = genomic DNA

SEQ ID NO: 115527 - DNA, 199 bp, Homo sapiens; identical to SEQ ID NO: 82378
  misc_feature 1..199: note = chr19:10562105-10562304
  misc_feature 1..199: note = Hypo
  source 1..199: mol_type = genomic DNA

SEQ ID NO: 115528 - DNA, 30 bp, Homo sapiens; identical to SEQ ID NO: 82379
  misc_feature 1..30: note = chr19:10570048-10570078
  misc_feature 1..30: note = Hypo
  source 1..30: mol_type = genomic DNA

SEQ ID NO: 115529 - DNA, 79 bp, Homo sapiens; identical to SEQ ID NO: 82380
  misc_feature 1..79: note = chr19:10570316-10570395
  misc_feature 1..79: note = Hypo
  source 1..79: mol_type = genomic DNA

SEQ ID NO: 115530 - DNA, 30 bp, Homo sapiens; identical to SEQ ID NO: 82381
  misc_feature 1..30: note = chr19:10589751-10589781
  misc_feature 1..30: note = Hyper
  source 1..30: mol_type = genomic DNA

SEQ ID NO: 115531 - DNA, 274 bp, Homo sapiens; identical to SEQ ID NO: 82382
  misc_feature 1..274: note = chr19:10616258-10616532
  misc_feature 1..274: note = Hyper
  source 1..274: mol_type = genomic DNA

SEQ ID NO: 115532 - DNA, 1113 bp, Homo sapiens
  misc_feature 1..1113: note = chr19:10624676-10625789
  misc_feature 1..1113: note = Hyper
  source 1..1113: mol_type = genomic DNA
ctgctgggagccactcgggtctctgccgcaggagtggcgtccgcagcagaccaggcgcaggagcgcgtggcgcaggtcgcggttggtgagcgtgtagatgatggggttcagaagtgagttggccatggccagtcccaggaagggatcggcctgcaggagtacaggacaggtgcgcgccgggcacgccacgtcgagcaacagcagcaggaagagggggccccaacatgccacaaaggccaggagcaccacgctgagcgtgcgcagcaaggccagcgagcgcggcttgcgacgcgcccgggtcgaggtggtccccgcagtcccgggccgtgccggcaggcgccgcgcgttggcgcgtacctggcagtagatgcgcgcgtagagtgcacagatagcggccaggatgcccacgaaggcgagcacgcagaagagcacgtaggccttggcgtagagcggcaagacagtggagcaagcgtccaggcgacccaggcaattccagcccagcgctggcaggagcccgaggagcagcgacacgccccaggccgcggctgccatcgccagcgtgcgcccccgactggagacgggcgcgggccccctgcgcgccatggtgaggctgcgctccagcgcgatggccaggaggctcagcacggacgcagtgagtgccacgaagacgcctccctcccgtgcgaaccagagcgcgggggacagtttcagcgtgagcggccccgacagtaggatgttggcggcgtaggcggcgcctgccagcagatccgacaacgtgaggctgcccaggagcaggaacatgggagcgtggaagcgcgggtggcgtccgagcaccaacaacacggctagattctctagcacgatgaaggcgcacaccgccaggcacaccacggcgtcggcgcgcaggccggcacccggctggtagcgcgcaccgcggagcttgccggtgtagttgtaatgcaggacgatgacctcgctcaccggcgccggccgcagcagccccgactccatgggccgcgcgccccaaggctgttggagaggcaagatacggtgtcaggccgcggtccccgtaagcacgctcgcagcagccggctaagtcgtgggaaaggggcc

SEQ ID NO: 115533 - DNA, 249 bp, Homo sapiens; identical to SEQ ID NO: 82386
  misc_feature 1..249: note = chr19:10627965-10628214
  misc_feature 1..249: note = Hyper
  source 1..249: mol_type = genomic DNA

SEQ ID NO: 115534 - DNA, 96 bp, Homo sapiens; identical to SEQ ID NO: 82387
  misc_feature 1..96: note = chr19:10628453-10628549
  misc_feature 1..96: note = Hyper
  source 1..96: mol_type = genomic DNA

SEQ ID NO: 115535 - DNA, 637 bp, Homo sapiens; identical to SEQ ID NO: 82388
  misc_feature 1..637: note = chr19:10629012-10629649
  misc_feature 1..637: note = Hyper
  source 1..637: mol_type = genomic DNA

SEQ ID NO: 115536 - DNA, 30 bp, Homo sapiens; identical to SEQ ID NO: 82389
  misc_feature 1..30: note = chr19:10665777-10665807
  misc_feature 1..30: note = Hypo
  source 1..30: mol_type = genomic DNA

SEQ ID NO: 115537 - DNA, 185 bp, Homo sapiens; identical to SEQ ID NO: 82390
  misc_feature 1..185: note = chr19:10691879-10692064
  misc_feature 1..185: note = Hyper
  source 1..185: mol_type = genomic DNA

SEQ ID NO: 115538 - DNA, 30 bp, Homo sapiens; identical to SEQ ID NO: 82392
  misc_feature 1..30: note = chr19:10692126-10692156
  misc_feature 1..30: note = Hypo
  source 1..30: mol_type = genomic DNA

SEQ ID NO: 115539 - DNA, 139 bp, Homo sapiens; identical to SEQ ID NO: 45700
  misc_feature 1..139: note = chr19:10711944-10712083
  misc_feature 1..139: note = Hypo
  source 1..139: mol_type = genomic DNA

SEQ ID NO: 115540 - DNA, 65 bp, Homo sapiens; identical to SEQ ID NO: 82395
  misc_feature 1..65: note = chr19:10738627-10738692
  misc_feature 1..65: note = Hypo
  source 1..65: mol_type = genomic DNA

SEQ ID NO: 115541 - DNA, 162 bp, Homo sapiens; identical to SEQ ID NO: 82396
  misc_feature 1..162: note = chr19:10762073-10762235
  misc_feature 1..162: note = Hypo
  source 1..162: mol_type = genomic DNA

SEQ ID NO: 115542 - DNA, 30 bp, Homo sapiens; identical to SEQ ID NO: 37216
  misc_feature 1..30: note = chr19:10806164-10806194
  misc_feature 1..30: note = Hyper
  source 1..30: mol_type = genomic DNA

SEQ ID NO: 115543 - DNA, 30 bp, Homo sapiens; identical to SEQ ID NO: 82399
  misc_feature 1..30: note = chr19:10823603-10823633
  misc_feature 1..30: note = Hypo
  source 1..30: mol_type = genomic DNA

SEQ ID NO: 115544 - DNA, 150 bp, Homo sapiens; identical to SEQ ID NO: 82403
  misc_feature 1..150: note = chr19:10859213-10859363
  misc_feature 1..150: note = Hypo
  source 1..150: mol_type = genomic DNA

SEQ ID NO: 115545 - DNA, 75 bp, Homo sapiens; identical to SEQ ID NO: 45702
  misc_feature 1..75: note = chr19:10872535-10872610
  misc_feature 1..75: note = Hypo
  source 1..75: mol_type = genomic DNA

SEQ ID NO: 115546 - DNA, 154 bp, Homo sapiens; identical to SEQ ID NO: 82406
  misc_feature 1..154: note = chr19:10875953-10876107
  misc_feature 1..154: note = Hypo
  source 1..154: mol_type = genomic DNA

SEQ ID NO: 115547 - DNA, 30 bp, Homo sapiens; identical to SEQ ID NO: 82407
  misc_feature 1..30: note = chr19:10949173-10949203
  misc_feature 1..30: note = Hypo
  source 1..30: mol_type = genomic DNA

SEQ ID NO: 115548 - DNA, 72 bp, Homo sapiens; identical to SEQ ID NO: 82408
  misc_feature 1..72: note = chr19:10954418-10954490
  misc_feature 1..72: note = Hypo
  source 1..72: mol_type = genomic DNA

SEQ ID NO: 115549 - DNA, 43 bp, Homo sapiens; identical to SEQ ID NO: 82409
  misc_feature 1..43: note = chr19:11002349-11002392
  misc_feature 1..43: note = Hypo
  source 1..43: mol_type = genomic DNA

SEQ ID NO: 115550 - DNA, 95 bp, Homo sapiens; identical to SEQ ID NO: 45706
  misc_feature 1..95: note = chr19:11002992-11003087
  misc_feature 1..95: note = Hypo
  source 1..95: mol_type = genomic DNA

SEQ ID NO: 115551 - DNA, 30 bp, Homo sapiens; identical to SEQ ID NO: 16438
  misc_feature 1..30: note = chr19:11005335-11005365
  misc_feature 1..30: note = Hypo
  source 1..30: mol_type = genomic DNA

SEQ ID NO: 115552 - DNA, 25 bp, Homo sapiens
  misc_feature 1..25: note = chr19:11008369-11008394
  misc_feature 1..25: note = Hypo
  source 1..25: mol_type = genomic DNA
atgctagctctgggccgggcacggt

SEQ ID NO: 115553 - DNA, 30 bp, Homo sapiens; identical to SEQ ID NO: 82413
  misc_feature 1..30: note = chr19:11009412-11009442
  misc_feature 1..30: note = Hypo
  source 1..30: mol_type = genomic DNA

SEQ ID NO: 115554 - DNA, 30 bp, Homo sapiens; identical to SEQ ID NO: 82414
  misc_feature 1..30: note = chr19:11029618-11029648
  misc_feature 1..30: note = Hypo
  source 1..30: mol_type = genomic DNA

SEQ ID NO: 115555 - DNA, 288 bp, Homo sapiens; identical to SEQ ID NO: 82415
  misc_feature 1..288: note = chr19:11029961-11030249
  misc_feature 1..288: note = Hypo
  source 1..288: mol_type = genomic DNA

SEQ ID NO: 115556 - DNA, 45 bp, Homo sapiens; identical to SEQ ID NO: 82416
  misc_feature 1..45: note = chr19:11049756-11049801
  misc_feature 1..45: note = Hypo
  source 1..45: mol_type = genomic DNA

SEQ ID NO: 115557 - DNA, 93 bp, Homo sapiens; identical to SEQ ID NO: 82417
  misc_feature 1..93: note = chr19:11052037-11052130
  misc_feature 1..93: note = Hypo
  source 1..93: mol_type = genomic DNA

SEQ ID NO: 115558 - DNA, 38 bp, Homo sapiens; identical to SEQ ID NO: 82418
  misc_feature 1..38: note = chr19:11053258-11053296
  misc_feature 1..38: note = Hypo
  source 1..38: mol_type = genomic DNA

SEQ ID NO: 115559 - DNA, 35 bp, Homo sapiens; identical to SEQ ID NO: 82420
  misc_feature 1..35: note = chr19:11063746-11063781
  misc_feature 1..35: note = Hypo
  source 1..35: mol_type = genomic DNA

SEQ ID NO: 115560 - DNA, 342 bp, Homo sapiens; identical to SEQ ID NO: 82422
  misc_feature 1..342: note = chr19:11128983-11129325
  misc_feature 1..342: note = Hypo
  source 1..342: mol_type = genomic DNA

SEQ ID NO: 115561 - DNA, 107 bp, Homo sapiens; identical to SEQ ID NO: 82423
  misc_feature 1..107: note = chr19:11129719-11129826
  misc_feature 1..107: note = Hypo
  source 1..107: mol_type = genomic DNA

SEQ ID NO: 115562 - DNA, 30 bp, Homo sapiens; identical to SEQ ID NO: 82425
  misc_feature 1..30: note = chr19:11145922-11145952
  misc_feature 1..30: note = Hypo
  source 1..30: mol_type = genomic DNA

SEQ ID NO: 115563 - DNA, 165 bp, Homo sapiens; identical to SEQ ID NO: 82427
  misc_feature 1..165: note = chr19:11252652-11252817
  misc_feature 1..165: note = Hypo
  source 1..165: mol_type = genomic DNA

SEQ ID NO: 115564 - DNA, 61 bp, Homo sapiens; identical to SEQ ID NO: 82428
  misc_feature 1..61: note = chr19:11285211-11285272
  misc_feature 1..61: note = Hypo
  source 1..61: mol_type = genomic DNA

SEQ ID NO: 115565 - DNA, 30 bp, Homo sapiens; identical to SEQ ID NO: 45714
  misc_feature 1..30: note = chr19:11406534-11406564
  misc_feature 1..30: note = Hypo
  source 1..30: mol_type = genomic DNA

SEQ ID NO: 115566 - DNA, 23 bp, Homo sapiens
  misc_feature 1..23: note = chr19:11490382-11490405
  misc_feature 1..23: note = Hypo
  source 1..23: mol_type = genomic DNA
tttttttttttgagacggagttt

SEQ ID NO: 115567 - DNA, 111 bp, Homo sapiens
  misc_feature 1..111: note = chr19:11492742-11492853
  misc_feature 1..111: note = Hyper
  source 1..111: mol_type = genomic DNA
ggagcctggtgcaggcgacacagcttccatggctcatccctatgcgcccagggaagggagcaggttgggaggggggaccggggagttggcattgcccggcctgtggggggc

SEQ ID NO: 115568 - DNA, 767 bp, Homo sapiens; identical to SEQ ID NO: 82432
  misc_feature 1..767: note = chr19:11529414-11530181
  misc_feature 1..767: note = Hyper
  source 1..767: mol_type = genomic DNA

SEQ ID NO: 115569 - DNA, 560 bp, Homo sapiens; identical to SEQ ID NO: 82433
  misc_feature 1..560: note = chr19:11531328-11531888
  misc_feature 1..560: note = Hyper
  source 1..560: mol_type = genomic DNA

SEQ ID NO: 115570 - DNA, 323 bp, Homo sapiens
  misc_feature 1..323: note = chr19:11532331-11532654
  misc_feature 1..323: note = Hyper
  source 1..323: mol_type = genomic DNA
ggctgcagggcacctcgcggttagcgatgtggcacagcatctcctgcacgtcgtggccctggagctgcgcctgcagtttcagcagcttttcctccacgaggcccagcaggtttggcacatagttatctgcctggggatccagctcctttcccgcgaagcggccgtcctcctgcggccagggtagagccgggtcagccgagaggggtggggcctcttggaaggctccacccaggggcggggcttttctttcgggggcggggcctaggaggtaagggcccacctgcagggtcgatcctagccattgggggcggggacttaggtca

SEQ ID NO: 115571 - DNA, 609 bp, Homo sapiens; identical to SEQ ID NO: 82435
  misc_feature 1..609: note = chr19:11533023-11533632
  misc_feature 1..609: note = Hyper
  source 1..609: mol_type = genomic DNA

SEQ ID NO: 115572 - DNA, 30 bp, Homo sapiens; identical to SEQ ID NO: 82436
  misc_feature 1..30: note = chr19:11537793-11537823
  misc_feature 1..30: note = Hypo
  source 1..30: mol_type = genomic DNA

SEQ ID NO: 115573 - DNA, 30 bp, Homo sapiens; identical to SEQ ID NO: 82437
  misc_feature 1..30: note = chr19:11547189-11547219
  misc_feature 1..30: note = Hypo
  source 1..30: mol_type = genomic DNA

SEQ ID NO: 115574 - DNA, 30 bp, Homo sapiens; identical to SEQ ID NO: 82440
  misc_feature 1..30: note = chr19:11569191-11569221
  misc_feature 1..30: note = Hypo
  source 1..30: mol_type = genomic DNA

SEQ ID NO: 115575 - DNA, 512 bp, Homo sapiens; identical to SEQ ID NO: 82442
  misc_feature 1..512: note = chr19:11590692-11591204
  misc_feature 1..512: note = Hyper
  source 1..512: mol_type = genomic DNA

SEQ ID NO: 115576 - DNA, 475 bp, Homo sapiens
  misc_feature 1..475: note = chr19:11591537-11592012
  misc_feature 1..475: note = Hyper
  source 1..475: mol_type = genomic DNA
ccgctgcagatgtggcgatgaaggcggcggctccctcgagggccagggacgggcccgaacccggggatgcgcgcgcggatggccgggccccggggtggcctgcgggcggcaggggatggaaagagggagcgggcgcggggttgaggacgccccctgcgcggccccgcggggcccggggaggttgcgcttcccgacagagatcgcggcgctctgcctttcgccgccgcccctcggtcggtcctgtccggtcccgtgtgttcaagtcctctcccctcgcccaccctccctccctccctccggcccgcgctgcgcgctccgcgctctggaccgcgccgccgccgcccccagccctttatagcagcagctgccagcgccggcgtcgctcattggctgcggcgaccgagctccgcctcctcgcggctcccgacggcgcggcaggtggaagtgagcgcgcactggtcgggactctgaatcc

SEQ ID NO: 115577 - DNA, 782 bp, Homo sapiens; identical to SEQ ID NO: 82445
  misc_feature 1..782: note = chr19:11592671-11593453
  misc_feature 1..782: note = Hyper
  source 1..782: mol_type = genomic DNA

SEQ ID NO: 115578 - DNA, 213 bp, Homo sapiens; identical to SEQ ID NO: 82446
  misc_feature 1..213: note = chr19:11594589-11594802
  misc_feature 1..213: note = Hypo
  source 1..213: mol_type = genomic DNA

SEQ ID NO: 115579 - DNA, 177 bp, Homo sapiens; identical to SEQ ID NO: 82447
  misc_feature 1..177: note = chr19:11650656-11650833
  misc_feature 1..177: note = Hyper
  source 1..177: mol_type = genomic DNA

SEQ ID NO: 115580 - DNA, 135 bp, Homo sapiens; identical to SEQ ID NO: 82448
  misc_feature 1..135: note = chr19:11658622-11658757
  misc_feature 1..135: note = Hypo
  source 1..135: mol_type = genomic DNA

SEQ ID NO: 115581 - DNA, 362 bp, Homo sapiens; identical to SEQ ID NO: 82450
  misc_feature 1..362: note = chr19:11689266-11689628
  misc_feature 1..362: note = Hyper
  source 1..362: mol_type = genomic DNA

SEQ ID NO: 115582 - DNA, 30 bp, Homo sapiens; identical to SEQ ID NO: 82454
  misc_feature 1..30: note = chr19:11788723-11788753
  misc_feature 1..30: note = Hypo
  source 1..30: mol_type = genomic DNA

SEQ ID NO: 115583 - DNA, 171 bp, Homo sapiens; identical to SEQ ID NO: 37228
  misc_feature 1..171: note = chr19:11805426-11805597
  misc_feature 1..171: note = Hyper
  source 1..171: mol_type = genomic DNA

SEQ ID NO: 115584 - DNA, 73 bp, Homo sapiens; identical to SEQ ID NO: 82457
  misc_feature 1..73: note = chr19:11878759-11878832
  misc_feature 1..73: note = Hyper
  source 1..73: mol_type = genomic DNA

SEQ ID NO: 115585 - DNA, 399 bp, Homo sapiens; identical to SEQ ID NO: 82458
  misc_feature 1..399: note = chr19:11909333-11909732
  misc_feature 1..399: note = Hyper
  source 1..399: mol_type = genomic DNA

SEQ ID NO: 115586 - DNA, 159 bp, Homo sapiens; identical to SEQ ID NO: 82459
  misc_feature 1..159: note = chr19:11909792-11909951
  misc_feature 1..159: note = Hyper
  source 1..159: mol_type = genomic DNA

SEQ ID NO: 115587 - DNA, 30 bp, Homo sapiens; identical to SEQ ID NO: 82460
  misc_feature 1..30: note = chr19:11925559-11925589
  misc_feature 1..30: note = Hyper
  source 1..30: mol_type = genomic DNA

SEQ ID NO: 115588 - DNA, 202 bp, Homo sapiens; identical to SEQ ID NO: 82461
  misc_feature 1..202: note = chr19:11926261-11926463
  misc_feature 1..202: note = Hypo
  source 1..202: mol_type = genomic DNA

SEQ ID NO: 115589 - DNA, 82 bp, Homo sapiens; identical to SEQ ID NO: 82462
  misc_feature 1..82: note = chr19:11926703-11926785
  misc_feature 1..82: note = Hypo
  source 1..82: mol_type = genomic DNA

SEQ ID NO: 115590 - DNA, 906 bp, Homo sapiens
  misc_feature 1..906: note = chr19:11959427-11960333
  misc_feature 1..906: note = Hyper
  source 1..906: mol_type = genomic DNA
ctgtcagtctggctccgcagggcctgatacccagggcttccgctgtcacttagacgtggggggcggggccgaacattccatccaatcagaggcactggctcggggccctgcccactgtgcatccaggcacggaggatgttgcattcctgccgtcacctttgtcgctgcgagggcggcggttgggatctggcctttccagccccgagagggacctagtgcctctacccagatttctgtcgctctgtcacctgcgctatgccctgctttactcacaggagctgtagagaggaccccggtacatctgaaagccgggaaatggtgcgtgtgctggccgggagtggtgcgatgggggaggggctgcctggaactggcgggacccgggcctccctgtgggcgactccggggtctgggaccgagtcctcctagagctgctcggccctcggtccccgcggccgctggatgtgggtgggccggcagccgggactccgggcgtcctgtcccgtccctgcccgtcgactgcggccttggccccgaagcccttttgtgcagctccgcgcccgcagcccgacgccccagcttgtgcgggggccacgggagggtcatgcgcggatttcgactcgggtgtggatttcgtccgtaggaggagcagcggtctgtggggcccacagcctccactttctcctgttaaaaattatactgaggtacgttaacaaaaagttcatttgaggaaacagccattcacgaatgagaaacacccggtcctggcttgtggtttgtcaacggaaaaaaaacagactatgtaaaatacagaagtgtattcagagccgagtaggagagaccttggccgagggaaacacaaccccaagcagcctggagtaagtggtccggaggcggctcaggacagtt

SEQ ID NO: 115591 - DNA, 80 bp, Homo sapiens; identical to SEQ ID NO: 82465
  misc_feature 1..80: note = chr19:11980787-11980867
  misc_feature 1..80: note = Hypo
  source 1..80: mol_type = genomic DNA

SEQ ID NO: 115592 - DNA, 750 bp, Homo sapiens; identical to SEQ ID NO: 82466
  misc_feature 1..750: note = chr19:11998469-11999219
  misc_feature 1..750: note = Hyper
  source 1..750: mol_type = genomic DNA

SEQ ID NO: 115593 - DNA, 85 bp, Homo sapiens; identical to SEQ ID NO: 82467
  misc_feature 1..85: note = chr19:12075733-12075818
  misc_feature 1..85: note = Hyper
  source 1..85: mol_type = genomic DNA

SEQ ID NO: 115594 - DNA, 307 bp, Homo sapiens; identical to SEQ ID NO: 82468
  misc_feature 1..307: note = chr19:12076072-12076379
  misc_feature 1..307: note = Hyper
  source 1..307: mol_type = genomic DNA

SEQ ID NO: 115595 - DNA, 458 bp, Homo sapiens; identical to SEQ ID NO: 82470
  misc_feature 1..458: note = chr19:12098632-12099090
  misc_feature 1..458: note = Hyper
  source 1..458: mol_type = genomic DNA

SEQ ID NO: 115596 - DNA, 487 bp, Homo sapiens; identical to SEQ ID NO: 82471
  misc_feature 1..487: note = chr19:12146544-12147031
  misc_feature 1..487: note = Hyper
  source 1..487: mol_type = genomic DNA

SEQ ID NO: 115597 - DNA, 29 bp, Homo sapiens
  misc_feature 1..29: note = chr19:12147710-12147739
  misc_feature 1..29: note = Hypo
  source 1..29: mol_type = genomic DNA
cccccgcacccggccgaggctagggtttt

SEQ ID NO: 115598 - DNA, 276 bp, Homo sapiens; identical to SEQ ID NO: 82473
  misc_feature 1..276: note = chr19:12163055-12163331
  misc_feature 1..276: note = Hyper
  source 1..276: mol_type = genomic DNA

SEQ ID NO: 115599 - DNA, 576 bp, Homo sapiens; identical to SEQ ID NO: 82474
  misc_feature 1..576: note = chr19:12163451-12164027
  misc_feature 1..576: note = Hyper
  source 1..576: mol_type = genomic DNA

SEQ ID NO: 115600 - DNA, 718 bp, Homo sapiens; identical to SEQ ID NO: 82475
  misc_feature 1..718: note = chr19:12175445-12176163
  misc_feature 1..718: note = Hyper
  source 1..718: mol_type = genomic DNA

SEQ ID NO: 115601 - DNA, 625 bp, Homo sapiens
  misc_feature 1..625: note = chr19:12203013-12203638
  misc_feature 1..625: note = Hyper
  source 1..625: mol_type = genomic DNA
tcagggctctgaaggcgaggcggggagcacggtccaatcaggagcgccggggcggggccctgccaacttttttcggggaaggagacggctgcaagcccgcggtctcttgttgctgtgctaacgaccgttggaaccctctttctggctcttggaacgctcggctctgagaggctccaggtttctccgccagagctcctgtcgctctgtcagttgcgctgtgttcctctctagtcacaagagccttggggaagacagttggaagctcagacatggtgagtgtgtggggccaggcgtcctgagacgggggcgaagggcttcttagaacctgctggaaccggctgtggcgggacccgggcctccccgcggcgactccggggtctgtggggctgggccggcagccgggacccggggcatcctgtctcgtcccttcgcagcgaccgcggccccggacccggagccctctttgggcagctccgcgtcttcagccgcgggtctcctcagattgtgctgggccatgaggaggatcatggggggaatcccgtctcgggtgtagggttcttgcgtcagaaaagcggtggtctgtggagtccccagtcgtcttttctcctcttaaaagttaaaatgg

SEQ ID NO: 115602 - DNA, 101 bp, Homo sapiens; identical to SEQ ID NO: 45716
  misc_feature 1..101: note = chr19:12220383-12220484
  misc_feature 1..101: note = Hypo
  source 1..101: mol_type = genomic DNA

SEQ ID NO: 115603 - DNA, 132 bp, Homo sapiens; identical to SEQ ID NO: 45717
  misc_feature 1..132: note = chr19:12222626-12222758
  misc_feature 1..132: note = Hypo
  source 1..132: mol_type = genomic DNA

SEQ ID NO: 115604 - DNA, 917 bp, Homo sapiens
  misc_feature 1..917: note = chr19:12266893-12267810
  misc_feature 1..917: note = Hyper
  source 1..917: mol_type = genomic DNA
aatttctgggctgaagcaatccccccgcctcaacctgccaggcgtgacccactgcgcctggccttcaatttagtttttcaggaaaaaaggggggactggggaccccgcagcccaccgctcctcccacacgaaccacacacccgaggcaggattgcctccatgaccctcccgtggtctccgcacaatctggggagacgcgggactacgggcgcggagctccccagagagggctccggggccggggccagggccggggtcgcagtcgcagcgcagagacgggacaggacgcctggggtcccggctgccggcccaaccccaccctgcggccgaagggaccgagggccgagctacgccagggggactccgctctgcagacccgaagtcgctgcaggaaggcctgggtcctgctagagccggttcgagccggttcctcccggcccctcccccgtctcgggacccccggccccgcacactcaccatttcccggcttccaggtgtcctggcctcctctccacggatccctctaacagtccagtcacagtgcgggcgatggagcgacagaagctatggcggaggcacctggtccctctcggggccggaaaaccgagatcccgacctccctttggtgcaagacgcctgggagtcaggaaagcgggaatgcggcctccccttccccggatggacagttggcaggaccccgccccagcgcccctgattggatgaggctccagtccccgtcccatcggtcctgagtgacagcggaagccctgggtaacaaggcccggcagaaccgaaatgacctgttccaaccacagattatctaagcgagctccctccctgcgtcttgctctttgggtatttgcatttcagccaaatttgctccgaattgctagagggggtaccgttgtcttcctcac

SEQ ID NO: 115605 - DNA, 460 bp, Homo sapiens
  misc_feature 1..460: note = chr19:12305853-12306313
  misc_feature 1..460: note = Hyper
  source 1..460: mol_type = genomic DNA
cgactatcacctgaccgtagtaatatctcccgctacgcgcgttgtgaccaatgctgcatacaggagatgagggaggacggccagacacctggaagccggaaaatggtgagtgtgcggggccggtgtcccgagacctgaggagggacaggttggaaccggccggaaccggctgtggcgggacccggggctcccctcggcgactctggggtctgggacccgggtccctctggcgcagctgggccctcagtgccctcggccgcagagtggggctgggctggcatccgggaccccgggcatcctgtcccgttcctgcgcgacgcctgcggccccggcctcagcctcggcgccctctctgggcagctgcacgccgcagcctcgtgtctccccagattgcacgggagccccgggagggtcatggggaggattccgactcgtgtgtggggttcgtgcgtgggaggag

SEQ ID NO: 115606 - DNA, 586 bp, Homo sapiens; identical to SEQ ID NO: 82494
  misc_feature 1..586: note = chr19:12475782-12476368
  misc_feature 1..586: note = Hyper
  source 1..586: mol_type = genomic DNA

SEQ ID NO: 115607 - DNA, 95 bp, Homo sapiens; identical to SEQ ID NO: 82495
  misc_feature 1..95: note = chr19:12476602-12476697
  misc_feature 1..95: note = Hyper
  source 1..95: mol_type = genomic DNA

SEQ ID NO: 115608 - DNA, 298 bp, Homo sapiens; identical to SEQ ID NO: 82497
  misc_feature 1..298: note = chr19:12606167-12606465
  misc_feature 1..298: note = Hyper
  source 1..298: mol_type = genomic DNA

SEQ ID NO: 115609 - DNA, 40 bp, Homo sapiens; identical to SEQ ID NO: 45718
  misc_feature 1..40: note = chr19:12675871-12675911
  misc_feature 1..40: note = Hypo
  source 1..40: mol_type = genomic DNA

SEQ ID NO: 115610 - DNA, 50 bp, Homo sapiens; identical to SEQ ID NO: 82503
  misc_feature 1..50: note = chr19:12747555-12747605
  misc_feature 1..50: note = Hypo
  source 1..50: mol_type = genomic DNA

SEQ ID NO: 115611 - DNA, 384 bp, Homo sapiens; identical to SEQ ID NO: 82504
  misc_feature 1..384: note = chr19:12750831-12751215
  misc_feature 1..384: note = Hyper
  source 1..384: mol_type = genomic DNA

SEQ ID NO: 115612 - DNA, 16 bp, Homo sapiens
  misc_feature 1..16: note = chr19:12835315-12835331
  misc_feature 1..16: note = Hypo
  source 1..16: mol_type = genomic DNA
gttttgtttttgagac

SEQ ID NO: 115613 - DNA, 39 bp, Homo sapiens; identical to SEQ ID NO: 82506
  misc_feature 1..39: note = chr19:12846163-12846202
  misc_feature 1..39: note = Hypo
  source 1..39: mol_type = genomic DNA

SEQ ID NO: 115614 - DNA, 23 bp, Homo sapiens
  misc_feature 1..23: note = chr19:12846825-12846848
  misc_feature 1..23: note = Hypo
  source 1..23: mol_type = genomic DNA
tggagctgaagtccccgtctgag

SEQ ID NO: 115615 - DNA, 192 bp, Homo sapiens; identical to SEQ ID NO: 45720
  misc_feature 1..192: note = chr19:12863412-12863604
  misc_feature 1..192: note = Hypo
  source 1..192: mol_type = genomic DNA

SEQ ID NO: 115616 - DNA, 23 bp, Homo sapiens
  misc_feature 1..23: note = chr19:12906634-12906657
  misc_feature 1..23: note = Hypo
  source 1..23: mol_type = genomic DNA
actgcgcccggccttgggagcag

SEQ ID NO: 115617 - DNA, 211 bp, Homo sapiens; identical to SEQ ID NO: 82514
  misc_feature 1..211: note = chr19:12936426-12936637
  misc_feature 1..211: note = Hyper
  source 1..211: mol_type = genomic DNA

SEQ ID NO: 115618 - DNA, 101 bp, Homo sapiens; identical to SEQ ID NO: 37253
  misc_feature 1..101: note = chr19:12945480-12945581
  misc_feature 1..101: note = Hyper
  source 1..101: mol_type = genomic DNA

SEQ ID NO: 115619 - DNA, 45 bp, Homo sapiens; identical to SEQ ID NO: 82517
  misc_feature 1..45: note = chr19:12946269-12946314
  misc_feature 1..45: note = Hyper
  source 1..45: mol_type = genomic DNA

SEQ ID NO: 115620 - DNA, 64 bp, Homo sapiens; identical to SEQ ID NO: 82518
  misc_feature 1..64: note = chr19:12947063-12947127
  misc_feature 1..64: note = Hyper
  source 1..64: mol_type = genomic DNA

SEQ ID NO: 115621 - DNA, 76 bp, Homo sapiens; identical to SEQ ID NO: 82520
  misc_feature 1..76: note = chr19:12949855-12949931
  misc_feature 1..76: note = Hyper
  source 1..76: mol_type = genomic DNA

SEQ ID NO: 115622 - DNA, 603 bp, Homo sapiens
  misc_feature 1..603: note = chr19:12951676-12952279
  misc_feature 1..603: note = Hyper
  source 1..603: mol_type = genomic DNA
ccacaggcgaaggggcgtggtctccccataataggcgggactagactaaagacaggacatgctgctgtttgcacgccgctttagggaacgagagacctgacaggatttgccccctctttctctcataggcagcagtcccctggacagcccccgaaacttctcccccaacacccccgcccacttctcgtttgcctcctcccgaaggtgagtccctcccctccagggccccagaaccctgggcagaccctccccaaccactgtctgggccgccatctgttctcctcctaattgcacccgagctggggcctgaggggaccagcgagtgccccaaggtctcagcgggaaggagcgcctagccttcggggcggggcctataagaaggcggggtccaatcgccgatctggaacggggaaggcggtggggctccctttgcggcaggtcgaaagcgcgtgcgccctgggcgcggggtcttagtctctccgagccttgctctcctggccaggtgtttccatagcaacaggacggggcagccaagatgacgtgcgcaagcgcagattgcgcgatgcctatcgagggactcttggtccccgaggtgggggagga

SEQ ID NO: 115623 - DNA, 30 bp, Homo sapiens; identical to SEQ ID NO: 82523
  misc_feature 1..30: note = chr19:12963030-12963060
  misc_feature 1..30: note = Hypo
  source 1..30: mol_type = genomic DNA

SEQ ID NO: 115624 - DNA, 62 bp, Homo sapiens; identical to SEQ ID NO: 82524
  misc_feature 1..62: note = chr19:12969408-12969470
  misc_feature 1..62: note = Hypo
  source 1..62: mol_type = genomic DNA

SEQ ID NO: 115625 - DNA, 30 bp, Homo sapiens; identical to SEQ ID NO: 82525
  misc_feature 1..30: note = chr19:12976945-12976975
  misc_feature 1..30: note = Hypo
  source 1..30: mol_type = genomic DNA

SEQ ID NO: 115626 - DNA, 106 bp, Homo sapiens; identical to SEQ ID NO: 82526
  misc_feature 1..106: note = chr19:12977473-12977579
  misc_feature 1..106: note = Hypo
  source 1..106: mol_type = genomic DNA

SEQ ID NO: 115627 - DNA, 160 bp, Homo sapiens; identical to SEQ ID NO: 82527
  misc_feature 1..160: note = chr19:12978416-12978576
  misc_feature 1..160: note = Hyper
  source 1..160: mol_type = genomic DNA

SEQ ID NO: 115628 - DNA, 42 bp, Homo sapiens; identical to SEQ ID NO: 82528
  misc_feature 1..42: note = chr19:12985184-12985226
  misc_feature 1..42: note = Hypo
  source 1..42: mol_type = genomic DNA

SEQ ID NO: 115629 - DNA, 809 bp, Homo sapiens; identical to SEQ ID NO: 82529
  misc_feature 1..809: note = chr19:12996071-12996880
  misc_feature 1..809: note = Hyper
  source 1..809: mol_type = genomic DNA

SEQ ID NO: 115630 - DNA, 443 bp, Homo sapiens; identical to SEQ ID NO: 82531
  misc_feature 1..443: note = chr19:13029873-13030316
  misc_feature 1..443: note = Hyper
  source 1..443: mol_type = genomic DNA

SEQ ID NO: 115631 - DNA, 20 bp, Homo sapiens
  misc_feature 1..20: note = chr19:13071955-13071975
  misc_feature 1..20: note = Hypo
  source 1..20: mol_type = genomic DNA
tttttttttttgagacggat

SEQ ID NO: 115632 - DNA, 90 bp, Homo sapiens; identical to SEQ ID NO: 82535
  misc_feature 1..90: note = chr19:13084316-13084406
  misc_feature 1..90: note = Hypo
  source 1..90: mol_type = genomic DNA

SEQ ID NO: 115633 - DNA, 24 bp, Homo sapiens
  misc_feature 1..24: note = chr19:13107011-13107035
  misc_feature 1..24: note = Hyper
  source 1..24: mol_type = genomic DNA
gcgggactccggctgacctgtggg

SEQ ID NO: 115634 - DNA, 173 bp, Homo sapiens; identical to SEQ ID NO: 82538
  misc_feature 1..173: note = chr19:13112120-13112293
  misc_feature 1..173: note = Hypo
  source 1..173: mol_type = genomic DNA

SEQ ID NO: 115635 - DNA, 46 bp, Homo sapiens; identical to SEQ ID NO: 82540
  misc_feature 1..46: note = chr19:13113959-13114005
  misc_feature 1..46: note = Hypo
  source 1..46: mol_type = genomic DNA

SEQ ID NO: 115636 - DNA, 92 bp, Homo sapiens; identical to SEQ ID NO: 82541
  misc_feature 1..92: note = chr19:13119930-13120022
  misc_feature 1..92: note = Hypo
  source 1..92: mol_type = genomic DNA

SEQ ID NO: 115637 - DNA, 36 bp, Homo sapiens
  misc_feature 1..36: note = chr19:13124045-13124081
  misc_feature 1..36: note = Hyper
  source 1..36: mol_type = genomic DNA
aaagtgaaaaaagaacgtgtgcgcccagcggacccg

SEQ ID NO: 115638 - DNA, 35 bp, Homo sapiens; identical to SEQ ID NO: 82542
  misc_feature 1..35: note = chr19:13201150-13201185
  misc_feature 1..35: note = Hypo
  source 1..35: mol_type = genomic DNA

SEQ ID NO: 115639 - DNA, 48 bp, Homo sapiens; identical to SEQ ID NO: 82543
  misc_feature 1..48: note = chr19:13208430-13208478
  misc_feature 1..48: note = Hyper
  source 1..48: mol_type = genomic DNA

SEQ ID NO: 115640 - DNA, 262 bp, Homo sapiens; identical to SEQ ID NO: 82544
  misc_feature 1..262: note = chr19:13208683-13208945
  misc_feature 1..262: note = Hyper
  source 1..262: mol_type = genomic DNA

SEQ ID NO: 115641 - DNA, 30 bp, Homo sapiens; identical to SEQ ID NO: 82545
  misc_feature 1..30: note = chr19:13209229-13209259
  misc_feature 1..30: note = Hyper
  source 1..30: mol_type = genomic DNA

SEQ ID NO: 115642 - DNA, 360 bp, Homo sapiens
  misc_feature 1..360: note = chr19:13210062-13210422
  misc_feature 1..360: note = Hyper
  source 1..360: mol_type = genomic DNA
ctgccctttccttgacggccctgggccgagtccctggtgccctccggctcagaggtgctgccgcgtgcggtcaccgcacctctgggctcaaagcggtttgctccatcttgatgggccgggccgctccaccggggctgccgtcggggtcggccgggggcgcgggctgcgagcgcgctgccgcctcggccctgcgtccggatccccggcgggcgccgtcgtctgggacccggtgcaccggccgtttgcgaggcccgggaggggtggggcctgcggccagagctgcggcttggtcgcgcagcagccgcaccaggaagccgatgtacttcatggctaggcggagcacctcgttcttgctcagct

SEQ ID NO: 115643 - DNA, 218 bp, Homo sapiens
  misc_feature 1..218: note = chr19:13213616-13213834
  misc_feature 1..218: note = Hyper
  source 1..218: mol_type = genomic DNA
ccctctcacccctggcggcgcagcggccggaggatgctggcccagtgcagataagggccaggctgcctggccgcgcctgataaggagcctggctgaccccggaggaaaccagcgggcggggacctagcagcgcgggcctcccggccccgcccccagccggcgctggcaggactcggtccgccacccctcagggcttcgccttccgctcccccagccac

SEQ ID NO: 115644 - DNA, 30 bp, Homo sapiens; identical to SEQ ID NO: 82548
  misc_feature 1..30: note = chr19:13226114-13226144
  misc_feature 1..30: note = Hypo
  source 1..30: mol_type = genomic DNA

SEQ ID NO: 115645 - DNA, 30 bp, Homo sapiens; identical to SEQ ID NO: 16444
  misc_feature 1..30: note = chr19:13335742-13335772
  misc_feature 1..30: note = Hypo
  source 1..30: mol_type = genomic DNA

SEQ ID NO: 115646 - DNA, 45 bp, Homo sapiens; identical to SEQ ID NO: 82552
  misc_feature 1..45: note = chr19:13365938-13365983
  misc_feature 1..45: note = Hypo
  source 1..45: mol_type = genomic DNA

SEQ ID NO: 115647 - DNA, 78 bp, Homo sapiens; identical to SEQ ID NO: 82554
  misc_feature 1..78: note = chr19:13397451-13397529
  misc_feature 1..78: note = Hypo
  source 1..78: mol_type = genomic DNA

SEQ ID NO: 115648 - DNA, 1836 bp, Homo sapiens
  misc_feature 1..1836: note = chr19:13616677-13618513
  misc_feature 1..1836: note = Hyper
  source 1..1836: mol_type = genomic DNA
ctggaagaggggaggcggagggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctccgctgcccacgaccaccccggcggctgccccggagcctcctcccccgtagcgggccggcatctcgtctccgaagcgggccattctgcaaagagcaaagggctccgggttacgctgcggcgaacgatgcggaagacgccgccgccgccgccgccgccgctgatgctgaggctgccggggctgggagcgcggcggctggagctacgactgcggagacgctccacggcccagcccatcgggcggcggcggctcggcgcctcgggtcgggggctcagaaggcggctgcccgggccgagccggggatagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaacgcacaccccctttaagacgcgaacggtttgcaaaggacgccccccccgggacgcagtggaagcttcaaattcctccgaggtccgggtcaggctggcatcttgcaaaaggagtgcgctcggcccattaaaaaaaaataaaaaataaaaaataaaaaaatatatatatatttaaaaataaagaaagacgaaacccaggtctgggtggggagggcaaaaaaaaaaaaaaaaaaaattaagtgcccttctgttttgctggagttcctagaccttaaaaatgctgaaagatctgtagctccaaaaataaaataaaataaaaacaaagaagatgaaagggaagggaaagaggagggaaggggagtaagacgctccagagggttcctaaggagtcttcacaccgcagggtccaggtttaaaaaaaaaaaaaaaaattttttttcttcctgaatcaccaacggctgcctcttctgctcccggaggaagtgtgagtgtgtatgtgcgcacagcgtttcgctcaatggtgcctcatcttggggttaaattgcagcagtgaaatcctgaaaattcccaacagggggaaaagagagagagagagaggtatgcgccctccgcttagccactcaatagctgcccctggatgcggcaatgcctctccaccctccaaatccctccacctcctccttctctaggttttgctaaaataagactggtgtggagggttgcgggtagaagaaggtaaagaggaaaaaaaaatgggcgcaaaggtctgaaccactggccagcaaacggaaaaggggagcaattgatgagtttaacagtagaaggacccacccagagtgtcgacacatgagggcccgcgaccaatcgtggaggctcgtggaggcgcgggggtaccgggctcagcggagtttgtgggggagagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 115649 - DNA, 163 bp, Homo sapiens; identical to SEQ ID NO: 45723
  misc_feature 1..163: note = chr19:13781908-13782071
  misc_feature 1..163: note = Hypo
  source 1..163: mol_type = genomic DNA

SEQ ID NO: 115650 - DNA, 32 bp, Homo sapiens; identical to SEQ ID NO: 82564
  misc_feature 1..32: note = chr19:13915613-13915645
  misc_feature 1..32: note = Hypo
  source 1..32: mol_type = genomic DNA

SEQ ID NO: 115651 - DNA, 135 bp, Homo sapiens; identical to SEQ ID NO: 82565
  misc_feature 1..135: note = chr19:13936577-13936712
  misc_feature 1..135: note = Hypo
  source 1..135: mol_type = genomic DNA

SEQ ID NO: 115652 - DNA, 28 bp, Homo sapiens
  misc_feature 1..28: note = chr19:13943608-13943636
  misc_feature 1..28: note = Hypo
  source 1..28: mol_type = genomic DNA
agaaagggcacccagcggccgggcgcgg

SEQ ID NO: 115653 - DNA, 120 bp, Homo sapiens; identical to SEQ ID NO: 82567
  misc_feature 1..120: note = chr19:13965902-13966022
  misc_feature 1..120: note = Hypo
  source 1..120: mol_type = genomic DNA

SEQ ID NO: 115654 - DNA, 83 bp, Homo sapiens; identical to SEQ ID NO: 82568
  misc_feature 1..83: note = chr19:13975708-13975791
  misc_feature 1..83: note = Hyper
  source 1..83: mol_type = genomic DNA

SEQ ID NO: 115655 - DNA, 30 bp, Homo sapiens; identical to SEQ ID NO: 82569
  misc_feature 1..30: note = chr19:13983835-13983865
  misc_feature 1..30: note = Hyper
  source 1..30: mol_type = genomic DNA

SEQ ID NO: 115656 - DNA, 458 bp, Homo sapiens; identical to SEQ ID NO: 82570
  misc_feature 1..458: note = chr19:13988269-13988727
  misc_feature 1..458: note = Hypo
  source 1..458: mol_type = genomic DNA

SEQ ID NO: 115657 - DNA, 35 bp, Homo sapiens; identical to SEQ ID NO: 82572
  misc_feature 1..35: note = chr19:14029963-14029998
  misc_feature 1..35: note = Hypo
  source 1..35: mol_type = genomic DNA

SEQ ID NO: 115658 - DNA, 141 bp, Homo sapiens; identical to SEQ ID NO: 82574
  misc_feature 1..141: note = chr19:14042824-14042965
  misc_feature 1..141: note = Hypo
  source 1..141: mol_type = genomic DNA

SEQ ID NO: 115659 - DNA, 184 bp, Homo sapiens; identical to SEQ ID NO: 82575
  misc_feature 1..184: note = chr19:14044040-14044224
  misc_feature 1..184: note = Hypo
  source 1..184: mol_type = genomic DNA

SEQ ID NO: 115660 - DNA, 30 bp, Homo sapiens; identical to SEQ ID NO: 82577
  misc_feature 1..30: note = chr19:14116323-14116353
  misc_feature 1..30: note = Hyper
  source 1..30: mol_type = genomic DNA

SEQ ID NO: 115661 - DNA, 274 bp, Homo sapiens; identical to SEQ ID NO: 45727
  misc_feature 1..274: note = chr19:14181305-14181579
  misc_feature 1..274: note = Hypo
  source 1..274: mol_type = genomic DNA

SEQ ID NO: 115662 - DNA, 44 bp, Homo sapiens; identical to SEQ ID NO: 82579
  misc_feature 1..44: note = chr19:14199744-14199788
  misc_feature 1..44: note = Hypo
  source 1..44: mol_type = genomic DNA

SEQ ID NO: 115663 - DNA, 79 bp, Homo sapiens; identical to SEQ ID NO: 45728
  misc_feature 1..79: note = chr19:14209036-14209115
  misc_feature 1..79: note = Hypo
  source 1..79: mol_type = genomic DNA

SEQ ID NO: 115664 - DNA, 104 bp, Homo sapiens; identical to SEQ ID NO: 82582
  misc_feature 1..104: note = chr19:14244886-14244990
  misc_feature 1..104: note = Hypo
  source 1..104: mol_type = genomic DNA

SEQ ID NO: 115665 - DNA, 370 bp, Homo sapiens; identical to SEQ ID NO: 82583
  misc_feature 1..370: note = chr19:14320287-14320657
  misc_feature 1..370: note = Hyper
  source 1..370: mol_type = genomic DNA

SEQ ID NO: 115666 - DNA, 30 bp, Homo sapiens; identical to SEQ ID NO: 82584
  misc_feature 1..30: note = chr19:14327424-14327454
  misc_feature 1..30: note = Hypo
  source 1..30: mol_type = genomic DNA

SEQ ID NO: 115667 - DNA, 60 bp, Homo sapiens; identical to SEQ ID NO: 82592
  misc_feature 1..60: note = chr19:14508107-14508167
  misc_feature 1..60: note = Hypo
  source 1..60: mol_type = genomic DNA

SEQ ID NO: 115668 - DNA, 635 bp, Homo sapiens
  misc_feature 1..635: note = chr19:14583085-14583720
  misc_feature 1..635: note = Hyper
  source 1..635: mol_type = genomic DNA
ctcctgcggctctggcgcccacgggcccggcaccctcgaacctcctagaaccgcgcccccgtgtctccgcgccctcttctggtaggccccggaactgcatccaccctggaggcgcacgcggcgtccctgcagccccccgcgcggccccagtggatgccgaagccccgacgggacacacggtcctgcctgggctcgcagaatggctttttattcccaaaggctctgcgccgcgcacctgggcccagcccagggtgggctggcttagtcgttgggcctctggttgtgcttagaagtggctgaggccgctgtgccgggagctgcgcagcgagctggcctcccaggcgctcggtgttaggcccagccccgcggggccgcccttggctccggccctcgggggcaagaggcgaagcagttggcgcagcacggcctggcgcagtaggatgtacacccaagggtccaggatctggttccaggaggcaaggcgcacggccaggaacagtggccgctgcagggaggtagagctccagccgccgacggccagcgccaccaacacctgcgggggaagccggtgtgagctatagagcaggcgcgggcgcaggggggcgcagggatggtgggggcgtggctggaaggta

SEQ ID NO: 115669 - DNA, 683 bp, Homo sapiens
  misc_feature 1..683: note = chr19:14584199-14584882
  misc_feature 1..683: note = Hyper
  source 1..683: mol_type = genomic DNA
gctccagcagatgcacgacaccaccatgataccgacaagctggcccaccatctccacgtcgtgggcgcgagctctgcgtgccgagccgctgctccgagagccgccaaagaaggtggaggccgaagcgatggacgaggcggacgaggcggaggccgagcggggtccgtgcgccccccagcgacgccggctgtcggggcctgaggccgggggaggccgtcgggagcggcgtcgccagcgggcgcgtagcagggccaggccgctgagcgtgttgcacaccagcgcggcgaggagcgcgaccaggccgaggctggcgaagaggccagcaagcagtgcctggcgccagccgcccgggggacccaggccgatgaagcaccacgtgcccgggtactgcagctcatagcggcccacgcgcgccagcggcagcagcgccacggccaaggccaccgcggccaccgcggccagcgccaggcgcgcgcgggcgaccgagacccgcgcggcgtggagcagcggccgcgtgacgcccacgcagcgctccacggccatgccacagcccagcagcagcgggcacaggccgaagaagaccatgcagccgcccaggaagtggcaggccccgccggccggagcgcgccccgcagtgtacagacgcagcaccagcgcgcccgggatcacgtggcccgccaggt

SEQ ID NO: 115670 - DNA, 30 bp, Homo sapiens; identical to SEQ ID NO: 82598
  misc_feature 1..30: note = chr19:14586108-14586138
  misc_feature 1..30: note = Hyper
  source 1..30: mol_type = genomic DNA

SEQ ID NO: 115671 - DNA, 30 bp, Homo sapiens; identical to SEQ ID NO: 45730
  misc_feature 1..30: note = chr19:14616913-14616943
  misc_feature 1..30: note = Hypo
  source 1..30: mol_type = genomic DNA

SEQ ID NO: 115672 - DNA, 134 bp, Homo sapiens; identical to SEQ ID NO: 82601
  misc_feature 1..134: note = chr19:14630529-14630663
  misc_feature 1..134: note = Hypo
  source 1..134: mol_type = genomic DNA

SEQ ID NO: 115673 - DNA, 19 bp, Homo sapiens
  misc_feature 1..19: note = chr19:14648564-14648583
  misc_feature 1..19: note = Hypo
  source 1..19: mol_type = genomic DNA
tttttttttttgagacgaa

SEQ ID NO: 115674 - DNA, 30 bp, Homo sapiens; identical to SEQ ID NO: 82603
  misc_feature 1..30: note = chr19:14660906-14660936
  misc_feature 1..30: note = Hypo
  source 1..30: mol_type = genomic DNA

SEQ ID NO: 115675 - DNA, 317 bp, Homo sapiens; identical to SEQ ID NO: 82604
  misc_feature 1..317: note = chr19:14667536-14667853
  misc_feature 1..317: note = Hyper
  source 1..317: mol_type = genomic DNA

SEQ ID NO: 115676 - DNA, 57 bp, Homo sapiens; identical to SEQ ID NO: 82605
  misc_feature 1..57: note = chr19:14675015-14675072
  misc_feature 1..57: note = Hypo
  source 1..57: mol_type = genomic DNA

SEQ ID NO: 115677 - DNA, 30 bp, Homo sapiens; identical to SEQ ID NO: 82606
  misc_feature 1..30: note = chr19:14711331-14711361
  misc_feature 1..30: note = Hypo
  source 1..30: mol_type = genomic DNA

SEQ ID NO: 115678 - DNA, 16 bp, Homo sapiens
  misc_feature 1..16: note = chr19:14797872-14797888
  misc_feature 1..16: note = Hypo
  source 1..16: mol_type = genomic DNA
aacaatggaaaacagc

SEQ ID NO: 115679 - DNA, 30 bp, Homo sapiens; identical to SEQ ID NO: 82610
  misc_feature 1..30: note = chr19:14839808-14839838
  misc_feature 1..30: note = Hypo
  source 1..30: mol_type = genomic DNA

SEQ ID NO: 115680 - DNA, 30 bp, Homo sapiens; identical to SEQ ID NO: 82611
  misc_feature 1..30: note = chr19:14863133-14863163
  misc_feature 1..30: note = Hypo
  source 1..30: mol_type = genomic DNA

SEQ ID NO: 115681 - DNA, 89 bp, Homo sapiens; identical to SEQ ID NO: 82612
  misc_feature 1..89: note = chr19:14877970-14878059
  misc_feature 1..89: note = Hypo
  source 1..89: mol_type = genomic DNA

SEQ ID NO: 115682 - DNA, 88 bp, Homo sapiens
  misc_feature 1..88: note = chr19:14886807-14886895
  misc_feature 1..88: note = Hyper
  source 1..88: mol_type = genomic DNA
ggtgatatttcaccccgggcgcccctcccacaggaaaacgctgtggccgcctgttggggtgcatgtggcgctgcggttcccagcactc

SEQ ID NO: 115683 - DNA, 146 bp, Homo sapiens; identical to SEQ ID NO: 82614
  misc_feature 1..146: note = chr19:14887415-14887561
  misc_feature 1..146: note = Hyper
  source 1..146: mol_type = genomic DNA

SEQ ID NO: 115684 - DNA, 32 bp, Homo sapiens; identical to SEQ ID NO: 82620
  misc_feature 1..32: note = chr19:15079221-15079253
  misc_feature 1..32: note = Hypo
  source 1..32: mol_type = genomic DNA

SEQ ID NO: 115685 - DNA, 1013 bp, Homo sapiens
  misc_feature 1..1013: note = chr19:15090040-15091053
  misc_feature 1..1013: note = Hyper
  source 1..1013: mol_type = genomic DNA
tgtgtgcggaggccacgggttggggaggtggggagacgggcagggagacccggggataactaaggggataggaaactcaccagaacgaccaggagaaaagcggtggcaacggctctaaggggcaagcaggagctcagagacaaagggcggcggagaagtggggacgtgggcgcagggagcgccccacacgcctgaccccagcgcctcggatcccccacctgcccgcaacctccgcgccgcagccacaccgagtccccgcgccgagccgcggagtccccactcaccggcgtccggagcggcgggggcggcctgcccgcgcctcggcctgcgcgctgcgcccggatgcaggagccggagcccggcgaagcgcccggccggggccgcggggacccgccagggactgtgcagcaccggcgcggggaccggaccgtggaggcaccggcgcggagccgggacgcgctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgctcggagccgcgcctccgcgcccccgccccctaaaccgcctccggagccctcggaggccccagcatccctggcggagcgcggggaacaggccctggcaccgcgggacccgctccagcagcctcggcggaggcctggggaaggcgcggctctagtgtcccagtaacaacagccagggagagggctccgctgcccccttctccttgcgggtgcaccttccggccttggccacttggctgctgtgtgcccttgggccaactcctctccctctctgagcctggcttcctccgctaaacaaggaagatggcttggccgaccccacagaaaa

SEQ ID NO: 115686 - DNA, 657 bp, Homo sapiens; identical to SEQ ID NO: 82624
  misc_feature 1..657: note = chr19:15121625-15122282
  misc_feature 1..657: note = Hyper
  source 1..657: mol_type = genomic DNA

SEQ ID NO: 115687 - DNA, 370 bp, Homo sapiens; identical to SEQ ID NO: 82626
  misc_feature 1..370: note = chr19:15217949-15218319
  misc_feature 1..370: note = Hyper
  source 1..370: mol_type = genomic DNA

SEQ ID NO: 115688 - DNA, 164 bp, Homo sapiens; identical to SEQ ID NO: 82627
  misc_feature 1..164: note = chr19:15220615-15220779
  misc_feature 1..164: note = Hypo
  source 1..164: mol_type = genomic DNA

SEQ ID NO: 115689 - DNA, 266 bp, Homo sapiens; identical to SEQ ID NO: 82636
  misc_feature 1..266: note = chr19:15272249-15272515
  misc_feature 1..266: note = Hypo
  source 1..266: mol_type = genomic DNA

SEQ ID NO: 115690 - DNA, 739 bp, Homo sapiens; identical to SEQ ID NO: 82638
  misc_feature 1..739: note = chr19:15288174-15288913
  misc_feature 1..739: note = Hyper
  source 1..739: mol_type = genomic DNA

SEQ ID NO: 115691 - DNA, 357 bp, Homo sapiens; identical to SEQ ID NO: 82639
  misc_feature 1..357: note = chr19:15292255-15292612
  misc_feature 1..357: note = Hypo
  source 1..357: mol_type = genomic DNA

SEQ ID NO: 115692 - DNA, 132 bp, Homo sapiens; identical to SEQ ID NO: 82640
  misc_feature 1..132: note = chr19:15298622-15298754
  misc_feature 1..132: note = Hypo
  source 1..132: mol_type = genomic DNA

SEQ ID NO: 115693 - DNA, 96 bp, Homo sapiens; identical to SEQ ID NO: 82641
  misc_feature 1..96: note = chr19:15300050-15300146
  misc_feature 1..96: note = Hypo
  source 1..96: mol_type = genomic DNA

SEQ ID NO: 115694 - DNA, 30 bp, Homo sapiens; identical to SEQ ID NO: 82642
  misc_feature 1..30: note = chr19:15306935-15306965
  misc_feature 1..30: note = Hyper
  source 1..30: mol_type = genomic DNA

SEQ ID NO: 115695 - DNA, 30 bp, Homo sapiens; identical to SEQ ID NO: 82643
  misc_feature 1..30: note = chr19:15311325-15311355
  misc_feature 1..30: note = Hyper
  source 1..30: mol_type = genomic DNA

SEQ ID NO: 115696 - DNA, 361 bp, Homo sapiens; identical to SEQ ID NO: 82644
  misc_feature 1..361: note = chr19:15311593-15311954
  misc_feature 1..361: note = Hyper
  source 1..361: mol_type = genomic DNA

SEQ ID NO: 115697 - DNA, 298 bp, Homo sapiens; identical to SEQ ID NO: 82645
  misc_feature 1..298: note = chr19:15333522-15333820
  misc_feature 1..298: note = Hyper
  source 1..298: mol_type = genomic DNA

SEQ ID NO: 115698 - DNA, 140 bp, Homo sapiens; identical to SEQ ID NO: 82646
  misc_feature 1..140: note = chr19:15334711-15334851
  misc_feature 1..140: note = Hyper
  source 1..140: mol_type = genomic DNA

SEQ ID NO: 115699 - DNA, 824 bp, Homo sapiens; identical to SEQ ID NO: 82648
  misc_feature 1..824: note = chr19:15342587-15343411
  misc_feature 1..824: note = Hyper
  source 1..824: mol_type = genomic DNA

SEQ ID NO: 115700 - DNA, 495 bp, Homo sapiens
  misc_feature 1..495: note = chr19:15343929-15344424
  misc_feature 1..495: note = Hyper
  source 1..495: mol_type = genomic DNA
gggccaatgagctgacggtaggccggggagggggcggtggggtggggtgggcaatgggcaatgagacggagggcggggccgggacctaatatggcgggtcaggagggtctggaagacgaagaagagggacaggcaatgccaggtctaggactaggagggaggcgcgggcggtattagcggctggaggaggcttcgggaggcccggccgacggccgccgcctggtgctacccacccaggggcgcgcgaccctcccttcggtctggctccaaagacctagcagcactgacttcacccagctgtggttccaacggcgggtccagcggcctcggcccggcgccgtcctcctgctggcccaacaggcccgccagcccgcccctgtacgtctgtgattggacggcggcggccactgatgttcaagcgacaggtcctggcccgggagccaatctgcaggtgttgaggcccaggctccgagagcgggccgaggaggcgtggat

SEQ ID NO: 115701 - DNA, 30 bp, Homo sapiens; identical to SEQ ID NO: 82651
  misc_feature 1..30: note = chr19:15364996-15365026
  misc_feature 1..30: note = Hypo
  source 1..30: mol_type = genomic DNA

SEQ ID NO: 115702 - DNA, 94 bp, Homo sapiens; identical to SEQ ID NO: 82652
  misc_feature 1..94: note = chr19:15370805-15370899
  misc_feature 1..94: note = Hypo
  source 1..94: mol_type = genomic DNA

SEQ ID NO: 115703 - DNA, 40 bp, Homo sapiens; identical to SEQ ID NO: 82654
  misc_feature 1..40: note = chr19:15488544-15488584
  misc_feature 1..40: note = Hypo
  source 1..40: mol_type = genomic DNA

SEQ ID NO: 115704 - DNA, 30 bp, Homo sapiens; identical to SEQ ID NO: 45739
  misc_feature 1..30: note = chr19:15547714-15547744
  misc_feature 1..30: note = Hypo
  source 1..30: mol_type = genomic DNA

SEQ ID NO: 115705 - DNA, 30 bp, Homo sapiens; identical to SEQ ID NO: 82656
  misc_feature 1..30: note = chr19:15551609-15551639
  misc_feature 1..30: note = Hypo
  source 1..30: mol_type = genomic DNA

SEQ ID NO: 115706 - DNA, 174 bp, Homo sapiens; identical to SEQ ID NO: 45740
  misc_feature 1..174: note = chr19:15558347-15558521
  misc_feature 1..174: note = Hypo
  source 1..174: mol_type = genomic DNA

SEQ ID NO: 115707 - DNA, 30 bp, Homo sapiens; identical to SEQ ID NO: 82658
  misc_feature 1..30: note = chr19:15558960-15558990
  misc_feature 1..30: note = Hypo
  source 1..30: mol_type = genomic DNA

SEQ ID NO: 115708 - DNA, 385 bp, Homo sapiens; identical to SEQ ID NO: 82659
  misc_feature 1..385: note = chr19:15619208-15619593
  misc_feature 1..385: note = Hyper
  source 1..385: mol_type = genomic DNA

SEQ ID NO: 115709 - DNA, 30 bp, Homo sapiens; identical to SEQ ID NO: 82660
  misc_feature 1..30: note = chr19:15622487-15622517
  misc_feature 1..30: note = Hypo
  source 1..30: mol_type = genomic DNA

SEQ ID NO: 115710 - DNA, 31 bp, Homo sapiens; identical to SEQ ID NO: 82661
  misc_feature 1..31: note = chr19:15630862-15630893
  misc_feature 1..31: note = Hypo
  source 1..31: mol_type = genomic DNA

SEQ ID NO: 115711 - DNA, 386 bp, Homo sapiens; identical to SEQ ID NO: 82665
  misc_feature 1..386: note = chr19:15695283-15695669
  misc_feature 1..386: note = Hyper
  source 1..386: mol_type = genomic DNA

SEQ ID NO: 115712 - DNA, 16 bp, Homo sapiens
  misc_feature 1..16: note = chr19:15968359-15968375
  misc_feature 1..16: note = Hypo
  source 1..16: mol_type = genomic DNA
gcgacagagtgagact

SEQ ID NO: 115713 - DNA, 79 bp, Homo sapiens; identical to SEQ ID NO: 82669
  misc_feature 1..79: note = chr19:16013614-16013693
  misc_feature 1..79: note = Hypo
  source 1..79: mol_type = genomic DNA

SEQ ID NO: 115714 - DNA, 32 bp, Homo sapiens; identical to SEQ ID NO: 82670
  misc_feature 1..32: note = chr19:16130658-16130690
  misc_feature 1..32: note = Hypo
  source 1..32: mol_type = genomic DNA

SEQ ID NO: 115715 - DNA, 37 bp, Homo sapiens; identical to SEQ ID NO: 82671
  misc_feature 1..37: note = chr19:16186963-16187000
  misc_feature 1..37: note = Hyper
  source 1..37: mol_type = genomic DNA

SEQ ID NO: 115716 - DNA, 51 bp, Homo sapiens; identical to SEQ ID NO: 82672
  misc_feature 1..51: note = chr19:16232444-16232495
  misc_feature 1..51: note = Hypo
  source 1..51: mol_type = genomic DNA

SEQ ID NO: 115717 - DNA, 143 bp, Homo sapiens; identical to SEQ ID NO: 82673
  misc_feature 1..143: note = chr19:16275680-16275823
  misc_feature 1..143: note = Hypo
  source 1..143: mol_type = genomic DNA

SEQ ID NO: 115718 - DNA, 167 bp, Homo sapiens
  misc_feature 1..167: note = chr19:16436279-16436446
  misc_feature 1..167: note = Hyper
  source 1..167: mol_type = genomic DNA
gccgctttctgctggcgccgcccggccgcctggtcaaggccgagccccctgaagcggacggcggcggcggctacggctgcgcccccgggctgacccgtggaccgcgcggcctcaagcgcgagggcgccccgggcccggcggcttcgtgcatgcgaggtcccgggggc

SEQ ID NO: 115719 - DNA, 119 bp, Homo sapiens; identical to SEQ ID NO: 82675
  misc_feature 1..119: note = chr19:16472658-16472777
  misc_feature 1..119: note = Hypo
  source 1..119: mol_type = genomic DNA

SEQ ID NO: 115720 - DNA, 35 bp, Homo sapiens; identical to SEQ ID NO: 82678
  misc_feature 1..35: note = chr19:16585115-16585150
  misc_feature 1..35: note = Hypo
  source 1..35: mol_type = genomic DNA

SEQ ID NO: 115721 - DNA, 40 bp, Homo sapiens; identical to SEQ ID NO: 82679
  misc_feature 1..40: note = chr19:16608429-16608469
  misc_feature 1..40: note = Hypo
  source 1..40: mol_type = genomic DNA

SEQ ID NO: 115722 - DNA, 58 bp, Homo sapiens; identical to SEQ ID NO: 82680
  misc_feature 1..58: note = chr19:16620382-16620440
  misc_feature 1..58: note = Hypo
  source 1..58: mol_type = genomic DNA

SEQ ID NO: 115723 - DNA, 54 bp, Homo sapiens; identical to SEQ ID NO: 82681
  misc_feature 1..54: note = chr19:16638261-16638315
  misc_feature 1..54: note = Hypo
  source 1..54: mol_type = genomic DNA

SEQ ID NO: 115724 - DNA, 68 bp, Homo sapiens; identical to SEQ ID NO: 45744
  misc_feature 1..68: note = chr19:16638668-16638736
  misc_feature 1..68: note = Hypo
  source 1..68: mol_type = genomic DNA

SEQ ID NO: 115725 - DNA, 31 bp, Homo sapiens; identical to SEQ ID NO: 82684
  misc_feature 1..31: note = chr19:16684446-16684477
  misc_feature 1..31: note = Hypo
  source 1..31: mol_type = genomic DNA

SEQ ID NO: 115726 - DNA, 30 bp, Homo sapiens; identical to SEQ ID NO: 82685
  misc_feature 1..30: note = chr19:16693656-16693686
  misc_feature 1..30: note = Hypo
  source 1..30: mol_type = genomic DNA

SEQ ID NO: 115727 - DNA, 226 bp, Homo sapiens; identical to SEQ ID NO: 82688
  misc_feature 1..226: note = chr19:16939668-16939894
  misc_feature 1..226: note = Hypo
  source 1..226: mol_type = genomic DNA

SEQ ID NO: 115728 - DNA, 707 bp, Homo sapiens
  misc_feature 1..707: note = chr19:17007086-17007793
  misc_feature 1..707: note = Hyper
  source 1..707: mol_type = genomic DNA
aagccaggtcatccccgtaggtggaggacgacgaggccggcagccgctgctctggaaggaagggggcctcggtcgggagggcgtggcggggaggggacccaagggccgaggggaggagatccgtggcccagagcagcagcgatggtgtccccgaggctaggcggggggtagggtcctcaccgagggcgcagcagctgggaggcgcgggctccaggggcgcggcctggcggcaggcggcctcccgcaggcggcaggcgctggcgtagaccaccccgtcggagccgcacaccgggttcccctgggcgccgcagtcgtggtcgcagccgcatcgcgcgatcgccgccccctcctcaggggccacggcagggcccgactcgccggggaaccagcctgggggacgaggcaggctcgacagaccccccaccctgaaccttgcccgcgcccccacagaacctgggggtggggaagatgtccctgggtcccgggcccactaccccctcggtgggtcttggggcgcgacagttaatgggaggtcctgagccctggccttatggaatttcacgcaggtatttgcctaatacttacaaaaacagaaacagacttttaaaaagcggttgtaggagagaaaggagacagggcgtcctgtctgggccgccctgcaacaacagccccgtcccctgccgcgcctcctccgcactgaccacacc

SEQ ID NO: 115729 - DNA, 450 bp, Homo sapiens
  misc_feature 1..450: note = chr19:17008359-17008809
  misc_feature 1..450: note = Hyper
  source 1..450: mol_type = genomic DNA
cccacctctatgctgcgttctcctgactttacgttggcccctcctctgccaagcccccaggggagccctccctggcgtccgagggtgggagtcggggtgtggcaggccgcggtggggggcggcagtggctccgcgcactcacccgggccccgggcaggggcgcgctccacttcgttgcacgcgggtccggcgcacagttcccgggcgagtgggctgtgggtgctgacgttgtagaagcgagtggcctcgaaggctacgggacgagggtggcgggtgaccaagtgcaggcgcgacgggtcagggaccgggccgggccgggggtgcgggcgcgcgggcctaccgggttcgtagtagtcgtacacggagactggcagcgccgacgtcctgcccaccacgcactcccggagagcacggaaccgcacgcacgtcaggcaccggctggggatctgt

SEQ ID NO: 115730 - DNA, 32 bp, Homo sapiens; identical to SEQ ID NO: 82695
  misc_feature 1..32: note = chr19:17048874-17048906
  misc_feature 1..32: note = Hypo
  source 1..32: mol_type = genomic DNA

SEQ ID NO: 115731 - DNA, 48 bp, Homo sapiens; identical to SEQ ID NO: 82696
  misc_feature 1..48: note = chr19:17049220-17049268
  misc_feature 1..48: note = Hypo
  source 1..48: mol_type = genomic DNA

SEQ ID NO: 115732 - DNA, 445 bp, Homo sapiens
  misc_feature 1..445: note = chr19:17137026-17137471
  misc_feature 1..445: note = Hyper
  source 1..445: mol_type = genomic DNA
acttctcagccaagacgctcctcttaccttcataccttggacaactggaaatcgccacccatgatgacagcccgggtcacacgaagggggcgaggtggggcggggggagctgacctcagcacctttagcttttgggagtccctgtacctccacagagccacttcggaaactttagggcgccccctcctcaagacgattcgggaacaagaggccaggtccagcccagcgcggaggctgtgtggccttgggcaggtcgctgcaacactctgagccagtacccgcgacccccaccccagaaggcgaccgacctcctctgtcgccggaggatactcacggggcctgaggctgcgcggcgcgcacgccgtcccgcgccgacagcagcaggagcaggagcgggagcaacggccagagcagggcgccgctcatttttcggctcctggggggc

SEQ ID NO: 115733 - DNA, 50 bp, Homo sapiens; identical to SEQ ID NO: 82699
  misc_feature 1..50: note = chr19:17137729-17137779
  misc_feature 1..50: note = Hyper
  source 1..50: mol_type = genomic DNA

SEQ ID NO: 115734 - DNA, 137 bp, Homo sapiens; identical to SEQ ID NO: 82704
  misc_feature 1..137: note = chr19:17264960-17265097
  misc_feature 1..137: note = Hypo
  source 1..137: mol_type = genomic DNA

SEQ ID NO: 115735 - DNA, 30 bp, Homo sapiens; identical to SEQ ID NO: 82706
  misc_feature 1..30: note = chr19:17321616-17321646
  misc_feature 1..30: note = Hypo
  source 1..30: mol_type = genomic DNA

SEQ ID NO: 115736 - DNA, 53 bp, Homo sapiens; identical to SEQ ID NO: 82707
  misc_feature 1..53: note = chr19:17362406-17362459
  misc_feature 1..53: note = Hypo
  source 1..53: mol_type = genomic DNA

SEQ ID NO: 115737 - DNA, 62 bp, Homo sapiens; identical to SEQ ID NO: 45748
  misc_feature 1..62: note = chr19:17365683-17365745
  misc_feature 1..62: note = Hypo
  source 1..62: mol_type = genomic DNA

SEQ ID NO: 115738 - DNA, 19 bp, Homo sapiens
  misc_feature 1..19: note = chr19:17379193-17379212
  misc_feature 1..19: note = Hypo
  source 1..19: mol_type = genomic DNA
cagtaagcggctcatcgcc

SEQ ID NO: 115739 - DNA, 628 bp, Homo sapiens; identical to SEQ ID NO: 82710
  misc_feature 1..628: note = chr19:17392502-17393130
  misc_feature 1..628: note = Hyper
  source 1..628: mol_type = genomic DNA

SEQ ID NO: 115740 - DNA, 21 bp, Homo sapiens
  misc_feature 1..21: note = chr19:17398566-17398587
  misc_feature 1..21: note = Hypo
  source 1..21: mol_type = genomic DNA
atggagcctgccaggcgcggt

SEQ ID NO: 115741 - DNA, 104 bp, Homo sapiens; identical to SEQ ID NO: 82712
  misc_feature 1..104: note = chr19:17399513-17399617
  misc_feature 1..104: note = Hypo
  source 1..104: mol_type = genomic DNA

SEQ ID NO: 115742 - DNA, 821 bp, Homo sapiens; identical to SEQ ID NO: 82713
  misc_feature 1..821: note = chr19:17404590-17405411
  misc_feature 1..821: note = Hypo
  source 1..821: mol_type = genomic DNA

SEQ ID NO: 115743 - DNA, 30 bp, Homo sapiens; identical to SEQ ID NO: 82714
  misc_feature 1..30: note = chr19:17415369-17415399
  misc_feature 1..30: note = Hypo
  source 1..30: mol_type = genomic DNA

SEQ ID NO: 115744 - DNA, 490 bp, Homo sapiens; identical to SEQ ID NO: 82715
  misc_feature 1..490: note = chr19:17438072-17438562
  misc_feature 1..490: note = Hypo
  source 1..490: mol_type = genomic DNA

SEQ ID NO: 115745 - DNA, 246 bp, Homo sapiens; identical to SEQ ID NO: 82716
  misc_feature 1..246: note = chr19:17449212-17449458
  misc_feature 1..246: note = Hypo
  source 1..246: mol_type = genomic DNA

SEQ ID NO: 115746 - DNA, 76 bp, Homo sapiens; identical to SEQ ID NO: 82717
  misc_feature 1..76: note = chr19:17462843-17462919
  misc_feature 1..76: note = Hypo
  source 1..76: mol_type = genomic DNA

SEQ ID NO: 115747 - DNA, 618 bp, Homo sapiens; identical to SEQ ID NO: 82723
  misc_feature 1..618: note = chr19:17501171-17501789
  misc_feature 1..618: note = Hyper
  source 1..618: mol_type = genomic DNA

SEQ ID NO: 115748 - DNA, 42 bp, Homo sapiens; identical to SEQ ID NO: 82726
  misc_feature 1..42: note = chr19:17531354-17531396
  misc_feature 1..42: note = Hyper
  source 1..42: mol_type = genomic DNA

SEQ ID NO: 115749 - DNA, 171 bp, Homo sapiens; identical to SEQ ID NO: 82730
  misc_feature 1..171: note = chr19:17559117-17559288
  misc_feature 1..171: note = Hyper
  source 1..171: mol_type = genomic DNA

SEQ ID NO: 115750 - DNA, 93 bp, Homo sapiens; identical to SEQ ID NO: 82734
  misc_feature 1..93: note = chr19:17605703-17605796
  misc_feature 1..93: note = Hypo
  source 1..93: mol_type = genomic DNA

SEQ ID NO: 115751 - DNA, 30 bp, Homo sapiens; identical to SEQ ID NO: 82737
  misc_feature 1..30: note = chr19:17627117-17627147
  misc_feature 1..30: note = Hypo
  source 1..30: mol_type = genomic DNA

SEQ ID NO: 115752 - DNA, 30 bp, Homo sapiens; identical to SEQ ID NO: 45752
  misc_feature 1..30: note = chr19:17644708-17644738
  misc_feature 1..30: note = Hypo
  source 1..30: mol_type = genomic DNA

SEQ ID NO: 115753 - DNA, 130 bp, Homo sapiens; identical to SEQ ID NO: 82742
  misc_feature 1..130: note = chr19:17687961-17688091
  misc_feature 1..130: note = Hypo
  source 1..130: mol_type = genomic DNA

SEQ ID NO: 115754 - DNA, 30 bp, Homo sapiens; identical to SEQ ID NO: 82744
  misc_feature 1..30: note = chr19:17716509-17716539
  misc_feature 1..30: note = Hyper
  source 1..30: mol_type = genomic DNA

SEQ ID NO: 115755 - DNA, 746 bp, Homo sapiens; identical to SEQ ID NO: 82745
  misc_feature 1..746: note = chr19:17716778-17717524
  misc_feature 1..746: note = Hyper
  source 1..746: mol_type = genomic DNA

SEQ ID NO: 115756 - DNA, 250 bp, Homo sapiens; identical to SEQ ID NO: 82746
  misc_feature 1..250: note = chr19:17734046-17734296
  misc_feature 1..250: note = Hypo
  source 1..250: mol_type = genomic DNA

SEQ ID NO: 115757 - DNA, 62 bp, Homo sapiens; identical to SEQ ID NO: 82748
  misc_feature 1..62: note = chr19:17756536-17756598
  misc_feature 1..62: note = Hypo
  source 1..62: mol_type = genomic DNA

SEQ ID NO: 115758 - DNA, 57 bp, Homo sapiens; identical to SEQ ID NO: 82749
  misc_feature 1..57: note = chr19:17758076-17758133
  misc_feature 1..57: note = Hypo
  source 1..57: mol_type = genomic DNA

SEQ ID NO: 115759 - DNA, 695 bp, Homo sapiens; identical to SEQ ID NO: 82750
  misc_feature 1..695: note = chr19:17759137-17759832
  misc_feature 1..695: note = Hypo
  source 1..695: mol_type = genomic DNA

SEQ ID NO: 115760 - DNA, 41 bp, Homo sapiens; identical to SEQ ID NO: 82752
  misc_feature 1..41: note = chr19:17767174-17767215
  misc_feature 1..41: note = Hypo
  source 1..41: mol_type = genomic DNA

SEQ ID NO: 115761 - DNA, 530 bp, Homo sapiens; identical to SEQ ID NO: 82754
  misc_feature 1..530: note = chr19:17790905-17791435
  misc_feature 1..530: note = Hyper
  source 1..530: mol_type = genomic DNA

SEQ ID NO: 115762 - DNA, 30 bp, Homo sapiens; identical to SEQ ID NO: 82755
  misc_feature 1..30: note = chr19:17792484-17792514
  misc_feature 1..30: note = Hyper
  source 1..30: mol_type = genomic DNA

SEQ ID NO: 115763 - DNA, 563 bp, Homo sapiens
  misc_feature 1..563: note = chr19:17798506-17799069
  misc_feature 1..563: note = Hyper
  source 1..563: mol_type = genomic DNA
ggagaaccctcccaccgcactctccttcgaatttccagccgggtccgcgtccatgaggacccgtaacccagcccacaacaccagaccccttccaagcacccctgcaggcttcaatcaaactaccgagcccagactcttcctcactgaccctctaaaaacctggtctacacagacgccccagtctagatcgtttccgggtagaaccccggatacccgtccacgtccacacgggcctccgcgttcagccgcgtccacacgacccctccagcagcggccaccaggacccccgagagccctgccgcgtctacacggatcaccccctccggggcccagctgcgtcgacaagggctacccctctcaaaagtccagccacctggactcgggtcaccccccaggaaccccctgggagccgcatccacgcggaccccgaccccagcccgcgtccacacgggtcccccgacccccagcctcgcctcctacctccaacgcaaagcagagacatgtctccgagctcgcaggtgggccggaggcggccgggccggctctgtcgggtcgggctcagc

SEQ ID NO: 115764 - DNA, 140 bp, Homo sapiens; identical to SEQ ID NO: 82758
  misc_feature 1..140: note = chr19:17808966-17809106
  misc_feature 1..140: note = Hypo
  source 1..140: mol_type = genomic DNA

SEQ ID NO: 115765 - DNA, 104 bp, Homo sapiens; identical to SEQ ID NO: 82759
  misc_feature 1..104: note = chr19:17836551-17836655
  misc_feature 1..104: note = Hypo
  source 1..104: mol_type = genomic DNA

SEQ ID NO: 115766 - DNA, 397 bp, Homo sapiens; identical to SEQ ID NO: 82760
  misc_feature 1..397: note = chr19:17905846-17906243
  misc_feature 1..397: note = Hyper
  source 1..397: mol_type = genomic DNA

SEQ ID NO: 115767 - DNA, 495 bp, Homo sapiens; identical to SEQ ID NO: 82761
  misc_feature 1..495: note = chr19:17958475-17958970
  misc_feature 1..495: note = Hyper
  source 1..495: mol_type = genomic DNA

SEQ ID NO: 115768 - DNA, 1048 bp, Homo sapiens
  misc_feature 1..1048: note = chr19:17982786-17983834
  misc_feature 1..1048: note = Hyper
  source 1..1048: mol_type = genomic DNA
cagcgctgagcacagcgcccagggagagggacagacagccggctgcatgggacagcggaacccagagtgagaggggaggtggcaggacagacagacagcaggggcggacgcagagacagacagcggggacagggaggccgacacggacatcgacagcccatagattcctaacccagggagccccggcccctctcgccgcttcccaccccagacggagcggggacaggctgccgagcatcctcccacccgccctccccgtcctgcctcctcggcccctgccagcttcccccgcttgagcacgcagggcgtccgaggacgcgctgggcctccgcacccgccctcatggaggccgtggagaccggggaacggcccaccttcggagcctgggactacggggtctttgccctcatgctcctggtgtccactggcatcgggctgtgggtcgggctggctcggggcgggcagcgcagcgctgaggacttcttcaccgggggccggcgcctggcggccctgcccgtgggcctgtcgctgtctgccagcttcatgtcggccgtgcaggtgctgggcgtgccgtcggaggcctatcgctatggcctcaagttcctctggatgtgcctgggccagcttctgaactcggtcctcaccgccctgctcttcatgcccgtcttctaccgcctgggcctcaccagcacctacgaggtaccggacagaggcccgggggtaggacctgccccactggcagtgctgggaccccgtgtgggggaggcgctggggctttgggccgctgtacaggaggacgcggatggcacctcggtgctttaacggaaggggcccctaggcagacacgtggggagggttctaggaagaggccccaggcgcccggcgaggggcaggaaggaggaagagagagcctggcgtcctgctccttcggtggaagcgcgcgcggggcggggcccggctcgaccaggtgtgtcctcacgggtggacacacacctgccccccacctgcccgggcgtgcagacccacgtgtgcgcgctagaggggactg

SEQ ID NO: 115769 - DNA, 324 bp, Homo sapiens; identical to SEQ ID NO: 82763
  misc_feature 1..324: note = chr19:17984588-17984912
  misc_feature 1..324: note = Hyper
  source 1..324: mol_type = genomic DNA

SEQ ID NO: 115770 - DNA, 51 bp, Homo sapiens; identical to SEQ ID NO: 82764
  misc_feature 1..51: note = chr19:17994699-17994750
  misc_feature 1..51: note = Hypo
  source 1..51: mol_type = genomic DNA

SEQ ID NO: 115771 - DNA, 96 bp, Homo sapiens; identical to SEQ ID NO: 16462
  misc_feature 1..96: note = chr19:18041146-18041242
  misc_feature 1..96: note = Hypo
  source 1..96: mol_type = genomic DNA

SEQ ID NO: 115772 - DNA, 783 bp, Homo sapiens; identical to SEQ ID NO: 82768
  misc_feature 1..783: note = chr19:18054252-18055035
  misc_feature 1..783: note = Hypo
  source 1..783: mol_type = genomic DNA

SEQ ID NO: 115773 - DNA, 30 bp, Homo sapiens; identical to SEQ ID NO: 82770
  misc_feature 1..30: note = chr19:18060062-18060092
  misc_feature 1..30: note = Hyper
  source 1..30: mol_type = genomic DNA

SEQ ID NO: 115774 - DNA, 47 bp, Homo sapiens; identical to SEQ ID NO: 82771
  misc_feature 1..47: note = chr19:18062162-18062209
  misc_feature 1..47: note = Hyper
  source 1..47: mol_type = genomic DNA

SEQ ID NO: 115775 - DNA, 179 bp, Homo sapiens; identical to SEQ ID NO: 82772
  misc_feature 1..179: note = chr19:18062412-18062591
  misc_feature 1..179: note = Hyper
  source 1..179: mol_type = genomic DNA

SEQ ID NO: 115776 - DNA, 135 bp, Homo sapiens; identical to SEQ ID NO: 82774
  misc_feature 1..135: note = chr19:18063960-18064095
  misc_feature 1..135: note = Hyper
  source 1..135: mol_type = genomic DNA

SEQ ID NO: 115777 - DNA, 535 bp, Homo sapiens; identical to SEQ ID NO: 82776
  misc_feature 1..535: note = chr19:18077737-18078272
  misc_feature 1..535: note = Hyper
  source 1..535: mol_type = genomic DNA

SEQ ID NO: 115778 - DNA, 106 bp, Homo sapiens; identical to SEQ ID NO: 82778
  misc_feature 1..106: note = chr19:18084912-18085018
  misc_feature 1..106: note = Hypo
  source 1..106: mol_type = genomic DNA

SEQ ID NO: 115779 - DNA, 395 bp, Homo sapiens; identical to SEQ ID NO: 82779
  misc_feature 1..395: note = chr19:18092490-18092885
  misc_feature 1..395: note = Hypo
  source 1..395: mol_type = genomic DNA

SEQ ID NO: 115780 - DNA, 224 bp, Homo sapiens; identical to SEQ ID NO: 82781
  misc_feature 1..224: note = chr19:18103700-18103924
  misc_feature 1..224: note = Hypo
  source 1..224: mol_type = genomic DNA

SEQ ID NO: 115781 - DNA, 94 bp, Homo sapiens; identical to SEQ ID NO: 82782
  misc_feature 1..94: note = chr19:18104399-18104493
  misc_feature 1..94: note = Hypo
  source 1..94: mol_type = genomic DNA

SEQ ID NO: 115782 - DNA, 19 bp, Homo sapiens
  misc_feature 1..19: note = chr19:18105637-18105656
  misc_feature 1..19: note = Hypo
  source 1..19: mol_type = genomic DNA
ccaccgtgcccagcccatt

SEQ ID NO: 115783 - DNA, 161 bp, Homo sapiens; identical to SEQ ID NO: 82786
  misc_feature 1..161: note = chr19:18118157-18118318
  misc_feature 1..161: note = Hyper
  source 1..161: mol_type = genomic DNA

SEQ ID NO: 115784 - DNA, 470 bp, Homo sapiens
  misc_feature 1..470: note = chr19:18118573-18119043
  misc_feature 1..470: note = Hyper
  source 1..470: mol_type = genomic DNA
ggccctcaactggggcgagagtcccccgccccaaatcgggctggacatgcctcgagtcacgtcaacgaggggcggctggtgagtgattaagccgagaggctgaaggctctgctaggtgacctcaggcctgggccctgcctctgcacctctttttttcctctttacccccggggtccgcgagagaccagctctggcagcctaagggcttcagtttctccccggggtccgcgagggaagggggcagccggcggtgagcaggggcgtttgttattttgctccacgcctgggcagagccacgccccttgtcgcgctattggtggagtcccttcccggggcggggaagagacggtgaccccacccccccccgccctgccgtataaaagcggcgccgacgcacggcgcggggattttctgctccggttggtgagcgcgcctgcgcgttgacggcgattttgcgttctgaggctgca

SEQ ID NO: 115785 - DNA, 30 bp, Homo sapiens; identical to SEQ ID NO: 82790
  misc_feature 1..30: note = chr19:18126576-18126606
  misc_feature 1..30: note = Hypo
  source 1..30: mol_type = genomic DNA

SEQ ID NO: 115786 - DNA, 21 bp, Homo sapiens
  misc_feature 1..21: note = chr19:18173288-18173309
  misc_feature 1..21: note = Hypo
  source 1..21: mol_type = genomic DNA
tctgtaattccaggccgggca

SEQ ID NO: 115787 - DNA, 120 bp, Homo sapiens; identical to SEQ ID NO: 82792
  misc_feature 1..120: note = chr19:18175554-18175674
  misc_feature 1..120: note = Hypo
  source 1..120: mol_type = genomic DNA

SEQ ID NO: 115788 - DNA, 35 bp, Homo sapiens; identical to SEQ ID NO: 82793
  misc_feature 1..35: note = chr19:18175734-18175769
  misc_feature 1..35: note = Hypo
  source 1..35: mol_type = genomic DNA

SEQ ID NO: 115789 - DNA, 70 bp, Homo sapiens; identical to SEQ ID NO: 82794
  misc_feature 1..70: note = chr19:18193110-18193180
  misc_feature 1..70: note = Hypo
  source 1..70: mol_type = genomic DNA

SEQ ID NO: 115790 - DNA, 86 bp, Homo sapiens; identical to SEQ ID NO: 82795
  misc_feature 1..86: note = chr19:18207919-18208005
  misc_feature 1..86: note = Hypo
  source 1..86: mol_type = genomic DNA

SEQ ID NO: 115791 - DNA, 51 bp, Homo sapiens; identical to SEQ ID NO: 82796
  misc_feature 1..51: note = chr19:18241304-18241355
  misc_feature 1..51: note = Hypo
  source 1..51: mol_type = genomic DNA

SEQ ID NO: 115792 - DNA, 30 bp, Homo sapiens; identical to SEQ ID NO: 82797
  misc_feature 1..30: note = chr19:18262269-18262299
  misc_feature 1..30: note = Hypo
  source 1..30: mol_type = genomic DNA

SEQ ID NO: 115793 - DNA, 30 bp, Homo sapiens; identical to SEQ ID NO: 82798
  misc_feature 1..30: note = chr19:18271945-18271975
  misc_feature 1..30: note = Hyper
  source 1..30: mol_type = genomic DNA

SEQ ID NO: 115794 - DNA, 199 bp, Homo sapiens; identical to SEQ ID NO: 82799
  misc_feature 1..199: note = chr19:18272708-18272907
  misc_feature 1..199: note = Hypo
  source 1..199: mol_type = genomic DNA

SEQ ID NO: 115795 - DNA, 18 bp, Homo sapiens
  misc_feature 1..18: note = chr19:18298268-18298286
  misc_feature 1..18: note = Hypo
  source 1..18: mol_type = genomic DNA
acaggcataagccaccga

SEQ ID NO: 115796 - DNA, 23 bp, Homo sapiens
  misc_feature 1..23: note = chr19:18325046-18325069
  misc_feature 1..23: note = Hypo
  source 1..23: mol_type = genomic DNA
caagactccgtctcaaaaaaaaa

SEQ ID NO: 115797 - DNA, 218 bp, Homo sapiens; identical to SEQ ID NO: 45769
  misc_feature 1..218: note = chr19:18330991-18331209
  misc_feature 1..218: note = Hypo
  source 1..218: mol_type = genomic DNA

SEQ ID NO: 115798 - DNA, 130 bp, Homo sapiens; identical to SEQ ID NO: 82803
  misc_feature 1..130: note = chr19:18335243-18335373
  misc_feature 1..130: note = Hyper
  source 1..130: mol_type = genomic DNA

SEQ ID NO: 115799 - DNA, 135 bp, Homo sapiens; identical to SEQ ID NO: 82804
  misc_feature 1..135: note = chr19:18336370-18336505
  misc_feature 1..135: note = Hyper
  source 1..135: mol_type = genomic DNA

SEQ ID NO: 115800 - DNA, 400 bp, Homo sapiens; identical to SEQ ID NO: 82805
  misc_feature 1..400: note = chr19:18336730-18337130
  misc_feature 1..400: note = Hyper
  source 1..400: mol_type = genomic DNA

SEQ ID NO: 115801 - DNA, 578 bp, Homo sapiens
  misc_feature 1..578: note = chr19:18343439-18344017
  misc_feature 1..578: note = Hyper
  source 1..578: mol_type = genomic DNA
atacccaagcatgaacgtacaggagcaccccaaacacatctggtcaccccagtctcacgcgcgcgcgcgcacacacacacacactctttcagtcccaaccgcacgtgggcacacccggtcacacagacccacaagccatgatgacaccagcaccctcagctccacccctacgtagaaatagctttttccttccaggcgccagcctcaaccaagcagcagagacccccgccccctggagaagcaaggaccctcccccactcccgccaggccccgcgcgcccctcccccgcgctgcaggaggcccctgccccggccacctaccgcctgcaggaggaaacgggccaggagagccgcgacttcctgagctccggccgcgggctcaggtccctctcgcggcagcccgcggacttgtccggatccgaatagaagcgctgttggatgcggatggggcgccggggttgccgccacaggtgcttcggggctctggtcatgctgtggcggccgcgagagcgactcaacctgctgcaagcctctgccccttcgccgacccccaggttctccatgcgccagagaaagggg

SEQ ID NO: 115802 - DNA, 48 bp, Homo sapiens; identical to SEQ ID NO: 45770
  misc_feature 1..48: note = chr19:18383303-18383351
  misc_feature 1..48: note = Hypo
  source 1..48: mol_type = genomic DNA

SEQ ID NO: 115803 - DNA, 30 bp, Homo sapiens; identical to SEQ ID NO: 82809
  misc_feature 1..30: note = chr19:18410211-18410241
  misc_feature 1..30: note = Hypo
  source 1..30: mol_type = genomic DNA

SEQ ID NO: 115804 - DNA, 40 bp, Homo sapiens; identical to SEQ ID NO: 82810
  misc_feature 1..40: note = chr19:18413086-18413126
  misc_feature 1..40: note = Hypo
  source 1..40: mol_type = genomic DNA

SEQ ID NO: 115805 - DNA, 30 bp, Homo sapiens; identical to SEQ ID NO: 82811
  misc_feature 1..30: note = chr19:18456915-18456945
  misc_feature 1..30: note = Hypo
  source 1..30: mol_type = genomic DNA

SEQ ID NO: 115806 - DNA, 55 bp, Homo sapiens; identical to SEQ ID NO: 82812
  misc_feature 1..55: note = chr19:18459164-18459219
  misc_feature 1..55: note = Hypo
  source 1..55: mol_type = genomic DNA

SEQ ID NO: 115807 - DNA, 95 bp, Homo sapiens; identical to SEQ ID NO: 82813
  misc_feature 1..95: note = chr19:18483800-18483895
  misc_feature 1..95: note = Hypo
  source 1..95: mol_type = genomic DNA

SEQ ID NO: 115808 - DNA, 117 bp, Homo sapiens; identical to SEQ ID NO: 82814
  misc_feature 1..117: note = chr19:18485487-18485604
  misc_feature 1..117: note = Hyper
  source 1..117: mol_type = genomic DNA

SEQ ID NO: 115809 - DNA, 240 bp, Homo sapiens; identical to SEQ ID NO: 82815
  misc_feature 1..240: note = chr19:18523277-18523517
  misc_feature 1..240: note = Hypo
  source 1..240: mol_type = genomic DNA

SEQ ID NO: 115810 - DNA, 77 bp, Homo sapiens; identical to SEQ ID NO: 82816
  misc_feature 1..77: note = chr19:18523577-18523654
  misc_feature 1..77: note = Hypo
  source 1..77: mol_type = genomic DNA

SEQ ID NO: 115811 - DNA, 153 bp, Homo sapiens; identical to SEQ ID NO: 82817
  misc_feature 1..153: note = chr19:18528822-18528975
  misc_feature 1..153: note = Hyper
  source 1..153: mol_type = genomic DNA

SEQ ID NO: 115812 - DNA, 61 bp, Homo sapiens; identical to SEQ ID NO: 82818
  misc_feature 1..61: note = chr19:18544595-18544656
  misc_feature 1..61: note = Hyper
  source 1..61: mol_type = genomic DNA

SEQ ID NO: 115813 - DNA, 30 bp, Homo sapiens; identical to SEQ ID NO: 82819
  misc_feature 1..30: note = chr19:18547884-18547914
  misc_feature 1..30: note = Hyper
  source 1..30: mol_type = genomic DNA

SEQ ID NO: 115814 - DNA, 30 bp, Homo sapiens; identical to SEQ ID NO: 82821
  misc_feature 1..30: note = chr19:18572176-18572206
  misc_feature 1..30: note = Hypo
  source 1..30: mol_type = genomic DNA

SEQ ID NO: 115815 - DNA, 79 bp, Homo sapiens; identical to SEQ ID NO: 82822
  misc_feature 1..79: note = chr19:18600734-18600813
  misc_feature 1..79: note = Hypo
  source 1..79: mol_type = genomic DNA

SEQ ID NO: 115816 - DNA, 30 bp, Homo sapiens; identical to SEQ ID NO: 82823
  misc_feature 1..30: note = chr19:18627227-18627257
  misc_feature 1..30: note = Hypo
  source 1..30: mol_type = genomic DNA

SEQ ID NO: 115817 - DNA, 120 bp, Homo sapiens; identical to SEQ ID NO: 45772
  misc_feature 1..120: note = chr19:18681763-18681883
  misc_feature 1..120: note = Hypo
  source 1..120: mol_type = genomic DNA

SEQ ID NO: 115818 - DNA, 142 bp, Homo sapiens; identical to SEQ ID NO: 82825
  misc_feature 1..142: note = chr19:18707322-18707464
  misc_feature 1..142: note = Hypo
  source 1..142: mol_type = genomic DNA

SEQ ID NO: 115819 - DNA, 680 bp, Homo sapiens
  misc_feature 1..680: note = chr19:18714455-18715135
  misc_feature 1..680: note = Hyper
  source 1..680: mol_type = genomic DNA
ccccctgaatgccagcgctgccctgcacttgccctcactgccccagatgggcgaggtggggtggacacggttcttgggccggccctgatgattttccggggcaaacttggctcgagggctctgtctcgctggagcctggaatcgcagttgcgcttggggcttggcccagggctcgccggaggtctccgcgtccgtgcgaaggagccggctgagcgggccagagccgaggaggcgggggcggccgaggggggcggggggctgggggccaggggaccgccctggaggtcccaggcagccagccgcccgctaattcggaattccttttgcatgaactcgggtgtgccagcgtctctgccccggcccacccaccgcttcctgcctgggcccccccaacagagtgggaggcacggccaggcctgcccagaccccaggcccctctcagcccttctagagtgggtctcactcctcctgcccccaccacccgccagcttggcctgggcaggaaggggctctctggggggtcctggctggggggcgctgcccctctgccacacccgcctggcctgggccggcgtggctcacttgccagcagctgcagctgccctcccggggctgggcgggggacaccgggcggcgacgggttgtagggggaaggcaaggccaggcgggcctggacagac

SEQ ID NO: 115820 - DNA, 45 bp, Homo sapiens; identical to SEQ ID NO: 82829
  misc_feature 1..45: note = chr19:18716238-18716283
  misc_feature 1..45: note = Hyper
  source 1..45: mol_type = genomic DNA

SEQ ID NO: 115821 - DNA, 112 bp, Homo sapiens; identical to SEQ ID NO: 82830
  misc_feature 1..112: note = chr19:18716735-18716847
  misc_feature 1..112: note = Hyper
  source 1..112: mol_type = genomic DNA

SEQ ID NO: 115822 - DNA, 255 bp, Homo sapiens; identical to SEQ ID NO: 82831
  misc_feature 1..255: note = chr19:18718127-18718382
  misc_feature 1..255: note = Hyper
  source 1..255: mol_type = genomic DNA

SEQ ID NO: 115823 - DNA, 162 bp, Homo sapiens
  misc_feature 1..162: note = chr19:18722263-18722425
  misc_feature 1..162: note = Hyper
  source 1..162: mol_type = genomic DNA
tcctgactttgccaacgcgtcccggagcctaagtttcccacctgtgaaatgggggacagtattggtcataacgcacagggctgtttcccaaggtgcgggcctggcgcgcgggtgggttagaagcggaattctcctgctggattctggcgcaaactgcgggct

SEQ ID NO: 115824 - DNA, 93 bp, Homo sapiens; identical to SEQ ID NO: 82834
  misc_feature 1..93: note = chr19:18722675-18722768
  misc_feature 1..93: note = Hyper
  source 1..93: mol_type = genomic DNA

SEQ ID NO: 115825 - DNA, 598 bp, Homo sapiens
  misc_feature 1..598: note = chr19:18723362-18723960
  misc_feature 1..598: note = Hyper
  source 1..598: mol_type = genomic DNA
ctttctcctctctcccgcgtggtcggctcacacgtcgcctcctccgccaagctctccgctctcctcgacacccctggggaatagtcccctccatcccatccccctatatatttccttttggccccaagcgccagcagagatcccccgcccgtgggcaccagggaggtgtcctgggacccccgcgatgggatagacggtgggggccgcgatgcacctgccccgcccgacccgcacgcctcgggtgccgcagcgcagctaccccgcccgctctccgcatctcccaccccccgcttcccaggctgcctcgctcgggtgacgtcagcgccccggtccccgccgcagccgctgcatcctccgtgcccggcctgagctggagtcccccgcgccccccgcgttccgcccggccatggctgcggtggcgctgatgccaccgccgctgctgctgctgctgctgttggcgtcgccgcccgccgcctccgcgccgtccgcccgcgatcccttcgccccccagctcggggacacgcagaactgccagctgcggtgccgcgaccgcgacctcggcccgcagccctcgcaggtgaggcgcgtgcggtgccag

SEQ ID NO: 115826 - DNA, 99 bp, Homo sapiens; identical to SEQ ID NO: 82837
  misc_feature 1..99: note = chr19:18788365-18788464
  misc_feature 1..99: note = Hypo
  source 1..99: mol_type = genomic DNA

SEQ ID NO: 115827 - DNA, 75 bp, Homo sapiens; identical to SEQ ID NO: 82838
  misc_feature 1..75: note = chr19:18807949-18808024
  misc_feature 1..75: note = Hypo
  source 1..75: mol_type = genomic DNA

SEQ ID NO: 115828 - DNA, 183 bp, Homo sapiens; identical to SEQ ID NO: 82839
  misc_feature 1..183: note = chr19:18811499-18811682
  misc_feature 1..183: note = Hyper
  source 1..183: mol_type = genomic DNA

SEQ ID NO: 115829 - DNA, 175 bp, Homo sapiens; identical to SEQ ID NO: 82840
  misc_feature 1..175: note = chr19:18819701-18819876
  misc_feature 1..175: note = Hypo
  source 1..175: mol_type = genomic DNA

SEQ ID NO: 115830 - DNA, 134 bp, Homo sapiens; identical to SEQ ID NO: 82841
  misc_feature 1..134: note = chr19:18870877-18871011
  misc_feature 1..134: note = Hypo
  source 1..134: mol_type = genomic DNA

SEQ ID NO: 115831 - DNA, 30 bp, Homo sapiens; identical to SEQ ID NO: 82842
  misc_feature 1..30: note = chr19:18872102-18872132
  misc_feature 1..30: note = Hypo
  source 1..30: mol_type = genomic DNA

SEQ ID NO: 115832 - DNA, 35 bp, Homo sapiens; identical to SEQ ID NO: 82843
  misc_feature 1..35: note = chr19:18878375-18878410
  misc_feature 1..35: note = Hypo
  source 1..35: mol_type = genomic DNA

SEQ ID NO: 115833 - DNA, 51 bp, Homo sapiens; identical to SEQ ID NO: 82844
  misc_feature 1..51: note = chr19:18879358-18879409
  misc_feature 1..51: note = Hypo
  source 1..51: mol_type = genomic DNA

SEQ ID NO: 115834 - DNA, 194 bp, Homo sapiens; identical to SEQ ID NO: 82845
  misc_feature 1..194: note = chr19:18880005-18880199
  misc_feature 1..194: note = Hypo
  source 1..194: mol_type = genomic DNA

SEQ ID NO: 115835 - DNA, 30 bp, Homo sapiens; identical to SEQ ID NO: 82846
  misc_feature 1..30: note = chr19:18882043-18882073
  misc_feature 1..30: note = Hypo
  source 1..30: mol_type = genomic DNA

SEQ ID NO: 115836 - DNA, 575 bp, Homo sapiens; identical to SEQ ID NO: 82847
  misc_feature 1..575: note = chr19:18883509-18884084
  misc_feature 1..575: note = Hypo
  source 1..575: mol_type = genomic DNA

SEQ ID NO: 115837 - DNA, 82 bp, Homo sapiens; identical to SEQ ID NO: 82848
  misc_feature 1..82: note = chr19:18895721-18895803
  misc_feature 1..82: note = Hypo
  source 1..82: mol_type = genomic DNA

SEQ ID NO: 115838 - DNA, 86 bp, Homo sapiens; identical to SEQ ID NO: 82849
  misc_feature 1..86: note = chr19:18896272-18896358
  misc_feature 1..86: note = Hyper
  source 1..86: mol_type = genomic DNA

SEQ ID NO: 115839 - DNA, 59 bp, Homo sapiens; identical to SEQ ID NO: 82850
  misc_feature 1..59: note = chr19:18896736-18896795
  misc_feature 1..59: note = Hyper
  source 1..59: mol_type = genomic DNA

SEQ ID NO: 115840 - DNA, 92 bp, Homo sapiens
  misc_feature 1..92: note = chr19:18898213-18898305
  misc_feature 1..92: note = Hyper
  source 1..92: mol_type = genomic DNA
aaaccagccaagccccgccccggagccgaatcccgcccttcggtgcccgccgcctctcctcgccccccaacccccatcgagctcacggtcgc

SEQ ID NO: 115841 - DNA, 579 bp, Homo sapiens; identical to SEQ ID NO: 82852
  misc_feature 1..579: note = chr19:18899038-18899617
  misc_feature 1..579: note = Hyper
  source 1..579: mol_type = genomic DNA

SEQ ID NO: 115842 - DNA, 2391 bp, Homo sapiens; identical to SEQ ID NO: 82853
  misc_feature 1..2391: note = chr19:18899906-18902297
  misc_feature 1..2391: note = Hyper
  source 1..2391: mol_type = genomic DNA

SEQ ID NO: 115843 - DNA, 30 bp, Homo sapiens; identical to SEQ ID NO: 82854
  misc_feature 1..30: note = chr19:18956799-18956829
  misc_feature 1..30: note = Hypo
  source 1..30: mol_type = genomic DNA

SEQ ID NO: 115844 - DNA, 16 bp, Homo sapiens
  misc_feature 1..16: note = chr19:18957788-18957804
  misc_feature 1..16: note = Hypo
  source 1..16: mol_type = genomic DNA
acggcaggtttgggcc

SEQ ID NO: 115845 - DNA, 30 bp, Homo sapiens; identical to SEQ ID NO: 45780
  misc_feature 1..30: note = chr19:18975090-18975120
  misc_feature 1..30: note = Hypo
  source 1..30: mol_type = genomic DNA

SEQ ID NO: 115846 - DNA, 757 bp, Homo sapiens
  misc_feature 1..757: note = chr19:18980703-18981460
  misc_feature 1..757: note = Hyper
  source 1..757: mol_type = genomic DNA
ctgctcgggcatccccgggccactctcgaggctcgccctgcgaggtctggcctccaggaccagtgtccccagcgaaagccccactcaccgcggtccgggatgtggcgcacgatgtttccggcgacccccagctcctccacgtggcacggttgcagggtgacccctggggacgtccgccgcgagccagacctggtctcctgggggtcccggcgtcgaaacaggcgccacatgaccgggggaaccggccggagcctgggggcaccctggggctcatcgcgcagtcctagagcctggagcagggcggcggctgggcctgggggcacgggggcgcgggtcaggggcagcgagggcagcagcagggccaggaggaggaggaggtggtggccgcagggaccttgctgcggcggtggcatcttcctcccaggcgatgaccagagagtgcgcagggtccgcggcggcccgggaccagtgggctgagggcggggccggtgtccccggaggggcaggggtcctggggggcgtggccgggaactggaggcaggatgagggggcggggtcccaggggaggtggcggcggccctagaggagcagagttggagggggtggaggggcggccaaggacggggagcgtggccggggtattcggggtggggccgggtccacgggggcggggccgaggggttcagaagcgcttgtccttcaccaggccgttcctcagtggcttcctgggggtcagaaccggcgcaggttagcctgg

SEQ ID NO: 115847 - DNA, 167 bp, Homo sapiens; identical to SEQ ID NO: 82861
  misc_feature 1..167: note = chr19:18988902-18989069
  misc_feature 1..167: note = Hypo
  source 1..167: mol_type = genomic DNA

SEQ ID NO: 115848 - DNA, 622 bp, Homo sapiens; identical to SEQ ID NO: 82862
  misc_feature 1..622: note = chr19:18989659-18990281
  misc_feature 1..622: note = Hypo
  source 1..622: mol_type = genomic DNA

SEQ ID NO: 115849 - DNA, 581 bp, Homo sapiens; identical to SEQ ID NO: 82863
  misc_feature 1..581: note = chr19:18994680-18995261
  misc_feature 1..581: note = Hypo
  source 1..581: mol_type = genomic DNA

SEQ ID NO: 115850 - DNA, 1401 bp, Homo sapiens; identical to SEQ ID NO: 82864
  misc_feature 1..1401: note = chr19:19006016-19007417
  misc_feature 1..1401: note = Hyper
  source 1..1401: mol_type = genomic DNA

SEQ ID NO: 115851 - DNA, 30 bp, Homo sapiens; identical to SEQ ID NO: 82865
  misc_feature 1..30: note = chr19:19007899-19007929
  misc_feature 1..30: note = Hypo
  source 1..30: mol_type = genomic DNA

SEQ ID NO: 115852 - DNA, 163 bp, Homo sapiens; identical to SEQ ID NO: 82866
  misc_feature 1..163: note = chr19:19042704-19042867
  misc_feature 1..163: note = Hypo
  source 1..163: mol_type = genomic DNA

SEQ ID NO: 115853 - DNA, 30 bp, Homo sapiens; identical to SEQ ID NO: 82868
  misc_feature 1..30: note = chr19:19100115-19100145
  misc_feature 1..30: note = Hypo
  source 1..30: mol_type = genomic DNA

SEQ ID NO: 115854 - DNA, 35 bp, Homo sapiens; identical to SEQ ID NO: 82871
  misc_feature 1..35: note = chr19:19214212-19214247
  misc_feature 1..35: note = Hypo
  source 1..35: mol_type = genomic DNA

SEQ ID NO: 115855 - DNA, 221 bp, Homo sapiens; identical to SEQ ID NO: 82872
  misc_feature 1..221: note = chr19:19218598-19218819
  misc_feature 1..221: note = Hypo
  source 1..221: mol_type = genomic DNA

SEQ ID NO: 115856 - DNA, 70 bp, Homo sapiens; identical to SEQ ID NO: 82873
  misc_feature 1..70: note = chr19:19221225-19221295
  misc_feature 1..70: note = Hyper
  source 1..70: mol_type = genomic DNA

SEQ ID NO: 115857 - DNA, 41 bp, Homo sapiens; identical to SEQ ID NO: 82874
  misc_feature 1..41: note = chr19:19256265-19256306
  misc_feature 1..41: note = Hypo
  source 1..41: mol_type = genomic DNA

SEQ ID NO: 115858 - DNA, 418 bp, Homo sapiens; identical to SEQ ID NO: 82875
  misc_feature 1..418: note = chr19:19322511-19322929
  misc_feature 1..418: note = Hyper
  source 1..418: mol_type = genomic DNA

SEQ ID NO: 115859 - DNA, 443 bp, Homo sapiens; identical to SEQ ID NO: 82876
  misc_feature 1..443: note = chr19:19334846-19335289
  misc_feature 1..443: note = Hypo
  source 1..443: mol_type = genomic DNA

SEQ ID NO: 115860 - DNA, 94 bp, Homo sapiens
  misc_feature 1..94: note = chr19:19335756-19335850
  misc_feature 1..94: note = Hyper
  source 1..94: mol_type = genomic DNA
cccctgacctccacccgcccctcccgcaggcgaggtcttctacgtgggcccggcccgccgcctgacactggccggcgcgcgtgcacagtgccgc

SEQ ID NO: 115861 - DNA, 283 bp, Homo sapiens; identical to SEQ ID NO: 82878
  misc_feature 1..283: note = chr19:19373486-19373769
  misc_feature 1..283: note = Hyper
  source 1..283: mol_type = genomic DNA

SEQ ID NO: 115862 - DNA, 35 bp, Homo sapiens; identical to SEQ ID NO: 37328
  misc_feature 1..35: note = chr19:19383770-19383805
  misc_feature 1..35: note = Hyper
  source 1..35: mol_type = genomic DNA

SEQ ID NO: 115863 - DNA, 151 bp, Homo sapiens; identical to SEQ ID NO: 82880
  misc_feature 1..151: note = chr19:19384011-19384162
  misc_feature 1..151: note = Hyper
  source 1..151: mol_type = genomic DNA

SEQ ID NO: 115864 - DNA, 200 bp, Homo sapiens; identical to SEQ ID NO: 82881
  misc_feature 1..200: note = chr19:19391386-19391586
  misc_feature 1..200: note = Hypo
  source 1..200: mol_type = genomic DNA

SEQ ID NO: 115865 - DNA, 39 bp, Homo sapiens; identical to SEQ ID NO: 45790
  misc_feature 1..39: note = chr19:19391907-19391946
  misc_feature 1..39: note = Hypo
  source 1..39: mol_type = genomic DNA

SEQ ID NO: 115866 - DNA, 86 bp, Homo sapiens; identical to SEQ ID NO: 82883
  misc_feature 1..86: note = chr19:19447944-19448030
  misc_feature 1..86: note = Hypo
  source 1..86: mol_type = genomic DNA

SEQ ID NO: 115867 - DNA, 57 bp, Homo sapiens; identical to SEQ ID NO: 82884
  misc_feature 1..57: note = chr19:19540245-19540302
  misc_feature 1..57: note = Hypo
  source 1..57: mol_type = genomic DNA

SEQ ID NO: 115868 - DNA, 80 bp, Homo sapiens; identical to SEQ ID NO: 82885
  misc_feature 1..80: note = chr19:19542144-19542224
  misc_feature 1..80: note = Hypo
  source 1..80: mol_type = genomic DNA

SEQ ID NO: 115869 - DNA, 68 bp, Homo sapiens; identical to SEQ ID NO: 82886
  misc_feature 1..68: note = chr19:19613872-19613940
  misc_feature 1..68: note = Hypo
  source 1..68: mol_type = genomic DNA

SEQ ID NO: 115870 - DNA, 61 bp, Homo sapiens; identical to SEQ ID NO: 82887
  misc_feature 1..61: note = chr19:19645864-19645925
  misc_feature 1..61: note = Hypo
  source 1..61: mol_type = genomic DNA

SEQ ID NO: 115871 - DNA, 401 bp, Homo sapiens; identical to SEQ ID NO: 82888
  misc_feature 1..401: note = chr19:19649034-19649435
  misc_feature 1..401: note = Hyper
  source 1..401: mol_type = genomic DNA

SEQ ID NO: 115872 - DNA, 1037 bp, Homo sapiens
  misc_feature 1..1037: note = chr19:19651126-19652163
  misc_feature 1..1037: note = Hyper
  source 1..1037: mol_type = genomic DNA
cgctggcgctggaagcgcgcaccacggactgggccctgccgtccgccgtcggcgagcgcgtgcacttgaaccccacgcgcggcttctggtgcctcaaccgcgagcaaccgcgtggccgccgctgctccaactaccacgtgcgcttccgctgcccactaggtgagggcggggctggatgacgggggcggggctttgaatgggcggggctggcgaacgccgggaagagtcgtggtgggtggggctgggaggggcaggaccgtgtgggtgtgggcgtggctgggaagagccgggggacccttaggcgtaggacgacgtcagggggcggggccaggcagggcggggcttttgaagagaggcgctgggaacagcgcggggcccaagtgcaccgtcaggaggcccagcgggtcaggacccatgtccggccccctggaacgcatctccctcccgctgccctcatttgagcatctgtaagagctcagttctgtggagtgtcttgagcccaaatgcgtgcaggatgcagggagaaaagcaggactgatccccgggaccttatgcgggggtggggaggtgggtcggtacctaaactatgtcttcgacaggcgcgcctaggggagcatgggtgggggcgatggcagatctgctctctggagtgtccgcccttggatgcacatatgtgagggggttggggaagaagggtcctttagtcccaggttacccggaggcgcagttcctggggagggcggccacctgatctccgtccctgccttccgcagaagcctcgtggggcgcgtggggcccgtggggtccctgctcggggagctgtgggccaggccgtcgcttgcgccgccgccactgcccaagccccgctggggatgcgtgtcccgggcgtcctctggaggcgcagaagtgcgtgcggcctcggtgtccaggtaggaggggcggggtctggaggctgggacctgtacagaggggaggaaggggaggttaggggctgagcctgggagagagggtggagttagaggcggtgcctggatgta

SEQ ID NO: 115873 - DNA, 30 bp, Homo sapiens; identical to SEQ ID NO: 82892
  misc_feature 1..30: note = chr19:19652530-19652560
  misc_feature 1..30: note = Hypo
  source 1..30: mol_type = genomic DNA

SEQ ID NO: 115874 - DNA, 62 bp, Homo sapiens; identical to SEQ ID NO: 82893
  misc_feature 1..62: note = chr19:19680975-19681037
  misc_feature 1..62: note = Hypo
  source 1..62: mol_type = genomic DNA

SEQ ID NO: 115875 - DNA, 84 bp, Homo sapiens; identical to SEQ ID NO: 82896
  misc_feature 1..84: note = chr19:19737618-19737702
  misc_feature 1..84: note = Hypo
  source 1..84: mol_type = genomic DNA

SEQ ID NO: 115876 - DNA, 46 bp, Homo sapiens; identical to SEQ ID NO: 82897
  misc_feature 1..46: note = chr19:19738622-19738668
  misc_feature 1..46: note = Hyper
  source 1..46: mol_type = genomic DNA

SEQ ID NO: 115877 - DNA, 30 bp, Homo sapiens; identical to SEQ ID NO: 82899
  misc_feature 1..30: note = chr19:19843300-19843330
  misc_feature 1..30: note = Hyper
  source 1..30: mol_type = genomic DNA

SEQ ID NO: 115878 - DNA, 453 bp, Homo sapiens; identical to SEQ ID NO: 82900
  misc_feature 1..453: note = chr19:19843591-19844044
  misc_feature 1..453: note = Hyper
  source 1..453: mol_type = genomic DNA

SEQ ID NO: 115879 - DNA, 18 bp, Homo sapiens
  misc_feature 1..18: note = chr19:19882729-19882747
  misc_feature 1..18: note = Hypo
  source 1..18: mol_type = genomic DNA
ttagaaaaggctggtcgg

SEQ ID NO: 115880 - DNA, 205 bp, Homo sapiens; identical to SEQ ID NO: 82903
  misc_feature 1..205: note = chr19:19932180-19932385
  misc_feature 1..205: note = Hyper
  source 1..205: mol_type = genomic DNA

SEQ ID NO: 115881 - DNA, 204 bp, Homo sapiens; identical to SEQ ID NO: 82904
  misc_feature 1..204: note = chr19:19932505-19932709
  misc_feature 1..204: note = Hyper
  source 1..204: mol_type = genomic DNA

SEQ ID NO: 115882 - DNA, 45 bp, Homo sapiens; identical to SEQ ID NO: 82905
  misc_feature 1..45: note = chr19:19977249-19977294
  misc_feature 1..45: note = Hyper
  source 1..45: mol_type = genomic DNA

SEQ ID NO: 115883 - DNA, 30 bp, Homo sapiens; identical to SEQ ID NO: 82906
  misc_feature 1..30: note = chr19:19977542-19977572
  misc_feature 1..30: note = Hyper
  source 1..30: mol_type = genomic DNA

SEQ ID NO: 115884 - DNA, 300 bp, Homo sapiens; identical to SEQ ID NO: 82907
  misc_feature 1..300: note = chr19:20011907-20012207
  misc_feature 1..300: note = Hyper
  source 1..300: mol_type = genomic DNA

SEQ ID NO: 115885 - DNA, 874 bp, Homo sapiens; identical to SEQ ID NO: 82908
  misc_feature 1..874: note = chr19:20149645-20150519
  misc_feature 1..874: note = Hyper
  source 1..874: mol_type = genomic DNA

SEQ ID NO: 115886 - DNA, 910 bp, Homo sapiens
  misc_feature 1..910: note = chr19:20162654-20163564
  misc_feature 1..910: note = Hyper
  source 1..910: mol_type = genomic DNA
gtcaggaaaccagcacgttgggggaggcgggatcacagttacttgctgagacaagctgccctggctacgttcactcccgtcaggtaggagaggttaaagaacaggaaggctccccctccgcagggcggaactgctctgaaggcatggaggagcgacgctgaaggtggaggcttcgcccaccatgccgggagctaaaatttcttaaccaatgccggccagcgatggcagggctgcgggactacaatcccagcgcgcacagggatcagggactgtgcgcatcactggaagaagcggcagaacggcgcgcgcctcgctgagctttctgggagatgtagtctcatggcaactcccagccttttggccacaaggctacgggacctacaatcccagcctgtaccaggatcgggagcagttcgcagcactagaggaaggggcagggcggtgcgcgccgcgcctgatatgctgggagctgtagtctcttcacggtttttagccaatgagtaggtagcttcagaactacaatcccagtatgcatgggggcggtgcgtagtcctggaggtaggggctgagaggtgtggacttaccggtgtccaaagcattgctagcagccaattccatgccgccccgttgccagggagagtgaatacagctagggacgtgaagggtaggtctgggctgggcattgaggagggtattaggctaggaagtatacctcacctttgtccaaatcgggtggttcggcctcctctcattggccctatgcagctgggttgcctctctcacccgcacccaagggtctttccagagtgttgcgtcatttccagcccagggagctgccttctttcctaaactgcaatggaaactgtcctgatgtctgagacaatgtccgttgtgccgcagccctctgcct

SEQ ID NO: 115887 - DNA, 23 bp, Homo sapiens
  misc_feature 1..23: note = chr19:20188602-20188625
  misc_feature 1..23: note = Hyper
  source 1..23: mol_type = genomic DNA
ctcaaggaggaagcccggcctga

SEQ ID NO: 115888 - DNA, 120 bp, Homo sapiens; identical to SEQ ID NO: 82912
  misc_feature 1..120: note = chr19:20188745-20188865
  misc_feature 1..120: note = Hyper
  source 1..120: mol_type = genomic DNA

SEQ ID NO: 115889 - DNA, 180 bp, Homo sapiens; identical to SEQ ID NO: 82913
  misc_feature 1..180: note = chr19:20189405-20189585
  misc_feature 1..180: note = Hyper
  source 1..180: mol_type = genomic DNA

SEQ ID NO: 115890 - DNA, 20 bp, Homo sapiens
  misc_feature 1..20: note = chr19:21265857-21265877
  misc_feature 1..20: note = Hypo
  source 1..20: mol_type = genomic DNA
tttaagatggagtttcgctc

SEQ ID NO: 115891 - DNA, 30 bp, Homo sapiens; identical to SEQ ID NO: 82918
  misc_feature 1..30: note = chr19:21578373-21578403
  misc_feature 1..30: note = Hypo
  source 1..30: mol_type = genomic DNA

SEQ ID NO: 115892 - DNA, 30 bp, Homo sapiens; identical to SEQ ID NO: 82919
  misc_feature 1..30: note = chr19:21589791-21589821
  misc_feature 1..30: note = Hypo
  source 1..30: mol_type = genomic DNA

SEQ ID NO: 115893 - DNA, 202 bp, Homo sapiens; identical to SEQ ID NO: 82920
  misc_feature 1..202: note = chr19:21646235-21646437
  misc_feature 1..202: note = Hyper
  source 1..202: mol_type = genomic DNA

SEQ ID NO: 115894 - DNA, 16 bp, Homo sapiens
  misc_feature 1..16: note = chr19:21647196-21647212
  misc_feature 1..16: note = Hypo
  source 1..16: mol_type = genomic DNA
tcacgcctgtaattcc

SEQ ID NO: 115895 - DNA, 36 bp, Homo sapiens; identical to SEQ ID NO: 82922
  misc_feature 1..36: note = chr19:21657554-21657590
  misc_feature 1..36: note = Hyper
  source 1..36: mol_type = genomic DNA

SEQ ID NO: 115896 - DNA, 87 bp, Homo sapiens; identical to SEQ ID NO: 82923
  misc_feature 1..87: note = chr19:21659146-21659233
  misc_feature 1..87: note = Hypo
  source 1..87: mol_type = genomic DNA

SEQ ID NO: 115897 - DNA, 17 bp, Homo sapiens
  misc_feature 1..17: note = chr19:21726603-21726620
  misc_feature 1..17: note = Hypo
  source 1..17: mol_type = genomic DNA
agcactttgggaggccg

SEQ ID NO: 115898 - DNA, 30 bp, Homo sapiens; identical to SEQ ID NO: 45793
  misc_feature 1..30: note = chr19:21727297-21727327
  misc_feature 1..30: note = Hypo
  source 1..30: mol_type = genomic DNA

SEQ ID NO: 115899 - DNA, 30 bp, Homo sapiens; identical to SEQ ID NO: 82926
  misc_feature 1..30: note = chr19:21750501-21750531
  misc_feature 1..30: note = Hypo
  source 1..30: mol_type = genomic DNA

SEQ ID NO: 115900 - DNA, 311 bp, Homo sapiens
  misc_feature 1..311: note = chr19:21769289-21769600
  misc_feature 1..311: note = Hyper
  source 1..311: mol_type = genomic DNA
cggcacctggagtctcggtggaacccggcagcggtgggcgcggaccccggagaggctgccccgagcccgagcaccccctgaccgggcgctcaccacgggtgttgggacaagcagcggagcctgcgggctggagccaggctcggaccctccgcgccggggcgggcggccgagcggacgcagctggcagtggcggcgggagagcgccccggatccgcccggagcccaaccccgtggcacttcggctggctgggcagcggcgctggggacaacgcggggccttctgcaacgagcgcctgcgtgggactccaggg

SEQ ID NO: 115901 - DNA, 75 bp, Homo sapiens; identical to SEQ ID NO: 82930
  misc_feature 1..75: note = chr19:22005601-22005676
  misc_feature 1..75: note = Hypo
  source 1..75: mol_type = genomic DNA

SEQ ID NO: 115902 - DNA, 35 bp, Homo sapiens; identical to SEQ ID NO: 82931
  misc_feature 1..35: note = chr19:22016818-22016853
  misc_feature 1..35: note = Hypo
  source 1..35: mol_type = genomic DNA

SEQ ID NO: 115903 - DNA, 41 bp, Homo sapiens; identical to SEQ ID NO: 82932
  misc_feature 1..41: note = chr19:22017749-22017790
  misc_feature 1..41: note = Hypo
  source 1..41: mol_type = genomic DNA

SEQ ID NO: 115904 - DNA, 300 bp, Homo sapiens; identical to SEQ ID NO: 82933
  misc_feature 1..300: note = chr19:22018428-22018728
  misc_feature 1..300: note = Hyper
  source 1..300: mol_type = genomic DNA

SEQ ID NO: 115905 - DNA, 120 bp, Homo sapiens
  misc_feature 1..120: note = chr19:22018908-22019028
  misc_feature 1..120: note = Hyper
  source 1..120: mol_type = genomic DNA
cagaggctggacctctagcagcagaggacacagaagaacgaagacgagacgcagagctccaactgcagccagagacaaaggccccgccacatcccggaagccgccctgtcctctcctgcc

SEQ ID NO: 115906 - DNA, 89 bp, Homo sapiens; identical to SEQ ID NO: 82936
  misc_feature 1..89: note = chr19:22019088-22019177
  misc_feature 1..89: note = Hyper
  source 1..89: mol_type = genomic DNA

SEQ ID NO: 115907 - DNA, 101 bp, Homo sapiens; identical to SEQ ID NO: 82937
  misc_feature 1..101: note = chr19:22030099-22030200
  misc_feature 1..101: note = Hypo
  source 1..101: mol_type = genomic DNA

SEQ ID NO: 115908 - DNA, 30 bp, Homo sapiens; identical to SEQ ID NO: 82938
  misc_feature 1..30: note = chr19:22031956-22031986
  misc_feature 1..30: note = Hypo
  source 1..30: mol_type = genomic DNA

SEQ ID NO: 115909 - DNA, 637 bp, Homo sapiens
  misc_feature 1..637: note = chr19:22034401-22035038
  misc_feature 1..637: note = Hyper
  source 1..637: mol_type = genomic DNA
cctcctgcgcacacaccgagtcgggattctgccccgatcatccgccgggcatccctgaacaatctgggaaatactcggggctgctggtgcagagctgaccagagagctccagacagggtaccgcgcaggaatggggcgggacgcgggaggctcggctgcgggcccagccgccatcttgcggccagaggggcctggggcggagctgcgccagcgaccaggactcaggagcggactgtgaggaggccggtcccgccactttcacagcctgctctcccctctcgggatgcctaaccccgcacactcaccatttcccagcttccaggatgtccgggcatcttagctgtgcgtctcccaggacttgcagatcacagggtaacggaggctgcgacaaagtcaccggggattcccgagttggagaacgcggaaaagcagaggcgggtcccaaggtctagcgggagctggagacaaaggccccgccaaaagccggaagccacggccccctctccaactgcgcgtctgattgggtggttcccacgccagcgccactgattggataaagctccaggacccaccctccctagcgtttgcgcattttatggacagggaaacaggctcaagtaggcggggcacatgccca

SEQ ID NO: 115910 - DNA, 20 bp, Homo sapiens
  misc_feature 1..20: note = chr19:22037958-22037978
  misc_feature 1..20: note = Hypo
  source 1..20: mol_type = genomic DNA
gccaccgcacctggccccct

SEQ ID NO: 115911 - DNA, 26 bp, Homo sapiens
  misc_feature 1..26: note = chr19:22238973-22238999
  misc_feature 1..26: note = Hypo
  source 1..26: mol_type = genomic DNA
gggggagcactgtctcgtgcctgtaa

SEQ ID NO: 115912 - DNA, 120 bp, Homo sapiens; identical to SEQ ID NO: 82953
  misc_feature 1..120: note = chr19:22606117-22606237
  misc_feature 1..120: note = Hypo
  source 1..120: mol_type = genomic DNA

SEQ ID NO: 115913 - DNA, 261 bp, Homo sapiens
  misc_feature 1..261: note = chr19:22610486-22610747
  misc_feature 1..261: note = Hyper
  source 1..261: mol_type = genomic DNA
tgtctgtgcttccctcgcccaatctgagagtggcctgttccagggggcgggcttcctctttgtttggcagccaggagtctggagcgcaggtgccgggcaggcagcactgggagcgctcggcgacttggctggaggccgaaggtgccgcccctggggaaccagagcgcctttgcaaggtgggctcggcgtacactcccctatccttctgtggcccccgggcccctcctagaagaccgtcctcatctccgaggaccttgaccg

SEQ ID NO: 115914 - DNA, 30 bp, Homo sapiens; identical to SEQ ID NO: 82955
  misc_feature 1..30: note = chr19:22610975-22611005
  misc_feature 1..30: note = Hyper
  source 1..30: mol_type = genomic DNA

SEQ ID NO: 115915 - DNA, 30 bp, Homo sapiens; identical to SEQ ID NO: 82956
  misc_feature 1..30: note = chr19:22611307-22611337
  misc_feature 1..30: note = Hyper
  source 1..30: mol_type = genomic DNA

SEQ ID NO: 115916 - DNA, 878 bp, Homo sapiens; identical to SEQ ID NO: 82958
  misc_feature 1..878: note = chr19:22715140-22716018
  misc_feature 1..878: note = Hyper
  source 1..878: mol_type = genomic DNA

SEQ ID NO: 115917 - DNA, 406 bp, Homo sapiens
  misc_feature 1..406: note = chr19:22806000-22806406
  misc_feature 1..406: note = Hyper
  source 1..406: mol_type = genomic DNA
tctccctgccagttgcggtcgtgggcggcctcgccttggagccctggccacggagccgcacggggcggtagagaggctggtggggagggaccagcgggcggtggaggggcggccctgcaggcgacgcggggactggaaagggcgcctgggtgggaagaggcgctggcgggtgatcgtccccaccgggccagtccccgggatctgctgccgcccctctccgaaattcacagccagagcgggcgcactggtgtgtgtggcgcctggagcgctagggtccccacccaagtgcgaggcccccgcggggagcccagcccaggggcgtccacagtccaggccccagaccccaggtcctggctagattcgccaaagtcagaggctggaatctggagggcggatgtgagggtgc

SEQ ID NO: 115918 - DNA, 30 bp, Homo sapiens; identical to SEQ ID NO: 82965
  misc_feature 1..30: note = chr19:22815493-22815523
  misc_feature 1..30: note = Hypo
  source 1..30: mol_type = genomic DNA

SEQ ID NO: 115919 - DNA, 84 bp, Homo sapiens; identical to SEQ ID NO: 82966
  misc_feature 1..84: note = chr19:22817001-22817085
  misc_feature 1..84: note = Hyper
  source 1..84: mol_type = genomic DNA

SEQ ID NO: 115920 - DNA, 120 bp, Homo sapiens; identical to SEQ ID NO: 82967
  misc_feature 1..120: note = chr19:22817385-22817505
  misc_feature 1..120: note = Hyper
  source 1..120: mol_type = genomic DNA

SEQ ID NO: 115921 - DNA, 109 bp, Homo sapiens; identical to SEQ ID NO: 82971
  misc_feature 1..109: note = chr19:23077136-23077245
  misc_feature 1..109: note = Hypo
  source 1..109: mol_type = genomic DNA

SEQ ID NO: 115922 - DNA, 36 bp, Homo sapiens; identical to SEQ ID NO: 82973
  misc_feature 1..36: note = chr19:23083160-23083196
  misc_feature 1..36: note = Hypo
  source 1..36: mol_type = genomic DNA

SEQ ID NO: 115923 - DNA, 37 bp, Homo sapiens
  misc_feature 1..37: note = chr19:23185625-23185662
  misc_feature 1..37: note = Hyper
  source 1..37: mol_type = genomic DNA
aaaagacaggacgcccggggaccgggtgtcagcgcag

SEQ ID NO: 115924 - DNA, 633 bp, Homo sapiens
  misc_feature 1..633: note = chr19:23253781-23254414
  misc_feature 1..633: note = Hyper
  source 1..633: mol_type = genomic DNA
ccaaggcacccaccacgcagcacgccgtccctttcggcgctcggaaagccctcgggcgaacccctcccgagcccacccctcccgggacctcagaagatggctcaggacggcccctgactctccatggggacttgggaataaactcggcaggcgcctcagacagtcgggaccagcgtgggcgtccctggccccctgcgtcaggcctggtgggtcctgcgggtcgggcctcggcagttgcagtgcgcttgggatcagccggggcagccccacactcggctcgggctgggagcgcggggacagcctcccaagccacagccctgcgcgcccgacctccgactcacaagggacgcgccagagctctggtcccattgagacagttcagctgaaggctgcgggccttcccgagctccgcccagctcacagcggggacggtccctccctcggcagctgccgctggagctccggaggacaagagaacttagagaggtggcctcagtggagcccgacaaccagcgcgaacgtcaacaagacagatcgagatggcaagggcagctcgtgggcgaaatggatccacccgaccccagaaatgatccccgatacgtggctctgcatagaccacgacagagtccagtc

SEQ ID NO: 115925 - DNA, 840 bp, Homo sapiens
  misc_feature 1..840: note = chr19:23257752-23258592
  misc_feature 1..840: note = Hyper
  source 1..840: mol_type = genomic DNA
gcctctcaaagtgctgggatcacaggcgtgagccaccgccccccgacgcctcagctcatttgttaattagcagtaattgcccgggtcagtgacacctcctacttgagcctctttccctgtccataaaatgcactaatactggggtgggtgggattgggaggtgggtcctggagctccatccaatcagtggcactggtgtaggaaccgcccgatcaggcgcgcagttggagaggagggcgtggcttccggcatttggcggggtctttgtctctcgctcccgccagagcttgggatcggtcttcactgttccgcgtcctctacctgggaaccaccgacccccgcccggcgactttgtcacagactctgttgccctgtgatctgcaggtcctgggagacgcacagccaagatgccagggcaccctggaagctgtgaagtggtgcgtatgcggggttgggcatcccttgaggcgagagcgggctgtgaaacctgcaggaccggcctccccacagtccgctcccgggtccgccgacctcagtcctctctggcgcagctcggccccaggcgtctctggccgcaagatggcggctgggcccgcggccgggacccccagcgtctcgccgcgtccctgctgggcgccctgtctggacctccctgggcagctctgcgcccgcagccccgagtatttcccagagtgcttagggatgccaggcgggtcatcagggtagaatcccgactaggtgtgtgcgtgggaggagctgcgacccgtggggttcccaagctttcctgttattttttttttcttttctttttagacagtctcgctctgtcgctaaggtaaa

SEQ ID NO: 115926 - DNA, 79 bp, Homo sapiens; identical to SEQ ID NO: 1366
  misc_feature 1..79: note = chr19:23258652-23258731
  misc_feature 1..79: note = Hyper
  source 1..79: mol_type = genomic DNA

SEQ ID NO: 115927 - DNA, 20 bp, Homo sapiens
  misc_feature 1..20: note = chr19:23295513-23295533
  misc_feature 1..20: note = Hypo
  source 1..20: mol_type = genomic DNA
gacttcgtctcaaaaaaata

SEQ ID NO: 115928 - DNA, 151 bp, Homo sapiens; identical to SEQ ID NO: 37365
  misc_feature 1..151: note = chr19:23299633-23299784
  misc_feature 1..151: note = Hyper
  source 1..151: mol_type = genomic DNA

SEQ ID NO: 115929 - DNA, 30 bp, Homo sapiens; identical to SEQ ID NO: 37366
  misc_feature 1..30: note = chr19:23300324-23300354
  misc_feature 1..30: note = Hyper
  source 1..30: mol_type = genomic DNA

SEQ ID NO: 115930 - DNA, 293 bp, Homo sapiens
  misc_feature 1..293: note = chr19:23386702-23386995
  misc_feature 1..293: note = Hyper
  source 1..293: mol_type = genomic DNA
aggccggagtctgcccggcccagcccctcctcactcccttggactcttcacggtgtctccgggcccctgcacaatcctgagcgtccctcacatggaagccgaggtggtagcaggaagctggtggaaggaactggctccgcaggcagggaggtctcgcccaggaaatgctctgttggcctcggcttcctgcgcacgcagctgggcccggacccagggttggagtcgagacgtacccgggctggacgaccccgggcgttggcgcgcccgctgctgcggttcgtgctgtgctcggc

SEQ ID NO: 115931 - DNA, 40 bp, Homo sapiens; identical to SEQ ID NO: 82991
  misc_feature 1..40: note = chr19:23433143-23433183
  misc_feature 1..40: note = Hyper
  source 1..40: mol_type = genomic DNA

SEQ ID NO: 115932 - DNA, 97 bp, Homo sapiens; identical to SEQ ID NO: 82992
  misc_feature 1..97: note = chr19:23577749-23577846
  misc_feature 1..97: note = Hyper
  source 1..97: mol_type = genomic DNA

SEQ ID NO: 115933 - DNA, 157 bp, Homo sapiens; identical to SEQ ID NO: 82993
  misc_feature 1..157: note = chr19:23577966-23578123
  misc_feature 1..157: note = Hyper
  source 1..157: mol_type = genomic DNA

SEQ ID NO: 115934 - DNA, 511 bp, Homo sapiens; identical to SEQ ID NO: 82995
  misc_feature 1..511: note = chr19:23598357-23598868
  misc_feature 1..511: note = Hyper
  source 1..511: mol_type = genomic DNA

SEQ ID NO: 115935 - DNA, 230 bp, Homo sapiens
  misc_feature 1..230: note = chr19:23654082-23654312
  misc_feature 1..230: note = Hyper
  source 1..230: mol_type = genomic DNA
gcgcgttttctgggccgagggcgcatcgaggatgtgacccattccctggccaagggtgtgggtggggaacggcaaccgatctcactgcctggcggggcagcttcctttccaggcaaggcggagacctgcagggcgtggagaccccgcccggcgcagaacgcgctggccagtgggcagcttgacagggtccccgtgtgcctagcgaccctcttcagcgctgcatccatgag

SEQ ID NO: 115936 - DNA, 21 bp, Homo sapiens
  misc_feature 1..21: note = chr19:24099415-24099436
  misc_feature 1..21: note = Hypo
  source 1..21: mol_type = genomic DNA
agctaccgtgcctggtgaatt

SEQ ID NO: 115937 - DNA, 386 bp, Homo sapiens; identical to SEQ ID NO: 83005
  misc_feature 1..386: note = chr19:24154442-24154828
  misc_feature 1..386: note = Hyper
  source 1..386: mol_type = genomic DNA

SEQ ID NO: 115938 - DNA, 62 bp, Homo sapiens; identical to SEQ ID NO: 83006
  misc_feature 1..62: note = chr19:24215463-24215525
  misc_feature 1..62: note = Hypo
  source 1..62: mol_type = genomic DNA

SEQ ID NO: 115939 - DNA, 163 bp, Homo sapiens; identical to SEQ ID NO: 83007
  misc_feature 1..163: note = chr19:24216917-24217080
  misc_feature 1..163: note = Hyper
  source 1..163: mol_type = genomic DNA

SEQ ID NO: 115940 - DNA, 87 bp, Homo sapiens; identical to SEQ ID NO: 83008
  misc_feature 1..87: note = chr19:24305345-24305432
  misc_feature 1..87: note = Hypo
  source 1..87: mol_type = genomic DNA

SEQ ID NO: 115941 - DNA, 78 bp, Homo sapiens; identical to SEQ ID NO: 83030
  misc_feature 1..78: note = chr19:28342286-28342364
  misc_feature 1..78: note = Hypo
  source 1..78: mol_type = genomic DNA

SEQ ID NO: 115942 - DNA, 174 bp, Homo sapiens; identical to SEQ ID NO: 83031
  misc_feature 1..174: note = chr19:28402175-28402349
  misc_feature 1..174: note = Hypo
  source 1..174: mol_type = genomic DNA

SEQ ID NO: 115943 - DNA, 71 bp, Homo sapiens; identical to SEQ ID NO: 83033
  misc_feature 1..71: note = chr19:28715584-28715655
  misc_feature 1..71: note = Hypo
  source 1..71: mol_type = genomic DNA

SEQ ID NO: 115944 - DNA, 30 bp, Homo sapiens; identical to SEQ ID NO: 83034
  misc_feature 1..30: note = chr19:28918665-28918695
  misc_feature 1..30: note = Hypo
  source 1..30: mol_type = genomic DNA

SEQ ID NO: 115945 - DNA, 24 bp, Homo sapiens
  misc_feature 1..24: note = chr19:29024540-29024564
  misc_feature 1..24: note = Hypo
  source 1..24: mol_type = genomic DNA
gtgagactccgtttcaaaaaaaaa

SEQ ID NO: 115946 - DNA, 231 bp, Homo sapiens; identical to SEQ ID NO: 83039
  misc_feature 1..231: note = chr19:29145837-29146068
  misc_feature 1..231: note = Hypo
  source 1..231: mol_type = genomic DNA

SEQ ID NO: 115947 - DNA, 584 bp, Homo sapiens
  misc_feature 1..584: note = chr19:29284242-29284826
  misc_feature 1..584: note = Hyper
  source 1..584: mol_type = genomic DNA
agggaggaaggtttccggcctcccggaggccaaggcagaggcgctgggggaaggagcaagaagggaccagccgcccgcgcttcccgacgctgccaggcaggctcccgggacgggcagagctccgaggctgcctccgggcagtcacgtccaacgtacctgagcccggccagccgctgtcgctgtcgccgccgcactcgcctgtccggacgcaccttcctcctcctccgcggcccccgagaagctgggcgcgcaggcaagggaggcgcggcggcccctgcggctggtcagttcaccaggtgcctgctcccgagcgagttgccaccgaccccgccgcgcccggccgagccccgcgctccgcagcgtgggaaggagccgagcagagacccttgctccgagagcccggggtcggcgcctgctcattcctcgcgcagccgtggggcagcgggtggccccgggcgcgcgcgagcagcctcttctctggcacgcagaggccggctccgtgtcctcggccagccgccgtgggggcctcctccgcgctgcctcgcgtggtgcccggctcggcctagatgcggctgctgagagat

SEQ ID NO: 115948 - DNA, 86 bp, Homo sapiens; identical to SEQ ID NO: 83043
  misc_feature 1..86: note = chr19:29302897-29302983
  misc_feature 1..86: note = Hypo
  source 1..86: mol_type = genomic DNA

SEQ ID NO: 115949 - DNA, 104 bp, Homo sapiens; identical to SEQ ID NO: 83044
  misc_feature 1..104: note = chr19:29425113-29425217
  misc_feature 1..104: note = Hypo
  source 1..104: mol_type = genomic DNA

SEQ ID NO: 115950 - DNA, 43 bp, Homo sapiens; identical to SEQ ID NO: 83045
  misc_feature 1..43: note = chr19:29425457-29425500
  misc_feature 1..43: note = Hypo
  source 1..43: mol_type = genomic DNA

SEQ ID NO: 115951 - DNA, 34 bp, Homo sapiens; identical to SEQ ID NO: 83046
  misc_feature 1..34: note = chr19:29505183-29505217
  misc_feature 1..34: note = Hypo
  source 1..34: mol_type = genomic DNA

SEQ ID NO: 115952 - DNA, 30 bp, Homo sapiens; identical to SEQ ID NO: 83049
  misc_feature 1..30: note = chr19:29680159-29680189
  misc_feature 1..30: note = Hypo
  source 1..30: mol_type = genomic DNA

SEQ ID NO: 115953 - DNA, 82 bp, Homo sapiens; identical to SEQ ID NO: 83050
  misc_feature 1..82: note = chr19:29716608-29716690
  misc_feature 1..82: note = Hypo
  source 1..82: mol_type = genomic DNA

SEQ ID NO: 115954 - DNA, 30 bp, Homo sapiens; identical to SEQ ID NO: 45800
  misc_feature 1..30: note = chr19:29920756-29920786
  misc_feature 1..30: note = Hypo
  source 1..30: mol_type = genomic DNA

SEQ ID NO: 115955 - DNA, 79 bp, Homo sapiens; identical to SEQ ID NO: 83052
  misc_feature 1..79: note = chr19:29930911-29930990
  misc_feature 1..79: note = Hypo
  source 1..79: mol_type = genomic DNA

SEQ ID NO: 115956 - DNA, 30 bp, Homo sapiens; identical to SEQ ID NO: 83053
  misc_feature 1..30: note = chr19:29933086-29933116
  misc_feature 1..30: note = Hypo
  source 1..30: mol_type = genomic DNA

SEQ ID NO: 115957 - DNA, 30 bp, Homo sapiens; identical to SEQ ID NO: 83054
  misc_feature 1..30: note = chr19:29969803-29969833
  misc_feature 1..30: note = Hyper
  source 1..30: mol_type = genomic DNA

SEQ ID NO: 115958 - DNA, 3175 bp, Homo sapiens
  misc_feature 1..3175: note = chr19:30015572-30018747
  misc_feature 1..3175: note = Hyper
  source 1..3175: mol_type = genomic DNA
ctcctgggccatagacgaggaaactgaaaggcaggcactggaggcaagaagggctggccccgggcacccgctggcgaggacagccttggagagggcctgcagctcctcccctctgagctgtgctgcgctggccgcctggaccagggtggctgctggagagtgttttccctctgggtttccttctccttggctcccagggaatcctctggcggtgcctccgggaggctggtagccggggaagcaggcacgtgaatccaccgggctgccccaccccaacctgaggtcagagctgaggcgtaggggccggggtaggggcagaggtgccgaaacgcactagctggggactcccgggggaaggagataggagagacccaaggcgagccttaggactcgcccctatgactatgactacgcgctgcgtccgaaccacatgtccaccccgcatttgccttcggggaccagaccgcgctccctcagatggctggggagggagcagactccgggtgaaggctgggggaggtaccgggatgccgagtacgccagagcaggcgggggatgggttccggcttcctgccgcctcggcatctcgctttgcaccgggcaaagaaggggccacgaccggcgaagagcgcgtggagacacagggacccgcgatccaggggcaggaaccccgccccctcccggaaacctcccgggccctgagtcgtgcccggcgctccccaccccaccccacccccgccgcccctgccgtcactcacggccgctgcgggctggctagcgtgtgcgctctccgcgccgcaggcacctgctcgctgggcgctgtgcgctcacttctccctcgcgcactgcagactcccggcgctgccgccgccacccagcgtagtctccggctgggcacagcgttccgcccttctcgcggccccgggcgcccacccatccgtcatggcccaggcctgggccaaacagcggggcagctggttgcccaaactggggtaaggagttgagggctgggagctgcagagaggaccgagggacacacggggagcagggatgagcggccgtctcgagccgtgcagactgggaagaagccagggagagtttgggtgggaggactcccaacccaagcgggtgcggggcggggctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggctccgggtccgccacgccggacccgctctccccgcgctgcgctgggtcggacgccaggtctgcgcgccgcggctgagcgcccactcgccctgcggaaagagccgcggaggaaccggcgggggcggctgcgggagccgaaggaggtggcaatcgggagcagaaccagaaggagacagggaggcagaagctcgcggctccgtggcacgcactccctcggccagggatgggtcccggcgcggcccagcccctgcccggcccgccgggcagagactgaaccgcggatccccaccgtcctgtggacgaccggacagagagaggcactgaccgatcgccagcagcctcccggtgggaccgcgtctcctgcacaccccgcgcagcgccccccgccggagccgcaccgggcaagccggcgagggagcggggctgattggcggccgccggcggccaggggagggggcgccgcgcggggccatggcaggctcggaggcgtcctagcccgagccggagccgatccgagcccacgcggccgccgcctctccgctcccgggcccccgccgccaccgcgccccccgcgggagatggaacagcggaaccggctcggtgccctcggatacctgccgcctctgctgctgcatgccctgctgctcttcgtggccgacggtgagcgcgggaactttgctgccgctgtggactcgggggggtctttgctggggccgccaccgagaagaagaagaaagagaacgaaccgggaagcttcgcggtctccagcaatcccgctgtgcagcctgggcccggaggggtagggagaggcgagcggcgaagggtcgccgcagcagcagcgccgcgcccgagtcgttcccagtcccgccggggccccggctgcggaaaggatgcctgcggggagcgggagtaggcgcgccccagccaggctctggcggtgcggccaggggcgggggagaagcacgagtcgcccctgccgccccgccccatccggagggaagcagtaggcagccgatggccggtccctgcctcggccctgcagccgcttccccgaactttgctagcccctccggccgtgcgccagggagcagctgcggggtggggggcacaaggccagccagccagagaccgactgcctcgctttaggttgccccaggcccccgacctacagctggtcacgcctctctctctctccccacccccagctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacccgccgcccacgcggtaccggcgcgcgcccggctcgcgcccggggcggcgaaggctaacccagggagggaagcagcgggcttcactcgcgcagggcgccgccctgtggcgcagcccatcttccaccttcgcatcccaaagcatcttcaaagtcagcagtggttacccccaaacctgtcaattattttgacagcatcgctgttcccaccacctcccagaactccattcacgcccagcccctaaagagccacacctcagcctggtcgcttgctcgtgctcgctggctgcggccctctgatgggtgctgggtagtgaaggaagcccccttggtcccatcaggctctccccgccctctgccactttgaggaccccagggctcccacggctgcgttccagaggccaccagaaaaccgagtaccggaaagccggcaggacctccag

SEQ ID NO: 115959 - DNA, 2267 bp, Homo sapiens
  misc_feature 1..2267: note = chr19:30019113-30021380
  misc_feature 1..2267: note = Hyper
  source 1..2267: mol_type = genomic DNA
accagggcagccacccgttggtcaggcaccatgctagctccaaagcccgcttcctcctgggaaactcttggaaagccggacgtcctttgtgccctcaacccccatcccccgggcggtttcggtcctagcctgccggaggagggtgcccttgcctaaaggcggatccgagttcccctagccagaaggccgcgagcctcacgtctctctctccctctttgcattttaggtaacaaataaggatgcaactaaaatcagcgtaagtgtggagcccagcgcgggccgcgggagaccccttctggccgcctcgggtcccgcagctccctcccttagcaagccgcggcggccgcgcatgtggggccgcgcaagtagggcagcgatcgcagccttgcatcggtggctgctcggcgtgtccgggcgccatctgtcgccggttgcagggtcgggttctcttttgtgtaaatcaagggtccaaggcttgagtcccctaattcggctcggcgctgacctgtaaaactccccttggtcggactgcgcgcttagggcctctcgcgcctgccagcctccgctctgcgggcattcctcctagcaccgggagcgcgcggctgctcgccctcgccgcgaccgtggcgccagcttcccgccccctctgccccgccctgagcatctgctctgcgccctccgctgcaaccctttatcctccgcctggattgcgggtctgggtgcggggtgttgcaggcttgcaggggacggggtagggggtggttgtgccaggctgcgaggggcccgggtcatggggttgctaactctgggaggagatgcgcccaagcttcccacctggagcgtagaaaggcctggagatgacgaagcctcctcgtgggctcggttcagaggtgagggctccctgggtgtttgttgagagccgtagagcagtacttcccgaagtccccaccggggcgcaggggaggagcacttcgctggggggcttctggagatcccgcggaaaggcgggttggtagcaggtggccagggagccaggcagcagcctcagcgttgcttgccttcttaagaaagcacagtgttagctgtaaagggcggggtccggtgacagggtggctttccttaggaagcgattcgggcaggccctccgtgctccgggaggtgaggagggccggctggggcgggactgtcggttggagcgcgtcggggcgggaaagacgtggggaagttaaggaacaaggaatccagcctggggtttcctgaaggtgcaggagggaggaaggagaggtggactctgcccttctgaagcgccagctacgggaagacaagcagtgttggtttgtatgggcggggcagatgcaaggtgggcgtttggttaacgtgatggggacgtggggacacagtccaaagagctggctgcctggcgtccacgcagagttggaagccctatgccactgggtagacgcgggtgaaagggaagccggatcgtgatggtgggcaaaccaggatccgggaagtgttggggtgcgcggatgagggggcgcgacggccagggtggccagaagagtaggtttgggagctgcccagcccggcctctaaccctgctctcttgcagaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggtaagggatcgcggagagggggcgcacgcgcggggatggcgcagggctagggctgcgccgggacgccccggggggctccggacccaggacccgccccctgggcgcatttgcatatgcatactccttcctagttaggtcgggagcgccccccccagggccttcttcccgcggtttctctgtctt

SEQ ID NO: 115960 - DNA, 74 bp, Homo sapiens; identical to SEQ ID NO: 83065
  misc_feature 1..74: note = chr19:30056243-30056317
  misc_feature 1..74: note = Hypo
  source 1..74: mol_type = genomic DNA

SEQ ID NO: 115961 - DNA, 30 bp, Homo sapiens; identical to SEQ ID NO: 83066
  misc_feature 1..30: note = chr19:30174182-30174212
  misc_feature 1..30: note = Hypo
  source 1..30: mol_type = genomic DNA

SEQ ID NO: 115962 - DNA, 93 bp, Homo sapiens; identical to SEQ ID NO: 83067
  misc_feature 1..93: note = chr19:30188529-30188622
  misc_feature 1..93: note = Hypo
  source 1..93: mol_type = genomic DNA

SEQ ID NO: 115963 - DNA, 30 bp, Homo sapiens; identical to SEQ ID NO: 83068
  misc_feature 1..30: note = chr19:30211721-30211751
  misc_feature 1..30: note = Hypo
  source 1..30: mol_type = genomic DNA

SEQ ID NO: 115964 - DNA, 465 bp, Homo sapiens; identical to SEQ ID NO: 83069
  misc_feature 1..465: note = chr19:30215009-30215474
  misc_feature 1..465: note = Hyper
  source 1..465: mol_type = genomic DNA

SEQ ID NO: 115965 - DNA, 39 bp, Homo sapiens; identical to SEQ ID NO: 83070
  misc_feature 1..39: note = chr19:30244714-30244753
  misc_feature 1..39: note = Hypo
  source 1..39: mol_type = genomic DNA

SEQ ID NO: 115966 - DNA, 159 bp, Homo sapiens; identical to SEQ ID NO: 83071
  misc_feature 1..159: note = chr19:30252171-30252330
  misc_feature 1..159: note = Hypo
  source 1..159: mol_type = genomic DNA

SEQ ID NO: 115967 - DNA, 30 bp, Homo sapiens; identical to SEQ ID NO: 83072
  misc_feature 1..30: note = chr19:30252886-30252916
  misc_feature 1..30: note = Hypo
  source 1..30: mol_type = genomic DNA

SEQ ID NO: 115968 - DNA, 30 bp, Homo sapiens; identical to SEQ ID NO: 83073
  misc_feature 1..30: note = chr19:30259225-30259255
  misc_feature 1..30: note = Hypo
  source 1..30: mol_type = genomic DNA

SEQ ID NO: 115969 - DNA, 135 bp, Homo sapiens; identical to SEQ ID NO: 83074
  misc_feature 1..135: note = chr19:30272553-30272688
  misc_feature 1..135: note = Hypo
  source 1..135: mol_type = genomic DNA

SEQ ID NO: 115970 - DNA, 27 bp, Homo sapiens
  misc_feature 1..27: note = chr19:30329268-30329295
  misc_feature 1..27: note = Hypo
  source 1..27: mol_type = genomic DNA
cacatcagtaatctacgttgaatgagc

SEQ ID NO: 115971 - DNA, 30 bp, Homo sapiens; identical to SEQ ID NO: 37384
  misc_feature 1..30: note = chr19:30334621-30334651
  misc_feature 1..30: note = Hyper
  source 1..30: mol_type = genomic DNA

SEQ ID NO: 115972 - DNA, 30 bp, Homo sapiens; identical to SEQ ID NO: 83078
  misc_feature 1..30: note = chr19:30410677-30410707
  misc_feature 1..30: note = Hypo
  source 1..30: mol_type = genomic DNA

SEQ ID NO: 115973 - DNA, 30 bp, Homo sapiens; identical to SEQ ID NO: 83080
  misc_feature 1..30: note = chr19:30416554-30416584
  misc_feature 1..30: note = Hypo
  source 1..30: mol_type = genomic DNA

SEQ ID NO: 115974 - DNA, 388 bp, Homo sapiens; identical to SEQ ID NO: 45804
  misc_feature 1..388: note = chr19:30555329-30555717
  misc_feature 1..388: note = Hypo
  source 1..388: mol_type = genomic DNA

SEQ ID NO: 115975 - DNA, 30 bp, Homo sapiens; identical to SEQ ID NO: 45805
  misc_feature 1..30: note = chr19:30562726-30562756
  misc_feature 1..30: note = Hypo
  source 1..30: mol_type = genomic DNA

SEQ ID NO: 115976 - DNA, 30 bp, Homo sapiens; identical to SEQ ID NO: 83084
  misc_feature 1..30: note = chr19:30565672-30565702
  misc_feature 1..30: note = Hypo
  source 1..30: mol_type = genomic DNA

SEQ ID NO: 115977 - DNA, 184 bp, Homo sapiens; identical to SEQ ID NO: 45806
  misc_feature 1..184: note = chr19:30579049-30579233
  misc_feature 1..184: note = Hypo
  source 1..184: mol_type = genomic DNA

SEQ ID NO: 115978 - DNA, 30 bp, Homo sapiens; identical to SEQ ID NO: 83086
  misc_feature 1..30: note = chr19:30580294-30580324
  misc_feature 1..30: note = Hypo
  source 1..30: mol_type = genomic DNA

SEQ ID NO: 115979 - DNA, 204 bp, Homo sapiens; identical to SEQ ID NO: 83087
  misc_feature 1..204: note = chr19:30588597-30588801
  misc_feature 1..204: note = Hypo
  source 1..204: mol_type = genomic DNA

SEQ ID NO: 115980 - DNA, 30 bp, Homo sapiens; identical to SEQ ID NO: 83088
  misc_feature 1..30: note = chr19:30614219-30614249
  misc_feature 1..30: note = Hypo
  source 1..30: mol_type = genomic DNA

SEQ ID NO: 115981 - DNA, 33 bp, Homo sapiens; identical to SEQ ID NO: 45807
  misc_feature 1..33: note = chr19:30636005-30636038
  misc_feature 1..33: note = Hypo
  source 1..33: mol_type = genomic DNA

SEQ ID NO: 115982 - DNA, 76 bp, Homo sapiens; identical to SEQ ID NO: 83090
  misc_feature 1..76: note = chr19:30637494-30637570
  misc_feature 1..76: note = Hypo
  source 1..76: mol_type = genomic DNA

SEQ ID NO: 115983 - DNA, 30 bp, Homo sapiens; identical to SEQ ID NO: 83091
  misc_feature 1..30: note = chr19:30646730-30646760
  misc_feature 1..30: note = Hypo
  source 1..30: mol_type = genomic DNA

SEQ ID NO: 115984 - DNA, 163 bp, Homo sapiens; identical to SEQ ID NO: 83092
  misc_feature 1..163: note = chr19:30699747-30699910
  misc_feature 1..163: note = Hypo
  source 1..163: mol_type = genomic DNA

SEQ ID NO: 115985 - DNA, 677 bp, Homo sapiens
  misc_feature 1..677: note = chr19:30713398-30714075
  misc_feature 1..677: note = Hyper
  source 1..677: mol_type = genomic DNA
caacaagggccgcgccgggaggtctccccggggacccccactcagcttgctcaggtcctggaggcatgcagagggcgtcggcgccgacagggggagccggagagccccctgcccggccgtctgcggggctcaggcggggcttggcctccgatgagcgcgctgtctctgcccggtgggtcccaccccgcccggccacgcaaagccgtggcagccccctcgcggcagcgcgccccaggcgaagcaccccgggccaccgggagcgcggccctcccgagacgcacgggctccgaggccgcagaagccttgggcctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccatatggtcacttcctttcgacctgctcggccctgctcgcctctttgtccgctctgtcacttataaagaatcacttgacttacaataacaggttcaaaagacgacggagtataatcagttgatccacgaagaattggaataaagaacaccccaccgctcaggctatcat

SEQ ID NO: 115986 - DNA, 321 bp, Homo sapiens; identical to SEQ ID NO: 83095
  misc_feature 1..321: note = chr19:30714424-30714745
  misc_feature 1..321: note = Hyper
  source 1..321: mol_type = genomic DNA

SEQ ID NO: 115987 - DNA, 603 bp, Homo sapiens; identical to SEQ ID NO: 83096
  misc_feature 1..603: note = chr19:30715266-30715869
  misc_feature 1..603: note = Hyper
  source 1..603: mol_type = genomic DNA

SEQ ID NO: 115988 - DNA, 2731 bp, Homo sapiens
  misc_feature 1..2731: note = chr19:30716203-30718934
  misc_feature 1..2731: note = Hyper
  source 1..2731: mol_type = genomic DNA
tgaattatgccagggcgacaatggagagcgtttttaatggtacaatgcatttcacctaccagatagggggaggccgagccggggatggggatgtctgctggggctgggtgatgagtatcaatgaacggggcgattctgaaaagaggctgatgaaaatcgagcccgccctgccccggctgggctgggaacagttcgcagggctctgccgagtgggcgagtgaggcgcgcgagcagggcgcccgtcccccctcagccccggaaaatgatcaagtcaatcgtgtgggcatgtttcattattcattgaacacaatcttttacaacgctccgtttacgtgcccgagtttgctcctgacgcccgcgtttcaatgtttaaggtaaggaaaacaaaggtgggggggggatcgcggggcgcggcgcggtgcggggggcgcggcgcgggggggcggcggcgggtgggggggcagcttcggcgtccgggaggtggcaaagtgagtttggactcttggcgcggcccccccgtcccctccccctccccatctcggcgaggcctgccgcccggttccttctcgccccatcgcgattaaaaaatacggtctaattaaatatccgtggctgtgacgttggcgagagaagctgtcagcgggtggggggtggggggaaagaagaggaaaaccgagccggcggctgcggccgggcatcgtatggcgctagagaacttcggcggcgagcgggacctgcgcctgggccgccgcctccccgcccgcggtcccgggaccgttactttgaaaaggagtcccgaggcctggcgcccggcgcgcgatcgggaccccgcgtccagctccggggacccggccggcgccccccacccgcgagcggcccgcgagccactctcaggccccgggaaactttcaagagggtctggggggtggggggagtaaaaaggggagggggtaggctggggccgcggaaacttctgctcaagtgactttccccattttctcctctgcctgggacgggggttcgccttgcgctctttctctggtccgcgctcactgcggggttccggcccctccgcccgtggagagagggtaatttgcaaccttttttttttttcaattaaagttagctgatgcttacaatgtgtcaaacttgcgggcgccgagagccgctgagatctgccattttgtgattgcatcggcctcctgtgccccgggagcctggccaggctgaggccggagagttggtttcagggctgaggtgccagggtccgaacccgcgaccccaggaaaggccgtggcgcctgcaagcgcaggcggcgcccgcagcacctgccccagccgggcctcggcctgggggcccagccgggggccaaagaggaaataaataaataaataagtaacaggttatggagggaaaagagccggccagtcccaggctggagaaatgaggccaatcagagcgaggaagtgcgggcgtgggggctctggaaggcagaggagaggcagggcttgcgcggcgtctgggaagagtgcaatctggggggacgcctcccgtccccccagcgcagatgcatgactggggtaggaatgatctttgctgataagcctttttctgtttgcttcaagacattatttttcgaagatgaattgaggaaaacagtcgtaggcgagactcggggtgtattttaggcaaaaaaaaaaaagttagggttgggggagagctttcctttgatgagtaggaaagtgtccagatctcgacgcgcccatctgttgcagttttgcaaataatttaaaatatagatatctccatatagacggatgtatgtgaagtggaggaaggtcgaaacgcggggaagttagggaaaaagaaagaaaaagggctgggcagagagagacctgtgttgctcactcttcactctgcggagtgaactccggcagggctttctttggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccccaaccctggtgtccccggcgagttgggcagccccgcgcgccctgaccttgacgccccagtctccagccagggcttaggtgaacttgg

SEQ ID NO: 115989 - DNA, 1051 bp, Homo sapiens
  misc_feature 1..1051: note = chr19:30718994-30720045
  misc_feature 1..1051: note = Hyper
  source 1..1051: mol_type = genomic DNA
gagactgggaacgcgctgttttctttcccagtttgatactagcaactggatttttactttaagaccggctttgctctctgctggggttgggagggggggcgatcttttcccatcactcacatctttgttcattgttcactgagtggaaggcaggcgacttaaagagacgaaagagaggaaaaaggggtgagagacggagagaggaaaaagaggggggcggccagaagagggaaggagaggcgtggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatcccgcgcctcccagtccggagtccatttgcataattggattttttttttttgcctccttctttctccctgaaacttgtttgaaaacccaagtgaaaaccgcgacgatctgcacactcaaaagcaagtgccaagtaagtgccctgcggtggcctcggcgcgccccggggtgagcgcgcaaagccgggagcgaggtgccgcgagctgcgcgccgccccgggccggcctcgcgtgtgggcggctgggcggctgggcggcgggaggacggcctccgcgggctccgggactgcccggctggctgctcgcacaactttttttttttcccccgtctgctgacttttcgggccaggtgaagtgtttgggccacgcgtgtacctgtggcgagactcgggaggcgatcttggggggcgcgcggtcgcagttgggcatcttgcctgggtcgggggcgggcagtcggtcccagtggccgccgctgagggcagagctgcgagcgagcggggccggctgctggtcgcgccgcgccgtaaatgcaagcctgtagccaaatgcttcccccattattctaaggtttgtgtctgcgtgtgcgtgtatgtatgtgt

SEQ ID NO: 115990 - DNA, 30 bp, Homo sapiens; identical to SEQ ID NO: 83102
  misc_feature 1..30: note = chr19:30769986-30770016
  misc_feature 1..30: note = Hypo
  source 1..30: mol_type = genomic DNA

SEQ ID NO: 115991 - DNA, 1044 bp, Homo sapiens
  misc_feature 1..1044: note = chr19:30865459-30866503
  misc_feature 1..1044: note = Hyper
  source 1..1044: mol_type = genomic DNA
cgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccggcgcccgggcggattgcgagcccccgcgggtccggccgggggagcggagactggccccccgcccgggctggggcgcctgccgcccgcgagccggaagagcgccccattcacgagcaggcagccctggcagagggttaattgaggatcattgttgttggttccaggaggagcgaagcgcctggagatcgggcgcgcgggcgcggctctgggagcgggggaaggtgaggggaaatgggacatgatggcattaataatcgttaccaaagacggtgggagtaacaaaggaatgcgtctccgagacgccgcccagccccggggtgttttctggcgcggtcgcggtgcaggaacgcgagccccgccgccgagcctcccgccgcctgcgttcgttggcgcggcgcccggcggtagtgccaccccgaggccgagcgctgcccccgccggcccgcggctgccagccggccctgcccgcgcccgggccccgcgagcggccgcacttcaccttacggaggggagataatgagatcaattagaggcgccgtcaccgcgccggagacagctgccgccgcatagtaatcacccgcgggctgggtgcgcgggggctccccgctacctgcgcgcctgctgctcccaccacgcggcaccgacccgggcgcgcccccggcccctgtccgcagcccacagccacaccgcgcaccctacaccctccttgcgcctctgctggggagctcaccccctccactcgcacagtgcgctgcggcccggggtgtgggaggtcccgggacttggggtgt

SEQ ID NO: 115992 - DNA, 32 bp, Homo sapiens; identical to SEQ ID NO: 83105
  misc_feature 1..32: note = chr19:30901662-30901694
  misc_feature 1..32: note = Hypo
  source 1..32: mol_type = genomic DNA

SEQ ID NO: 115993 - DNA, 95 bp, Homo sapiens; identical to SEQ ID NO: 83106
  misc_feature 1..95: note = chr19:30931166-30931261
  misc_feature 1..95: note = Hypo
  source 1..95: mol_type = genomic DNA

SEQ ID NO: 115994 - DNA, 182 bp, Homo sapiens; identical to SEQ ID NO: 83107
  misc_feature 1..182: note = chr19:30934382-30934564
  misc_feature 1..182: note = Hypo
  source 1..182: mol_type = genomic DNA

SEQ ID NO: 115995 - DNA, 354 bp, Homo sapiens; identical to SEQ ID NO: 83108
  misc_feature 1..354: note = chr19:30935523-30935877
  misc_feature 1..354: note = Hypo
  source 1..354: mol_type = genomic DNA

SEQ ID NO: 115996 - DNA, 223 bp, Homo sapiens; identical to SEQ ID NO: 83109
  misc_feature 1..223: note = chr19:30954451-30954674
  misc_feature 1..223: note = Hypo
  source 1..223: mol_type = genomic DNA

SEQ ID NO: 115997 - DNA, 142 bp, Homo sapiens; identical to SEQ ID NO: 83110
  misc_feature 1..142: note = chr19:31017204-31017346
  misc_feature 1..142: note = Hypo
  source 1..142: mol_type = genomic DNA

SEQ ID NO: 115998 - DNA, 53 bp, Homo sapiens; identical to SEQ ID NO: 83111
  misc_feature 1..53: note = chr19:31038908-31038961
  misc_feature 1..53: note = Hypo
  source 1..53: mol_type = genomic DNA

SEQ ID NO: 115999 - DNA, 30 bp, Homo sapiens; identical to SEQ ID NO: 83112
  misc_feature 1..30: note = chr19:31057923-31057953
  misc_feature 1..30: note = Hypo
  source 1..30: mol_type = genomic DNA

SEQ ID NO: 116000 - DNA, 55 bp, Homo sapiens; identical to SEQ ID NO: 83113
  misc_feature 1..55: note = chr19:31117725-31117780
  misc_feature 1..55: note = Hypo
  source 1..55: mol_type = genomic DNA

SEQ ID NO: 116001 - DNA, 247 bp, Homo sapiens; identical to SEQ ID NO: 83114
  misc_feature 1..247: note = chr19:31210572-31210819
  misc_feature 1..247: note = Hyper
  source 1..247: mol_type = genomic DNA

SEQ ID NO: 116002 - DNA, 87 bp, Homo sapiens; identical to SEQ ID NO: 83115
  misc_feature 1..87: note = chr19:31213098-31213185
  misc_feature 1..87: note = Hypo
  source 1..87: mol_type = genomic DNA

SEQ ID NO: 116003 - DNA, 79 bp, Homo sapiens; identical to SEQ ID NO: 83116
  misc_feature 1..79: note = chr19:31217835-31217914
  misc_feature 1..79: note = Hypo
  source 1..79: mol_type = genomic DNA

SEQ ID NO: 116004 - DNA, 134 bp, Homo sapiens; identical to SEQ ID NO: 83118
  misc_feature 1..134: note = chr19:31567889-31568023
  misc_feature 1..134: note = Hypo
  source 1..134: mol_type = genomic DNA

SEQ ID NO: 116005 - DNA, 205 bp, Homo sapiens; identical to SEQ ID NO: 45810
  misc_feature 1..205: note = chr19:31587355-31587560
  misc_feature 1..205: note = Hypo
  source 1..205: mol_type = genomic DNA

SEQ ID NO: 116006 - DNA, 30 bp, Homo sapiens; identical to SEQ ID NO: 83121
  misc_feature 1..30: note = chr19:31768075-31768105
  misc_feature 1..30: note = Hypo
  source 1..30: mol_type = genomic DNA

SEQ ID NO: 116007 - DNA, 30 bp, Homo sapiens; identical to SEQ ID NO: 83122
  misc_feature 1..30: note = chr19:31770460-31770490
  misc_feature 1..30: note = Hypo
  source 1..30: mol_type = genomic DNA

SEQ ID NO: 116008 - DNA, 172 bp, Homo sapiens; identical to SEQ ID NO: 83123
  misc_feature 1..172: note = chr19:31780548-31780720
  misc_feature 1..172: note = Hypo
  source 1..172: mol_type = genomic DNA

SEQ ID NO: 116009 - DNA, 243 bp, Homo sapiens; identical to SEQ ID NO: 83124
  misc_feature 1..243: note = chr19:31804724-31804967
  misc_feature 1..243: note = Hypo
  source 1..243: mol_type = genomic DNA

SEQ ID NO: 116010 - DNA, 1577 bp, Homo sapiens
  misc_feature 1..1577: note = chr19:31839600-31841177
  misc_feature 1..1577: note = Hyper
  source 1..1577: mol_type = genomic DNA
aaatgaggaatcaatcgtgttagtactaaggtggccgaggggaccggctcgctcactcgttcgcgctccctggctcggcggacaccaggcagtcccccggcggtcggccgctcggaggacgcggaagatgtcccggggaactcaggtgaccccgcccgccacccacagaaagagccaggccggggttgcttcccattccctctgcagccggagagctgaggaggtagggacctggcgcggctcagcgcgctccgcgagcggctccccaaatgggtgcgagagggaagagggcagagcgcggcggggcgtccggggggcgcccggtacccgaggcgggcgcacgcacccaaacaggagagcggcgcccggagttactcagtgcgggcagaagagcggggcgaggagcggggtcgcgcccgctggaggcgcggggcgagcggaggaagaggaggaggagagcagaaggaaggggaagcggctcgtacctgctgcgcgccggggcgcctgctgcttcctcctcggcatgatgcttctccggcgactgccactgccgccgccgccgccgctgccgggctgaggacagggagggagggggcggcgggcccgcgggggggcgaggcgggcctgctctcagcctcccccccggagagcggccgcccgcaggatgctgctgcgcccaggctctccgcgtcccccccgcgccgcgctccgccgcgaaccccgaacgtgcggagggaagaaggagggcgggcgagggaggctcggggagggaggagcacgggggggaggaggaggcagaggaggaggaggtggaggaggaggaggaggaccgcgctgccggcggaatgggaagtttgacaaatcgctccagaggccagaggaggagggggcggggaggagcggcggccctgcccccccccgccccgtccccagacgaggtgcgcggggttcggggctggggggcggggagagggcgggcagagcggtgggaggaggagcgcgggagcggcccggaccggtactgccccggcccccgcccctaggccgggggtcacggcatccggggggacgcgcagccgccgccgcggcccggggctcggcggtccagtcttctgcccgtggcgcggctggagcggcggcgtcggcaacaggcaagcttaaaggaaaaggagatgatcgtgtcaatcgcccgcccgcgggggcgccgcgcccccgcccccggccccaggcccgcgtgggacccccgccccgccagcgaaaggggtgccgcccctccgcctccgccccgtgcgcacacgcgggggcgcggcgccagccccgccgagcccgtcccggggcgctcgttaccccccacccctattcccacccagcgttcgtccccagccaccccccagctgccccacccggctcgcactcctctccacccgccgactccggagcccccagcgtggtccccgggccggggctggcgtcccccggggaagccagagcccacgggcaggccccctccagggaggaggcgggcgcgggccggggcgggtgggggcagccctcagaccccgcgccacccagctcct

SEQ ID NO: 116011 - DNA, 173 bp, Homo sapiens; identical to SEQ ID NO: 83127
  misc_feature 1..173: note = chr19:31841410-31841583
  misc_feature 1..173: note = Hyper
  source 1..173: mol_type = genomic DNA

SEQ ID NO: 116012 - DNA, 88 bp, Homo sapiens; identical to SEQ ID NO: 83128
  misc_feature 1..88: note = chr19:31841908-31841996
  misc_feature 1..88: note = Hyper
  source 1..88: mol_type = genomic DNA

SEQ ID NO: 116013 - DNA, 669 bp, Homo sapiens
  misc_feature 1..669: note = chr19:31842200-31842869
  misc_feature 1..669: note = Hyper
  source 1..669: mol_type = genomic DNA
aagatcaaaagtctccgctcgcccagcctgcgggcttgggctgggtccagacgtctcccaggatgcagatgcgccgccgctggcctccccggctataaagccgcctccagcgcctttccgcgcgcaggagcgctcggagttgtggggtacggaccccaggcggggcagggagtccgaggcgggctgcggcggggctctcgggctggcggactcgggggctgaggcgccgtgcgcgttgggtgcccgcggccgcagaggccagaaccgctactcctccaggccggggagacgcggccgtggagcgtgaaacgcttcttgcaagcgaggaaacggtgagttggccgacaccgccggcggcctcaccattctggtggccgcgctgagctcctgtcgcctggaggcgggttgcgccgcacggggtcagctcccgccggctcccagctcaccttcgaagctcccacttaggcgcgcccggtgcggcgtgtgcacagcgcggggcgccgcacacggaagcgtgtagttctccctggtcgcgcttttctcctcctttccatcccctcgctgttcttgcaaacctctgttccttcggccccctcccactgcgggccgcggcctgaactcgggtctccgcgtagccggccgccgccgctgggtcgctgcctggccctc

SEQ ID NO: 116014 - DNA, 249 bp, Homo sapiens
  misc_feature 1..249: note = chr19:31847973-31848222
  misc_feature 1..249: note = Hyper
  source 1..249: mol_type = genomic DNA
gctttcctgcgcgggcgatggctcctctctggcgcggagggcacccacatttgcatgataaattgaccagactggcggcagccaatgaaatattcaaattaggctgggtggcggtagtaggggtggagtccctggggctgccccttggcgcggcggcgggagcgggcgctaccacctctccgtcagcgccctctggaggcgggacagcgcgggcggccgctctggcccaaaagacgagatggggggttg

SEQ ID NO: 116015 - DNA, 30 bp, Homo sapiens; identical to SEQ ID NO: 83133
  misc_feature 1..30: note = chr19:31956583-31956613
  misc_feature 1..30: note = Hypo
  source 1..30: mol_type = genomic DNA

SEQ ID NO: 116016 - DNA, 30 bp, Homo sapiens; identical to SEQ ID NO: 83134
  misc_feature 1..30: note = chr19:31993710-31993740
  misc_feature 1..30: note = Hypo
  source 1..30: mol_type = genomic DNA

SEQ ID NO: 116017 - DNA, 30 bp, Homo sapiens; identical to SEQ ID NO: 45812
  misc_feature 1..30: note = chr19:32026024-32026054
  misc_feature 1..30: note = Hypo
  source 1..30: mol_type = genomic DNA

SEQ ID NO: 116018 - DNA, 76 bp, Homo sapiens; identical to SEQ ID NO: 83136
  misc_feature 1..76: note = chr19:32078937-32079013
  misc_feature 1..76: note = Hypo
  source 1..76: mol_type = genomic DNA

SEQ ID NO: 116019 - DNA, 160 bp, Homo sapiens; identical to SEQ ID NO: 83137
  misc_feature 1..160: note = chr19:32083599-32083759
  misc_feature 1..160: note = Hypo
  source 1..160: mol_type = genomic DNA

SEQ ID NO: 116020 - DNA, 32 bp, Homo sapiens; identical to SEQ ID NO: 45814
  misc_feature 1..32: note = chr19:32232273-32232305
  misc_feature 1..32: note = Hypo
  source 1..32: mol_type = genomic DNA

SEQ ID NO: 116021 - DNA, 30 bp, Homo sapiens; identical to SEQ ID NO: 83143
  misc_feature 1..30: note = chr19:32268791-32268821
  misc_feature 1..30: note = Hypo
  source 1..30: mol_type = genomic DNA

SEQ ID NO: 116022 - DNA, 504 bp, Homo sapiens; identical to SEQ ID NO: 83144
  misc_feature 1..504: note = chr19:32364179-32364683
  misc_feature 1..504: note = Hypo
  source 1..504: mol_type = genomic DNA

SEQ ID NO: 116023 - DNA, 30 bp, Homo sapiens; identical to SEQ ID NO: 83145
  misc_feature 1..30: note = chr19:32366594-32366624
  misc_feature 1..30: note = Hypo
  source 1..30: mol_type = genomic DNA

SEQ ID NO: 116024 - DNA, 35 bp, Homo sapiens; identical to SEQ ID NO: 83148
  misc_feature 1..35: note = chr19:32454989-32455024
  misc_feature 1..35: note = Hypo
  source 1..35: mol_type = genomic DNA

SEQ ID NO: 116025 - DNA, 32 bp, Homo sapiens; identical to SEQ ID NO: 83149
  misc_feature 1..32: note = chr19:32471100-32471132
  misc_feature 1..32: note = Hypo
  source 1..32: mol_type = genomic DNA

SEQ ID NO: 116026 - DNA, 58 bp, Homo sapiens; identical to SEQ ID NO: 83150
  misc_feature 1..58: note = chr19:32516346-32516404
  misc_feature 1..58: note = Hypo
  source 1..58: mol_type = genomic DNA

SEQ ID NO: 116027 - DNA, 84 bp, Homo sapiens; identical to SEQ ID NO: 83151
  misc_feature 1..84: note = chr19:32532918-32533002
  misc_feature 1..84: note = Hyper
  source 1..84: mol_type = genomic DNA

SEQ ID NO: 116028 - DNA, 30 bp, Homo sapiens; identical to SEQ ID NO: 83152
  misc_feature 1..30: note = chr19:32570308-32570338
  misc_feature 1..30: note = Hypo
  source 1..30: mol_type = genomic DNA

SEQ ID NO: 116029 - DNA, 30 bp, Homo sapiens; identical to SEQ ID NO: 83153
  misc_feature 1..30: note = chr19:32630194-32630224
  misc_feature 1..30: note = Hypo
  source 1..30: mol_type = genomic DNA

SEQ ID NO: 116030 - DNA, 89 bp, Homo sapiens; identical to SEQ ID NO: 45817
  misc_feature 1..89: note = chr19:32672320-32672409
  misc_feature 1..89: note = Hypo
  source 1..89: mol_type = genomic DNA

SEQ ID NO: 116031 - DNA, 588 bp, Homo sapiens
  misc_feature 1..588: note = chr19:32715369-32715957
  misc_feature 1..588: note = Hyper
  source 1..588: mol_type = genomic DNA
gctgccaccaaaacccgctccgagggccccgccgggccgccctggcagctggaaaagcgcattcctgctcgcccgaggatgcagaaggcaaccgagtccccgggcggcggcggggcaactgcggaaatcacgcagccagatgaagctcataaatttcccctatgaacaattgttttcatttccctcccatgccactagatattataagtggaaagcaaaacacaagtaaatatgttcattccgctcttgcgatcggtgataaaccggaggcggccgaggccgacagaggtcagcaggccgctcgccacgggtctgcgagcggacactgccaccctccggccgcgcgcgggactgcaccggccccaccgcccggctctcccgcccgctcgctgcccgccaatgttcgctttgcgcccttcgctcaatgtgcgtgcaaattacagggacattcgaaaggacagagagctcccatatttaaaataatcatttttgttcatcataacctctcttccagagataaccgctcttattaacgttttcgtacaattatctccagtctttatgtgcattctacgatgtcttctgtgt

SEQ ID NO: 116032 - DNA, 93 bp, Homo sapiens; identical to SEQ ID NO: 83157
  misc_feature 1..93: note = chr19:32718922-32719015
  misc_feature 1..93: note = Hypo
  source 1..93: mol_type = genomic DNA

SEQ ID NO: 116033 - DNA, 30 bp, Homo sapiens; identical to SEQ ID NO: 83158
  misc_feature 1..30: note = chr19:32753918-32753948
  misc_feature 1..30: note = Hypo
  source 1..30: mol_type = genomic DNA

SEQ ID NO: 116034 - DNA, 30 bp, Homo sapiens; identical to SEQ ID NO: 83159
  misc_feature 1..30: note = chr19:32832651-32832681
  misc_feature 1..30: note = Hypo
  source 1..30: mol_type = genomic DNA

SEQ ID NO: 116035 - DNA, 30 bp, Homo sapiens; identical to SEQ ID NO: 83160
  misc_feature 1..30: note = chr19:32834773-32834803
  misc_feature 1..30: note = Hypo
  source 1..30: mol_type = genomic DNA

SEQ ID NO: 116036 - DNA, 145 bp, Homo sapiens; identical to SEQ ID NO: 83161
  misc_feature 1..145: note = chr19:32835111-32835256
  misc_feature 1..145: note = Hypo
  source 1..145: mol_type = genomic DNA

SEQ ID NO: 116037 - DNA, 30 bp, Homo sapiens; identical to SEQ ID NO: 83162
  misc_feature 1..30: note = chr19:32835942-32835972
  misc_feature 1..30: note = Hypo
  source 1..30: mol_type = genomic DNA

SEQ ID NO: 116038 - DNA, 23 bp, Homo sapiens
  misc_feature 1..23: note = chr19:32853027-32853050
  misc_feature 1..23: note = Hypo
  source 1..23: mol_type = genomic DNA
caagtgtccgcccaccttggcct

SEQ ID NO: 116039 - DNA, 42 bp, Homo sapiens; identical to SEQ ID NO: 83165
  misc_feature 1..42: note = chr19:32898448-32898490
  misc_feature 1..42: note = Hypo
  source 1..42: mol_type = genomic DNA

SEQ ID NO: 116040 - DNA, 141 bp, Homo sapiens; identical to SEQ ID NO: 83168
  misc_feature 1..141: note = chr19:33143094-33143235
  misc_feature 1..141: note = Hypo
  source 1..141: mol_type = genomic DNA

SEQ ID NO: 116041 - DNA, 20 bp, Homo sapiens
  misc_feature 1..20: note = chr19:33143475-33143495
  misc_feature 1..20: note = Hypo
  source 1..20: mol_type = genomic DNA
catcccgggggtagggtgtg

SEQ ID NO: 116042 - DNA, 605 bp, Homo sapiens
  misc_feature 1..605: note = chr19:33166918-33167523
  misc_feature 1..605: note = Hyper
  source 1..605: mol_type = genomic DNA
cctggggaggatggacgagggagcgggggaccgctaacggggctccctctgcgcgccccgtccgcagaggcgcacgtcgagggtcccgggcgggctccgtggacgttggcggtagcgccgagcgagtcacggaccatgaagagcgttcgtgccgcgcggcccaaggccgggatgggggttagccacatcctgccgcgctgagggggaggctaacgggcgcgggcggccgggcccagccggagcccaccgcgatggcgagggaggagtgcaaggcgctgctggacgggctcaacaagacgactgcgtgctaccaccacctggtgctgaccgtcggtggctcggcggactcgcagaacctgcggcaggagctgcaaaagacgcgccagaaggcgcaggagctggcggtgtccacctgcgcccggctgactgctgtgctgcgcgaccggggcctggccgccgacgagcgcgccgagttcgagcggctctgggtggccttctcgggctgcctggacctgctggaagcggacatgcgacgcgcgctggagctgggcgccgcgttcccgctgcacgcgccgcggcggccgctggtgcgcacaggtgtggct

SEQ ID NO: 116043 - DNA, 64 bp, Homo sapiens; identical to SEQ ID NO: 83173
  misc_feature 1..64: note = chr19:33167843-33167907
  misc_feature 1..64: note = Hyper
  source 1..64: mol_type = genomic DNA

SEQ ID NO: 116044 - DNA, 156 bp, Homo sapiens; identical to SEQ ID NO: 45822
  misc_feature 1..156: note = chr19:33415273-33415429
  misc_feature 1..156: note = Hypo
  source 1..156: mol_type = genomic DNA

SEQ ID NO: 116045 - DNA, 72 bp, Homo sapiens; identical to SEQ ID NO: 83175
  misc_feature 1..72: note = chr19:33425338-33425410
  misc_feature 1..72: note = Hypo
  source 1..72: mol_type = genomic DNA

SEQ ID NO: 116046 - DNA, 50 bp, Homo sapiens; identical to SEQ ID NO: 83177
  misc_feature 1..50: note = chr19:33468018-33468068
  misc_feature 1..50: note = Hypo
  source 1..50: mol_type = genomic DNA

SEQ ID NO: 116047 - DNA, 26 bp, Homo sapiens
  misc_feature 1..26: note = chr19:33557330-33557356
  misc_feature 1..26: note = Hypo
  source 1..26: mol_type = genomic DNA
ttaaccacctccgttttctaggctgc

SEQ ID NO: 116048 - DNA, 23 bp, Homo sapiens
  misc_feature 1..23: note = chr19:33557746-33557769
  misc_feature 1..23: note = Hypo
  source 1..23: mol_type = genomic DNA
aaaaaaaaaaaagtccgggcgcg

SEQ ID NO: 116049 - DNA, 92 bp, Homo sapiens; identical to SEQ ID NO: 83182
  misc_feature 1..92: note = chr19:33685144-33685236
  misc_feature 1..92: note = Hyper
  source 1..92: mol_type = genomic DNA

SEQ ID NO: 116050 - DNA, 83 bp, Homo sapiens; identical to SEQ ID NO: 83183
  misc_feature 1..83: note = chr19:33685570-33685653
  misc_feature 1..83: note = Hyper
  source 1..83: mol_type = genomic DNA

SEQ ID NO: 116051 - DNA, 118 bp, Homo sapiens; identical to SEQ ID NO: 83184
  misc_feature 1..118: note = chr19:33685902-33686020
  misc_feature 1..118: note = Hyper
  source 1..118: mol_type = genomic DNA

SEQ ID NO: 116052 - DNA, 354 bp, Homo sapiens; identical to SEQ ID NO: 83185
  misc_feature 1..354: note = chr19:33716410-33716764
  misc_feature 1..354: note = Hyper
  source 1..354: mol_type = genomic DNA

SEQ ID NO: 116053 - DNA, 363 bp, Homo sapiens; identical to SEQ ID NO: 83186
  misc_feature 1..363: note = chr19:33717533-33717896
  misc_feature 1..363: note = Hyper
  source 1..363: mol_type = genomic DNA

SEQ ID NO: 116054 - DNA, 30 bp, Homo sapiens; identical to SEQ ID NO: 83187
  misc_feature 1..30: note = chr19:33781895-33781925
  misc_feature 1..30: note = Hypo
  source 1..30: mol_type = genomic DNA

SEQ ID NO: 116055 - DNA, 138 bp, Homo sapiens; identical to SEQ ID NO: 83188
  misc_feature 1..138: note = chr19:33792492-33792630
  misc_feature 1..138: note = Hyper
  source 1..138: mol_type = genomic DNA

SEQ ID NO: 116056 - DNA, 84 bp, Homo sapiens; identical to SEQ ID NO: 83189
  misc_feature 1..84: note = chr19:33793876-33793960
  misc_feature 1..84: note = Hyper
  source 1..84: mol_type = genomic DNA

SEQ ID NO: 116057 - DNA, 397 bp, Homo sapiens
  misc_feature 1..397: note = chr19:33794400-33794797
  misc_feature 1..397: note = Hyper
  source 1..397: mol_type = genomic DNA
caccgcttcctcccccgcctccccattcaggtgggcgccaacggcgggagcgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccggggtggcggctacggaccgtcagctgggcccagatggagtcttgggagccctcaagtgtctcctgtccttgcccgcgccgcccctcgccactggcgctgaggcctgacgccgcctgcgtcccggc

SEQ ID NO: 116058 - DNA, 204 bp, Homo sapiens; identical to SEQ ID NO: 83192
  misc_feature 1..204: note = chr19:33907896-33908100
  misc_feature 1..204: note = Hypo
  source 1..204: mol_type = genomic DNA

SEQ ID NO: 116059 - DNA, 41 bp, Homo sapiens; identical to SEQ ID NO: 83193
  misc_feature 1..41: note = chr19:33950319-33950360
  misc_feature 1..41: note = Hypo
  source 1..41: mol_type = genomic DNA

SEQ ID NO: 116060 - DNA, 30 bp, Homo sapiens; identical to SEQ ID NO: 83194
  misc_feature 1..30: note = chr19:33996127-33996157
  misc_feature 1..30: note = Hypo
  source 1..30: mol_type = genomic DNA

SEQ ID NO: 116061 - DNA, 30 bp, Homo sapiens; identical to SEQ ID NO: 83195
  misc_feature 1..30: note = chr19:34048983-34049013
  misc_feature 1..30: note = Hypo
  source 1..30: mol_type = genomic DNA

SEQ ID NO: 116062 - DNA, 2090 bp, Homo sapiens
  misc_feature 1..2090: note = chr19:34112213-34114303
  misc_feature 1..2090: note = Hyper
  source 1..2090: mol_type = genomic DNA
aagggagcacctgttcgcagggcactttcagcagaatctagagccccagggatttgaggatggatgcggacacccgggcctgaggcagctcgcggccttgaccgaattccacgcgagctgaagcccagggatatcccagaatcttcctcaggatcaatcttccgcctttcaccggccctgcgcccccgcagcatcgggtcctgggcgcgcgcccctgccccgctgtggtcaaggcccgccccggtgacgcctggtccttttcccgggttggcgccgcgtgcgacccaccgaggcagtggcagcactggccgcggtctggagcctagcgtcaggccggagtccggctctcctgaaccgggagaccggcgcagccccagccacgaccgctcccacccccgcggccgccggaccgcgcccagcagcgactctttctgagagcgctgccagaggggccgcgggagccgcagagcgcgcgtgggcgcggcgcccgcgagcccccgggagggccgagtgcatcgctggagcgatccccgcccggcccggccaccgccgtagccgccaccacggcggggcggggcacgggccgggggcggggcgccgggcgggcgcggcgctatttccagcctcgccggaggcttcgctctcacttcgctgggagccttcccggcgcgcaagccggatccggcagtgctgcggggaggagagaggacgaggcggcggcggcagcaggaggtgggggaccgatcgcgccgggggccgaagaggaacgccgccccgcgccctctcgctccccgcacgctccggctgccggccccacgctgctcgcccacagatcgcactgggttccgcttggagcgggcggaggcaccgggcccgagctgggtcggaggtcctctccgccgcctgcgcgccccaagcagaggatccgccgcggagaaccgctcccggactggaggcgcccgcggcctcgggtgcgtccgctgcgccaggtaagtggctgcgcccctgccccacccctgttcccgccctgcgcaggctcctggcctgcagagacgccaggaaggggtcccgagcgggccccggactgcaccgctcgccatccccgccaccgcacgcgaatgggagtccgaagctgcgggcggaggtgggcgcgcggggctcgggtctggttgcactttggggaccggccccggtagcgggaactttaattagactttctctccttggatctcactcgctgccgcgcttctgggaactgccgtccctcgggccctcttggtccctgcggactcccgctccgcctcctggccctcggtgctgcccgcggggaggcggcgtcgggcgctgagcagcgagcgccgagggccaggcaggagcgctcggggcgctggggcttcctggcgcgctcggagccggggctccggacgggttgcggcgggcagagactatgggggaagtttaagtggccttggcttcctacccagcggctccgtcgcgcgcgtccccgacccgcaactctccagggcaccggcctgtgagtgctggaggcgagtgtgcgtgcgtcagcgatggtgtgaaggtgtgtgcgtgcgtgtgtcgggagtgcgggagtcggagcctggggcggctccagggggcggggaaatgatccgtttggccgcgggaccgagccgagctctgacggcggctgcaactccggctaccgactctgcagacccgctctggcctcgctggaggccagccgggccaggagggcgatcacgggttttggcagtgcccgatgctggggcttgggtctgatgtgaccccgattccttctccagtgcgggactcccgccgccctaactttcgcgtacatcttgtctccaggcccgcgaccccgacccggagttgaagcggctgcggcgccctcggctgtgggcgctgctgcccggctgtctgttttaacccagaagtaggcgccgatcctggggctctctgtcctgcagtcgtctccggcgtcccagaggactctgcgtccctgggccactcccgctggctcaggagccgtgatcagctccgttaaggggaacgcgcgtcccggcccctct

SEQ ID NO: 116063 - DNA, 130 bp, Homo sapiens; identical to SEQ ID NO: 83202
  misc_feature 1..130: note = chr19:34175192-34175322
  misc_feature 1..130: note = Hyper
  source 1..130: mol_type = genomic DNA

SEQ ID NO: 116064 - DNA, 75 bp, Homo sapiens; identical to SEQ ID NO: 37419
  misc_feature 1..75: note = chr19:34175542-34175617
  misc_feature 1..75: note = Hyper
  source 1..75: mol_type = genomic DNA

SEQ ID NO: 116065 - DNA, 189 bp, Homo sapiens; identical to SEQ ID NO: 83204
  misc_feature 1..189: note = chr19:34263083-34263272
  misc_feature 1..189: note = Hypo
  source 1..189: mol_type = genomic DNA

SEQ ID NO: 116066 - DNA, 56 bp, Homo sapiens; identical to SEQ ID NO: 83205
  misc_feature 1..56: note = chr19:34263838-34263894
  misc_feature 1..56: note = Hypo
  source 1..56: mol_type = genomic DNA

SEQ ID NO: 116067 - DNA, 30 bp, Homo sapiens; identical to SEQ ID NO: 83206
  misc_feature 1..30: note = chr19:34268680-34268710
  misc_feature 1..30: note = Hypo
  source 1..30: mol_type = genomic DNA

SEQ ID NO: 116068 - DNA, 179 bp, Homo sapiens; identical to SEQ ID NO: 83207
  misc_feature 1..179: note = chr19:34272529-34272708
  misc_feature 1..179: note = Hypo
  source 1..179: mol_type = genomic DNA

SEQ ID NO: 116069 - DNA, 588 bp, Homo sapiens; identical to SEQ ID NO: 83208
  misc_feature 1..588: note = chr19:34288087-34288675
  misc_feature 1..588: note = Hyper
  source 1..588: mol_type = genomic DNA

SEQ ID NO: 116070 - DNA, 32 bp, Homo sapiens; identical to SEQ ID NO: 37421
  misc_feature 1..32: note = chr19:34311466-34311498
  misc_feature 1..32: note = Hyper
  source 1..32: mol_type = genomic DNA

SEQ ID NO: 116071 - DNA, 108 bp, Homo sapiens; identical to SEQ ID NO: 83210
  misc_feature 1..108: note = chr19:34396791-34396899
  misc_feature 1..108: note = Hyper
  source 1..108: mol_type = genomic DNA

SEQ ID NO: 116072 - DNA, 32 bp, Homo sapiens; identical to SEQ ID NO: 83211
  misc_feature 1..32: note = chr19:34397391-34397423
  misc_feature 1..32: note = Hyper
  source 1..32: mol_type = genomic DNA

SEQ ID NO: 116073 - DNA, 16 bp, Homo sapiens
  misc_feature 1..16: note = chr19:34436559-34436575
  misc_feature 1..16: note = Hypo
  source 1..16: mol_type = genomic DNA
gcgcccagccatcagc

SEQ ID NO: 116074 - DNA, 39 bp, Homo sapiens; identical to SEQ ID NO: 83214
  misc_feature 1..39: note = chr19:34558335-34558374
  misc_feature 1..39: note = Hypo
  source 1..39: mol_type = genomic DNA

SEQ ID NO: 116075 - DNA, 23 bp, Homo sapiens
  misc_feature 1..23: note = chr19:34896337-34896360
  misc_feature 1..23: note = Hypo
  source 1..23: mol_type = genomic DNA
accgcgcccggcctttcttaagg

SEQ ID NO: 116076 - DNA, 1583 bp, Homo sapiens
  misc_feature 1..1583: note = chr19:34972183-34973766
  misc_feature 1..1583: note = Hyper
  source 1..1583: mol_type = genomic DNA
gtggggacgcatctgcgctaggcgcacagtattcctgggcgcgggacgggcgaagcgccgtgggttccaagctgagctgggtcggccctgcagcgccggagagcaaggcggcgcagggaagggagatggggcgggatgtggggaaagctgtcgactgcttggatctctccggcccggatggcgccagctgcctccagctcagcctgcggaaatccgagctcttcccagcggcccgacggcccgggcgccccgcagaccctgggctctccccgcggtgcctccgccgcccgcccctgcgtcctggcccggcctccacgcccctccgaggtcccggcgcagcgcggccgccgccactccccccacattccagaggccgcagcgccgtctccttcctcgcattcctgcccccgcaaaggagtccctccgccccgcgcgaggccgcggcgaggagggggcgcggcccggcgcctgggagcttacattcctccgccgcgcgcgccgccgagcagggcgccgcgtcccccggcccgcgcgtggccgccggaacgaccccggcccggcgccggccccgccccgccccgcgcccaggggtcccggggcgggctccgggcttcgggcggacgatgcggcggcccggccggagcggcggcgggaagcggaggcggaggtgacgcgccagggccggcgggccgggccatgcagcgctccagggcgggcgcggacgaggcggccctactcctggccgggctggccctgcgggagctggagcccgggtgcggctctcccggtcgggggcggcgggggccgcggcctgggcctggagacgaggcggcgcccgcgctgggccgcagagggaagggcagcggcggccccgaggccggggcggacggactgagccgcggggagcggggtccccggcgcgcggcggttccggagctcagcgcgcagcctgcgggcagcccacgggccagcctggcggggtccgacggcggcggcggtggcggcagcgcccgatccagcggcatcagcctgggctacgaccagcgccacggcagcccgcgctccggtcgctcggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggagggcggcccaagcgcggccgagcggcggctggaggcgctcacccgggagctggagcgggcgctcgaggcgcgcacggcgcgggactacttcggtgagctcgctcggcccggcagttccctgcgcgcatggctggggtccggggttccgagactgcctcgggtaggcggccggatcagcggaggagagcacggggctggctgggggtgcagcagtgcacggggttgggacgaggaaggtgcatcccctggggactggggagcgcaaagggtgagtgagtgcgcctggatccccagcagcggcttcacccctgc

SEQ ID NO: 116077 - DNA, 414 bp, Homo sapiens
  misc_feature 1..414: note = chr19:35068466-35068880
  misc_feature 1..414: note = Hyper
  source 1..414: mol_type = genomic DNA
caggagacccagcagcgccagggctcgggcggacgccacgcggttcggggtcggggccggtaggtatgcgggtcacactggggcagtgcggacgcaggtccctctggcatctcgggagacgcggtccttaaactccgtgtcctgggggcgggcccgggtggcgtggcttggctggacagggagggtaggggcggtagtggggtttgtggcactccagcgtagcaggttgcatctgcgggtccccgcccctgccccgcccccagcccctcccatggtgctggatccaggcagctgatgtgcaggcggggacccctggctgggcgcggtcctgggcgcgtccctgcgcggttcaggcttccatgcgcgctgagactccgctggctctgtggcctgccccgtcgtgtgtgcgtcacg

SEQ ID NO: 116078 - DNA, 85 bp, Homo sapiens; identical to SEQ ID NO: 83228
  misc_feature 1..85: note = chr19:35168907-35168992
  misc_feature 1..85: note = Hyper
  source 1..85: mol_type = genomic DNA

SEQ ID NO: 116079 - DNA, 412 bp, Homo sapiens; identical to SEQ ID NO: 83229
  misc_feature 1..412: note = chr19:35263586-35263998
  misc_feature 1..412: note = Hyper
  source 1..412: mol_type = genomic DNA

SEQ ID NO: 116080 - DNA, 30 bp, Homo sapiens; identical to SEQ ID NO: 83230
  misc_feature 1..30: note = chr19:35316742-35316772
  misc_feature 1..30: note = Hypo
  source 1..30: mol_type = genomic DNA

SEQ ID NO: 116081 - DNA, 139 bp, Homo sapiens; identical to SEQ ID NO: 83231
  misc_feature 1..139: note = chr19:35323440-35323579
  misc_feature 1..139: note = Hypo
  source 1..139: mol_type = genomic DNA

SEQ ID NO: 116082 - DNA, 41 bp, Homo sapiens; identical to SEQ ID NO: 83232
  misc_feature 1..41: note = chr19:35343555-35343596
  misc_feature 1..41: note = Hypo
  source 1..41: mol_type = genomic DNA

SEQ ID NO: 116083 - DNA, 21 bp, Homo sapiens
  misc_feature 1..21: note = chr19:35368034-35368055
  misc_feature 1..21: note = Hypo
  source 1..21: mol_type = genomic DNA
accaaataggccgggcgcggc

SEQ ID NO: 116084 - DNA, 566 bp, Homo sapiens
  misc_feature 1..566: note = chr19:35395923-35396489
  misc_feature 1..566: note = Hyper
  source 1..566: mol_type = genomic DNA
cccagctgcaagggccggcgcacccacgcgcactggttgccaaatctcccgctttcaggccaggtgcggagcgcgcctcgacagtcctgaacattctccacttaacggctgagagccgctgggagcctaacgcctgcaaccgagtgagctcgagtccggctggggtcggaccgttggacctccccgttggccctttgttgtacttcttcgcgccctgggctcgcgcaagctttctctgccacgcgttccaacggccgctcaccggcatcgggctgaacacggtgcgcttcacctcggagttcccactccactccaaggatccaacagcgcacaagctgctcttcacgggcaactacctctgcaagcttcacccccggccccgccacgccccgcagggttccctgtctggtctggatcacctcgctctccctgcgcctctctccttggcctagctagacaagtgcttctcacgatccagcgcgtttaccgctcggtttcgtcgccgctaaggggtggtggtgtctgatccgtcaggctctgcgcttctctctcggatccatcctcaa

SEQ ID NO: 116085 - DNA, 111 bp, Homo sapiens; identical to SEQ ID NO: 83237
  misc_feature 1..111: note = chr19:35454422-35454533
  misc_feature 1..111: note = Hyper
  source 1..111: mol_type = genomic DNA

SEQ ID NO: 116086 - DNA, 16 bp, Homo sapiens
  misc_feature 1..16: note = chr19:35497210-35497226
  misc_feature 1..16: note = Hypo
  source 1..16: mol_type = genomic DNA
gcgactctttgtctcc

SEQ ID NO: 116087 - DNA, 165 bp, Homo sapiens; identical to SEQ ID NO: 83239
  misc_feature 1..165: note = chr19:35503957-35504122
  misc_feature 1..165: note = Hyper
  source 1..165: mol_type = genomic DNA

SEQ ID NO: 116088 - DNA, 97 bp, Homo sapiens; identical to SEQ ID NO: 83240
  misc_feature 1..97: note = chr19:35524526-35524623
  misc_feature 1..97: note = Hypo
  source 1..97: mol_type = genomic DNA

SEQ ID NO: 116089 - DNA, 139 bp, Homo sapiens; identical to SEQ ID NO: 83241
  misc_feature 1..139: note = chr19:35531737-35531876
  misc_feature 1..139: note = Hyper
  source 1..139: mol_type = genomic DNA

SEQ ID NO: 116090 - DNA, 30 bp, Homo sapiens; identical to SEQ ID NO: 83242
  misc_feature 1..30: note = chr19:35559263-35559293
  misc_feature 1..30: note = Hypo
  source 1..30: mol_type = genomic DNA

SEQ ID NO: 116091 - DNA, 30 bp, Homo sapiens; identical to SEQ ID NO: 83243
  misc_feature 1..30: note = chr19:35581749-35581779
  misc_feature 1..30: note = Hyper
  source 1..30: mol_type = genomic DNA

SEQ ID NO: 116092 - DNA, 79 bp, Homo sapiens; identical to SEQ ID NO: 83244
  misc_feature 1..79: note = chr19:35589938-35590017
  misc_feature 1..79: note = Hypo
  source 1..79: mol_type = genomic DNA

SEQ ID NO: 116093 - DNA, 30 bp, Homo sapiens; identical to SEQ ID NO: 83245
  misc_feature 1..30: note = chr19:35590789-35590819
  misc_feature 1..30: note = Hypo
  source 1..30: mol_type = genomic DNA

SEQ ID NO: 116094 - DNA, 30 bp, Homo sapiens; identical to SEQ ID NO: 83246
  misc_feature 1..30: note = chr19:35599404-35599434
  misc_feature 1..30: note = Hypo
  source 1..30: mol_type = genomic DNA

SEQ ID NO: 116095 - DNA, 224 bp, Homo sapiens; identical to SEQ ID NO: 83247
  misc_feature 1..224: note = chr19:35607205-35607429
  misc_feature 1..224: note = Hypo
  source 1..224: mol_type = genomic DNA

SEQ ID NO: 116096 - DNA, 30 bp, Homo sapiens; identical to SEQ ID NO: 45834
  misc_feature 1..30: note = chr19:35608942-35608972
  misc_feature 1..30: note = Hypo
  source 1..30: mol_type = genomic DNA

SEQ ID NO: 116097 - DNA, 551 bp, Homo sapiens; identical to SEQ ID NO: 83249
  misc_feature 1..551: note = chr19:35615955-35616506
  misc_feature 1..551: note = Hypo
  source 1..551: mol_type = genomic DNA

SEQ ID NO: 116098 - DNA, 87 bp, Homo sapiens; identical to SEQ ID NO: 83250
  misc_feature 1..87: note = chr19:35621761-35621848
  misc_feature 1..87: note = Hypo
  source 1..87: mol_type = genomic DNA

SEQ ID NO: 116099 - DNA, 45 bp, Homo sapiens; identical to SEQ ID NO: 83251
  misc_feature 1..45: note = chr19:35622243-35622288
  misc_feature 1..45: note = Hypo
  source 1..45: mol_type = genomic DNA

SEQ ID NO: 116100 - DNA, 274 bp, Homo sapiens; identical to SEQ ID NO: 83258
  misc_feature 1..274: note = chr19:35781236-35781510
  misc_feature 1..274: note = Hypo
  source 1..274: mol_type = genomic DNA

SEQ ID NO: 116101 - DNA, 69 bp, Homo sapiens; identical to SEQ ID NO: 83260
  misc_feature 1..69: note = chr19:35784054-35784123
  misc_feature 1..69: note = Hypo
  source 1..69: mol_type = genomic DNA

SEQ ID NO: 116102 - DNA, 364 bp, Homo sapiens; identical to SEQ ID NO: 83261
  misc_feature 1..364: note = chr19:35797873-35798237
  misc_feature 1..364: note = Hypo
  source 1..364: mol_type = genomic DNA

SEQ ID NO: 116103 - DNA, 156 bp, Homo sapiens; identical to SEQ ID NO: 45839
  misc_feature 1..156: note = chr19:35827208-35827364
  misc_feature 1..156: note = Hypo
  source 1..156: mol_type = genomic DNA

SEQ ID NO: 116104 - DNA, 30 bp, Homo sapiens; identical to SEQ ID NO: 83263
  misc_feature 1..30: note = chr19:35827795-35827825
  misc_feature 1..30: note = Hypo
  source 1..30: mol_type = genomic DNA

SEQ ID NO: 116105 - DNA, 40 bp, Homo sapiens; identical to SEQ ID NO: 83264
  misc_feature 1..40: note = chr19:35842975-35843015
  misc_feature 1..40: note = Hypo
  source 1..40: mol_type = genomic DNA

SEQ ID NO: 116106 - DNA, 224 bp, Homo sapiens; identical to SEQ ID NO: 83266
  misc_feature 1..224: note = chr19:35920847-35921071
  misc_feature 1..224: note = Hypo
  source 1..224: mol_type = genomic DNA

SEQ ID NO: 116107 - DNA, 195 bp, Homo sapiens; identical to SEQ ID NO: 45842
  misc_feature 1..195: note = chr19:35940942-35941137
  misc_feature 1..195: note = Hypo
  source 1..195: mol_type = genomic DNA

SEQ ID NO: 116108 - DNA, 333 bp, Homo sapiens; identical to SEQ ID NO: 83268
  misc_feature 1..333: note = chr19:36024742-36025075
  misc_feature 1..333: note = Hyper
  source 1..333: mol_type = genomic DNA

SEQ ID NO: 116109 - DNA, 867 bp, Homo sapiens
  misc_feature 1..867: note = chr19:36048553-36049420
  misc_feature 1..867: note = Hyper
  source 1..867: mol_type = genomic DNA
caccgagcacgcgttcgcccaggcctcccaggctgaggtaggcggtctggaaggcctcgcgccactgctcgtccagcggcagctcctggcccttgataaggatggagctgcagcgctccagcacgcgctcgggggcgcccttcatcaccagcaagtgtcgcgggtcccgcgggtcctccagcgtatggatggacagctgtgggcgggggggagaggcgaggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttgggaagcggtcccggtagcccatggcgttgcccagcgtcagctccgagaacttgagcagcgccgtctccgatgcgtctccaatcacgatgcgctgggagcggggaccggtgtca

SEQ ID NO: 116110 - DNA, 86 bp, Homo sapiens; identical to SEQ ID NO: 83271
  misc_feature 1..86: note = chr19:36138505-36138591
  misc_feature 1..86: note = Hypo
  source 1..86: mol_type = genomic DNA

SEQ ID NO: 116111 - DNA, 65 bp, Homo sapiens; identical to SEQ ID NO: 83272
  misc_feature 1..65: note = chr19:36166552-36166617
  misc_feature 1..65: note = Hypo
  source 1..65: mol_type = genomic DNA

SEQ ID NO: 116112 - DNA, 81 bp, Homo sapiens; identical to SEQ ID NO: 83273
  misc_feature 1..81: note = chr19:36183048-36183129
  misc_feature 1..81: note = Hypo
  source 1..81: mol_type = genomic DNA

SEQ ID NO: 116113 - DNA, 30 bp, Homo sapiens; identical to SEQ ID NO: 45843
  misc_feature 1..30: note = chr19:36199677-36199707
  misc_feature 1..30: note = Hypo
  source 1..30: mol_type = genomic DNA

SEQ ID NO: 116114 - DNA, 63 bp, Homo sapiens; identical to SEQ ID NO: 83275
  misc_feature 1..63: note = chr19:36220088-36220151
  misc_feature 1..63: note = Hypo
  source 1..63: mol_type = genomic DNA

SEQ ID NO: 116115 - DNA, 558 bp, Homo sapiens; identical to SEQ ID NO: 83276
  misc_feature 1..558: note = chr19:36221431-36221989
  misc_feature 1..558: note = Hypo
  source 1..558: mol_type = genomic DNA

SEQ ID NO: 116116 - DNA, 131 bp, Homo sapiens; identical to SEQ ID NO: 83277
  misc_feature 1..131: note = chr19:36222351-36222482
  misc_feature 1..131: note = Hypo
  source 1..131: mol_type = genomic DNA

SEQ ID NO: 116117 - DNA, 277 bp, Homo sapiens; identical to SEQ ID NO: 45846
  misc_feature 1..277: note = chr19:36249972-36250249
  misc_feature 1..277: note = Hypo
  source 1..277: mol_type = genomic DNA

SEQ ID NO: 116118 - DNA, 34 bp, Homo sapiens; identical to SEQ ID NO: 83279
  misc_feature 1..34: note = chr19:36267492-36267526
  misc_feature 1..34: note = Hypo
  source 1..34: mol_type = genomic DNA

SEQ ID NO: 116119 - DNA, 83 bp, Homo sapiens; identical to SEQ ID NO: 83280
  misc_feature 1..83: note = chr19:36280047-36280130
  misc_feature 1..83: note = Hypo
  source 1..83: mol_type = genomic DNA

SEQ ID NO: 116120 - DNA, 482 bp, Homo sapiens; identical to SEQ ID NO: 83281
  misc_feature 1..482: note = chr19:36334909-36335391
  misc_feature 1..482: note = Hyper
  source 1..482: mol_type = genomic DNA

SEQ ID NO: 116121 - DNA, 359 bp, Homo sapiens; identical to SEQ ID NO: 83282
  misc_feature 1..359: note = chr19:36336410-36336769
  misc_feature 1..359: note = Hyper
  source 1..359: mol_type = genomic DNA

SEQ ID NO: 116122 - DNA, 147 bp, Homo sapiens; identical to SEQ ID NO: 83283
  misc_feature 1..147: note = chr19:36336989-36337136
  misc_feature 1..147: note = Hyper
  source 1..147: mol_type = genomic DNA

SEQ ID NO: 116123 - DNA, 146 bp, Homo sapiens; identical to SEQ ID NO: 83284
  misc_feature 1..146: note = chr19:36342250-36342396
  misc_feature 1..146: note = Hyper
  source 1..146: mol_type = genomic DNA

SEQ ID NO: 116124 - DNA, 256 bp, Homo sapiens; identical to SEQ ID NO: 83285
  misc_feature 1..256: note = chr19:36347809-36348065
  misc_feature 1..256: note = Hyper
  source 1..256: mol_type = genomic DNA

SEQ ID NO: 116125 - DNA, 580 bp, Homo sapiens; identical to SEQ ID NO: 83286
  misc_feature 1..580: note = chr19:36351788-36352368
  misc_feature 1..580: note = Hyper
  source 1..580: mol_type = genomic DNA

SEQ ID NO: 116126 - DNA, 83 bp, Homo sapiens; identical to SEQ ID NO: 83287
  misc_feature 1..83: note = chr19:36353747-36353830
  misc_feature 1..83: note = Hypo
  source 1..83: mol_type = genomic DNA

SEQ ID NO: 116127 - DNA, 56 bp, Homo sapiens; identical to SEQ ID NO: 83288
  misc_feature 1..56: note = chr19:36360563-36360619
  misc_feature 1..56: note = Hyper
  source 1..56: mol_type = genomic DNA

SEQ ID NO: 116128 - DNA, 230 bp, Homo sapiens; identical to SEQ ID NO: 83289
  misc_feature 1..230: note = chr19:36361080-36361310
  misc_feature 1..230: note = Hyper
  source 1..230: mol_type = genomic DNA

SEQ ID NO: 116129 - DNA, 30 bp, Homo sapiens; identical to SEQ ID NO: 83290
  misc_feature 1..30: note = chr19:36442475-36442505
  misc_feature 1..30: note = Hypo
  source 1..30: mol_type = genomic DNA

SEQ ID NO: 116130 - DNA, 733 bp, Homo sapiens
  misc_feature 1..733: note = chr19:36449856-36450589
  misc_feature 1..733: note = Hyper
  source 1..733: mol_type = genomic DNA
tggttccctcaagcccgacggacgtctgtgttttatgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgcagggctcgcggcaggcggcgctgtgcaagcagcgacgtcgcggcccgaggaagtggaggcggtgaacgcgcgtgggcgcgcctcccgggacacggcgctggctctgcggcgctacctgctgggcactccctaatcgatggtgacgccgtcgctgccgcccggcgaccggcacaaggagtttgcggtggtggcgggcgctgggcccacgctcttgaggcgcctcaagccccctaagcctgttctgctggaccgcgtaggccaccctgcccgctggccccatccattgagccttgaaggcttccagaggcgctgcagttgcagagagcaggagacctatccggcacccgcgtcgtggccgcccatcctgtcgcgctgctggctggcctcagttgtctgcaagcgagaagcaaggcctgtggccacgcgtttggacgaccgccgccccagggtcgctggagtggtctccacacggtgccccactttg

SEQ ID NO: 116131 - DNA, 154 bp, Homo sapiens; identical to SEQ ID NO: 83293
  misc_feature 1..154: note = chr19:36478149-36478303
  misc_feature 1..154: note = Hyper
  source 1..154: mol_type = genomic DNA

SEQ ID NO: 116132 - DNA, 654 bp, Homo sapiens; identical to SEQ ID NO: 83295
  misc_feature 1..654: note = chr19:36523267-36523921
  misc_feature 1..654: note = Hyper
  source 1..654: mol_type = genomic DNA

SEQ ID NO: 116133 - DNA, 21 bp, Homo sapiens
  misc_feature 1..21: note = chr19:36546792-36546813
  misc_feature 1..21: note = Hypo
  source 1..21: mol_type = genomic DNA
gggcgcggtagctcacgtctg

SEQ ID NO: 116134 - DNA, 187 bp, Homo sapiens; identical to SEQ ID NO: 83297
  misc_feature 1..187: note = chr19:36547420-36547607
  misc_feature 1..187: note = Hypo
  source 1..187: mol_type = genomic DNA

SEQ ID NO: 116135 - DNA, 454 bp, Homo sapiens; identical to SEQ ID NO: 83298
  misc_feature 1..454: note = chr19:36604324-36604778
  misc_feature 1..454: note = Hypo
  source 1..454: mol_type = genomic DNA

SEQ ID NO: 116136 - DNA, 165 bp, Homo sapiens; identical to SEQ ID NO: 83299
  misc_feature 1..165: note = chr19:36640992-36641157
  misc_feature 1..165: note = Hypo
  source 1..165: mol_type = genomic DNA

SEQ ID NO: 116137 - DNA, 196 bp, Homo sapiens; identical to SEQ ID NO: 45849
  misc_feature 1..196: note = chr19:36704661-36704857
  misc_feature 1..196: note = Hypo
  source 1..196: mol_type = genomic DNA

SEQ ID NO: 116138 - DNA, 753 bp, Homo sapiens
  misc_feature 1..753: note = chr19:36736016-36736769
  misc_feature 1..753: note = Hyper
  source 1..753: mol_type = genomic DNA
agacccggcgagcctcgctgcccttgcgagagccatggattcgcatttgcgcagagtcggggtctgttgctacgggtcccctgggctcctttgaatcgctttggcagctccctcggtttagagctacagggttttctccctcccctgagactctaacgcgtgcaccaactcgcgcctagagggcgtgtatgaccccagctcagttctaagccgaggggctgctgccggacattctagggtctgatctggcgggctcgaagggaggacagtcactgcgacccggaaagctccgcgcttacgacgcccacccagaaaatccggatcacatttcccgtggtccaccgcgcatctaggaggttacctgcgtccaggcggtgacttgcgagggaccacctttcccagggtccacggcgcatttaggtggtggcttgctctggactacatttcccagggtccaccgcggatctaggaggaggcttgagatgcagcctcccagcttcgaggctaccacctgcccgaattggtgctttggcagagtctctggtgcccgggtgaatgggttcagggtctcttaaggaccctccgttgacgatgcctcgagctatgacccaccctggctccgtccacggttgtcggggtcccgggctgcttttcttggagggctcggtgccggaggctactcttgagtcccggttccttcgcccagctgcgggcctcgggctactggatccgctgtctcggtttgggtgcggg

SEQ ID NO: 116139 - DNA, 100 bp, Homo sapiens; identical to SEQ ID NO: 83304
  misc_feature 1..100: note = chr19:36747764-36747864
  misc_feature 1..100: note = Hypo
  source 1..100: mol_type = genomic DNA

SEQ ID NO: 116140 - DNA, 650 bp, Homo sapiens
  misc_feature 1..650: note = chr19:36822242-36822892
  misc_feature 1..650: note = Hyper
  source 1..650: mol_type = genomic DNA
ataaacctcaacctgcgggtcactccctcccaggcgtgcaacaaaacacctgcctagaaatcaaaaggcgttttacccgagtgggctgaaaaagccccgtttttacctttaatctggagacaatacgggtcagaggtcaggaaactacatcagcgccagtgcgagcgcccacgagtccggtggacggatgagaaacggccggggggcagcctgagtcccagttcccgccgtggcaatggccaatttcccacccgtggacgcaaaaggccaggactccacgctgctgaccctccagcgtcccatgtccggcaggcacgtggccgaatagcccaagactgaggactcacacttcccactttgcacctggaggccacctgcagaccaaccttgcgccaggcttccggaaatgggagggcgggcttccggaaacggcggccaatgggaaacgtgatcagatgttactaggcagacagtccgtttccaggcaacacagaagaaaggaacgcgctcagtcagcctcaaatagacggagatttcagccaatggatgtgcaggttccctccacattagccaataagaagtgcttggggcctacctgcctacaagcacagcaaaagctttcctgcgcatttttgcgctggaatggctac

SEQ ID NO: 116141 - DNA, 105 bp, Homo sapiens; identical to SEQ ID NO: 83307
  misc_feature 1..105: note = chr19:36881579-36881684
  misc_feature 1..105: note = Hypo
  source 1..105: mol_type = genomic DNA

SEQ ID NO: 116142 - DNA, 30 bp, Homo sapiens; identical to SEQ ID NO: 83308
  misc_feature 1..30: note = chr19:36904317-36904347
  misc_feature 1..30: note = Hypo
  source 1..30: mol_type = genomic DNA

SEQ ID NO: 116143 - DNA, 867 bp, Homo sapiens
  misc_feature 1..867: note = chr19:36909068-36909935
  misc_feature 1..867: note = Hyper
  source 1..867: mol_type = genomic DNA
ctcgctctcccagagctctgggattacagatgtgagccacctggtccggcctagtctgcgcgtttctgctgggagtctttggcgtgcagaaactgaccgagggccatttctctgcagctgggcccggtgtgggcagaggatgctggggtcagtcacgcactccacggccacaacaaccttcgctcatacaatagtctctgcacccaagtcagccgcacagactccgtcacgtcccagccccggccccgtcacgcccacgacacacacacccgggcctgaggcgcgggctcccgcccctctgcgatactgcagtggccccgcttacctctctttaccccctgggccgcagcgcttttcctacagattaccaggaccgacgctccgggccaggactgctcactcggggcgcgaacccgaggcacagcgatgcccgaacggaggaagccgctgccgggtcacgccacaatccccggggcctaacgggctgcgcgcggaggctgctgggagggccgggcgcgctcacggagtgcgcaggcgcggccagtctcaagggtccgctcgctggtgcagcccctgctctgcgtgaacccggagccggagctaggtccgtcccagcgaggctgcgcttcgagtcccttagcgcctggggacggcgcggcagggcctggaggggagcggggacagatggctggcgcgttaaagaggggcgcccgcgaccgcctctctatagtgccaactagggagccctgtgagcgaggacggcgctgcgagtctgtccctggcgcgctcctgggtgggattctttcactgggtgtggctgttgggatttgagaccgtgtgactccggagattcggggaagccagttc

SEQ ID NO: 116144 - DNA, 284 bp, Homo sapiens
  misc_feature 1..284: note = chr19:36912309-36912593
  misc_feature 1..284: note = Hyper
  source 1..284: mol_type = genomic DNA
ggactgctcagccaccggccgctcccggcaccaggggacgccggacgccctctggacaatcggcgcacttgccacgatcttggacgggcctcgggcctcgaccttaagattccccgctccagctccgagatgtcagcaacgctgatcctggagcccgcgggccgcggctgccgagacaagccggtgcgcatcaccatgcgcggcctggcttcggagccgctggacacgctgcgcgcgcgtccctgcgcgacgagaaggctgggctcttccgctactgcgccgac

SEQ ID NO: 116145 - DNA, 32 bp, Homo sapiens; identical to SEQ ID NO: 83313
  misc_feature 1..32: note = chr19:36912845-36912877
  misc_feature 1..32: note = Hyper
  source 1..32: mol_type = genomic DNA

SEQ ID NO: 116146 - DNA, 38 bp, Homo sapiens; identical to SEQ ID NO: 83314
  misc_feature 1..38: note = chr19:36993076-36993114
  misc_feature 1..38: note = Hypo
  source 1..38: mol_type = genomic DNA

SEQ ID NO: 116147 - DNA, 271 bp, Homo sapiens; identical to SEQ ID NO: 83315
  misc_feature 1..271: note = chr19:37064089-37064360
  misc_feature 1..271: note = Hyper
  source 1..271: mol_type = genomic DNA

SEQ ID NO: 116148 - DNA, 127 bp, Homo sapiens; identical to SEQ ID NO: 83316
  misc_feature 1..127: note = chr19:37064635-37064762
  misc_feature 1..127: note = Hyper
  source 1..127: mol_type = genomic DNA

SEQ ID NO: 116149 - DNA, 25 bp, Homo sapiens
  misc_feature 1..25: note = chr19:37093816-37093841
  misc_feature 1..25: note = Hypo
  source 1..25: mol_type = genomic DNA
agtgaaactccgtctcaaaagaaaa

SEQ ID NO: 116150 - DNA, 929 bp, Homo sapiens
  misc_feature 1..929: note = chr19:37095665-37096594
  misc_feature 1..929: note = Hyper
  source 1..929: mol_type = genomic DNA
cacattcatagtcaccgctcagcgccgtcacacaaacggccccgcccccactcagtcccgcgggcccaatcggggacagtcagggctgtcccgggctgtgcacctgctgtgcacacacaccccctgctgtgcacaccccccgcccccccgggaccatcacaggcgcgcccactcacaccaccacacacggacgcagccacagaacggcacacacaaacacaatcacacagtctccctccccagcaggtgacttgcacacaggcctggggcttctgcctccacaaaccctctccgcgtcccatgaacccaggtcccctgccgtgagctcttctcgcatccagacccgggtcacctcaactcaccacatggaaaacgaacaccaggtcaacggaaaagggagccggggtcctggcagaagcgtagtgccagccgcaatagggcggccgtgggtgcaaacggaggggagcgccggcagctagcaccgcgcggcgactaacgggccgccccggagactcctgggagctcaggcccacgcgcgagtgcgcaggcgcagacgactcaccctgggccgggggtgaggcttggtgggtgccaggggtgctgaggaggccaaggagggcactgggagctccgttccgggagagctgtctaaggacgcggaaccgggtggggaggccagggaggtaaccaagagtccgagccgggcctggaaattctgaggaggaaaccgggaccgcggtatccagacgctccgatctgtacgagccgggcctcgggcgtggtccatgggcgtgaccttgagggtgacccggagcgagctccgcgaagggggattttgcccgttctgatcccgcggaagcgccatcgctggcggcgggtccccgcgcggagcgggcgctgtgtgttcgcgcgcgcgggcgcgcgctgaa

SEQ ID NO: 116151 - DNA, 135 bp, Homo sapiens; identical to SEQ ID NO: 83320
  misc_feature 1..135: note = chr19:37108753-37108888
  misc_feature 1..135: note = Hypo
  source 1..135: mol_type = genomic DNA

SEQ ID NO: 116152 - DNA, 30 bp, Homo sapiens; identical to SEQ ID NO: 45851
  misc_feature 1..30: note = chr19:37110908-37110938
  misc_feature 1..30: note = Hypo
  source 1..30: mol_type = genomic DNA

SEQ ID NO: 116153 - DNA, 880 bp, Homo sapiens; identical to SEQ ID NO: 83322
  misc_feature 1..880: note = chr19:37157302-37158182
  misc_feature 1..880: note = Hyper
  source 1..880: mol_type = genomic DNA

SEQ ID NO: 116154 - DNA, 87 bp, Homo sapiens; identical to SEQ ID NO: 83323
  misc_feature 1..87: note = chr19:37159081-37159168
  misc_feature 1..87: note = Hypo
  source 1..87: mol_type = genomic DNA

SEQ ID NO: 116155 - DNA, 38 bp, Homo sapiens; identical to SEQ ID NO: 83325
  misc_feature 1..38: note = chr19:37179419-37179457
  misc_feature 1..38: note = Hypo
  source 1..38: mol_type = genomic DNA

SEQ ID NO: 116156 - DNA, 28 bp, Homo sapiens
  misc_feature 1..28: note = chr19:37260522-37260550
  misc_feature 1..28: note = Hypo
  source 1..28: mol_type = genomic DNA
aataaaaattcagcgatggagttgatgg

SEQ ID NO: 116157 - DNA, 1072 bp, Homo sapiens; identical to SEQ ID NO: 83327
  misc_feature 1..1072: note = chr19:37263321-37264393
  misc_feature 1..1072: note = Hyper
  source 1..1072: mol_type = genomic DNA

SEQ ID NO: 116158 - DNA, 30 bp, Homo sapiens; identical to SEQ ID NO: 83328
  misc_feature 1..30: note = chr19:37286524-37286554
  misc_feature 1..30: note = Hypo
  source 1..30: mol_type = genomic DNA

SEQ ID NO: 116159 - DNA, 32 bp, Homo sapiens; identical to SEQ ID NO: 37459
  misc_feature 1..32: note = chr19:37287904-37287936
  misc_feature 1..32: note = Hyper
  source 1..32: mol_type = genomic DNA

SEQ ID NO: 116160 - DNA, 571 bp, Homo sapiens
  misc_feature 1..571: note = chr19:37288236-37288807
  misc_feature 1..571: note = Hyper
  source 1..571: mol_type = genomic DNA
cacttcttattggctaatctggagcaaacctgcatatccattggctgaaagctccgtctattttagggtgactgagagcgtctcttccttctgtgttgcctggaaacggactgttcgcctagtaacatctgatcacgtttcccattggtcaccgtttccggaagcccgctctcccgtttccggaatccccgcaggcgctgggtctgcagatggcgtccaggtacacagtggcgagtgtgattccgcagtcttgggctgtttggccaagcgcccgccggacatggtacgccgaagggtcatcggcgtggagtcctcgctttcagcgtccgcggctgggaaatcggccatcgctacggcgggaactgggactcgggctgcgtcccggcccttccacatcggtccaccgcactcgtgggcgcccgcattggtgctgacataatttcctgacctctgacccgtattgtctcgcgattaaaggtaaaaaacggggctttttcatcccactggggtaaaacgcccttttatttctagccaggtgttctgttgcagaacgcctcgaagggagggagtg

SEQ ID NO: 116161 - DNA, 17 bp, Homo sapiens
  misc_feature 1..17: note = chr19:37292008-37292025
  misc_feature 1..17: note = Hypo
  source 1..17: mol_type = genomic DNA
ggcgcttggccaagggg

SEQ ID NO: 116162 - DNA, 30 bp, Homo sapiens; identical to SEQ ID NO: 83334
  misc_feature 1..30: note = chr19:37295038-37295068
  misc_feature 1..30: note = Hypo
  source 1..30: mol_type = genomic DNA

SEQ ID NO: 116163 - DNA, 210 bp, Homo sapiens; identical to SEQ ID NO: 83335
  misc_feature 1..210: note = chr19:37328802-37329012
  misc_feature 1..210: note = Hyper
  source 1..210: mol_type = genomic DNA

SEQ ID NO: 116164 - DNA, 390 bp, Homo sapiens
  misc_feature 1..390: note = chr19:37329072-37329462
  misc_feature 1..390: note = Hyper
  source 1..390: mol_type = genomic DNA
tgcatcaatttcactctcgcatccactgctcccatcgcgatcgctcgcccccacgctccctcgccggcaaagccaccaactccaaagacattagcacctcactcccctcagccccggcctcgggccctccggagtcattcggcttctgtgtctcggaatcactcacccggccctgcggtcccttgatggtggaaggttccgcgatctttctattaaccctaaagggacagagggctgacaggaagttgcccggggaacggtgcactctgggaaatgtagtccggagcctgggccgtctttaactgccccggacaccgcggtcaccattaacggaccctgcatttgagccccatcccctcgctgggcaaagaccatcgcccacacaccgct

SEQ ID NO: 116165 - DNA, 535 bp, Homo sapiens
  misc_feature 1..535: note = chr19:37340723-37341258
  misc_feature 1..535: note = Hyper
  source 1..535: mol_type = genomic DNA
aatatgacctccccacgcccaaagctgcacacatcttgacctcacttctctcacacacacaccaatctgacccgcacgcggtttctttcactcaactacccagacacccctcatcccaccagcacaagcaggcccaccgcggtctcacacacactcgagccttcctttgcccagtctcacatgcatgactgggatcgcggatttgtccccttccgactccccatgctggttcggtcccagacgctcaggtgccacattggggtgcgctctcccggctcctccacacgctacgcagctgcccgcctcaagagcgtctgcgtgcttccagcgttaagtggaattccaagcagcctccggggcacagttagtctggtcactgcggccagactgccgcctcaggacccagagaacgcagcacactttagttgggcccatctatccccggcgaggcttggactacgtttcccaggagaccctgcggtccagtatgtctcccgaggaggggcggaagcccgggagccgccctctgaggctg

SEQ ID NO: 116166 - DNA, 720 bp, Homo sapiens; identical to SEQ ID NO: 83340
  misc_feature 1..720: note = chr19:37341469-37342189
  misc_feature 1..720: note = Hyper
  source 1..720: mol_type = genomic DNA

SEQ ID NO: 116167 - DNA, 30 bp, Homo sapiens; identical to SEQ ID NO: 83341
  misc_feature 1..30: note = chr19:37406378-37406408
  misc_feature 1..30: note = Hypo
  source 1..30: mol_type = genomic DNA

SEQ ID NO: 116168 - DNA, 825 bp, Homo sapiens
  misc_feature 1..825: note = chr19:37406765-37407590
  misc_feature 1..825: note = Hyper
  source 1..825: mol_type = genomic DNA
ctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaatggagatgagcctcccggggaacccggcccaagcctcaccctcacacaggaaagcagatgtgttctggccggaagttgagtggggccgcggggcctgctgggaggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatgg

SEQ ID NO: 116169 - DNA, 772 bp, Homo sapiens
  misc_feature 1..772: note = chr19:37463993-37464765
  misc_feature 1..772: note = Hyper
  source 1..772: mol_type = genomic DNA
ccagtgaccgtggtgcggtccaggccccgggtggcgcacccacctctggactacatttcccagggggccccgcggccaaccttttccggccgaagaaggctagtcacctttccttggcgggtgttggaaagcaaagggctggaacgtcccgggctgcggagctcgctgggttgggatggactcgttcagacctgagtgctaggacgccgaagggggcggtgaggcgtcccggcgaggagctggggtcgtctggagtttaaaagacaggtggctctcggagatgtgcgggctgcatgcccacgcttcaccgctaggggaggtcagggctgtgcgatggggaaggaagagagtgtcggggcggtgcagtcgggatgggagaagggtgtcagggccactggcccccagctcggcagagggcagtgtcgggccgcgcgcaggcagggagtgggtgtggtgtgaggctggcgctggagcggtctgggaatgttaggaggtctagggtatcgcggccctgcgtcctcttgtctggactaaaagtccgggcagttctccccggacctggattgtgggcccagcgacaggtgcttggcgatctgtgcccgctgtgcctgcggggctgtggtgggagtcctgtctgcacggtattctgtgtggctgtgcatgtaagtgtgagcgtgtgccgggtcatcgaccccatctttgggaggcctgggagggggcgggacaccctcgctgtacattctggggatacgctgggcggggtctgccctgt

SEQ ID NO: 116170 - DNA, 89 bp, Homo sapiens; identical to SEQ ID NO: 83348
  misc_feature 1..89: note = chr19:37500805-37500894
  misc_feature 1..89: note = Hypo
  source 1..89: mol_type = genomic DNA

SEQ ID NO: 116171 - DNA, 134 bp, Homo sapiens; identical to SEQ ID NO: 83349
  misc_feature 1..134: note = chr19:37502995-37503129
  misc_feature 1..134: note = Hypo
  source 1..134: mol_type = genomic DNA

SEQ ID NO: 116172 - DNA, 30 bp, Homo sapiens; identical to SEQ ID NO: 83350
  misc_feature 1..30: note = chr19:37504196-37504226
  misc_feature 1..30: note = Hypo
  source 1..30: mol_type = genomic DNA

SEQ ID NO: 116173 - DNA, 18 bp, Homo sapiens
  misc_feature 1..18: note = chr19:37551294-37551312
  misc_feature 1..18: note = Hypo
  source 1..18: mol_type = genomic DNA
ctcctcccctcagcccgt

SEQ ID NO: 116174 - DNA, 41 bp, Homo sapiens; identical to SEQ ID NO: 83352
  misc_feature 1..41: note = chr19:37557046-37557087
  misc_feature 1..41: note = Hypo
  source 1..41: mol_type = genomic DNA

SEQ ID NO: 116175 - DNA, 30 bp, Homo sapiens; identical to SEQ ID NO: 83353
  misc_feature 1..30: note = chr19:37569468-37569498
  misc_feature 1..30: note = Hyper
  source 1..30: mol_type = genomic DNA

SEQ ID NO: 116176 - DNA, 310 bp, Homo sapiens; identical to SEQ ID NO: 83355
  misc_feature 1..310: note = chr19:37663494-37663804
  misc_feature 1..310: note = Hyper
  source 1..310: mol_type = genomic DNA

SEQ ID NO: 116177 - DNA, 15 bp, Homo sapiens
  misc_feature 1..15: note = chr19:37693192-37693207
  misc_feature 1..15: note = Hypo
  source 1..15: mol_type = genomic DNA
cggcacccggcctca

SEQ ID NO: 116178 - DNA, 84 bp, Homo sapiens; identical to SEQ ID NO: 83357
  misc_feature 1..84: note = chr19:37702085-37702169
  misc_feature 1..84: note = Hypo
  source 1..84: mol_type = genomic DNA

SEQ ID NO: 116179 - DNA, 30 bp, Homo sapiens; identical to SEQ ID NO: 83361
  misc_feature 1..30: note = chr19:37795994-37796024
  misc_feature 1..30: note = Hypo
  source 1..30: mol_type = genomic DNA

SEQ ID NO: 116180 - DNA, 30 bp, Homo sapiens; identical to SEQ ID NO: 83362
  misc_feature 1..30: note = chr19:37803863-37803893
  misc_feature 1..30: note = Hyper
  source 1..30: mol_type = genomic DNA

SEQ ID NO: 116181 - DNA, 30 bp, Homo sapiens; identical to SEQ ID NO: 83366
  misc_feature 1..30: note = chr19:37933859-37933889
  misc_feature 1..30: note = Hypo
  source 1..30: mol_type = genomic DNA

SEQ ID NO: 116182 - DNA, 73 bp, Homo sapiens; identical to SEQ ID NO: 83367
  misc_feature 1..73: note = chr19:37940221-37940294
  misc_feature 1..73: note = Hypo
  source 1..73: mol_type = genomic DNA

SEQ ID NO: 116183 - DNA, 30 bp, Homo sapiens; identical to SEQ ID NO: 83368
  misc_feature 1..30: note = chr19:37947570-37947600
  misc_feature 1..30: note = Hypo
  source 1..30: mol_type = genomic DNA

SEQ ID NO: 116184 - DNA, 935 bp, Homo sapiens; identical to SEQ ID NO: 83369
  misc_feature 1..935: note = chr19:37957671-37958606
  misc_feature 1..935: note = Hyper
  source 1..935: mol_type = genomic DNA

SEQ ID NO: 116185 - DNA, 1043 bp, Homo sapiens
  misc_feature 1..1043: note = chr19:37959786-37960829
  misc_feature 1..1043: note = Hyper
  source 1..1043: mol_type = genomic DNA
cctcccaatttttttcgggtatccagcacaattctaggaattcgcctcccacccattttgagtagacgcgccactagcgcgttcccacgcacaaaccttttccctgcggccaacctgcgattctcaactccccgccctggttgctaagggaggcgcgcagagcgcttgtgcctgcgcacttccacaccagcccgtgtagtgtgacgctgggccccgtccctgtgaccgggccaggctcggagctgcagggaatccggactttcgggctctctggaaggccggggagaggccagtgtgggaggacctggtggggaggaggccgtgttacaaaccctgcgcggagctgcaccgctgctgccagacactgcgacgccgcgaccttttctactccggactacgtttcccagcggaccccgcgggagttgggccggcggcccctttgtgtcctccgggggcggaggcagctgaggcgcttctttccgggcccgtaagggctgggttccatccaactaagggtagcggtgagacccgagtgcagattccccgagccttcggggcaggaaggagatcttccaccagttctgttctgcaggtcgggagtgggctgaggagtggcgtgtgggtctccggaagctcgtcgcaggccatctgtgtgactccggtgcgagtggaggttggtaccgttcagtgcgaggctgtcaccccgtgtgcctgtccacgtcctgtgtgactgggtgcgaggaagtcaatggcaccgtggaatgtgaggctgtgagttgaggcgggagcgggcgactgttcgctgcaccttgttgggccgatacccgcggcttctttgtgactgggttgtgagattgtcgcttgtgatagataccctggtggctgagccttgccggtatgggaaagggtgcccgtgtgaggcagtccatacccatggcctctgactgtggcgtgggtaagacggtggttggcactgtagtttttcagactctgattatgtgggggattgagtgagagactgtgtgccacggagaggcttttaa

SEQ ID NO: 116186 - DNA, 99 bp, Homo sapiens; identical to SEQ ID NO: 83372
  misc_feature 1..99: note = chr19:37995676-37995775
  misc_feature 1..99: note = Hypo
  source 1..99: mol_type = genomic DNA

SEQ ID NO: 116187 - DNA, 1034 bp, Homo sapiens
  misc_feature 1..1034: note = chr19:37997089-37998123
  misc_feature 1..1034: note = Hyper
  source 1..1034: mol_type = genomic DNA
tatgcactgtatattcgttcccatcgctcccgtctcacttctccatcccccacctaccaaataaactgcttgcactcattctttcctcaggtcggcttctcgggcaagcctccttaggtaaaaaccttgctttcaacatttcctttccattatgcgctaagaactctgatctcttcccgctgcggcagccccgccctttccttgcggctccgccctttccgtgaagtcacgcccgtccttaggctgtctctgtctccctaagagcgagtctcttcgctgctctctaactcctagagctggctcagaaagagtttcacattgccataggggagctcctaggagaggctgcacccattgcacgtaagaagcggtaaaaatgtacgcggccatcttaccaggctgccggagacaaagaaagctcagctttgatgtctgggcgccaccatgttggccacaggaggttttggcatctgagatgctgagttaagagcagagacgacatctctgtttagggatccagggacacttccttctccttgtcctaaaatagccttatcttttggtctagcaaagggcttaatcatccgttttacggcacagttttaaacatggccgccccaggtaggagtcaagtgggcgtcgccatcatacctccaattacagctttgagaaacccagaatcctgttcactggaaggttgccgggtggcggctgacagcctcaaagtcgcaattgagtctgcgcaccggccattcaggatgggacgaccttataccgcggtgaggcggcgtggcaggacgaccaatttcagattcagggcgcggatgcagcataaatgggaaggcacggtttgagaaacggtcaaacctgggactagtggaggatagtgagctgccgactacggtggccgactgggtcagctatgggtgcccgtgagggtcaatgacaagggaactgaagggttaagagattcggcgtctgagcctcgcggggcctcagtggtggcggacagaggtttgcgggagtcagtggca

SEQ ID NO: 116188 - DNA, 503 bp, Homo sapiens; identical to SEQ ID NO: 83378
  misc_feature 1..503: note = chr19:38042365-38042868
  misc_feature 1..503: note = Hyper
  source 1..503: mol_type = genomic DNA

SEQ ID NO: 116189 - DNA, 437 bp, Homo sapiens; identical to SEQ ID NO: 83379
  misc_feature 1..437: note = chr19:38085240-38085677
  misc_feature 1..437: note = Hyper
  source 1..437: mol_type = genomic DNA

SEQ ID NO: 116190 - DNA, 111 bp, Homo sapiens; identical to SEQ ID NO: 83380
  misc_feature 1..111: note = chr19:38086051-38086162
  misc_feature 1..111: note = Hyper
  source 1..111: mol_type = genomic DNA

SEQ ID NO: 116191 - DNA, 21 bp, Homo sapiens
  misc_feature 1..21: note = chr19:38088612-38088633
  misc_feature 1..21: note = Hypo
  source 1..21: mol_type = genomic DNA
ccactgcgcccagccagcaaa

SEQ ID NO: 116192 - DNA, 83 bp, Homo sapiens; identical to SEQ ID NO: 83382
  misc_feature 1..83: note = chr19:38107062-38107145
  misc_feature 1..83: note = Hypo
  source 1..83: mol_type = genomic DNA

SEQ ID NO: 116193 - DNA, 22 bp, Homo sapiens
  misc_feature 1..22: note = chr19:38107205-38107227
  misc_feature 1..22: note = Hypo
  source 1..22: mol_type = genomic DNA
gcctgggcgacatagcgagagt

SEQ ID NO: 116194 - DNA, 30 bp, Homo sapiens; identical to SEQ ID NO: 83384
  misc_feature 1..30: note = chr19:38145556-38145586
  misc_feature 1..30: note = Hyper
  source 1..30: mol_type = genomic DNA

SEQ ID NO: 116195 - DNA, 1313 bp, Homo sapiens; identical to SEQ ID NO: 83385
  misc_feature 1..1313: note = chr19:38146010-38147323
  misc_feature 1..1313: note = Hyper
  source 1..1313: mol_type = genomic DNA

SEQ ID NO: 116196 - DNA, 717 bp, Homo sapiens
  misc_feature 1..717: note = chr19:38182757-38183474
  misc_feature 1..717: note = Hyper
  source 1..717: mol_type = genomic DNA
tcaccattttacagtcgaagaagggaagataagaggcggtgaatccgagactttcattcaggtgacgatccctcgcgggcactcactctcgctcacactacaatcagatcctccatgcggctttcatatactctgtcacactcgcagccagaatcccctcggatggactcttgcaaacctccagccccatcccgggatccgtgcgtcttctacagccaccacttgggccagcgtccaggacgcccaagcgtaacctccccactctaaaccgttaggaatcagtggctggactcaccgcgtcataaaagcataaactgtgacccgatgagtccgcgcactcggaaaacaagagaacgctcccacgtctccgggcgcagcttgtgccagcgactactaggtcagggggcgcagctgagagaattcaagcaacctccccgcaaccggttccgccgcgtttgtgggctggtagcccggaatacatttcccagaggccttcgcggccgacgtgcttcgcgcaggaacgcagccgcctcccgactggaggacgcggtagcggagctgctcaaagcgaggtgctcagccctgggaggctcagggctgcccgaggggcttagtcccagagccagtgctgtcaggggctgagcatgtgaatagggcagtcggaagaccatgtgtgtctgtggcttttaaatacaccccgaacgtctatctctttta

SEQ ID NO: 116197 - DNA, 734 bp, Homo sapiens
  misc_feature 1..734: note = chr19:38210017-38210751
  misc_feature 1..734: note = Hyper
  source 1..734: mol_type = genomic DNA
tttctctgttgtagtcgtactaggctgaggaaggcacaggaagcagcagggaacctggagccaagggtcaatagaccccacagagcccagcgaagcacgctttacaaaggacacacacggcatgtacaggtcacacaaggtcgactacgcacccctcacagtcccgcaactgcacccacgtcacacaggcaagccggtcctgtcgccgctgcgcggtctctcacgctccccgcctgtctcctagagacgggcccctcctccgcagctccagcaccctagggcctgaggaggcgggagactcgcccggcccgcctgggggcctccgcgctctgagcgcctcctgcagccccactctcaccgccacgcagggtaccacgcgggcggcgggctggggctgcagaggctcccgcagtgacctgcgccgccttcttcaggtggaaccaaaaggtcccggaaccggagccaggggtccaagttttctccgttgcctttgtaatatgtagtccaagccagaacagtcaggaccgcaggtaccggtgagaaatggagtccagaatcctaaaaacctacgagaaatacggcagcgaccacttggaccgcgcctcccacccaccgctcgagccccggagacttctgggagtggccgccttgcctcgagtgcgcatgcgcagatcggccactactgggcccctggcctgaggcttagggtggagttagtgcgttcttagggccag

SEQ ID NO: 116198 - DNA, 103 bp, Homo sapiens; identical to SEQ ID NO: 83396
  misc_feature 1..103: note = chr19:38228266-38228369
  misc_feature 1..103: note = Hypo
  source 1..103: mol_type = genomic DNA

SEQ ID NO: 116199 - DNA, 46 bp, Homo sapiens; identical to SEQ ID NO: 83398
  misc_feature 1..46: note = chr19:38287099-38287145
  misc_feature 1..46: note = Hypo
  source 1..46: mol_type = genomic DNA

SEQ ID NO: 116200 - DNA, 418 bp, Homo sapiens
  misc_feature 1..418: note = chr19:38308121-38308539
  misc_feature 1..418: note = Hyper
  source 1..418: mol_type = genomic DNA
ttggtcctttggctccgcgctgcgcgtgacctgcagtcacctgagcaagagggcggcgtgggtcgctgcgggagcccctacagccccagcccgcagcccacgtggcaccctacagggctgtgagagtggggctgctggaggcgttcagagcgcggaggccccaggcgcgggccgggctctctcccgcctcctcaggcccgggggtgctggagctgccgaggtgggggctcatctttgggagacaggtggggagtgtgagagaccgcgcagcggcgacagggccgggcgtgcctgtgtgacgtgggtgcagctgtgggactgtgaggggtgcgtggtcgaccttgcgtaacctggatgtgcagtgcgtgtcctttgcaaagcgtgcgttgctgtggctccgtggcgtcagcaacccttc

SEQ ID NO: 116201 - DNA, 26 bp, Homo sapiens
  misc_feature 1..26: note = chr19:38309113-38309139
  misc_feature 1..26: note = Hypo
  source 1..26: mol_type = genomic DNA
tagaataaagtaattcggccgggcgt

SEQ ID NO: 116202 - DNA, 64 bp, Homo sapiens; identical to SEQ ID NO: 83402
  misc_feature 1..64: note = chr19:38481038-38481102
  misc_feature 1..64: note = Hypo
  source 1..64: mol_type = genomic DNA

SEQ ID NO: 116203 - DNA, 30 bp, Homo sapiens; identical to SEQ ID NO: 83404
  misc_feature 1..30: note = chr19:38554526-38554556
  misc_feature 1..30: note = Hypo
  source 1..30: mol_type = genomic DNA

SEQ ID NO: 116204 - DNA, 30 bp, Homo sapiens; identical to SEQ ID NO: 83407
  misc_feature 1..30: note = chr19:38684394-38684424
  misc_feature 1..30: note = Hypo
  source 1..30: mol_type = genomic DNA

SEQ ID NO: 116205 - DNA, 30 bp, Homo sapiens; identical to SEQ ID NO: 83408
  misc_feature 1..30: note = chr19:38688124-38688154
  misc_feature 1..30: note = Hypo
  source 1..30: mol_type = genomic DNA

SEQ ID NO: 116206 - DNA, 30 bp, Homo sapiens; identical to SEQ ID NO: 83411
  misc_feature 1..30: note = chr19:38700527-38700557
  misc_feature 1..30: note = Hyper
  source 1..30: mol_type = genomic DNA

SEQ ID NO: 116207 - DNA, 146 bp, Homo sapiens; identical to SEQ ID NO: 83412
  misc_feature 1..146: note = chr19:38701109-38701255
  misc_feature 1..146: note = Hyper
  source 1..146: mol_type = genomic DNA

SEQ ID NO: 116208 - DNA, 662 bp, Homo sapiens; identical to SEQ ID NO: 83413
  misc_feature 1..662: note = chr19:38701550-38702212
  misc_feature 1..662: note = Hyper
  source 1..662: mol_type = genomic DNA

SEQ ID NO: 116209 - DNA, 92 bp, Homo sapiens; identical to SEQ ID NO: 37493
  misc_feature 1..92: note = chr19:38718791-38718883
  misc_feature 1..92: note = Hyper
  source 1..92: mol_type = genomic DNA

SEQ ID NO: 116210 - DNA, 33 bp, Homo sapiens; identical to SEQ ID NO: 83415
  misc_feature 1..33: note = chr19:38719684-38719717
  misc_feature 1..33: note = Hyper
  source 1..33: mol_type = genomic DNA

SEQ ID NO: 116211 - DNA, 37 bp, Homo sapiens; identical to SEQ ID NO: 83416
  misc_feature 1..37: note = chr19:38719919-38719956
  misc_feature 1..37: note = Hyper
  source 1..37: mol_type = genomic DNA

SEQ ID NO: 116212 - DNA, 220 bp, Homo sapiens; identical to SEQ ID NO: 83417
  misc_feature 1..220: note = chr19:38720219-38720439
  misc_feature 1..220: note = Hyper
  source 1..220: mol_type = genomic DNA

SEQ ID NO: 116213 - DNA, 640 bp, Homo sapiens
  misc_feature 1..640: note = chr19:38746768-38747408
  misc_feature 1..640: note = Hyper
  source 1..640: mol_type = genomic DNA
ccgggctcaccatgccgcggtacagctcctccaggcgcccgtcgatccacttctccacgtccagccgccgctgcagctcccgccggtcatacttgacggtgacgcgcgcgtgccgcttctgcagccccccgggactgccccctggcccgcgggcccgcgatggagactgcagcttgctcagcacgcgcttgcccagccgctgagctgccatcgcgctgctggacccagcctggccccgcgctgtgcgccttcgcctcgcgccccgggtgcttcttacgggccagggcggggctagccgggggcgggggctcgggctcgccgggaggtctgccccaccccggccgcctcaggcctcagtttccccgtctgcagtgcgagagtaggccgctgcgtcggcttgaggcacgcagtcgtgcgaagttgaggtatgggcggggacccagagtcccgggcgggtccctgcatcgggggctcccgggccgggatcctgtggggcgggggcctgggacagacactcgggacccggcctgtctgcgccctctggcggtggcggggtggggggctgttggtgcgggagcgcctgcgccgctgtcgctgtagaaggtcgagcggtcacttgttccttcgttcattcattcac

SEQ ID NO: 116214 - DNA, 32 bp, Homo sapiens; identical to SEQ ID NO: 83421
  misc_feature 1..32: note = chr19:38755286-38755318
  misc_feature 1..32: note = Hyper
  source 1..32: mol_type = genomic DNA

SEQ ID NO: 116215 - DNA, 135 bp, Homo sapiens; identical to SEQ ID NO: 83422
  misc_feature 1..135: note = chr19:38782535-38782670
  misc_feature 1..135: note = Hypo
  source 1..135: mol_type = genomic DNA

SEQ ID NO: 116216 - DNA, 86 bp, Homo sapiens; identical to SEQ ID NO: 83423
  misc_feature 1..86: note = chr19:38789299-38789385
  misc_feature 1..86: note = Hypo
  source 1..86: mol_type = genomic DNA

SEQ ID NO: 116217 - DNA, 217 bp, Homo sapiens; identical to SEQ ID NO: 83426
  misc_feature 1..217: note = chr19:38828116-38828333
  misc_feature 1..217: note = Hypo
  source 1..217: mol_type = genomic DNA

SEQ ID NO: 116218 - DNA, 60 bp, Homo sapiens; identical to SEQ ID NO: 83427
  misc_feature 1..60: note = chr19:38852327-38852387
  misc_feature 1..60: note = Hyper
  source 1..60: mol_type = genomic DNA

SEQ ID NO: 116219 - DNA, 226 bp, Homo sapiens; identical to SEQ ID NO: 83428
  misc_feature 1..226: note = chr19:38852967-38853193
  misc_feature 1..226: note = Hyper
  source 1..226: mol_type = genomic DNA

SEQ ID NO: 116220 - DNA, 230 bp, Homo sapiens; identical to SEQ ID NO: 45857
  misc_feature 1..230: note = chr19:38873935-38874165
  misc_feature 1..230: note = Hypo
  source 1..230: mol_type = genomic DNA

SEQ ID NO: 116221 - DNA, 397 bp, Homo sapiens
  misc_feature 1..397: note = chr19:38877650-38878047
  misc_feature 1..397: note = Hyper
  source 1..397: mol_type = genomic DNA
atcactggagagggccgttctaaggtgaggggcagggtcgagggtgaggcctggggctcccggggtaccatgagtcccgggggtgtggcgctgccagggaaccagacacccagcccacgagtcaggcgcatggcctgggaggtcatctcgggctccaccagggacgtccggcgggagtcgggggcgcggtccgagggctgcacttttcgggagcccccgcccgcggatggctccgactgcaagttccccatttctgacggagctcggagactagtcagaaaaatttactccagtcagcctgccagggccgtggggaccctacgaggctggctgtacttgatctaatgcgtccgcaccggccccgcccctgttctccaagatccgatcaggcccaagt

SEQ ID NO: 116222 - DNA, 32 bp, Homo sapiens; identical to SEQ ID NO: 83431
  misc_feature 1..32: note = chr19:38879580-38879612
  misc_feature 1..32: note = Hyper
  source 1..32: mol_type = genomic DNA

SEQ ID NO: 116223 - DNA, 35 bp, Homo sapiens; identical to SEQ ID NO: 37499
  misc_feature 1..35: note = chr19:38879840-38879875
  misc_feature 1..35: note = Hyper
  source 1..35: mol_type = genomic DNA

SEQ ID NO: 116224 - DNA, 30 bp, Homo sapiens; identical to SEQ ID NO: 83433
  misc_feature 1..30: note = chr19:38880189-38880219
  misc_feature 1..30: note = Hyper
  source 1..30: mol_type = genomic DNA

SEQ ID NO: 116225 - DNA, 30 bp, Homo sapiens; identical to SEQ ID NO: 83434
  misc_feature 1..30: note = chr19:38901928-38901958
  misc_feature 1..30: note = Hypo
  source 1..30: mol_type = genomic DNA

SEQ ID NO: 116226 - DNA, 231 bp, Homo sapiens; identical to SEQ ID NO: 83435
  misc_feature 1..231: note = chr19:38905501-38905732
  misc_feature 1..231: note = Hypo
  source 1..231: mol_type = genomic DNA

SEQ ID NO: 116227 - DNA, 411 bp, Homo sapiens
  misc_feature 1..411: note = chr19:38924224-38924635
  misc_feature 1..411: note = Hyper
  source 1..411: mol_type = genomic DNA
atgtgggcagggctccggcgaaggggagtggccggggagtcctggtccaatggggcccgggggcggggacttcctcccatctctgtccagcatgcgtgtactcctcgcagttccatctacctcgcgggtgcctctggtgtctccagaggtctccgaccccagcccgcccccagccctcccgcccagcccgcagccccctccctctgttccccgacctcagaccctgggcttccgacctcgacatcatgggtgacgcagaaggcgaagacgaggtccagttcctgcggacggtgcgtatctctgggttaggggcctgtggggctatctcttggggctctctgagggtctctctgtctctgaatgtccctgtccggcttgctggtggtctctgagactcgaggtctcttccta

SEQ ID NO: 116228 - DNA, 30 bp, Homo sapiens; identical to SEQ ID NO: 83438
  misc_feature 1..30: note = chr19:38931911-38931941
  misc_feature 1..30: note = Hypo
  source 1..30: mol_type = genomic DNA

SEQ ID NO: 116229 - DNA, 112 bp, Homo sapiens; identical to SEQ ID NO: 45859
  misc_feature 1..112: note = chr19:38934459-38934571
  misc_feature 1..112: note = Hypo
  source 1..112: mol_type = genomic DNA

SEQ ID NO: 116230 - DNA, 35 bp, Homo sapiens; identical to SEQ ID NO: 83440
  misc_feature 1..35: note = chr19:38954122-38954157
  misc_feature 1..35: note = Hypo
  source 1..35: mol_type = genomic DNA

SEQ ID NO: 116231 - DNA, 418 bp, Homo sapiens; identical to SEQ ID NO: 83441
  misc_feature 1..418: note = chr19:38956612-38957030
  misc_feature 1..418: note = Hypo
  source 1..418: mol_type = genomic DNA

SEQ ID NO: 116232 - DNA, 140 bp, Homo sapiens; identical to SEQ ID NO: 83442
  misc_feature 1..140: note = chr19:38958263-38958403
  misc_feature 1..140: note = Hypo
  source 1..140: mol_type = genomic DNA

SEQ ID NO: 116233 - DNA, 38 bp, Homo sapiens; identical to SEQ ID NO: 83443
  misc_feature 1..38: note = chr19:38964007-38964045
  misc_feature 1..38: note = Hypo
  source 1..38: mol_type = genomic DNA

SEQ ID NO: 116234 - DNA, 50 bp, Homo sapiens; identical to SEQ ID NO: 83444
  misc_feature 1..50: note = chr19:38973963-38974013
  misc_feature 1..50: note = Hypo
  source 1..50: mol_type = genomic DNA

SEQ ID NO: 116235 - DNA, 80 bp, Homo sapiens; identical to SEQ ID NO: 83445
  misc_feature 1..80: note = chr19:38974232-38974312
  misc_feature 1..80: note = Hypo
  source 1..80: mol_type = genomic DNA

SEQ ID NO: 116236 - DNA, 476 bp, Homo sapiens; identical to SEQ ID NO: 83446
  misc_feature 1..476: note = chr19:38976314-38976790
  misc_feature 1..476: note = Hypo
  source 1..476: mol_type = genomic DNA

SEQ ID NO: 116237 - DNA, 271 bp, Homo sapiens; identical to SEQ ID NO: 83447
  misc_feature 1..271: note = chr19:38990481-38990752
  misc_feature 1..271: note = Hypo
  source 1..271: mol_type = genomic DNA

SEQ ID NO: 116238 - DNA, 306 bp, Homo sapiens; identical to SEQ ID NO: 83448
  misc_feature 1..306: note = chr19:38991260-38991566
  misc_feature 1..306: note = Hypo
  source 1..306: mol_type = genomic DNA

SEQ ID NO: 116239 - DNA, 38 bp, Homo sapiens; identical to SEQ ID NO: 83449
  misc_feature 1..38: note = chr19:38993187-38993225
  misc_feature 1..38: note = Hypo
  source 1..38: mol_type = genomic DNA

SEQ ID NO: 116240 - DNA, 236 bp, Homo sapiens
  misc_feature 1..236: note = chr19:38993515-38993751
  misc_feature 1..236: note = Hypo
  source 1..236: mol_type = genomic DNA
gcaggtacatccgcccgtcgatgctgcagcacctgttgcgccgcctggtgttcgacgtgcccatcctcaacgagttcgccaagatgccactcaaggtgagggcaagcgctctttagcatctcatttccaggccgcacccactggtttgctcttccctcctactgcggggctcatttgtgtcggcactgcccagcccaataaacctgcactagttagggcagcgtccccgtagaaat

SEQ ID NO: 116241 - DNA, 61 bp, Homo sapiens; identical to SEQ ID NO: 83450
  misc_feature 1..61: note = chr19:38996547-38996608
  misc_feature 1..61: note = Hypo
  source 1..61: mol_type = genomic DNA

SEQ ID NO: 116242 - DNA, 138 bp, Homo sapiens; identical to SEQ ID NO: 83451
  misc_feature 1..138: note = chr19:38998362-38998500
  misc_feature 1..138: note = Hypo
  source 1..138: mol_type = genomic DNA

SEQ ID NO: 116243 - DNA, 55 bp, Homo sapiens; identical to SEQ ID NO: 83452
  misc_feature 1..55: note = chr19:39006701-39006756
  misc_feature 1..55: note = Hypo
  source 1..55: mol_type = genomic DNA

SEQ ID NO: 116244 - DNA, 30 bp, Homo sapiens; identical to SEQ ID NO: 83453
  misc_feature 1..30: note = chr19:39015083-39015113
  misc_feature 1..30: note = Hypo
  source 1..30: mol_type = genomic DNA

SEQ ID NO: 116245 - DNA, 30 bp, Homo sapiens; identical to SEQ ID NO: 83454
  misc_feature 1..30: note = chr19:39026975-39027005
  misc_feature 1..30: note = Hypo
  source 1..30: mol_type = genomic DNA

SEQ ID NO: 116246 - DNA, 131 bp, Homo sapiens; identical to SEQ ID NO: 83455
  misc_feature 1..131: note = chr19:39038903-39039034
  misc_feature 1..131: note = Hypo
  source 1..131: mol_type = genomic DNA

SEQ ID NO: 116247 - DNA, 52 bp, Homo sapiens; identical to SEQ ID NO: 45868
  misc_feature 1..52: note = chr19:39071019-39071071
  misc_feature 1..52: note = Hypo
  source 1..52: mol_type = genomic DNA

SEQ ID NO: 116248 - DNA, 30 bp, Homo sapiens; identical to SEQ ID NO: 83458
  misc_feature 1..30: note = chr19:39077322-39077352
  misc_feature 1..30: note = Hypo
  source 1..30: mol_type = genomic DNA

SEQ ID NO: 116249 - DNA, 98 bp, Homo sapiens; identical to SEQ ID NO: 83459
  misc_feature 1..98: note = chr19:39090729-39090827
  misc_feature 1..98: note = Hypo
  source 1..98: mol_type = genomic DNA

SEQ ID NO: 116250 - DNA, 30 bp, Homo sapiens; identical to SEQ ID NO: 45869
  misc_feature 1..30: note = chr19:39101480-39101510
  misc_feature 1..30: note = Hypo
  source 1..30: mol_type = genomic DNA

SEQ ID NO: 116251 - DNA, 20 bp, Homo sapiens
  misc_feature 1..20: note = chr19:39135434-39135454
  misc_feature 1..20: note = Hypo
  source 1..20: mol_type = genomic DNA
cagggcgagactccacctcc

SEQ ID NO: 116252 - DNA, 34 bp, Homo sapiens; identical to SEQ ID NO: 83462
  misc_feature 1..34: note = chr19:39151506-39151540
  misc_feature 1..34: note = Hypo
  source 1..34: mol_type = genomic DNA

SEQ ID NO: 116253 - DNA, 30 bp, Homo sapiens; identical to SEQ ID NO: 45871
  misc_feature 1..30: note = chr19:39151783-39151813
  misc_feature 1..30: note = Hypo
  source 1..30: mol_type = genomic DNA

SEQ ID NO: 116254 - DNA, 75 bp, Homo sapiens; identical to SEQ ID NO: 83464
  misc_feature 1..75: note = chr19:39187839-39187914
  misc_feature 1..75: note = Hypo
  source 1..75: mol_type = genomic DNA

SEQ ID NO: 116255 - DNA, 74 bp, Homo sapiens; identical to SEQ ID NO: 83465
  misc_feature 1..74: note = chr19:39191735-39191809
  misc_feature 1..74: note = Hypo
  source 1..74: mol_type = genomic DNA

SEQ ID NO: 116256 - DNA, 33 bp, Homo sapiens; identical to SEQ ID NO: 83466
  misc_feature 1..33: note = chr19:39210343-39210376
  misc_feature 1..33: note = Hypo
  source 1..33: mol_type = genomic DNA

SEQ ID NO: 116257 - DNA, 42 bp, Homo sapiens; identical to SEQ ID NO: 45873
  misc_feature 1..42: note = chr19:39222079-39222121
  misc_feature 1..42: note = Hypo
  source 1..42: mol_type = genomic DNA

SEQ ID NO: 116258 - DNA, 41 bp, Homo sapiens; identical to SEQ ID NO: 83468
  misc_feature 1..41: note = chr19:39235148-39235189
  misc_feature 1..41: note = Hypo
  source 1..41: mol_type = genomic DNA

SEQ ID NO: 116259 - DNA, 89 bp, Homo sapiens; identical to SEQ ID NO: 83469
  misc_feature 1..89: note = chr19:39266345-39266434
  misc_feature 1..89: note = Hypo
  source 1..89: mol_type = genomic DNA

SEQ ID NO: 116260 - DNA, 217 bp, Homo sapiens
  misc_feature 1..217: note = chr19:39282944-39283161
  misc_feature 1..217: note = Hyper
  source 1..217: mol_type = genomic DNA
ccgcctgcgcaccctcggggcagacgcgatggcagcggccccggctctgcggaacagctgggaggactcgaaggacggcgtgggttttccctggcgcagcgagccccattcccacgcgccctccgctctccccgacggcccggaccccggtcctagccctggtcactgtgacgggaggggaagcggacgccaagtgcagccccggccccagtgtgac

SEQ ID NO: 116261 - DNA, 62 bp, Homo sapiens; identical to SEQ ID NO: 83472
  misc_feature 1..62: note = chr19:39305867-39305929
  misc_feature 1..62: note = Hypo
  source 1..62: mol_type = genomic DNA

SEQ ID NO: 116262 - DNA, 67 bp, Homo sapiens; identical to SEQ ID NO: 83473
  misc_feature 1..67: note = chr19:39329572-39329639
  misc_feature 1..67: note = Hypo
  source 1..67: mol_type = genomic DNA

SEQ ID NO: 116263 - DNA, 304 bp, Homo sapiens; identical to SEQ ID NO: 83474
  misc_feature 1..304: note = chr19:39329947-39330251
  misc_feature 1..304: note = Hypo
  source 1..304: mol_type = genomic DNA

SEQ ID NO: 116264 - DNA, 19 bp, Homo sapiens
  misc_feature 1..19: note = chr19:39393000-39393019
  misc_feature 1..19: note = Hypo
  source 1..19: mol_type = genomic DNA
cgcccggcctcattttatt

SEQ ID NO: 116265 - DNA, 68 bp, Homo sapiens; identical to SEQ ID NO: 83479
  misc_feature 1..68: note = chr19:39452631-39452699
  misc_feature 1..68: note = Hypo
  source 1..68: mol_type = genomic DNA

SEQ ID NO: 116266 - DNA, 426 bp, Homo sapiens; identical to SEQ ID NO: 83480
  misc_feature 1..426: note = chr19:39466136-39466562
  misc_feature 1..426: note = Hyper
  source 1..426: mol_type = genomic DNA

SEQ ID NO: 116267 - DNA, 542 bp, Homo sapiens; identical to SEQ ID NO: 83482
  misc_feature 1..542: note = chr19:39522477-39523019
  misc_feature 1..542: note = Hyper
  source 1..542: mol_type = genomic DNA

SEQ ID NO: 116268 - DNA, 30 bp, Homo sapiens; identical to SEQ ID NO: 45880
  misc_feature 1..30: note = chr19:39524876-39524906
  misc_feature 1..30: note = Hypo
  source 1..30: mol_type = genomic DNA

SEQ ID NO: 116269 - DNA, 30 bp, Homo sapiens; identical to SEQ ID NO: 83484
  misc_feature 1..30: note = chr19:39568177-39568207
  misc_feature 1..30: note = Hypo
  source 1..30: mol_type = genomic DNA

SEQ ID NO: 116270 - DNA, 254 bp, Homo sapiens
  misc_feature 1..254: note = chr19:39574790-39575044
  misc_feature 1..254: note = Hyper
  source 1..254: mol_type = genomic DNA
ctgggtcccccttcccgcgccacgccctggtggggtgggcgggtgggtgtggggcgcccaggcaggaccggccggacctgtgggacccggggccctggctgtctagggaggctgtcaccccgaggcgaccggctcttccggggctgggacggctgtaggcggcaagaggcctcggcacccgcgaactcataaataccggggcggcgctggtggcgggagaggcgcgtgcgggcagccggcgcccccgagggtga

SEQ ID NO: 116271 - DNA, 177 bp, Homo sapiens
  misc_feature 1..177: note = chr19:39589664-39589841
  misc_feature 1..177: note = Hyper
  source 1..177: mol_type = genomic DNA
gcccactggagtccccgtctggctgtgtttggagacctgggggctgacaacccgaaggccgtcccccggctgcgcagggacacccagcagggcatgtatgacgccgttctccatgtgggtgaggcatccgcaggggcgcgcgcagggacggtggggggcgcgcgcagggatggtggg

SEQ ID NO: 116272 - DNA, 114 bp, Homo sapiens; identical to SEQ ID NO: 83488
  misc_feature 1..114: note = chr19:39597642-39597756
  misc_feature 1..114: note = Hypo
  source 1..114: mol_type = genomic DNA

SEQ ID NO: 116273 - DNA, 143 bp, Homo sapiens; identical to SEQ ID NO: 83489
  misc_feature 1..143: note = chr19:39626780-39626923
  misc_feature 1..143: note = Hypo
  source 1..143: mol_type = genomic DNA

SEQ ID NO: 116274 - DNA, 30 bp, Homo sapiens; identical to SEQ ID NO: 83490
  misc_feature 1..30: note = chr19:39645862-39645892
  misc_feature 1..30: note = Hypo
  source 1..30: mol_type = genomic DNA

SEQ ID NO: 116275 - DNA, 94 bp, Homo sapiens; identical to SEQ ID NO: 45881
  misc_feature 1..94: note = chr19:39646149-39646243
  misc_feature 1..94: note = Hypo
  source 1..94: mol_type = genomic DNA

SEQ ID NO: 116276 - DNA, 75 bp, Homo sapiens; identical to SEQ ID NO: 83492
  misc_feature 1..75: note = chr19:39672388-39672463
  misc_feature 1..75: note = Hypo
  source 1..75: mol_type = genomic DNA

SEQ ID NO: 116277 - DNA, 30 bp, Homo sapiens; identical to SEQ ID NO: 83493
  misc_feature 1..30: note = chr19:39678735-39678765
  misc_feature 1..30: note = Hypo
  source 1..30: mol_type = genomic DNA

SEQ ID NO: 116278 - DNA, 395 bp, Homo sapiens
  misc_feature 1..395: note = chr19:39687582-39687977
  misc_feature 1..395: note = Hyper
  source 1..395: mol_type = genomic DNA
ccagccctgtgaaaccgggacagtcgcgcagcctcgagggatggaggaggtgcgtgagggacacgcgctcggtggcgggatggaagccgatgggcccgcgagcctccaggagctgcctccctcgccacggtcgccttcaccgccgccgtcgccgccaccactgccctcgccgccgtcgctgccatcgcccgcagccccggaggcccccgagctccccgagccggcgcagccgtccgaggctcacgcccggcagctgctgctggaggagtgggggccgctgagcgggggcctggagctgccccagcgcctcacctggaagctgctcctgttgcggcggccgctctaccgcaacctgctgcgctcgcccaaccccgaaggtgcgcaagggcccagag

SEQ ID NO: 116279 - DNA, 44 bp, Homo sapiens; identical to SEQ ID NO: 83496
  misc_feature 1..44: note = chr19:39690983-39691027
  misc_feature 1..44: note = Hypo
  source 1..44: mol_type = genomic DNA

SEQ ID NO: 116280 - DNA, 835 bp, Homo sapiens
  misc_feature 1..835: note = chr19:39754874-39755709
  misc_feature 1..835: note = Hyper
  source 1..835: mol_type = genomic DNA
gggcagaggccaaggcgaggagggggccggctcccgctctctctccctctgtgtgtgctgcgcctcccctgtgagcctaacccaaggcaggggactggacgcgtgggaccctctctttggcctccctgacgtccctcaggagcagagatgcgaccgagtgtgtgggccgcggtggccgcgggactgtgggtcgtgtgcacggtgggcgcggcgatccgccagcgctgcctgctctcgcactaccgctcgctggagccccggacgctggcggcggtcaaggcgctgaggaaccgctaagtgagtgaccgcccagcccttgcgccccccggtacactggccccgccgggttcccacacacccgtcgctgacccgaggggtcctgcgtcctagcgcccagcaggcgcctcttgtacgtcagagcccacagttcccaccacgagatccccgcagtccccgtcgtcagcgcgaacgcaggctcagggtcagtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagtacccatccacgtccaggaatcccagactgtgcagaggttaggggccctggcgagggggcccagtcgtatgcgataagcgccgcttgtcccgcaggcggaagaggcgctgagttggaggtcgcgcaactgctccgtccgccccaggagggatcctccgcggccatcggtgaggcccagaagcggacgggagaggcatggc

SEQ ID NO: 116281 - DNA, 30 bp, Homo sapiens; identical to SEQ ID NO: 83502
  misc_feature 1..30: note = chr19:39800520-39800550
  misc_feature 1..30: note = Hypo
  source 1..30: mol_type = genomic DNA

SEQ ID NO: 116282 - DNA, 140 bp, Homo sapiens; identical to SEQ ID NO: 83503
  misc_feature 1..140: note = chr19:39811228-39811368
  misc_feature 1..140: note = Hyper
  source 1..140: mol_type = genomic DNA

SEQ ID NO: 116283 - DNA, 30 bp, Homo sapiens; identical to SEQ ID NO: 45883
  misc_feature 1..30: note = chr19:39815860-39815890
  misc_feature 1..30: note = Hypo
  source 1..30: mol_type = genomic DNA

SEQ ID NO: 116284 - DNA, 347 bp, Homo sapiens; identical to SEQ ID NO: 83505
  misc_feature 1..347: note = chr19:39816895-39817242
  misc_feature 1..347: note = Hypo
  source 1..347: mol_type = genomic DNA

SEQ ID NO: 116285 - DNA, 30 bp, Homo sapiens; identical to SEQ ID NO: 83508
  misc_feature 1..30: note = chr19:39823715-39823745
  misc_feature 1..30: note = Hypo
  source 1..30: mol_type = genomic DNA

SEQ ID NO: 116286 - DNA, 415 bp, Homo sapiens; identical to SEQ ID NO: 37511
  misc_feature 1..415: note = chr19:39989727-39990142
  misc_feature 1..415: note = Hyper
  source 1..415: mol_type = genomic DNA

SEQ ID NO: 116287 - DNA, 25 bp, Homo sapiens
  misc_feature 1..25: note = chr19:39992813-39992838
  misc_feature 1..25: note = Hypo
  source 1..25: mol_type = genomic DNA
gagactccgtcgcaaaaaacaaaca

SEQ ID NO: 116288 - DNA, 381 bp, Homo sapiens
  misc_feature 1..381: note = chr19:39993374-39993755
  misc_feature 1..381: note = Hyper
  source 1..381: mol_type = genomic DNA
agaatgcggccggggcgctccgtatgcatccatgttcggccgggcccaccccagcacccctcctttgcctgtcctcgcagggcccgcctggagcctgctggcgcgcgtggctggcaggcggcgcttggcagccggaggcccgtgggcccgggacattcagcgcgcaggcgcctgggagctgcgcttctcgtaccgcgcgcgctgcgagccgcctgccgtcgggaccgcgtgcacgcgcctctgccgtccgcgcagcgccccctcgcggtgcggtccgggactgcgcccctgcgcaccgctcgaggacgaatgtgaggcgccgcgtgagtcctgcgttcgaccccaccccgtcccagccggggaccccggcccctcctgagc

SEQ ID NO: 116289 - DNA, 22 bp, Homo sapiens
  misc_feature 1..22: note = chr19:39996552-39996574
  misc_feature 1..22: note = Hypo
  source 1..22: mol_type = genomic DNA
ctaaaagattaaatgcggcccg

SEQ ID NO: 116290 - DNA, 453 bp, Homo sapiens
  misc_feature 1..453: note = chr19:39997688-39998141
  misc_feature 1..453: note = Hyper
  source 1..453: mol_type = genomic DNA
cctggacctgggccacgccctgcgctgccgctgccgcgccggcttcgcgggtcctcgctgcgagcacgacctggacgactgcgcgggccgcgcctgcgctaacggcggcacgtgtgtggagggcggcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgctcgtggccgcgggcgtggccggcgctgcgctcttgctggtccacgtgcgccgccgtgg

SEQ ID NO: 116291 - DNA, 1175 bp, Homo sapiens
  misc_feature 1..1175: note = chr19:40005651-40006826
  misc_feature 1..1175: note = Hyper
  source 1..1175: mol_type = genomic DNA
cgggggttaagggggcgggaattactcggcgaggtcgggaggtcgcgcggtggaacccgggggccaggtggaactcggtgtaacagagcccccagtggtcgcgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactggtgaggacctcacacatgcctctcccaacccccggggacagggccggcagtgggggctgggtctccggggacgtggaggtcagggttggggtagggcgaggggagggattcaggaagagccccagagttccagttcccagattggaaacccgctcttgtctctca

SEQ ID NO: 116292 - DNA, 200 bp, Homo sapiens; identical to SEQ ID NO: 83521
  misc_feature 1..200: note = chr19:40097695-40097895
  misc_feature 1..200: note = Hypo
  source 1..200: mol_type = genomic DNA

SEQ ID NO: 116293 - DNA, 189 bp, Homo sapiens; identical to SEQ ID NO: 16507
  misc_feature 1..189: note = chr19:40218707-40218896
  misc_feature 1..189: note = Hypo
  source 1..189: mol_type = genomic DNA

SEQ ID NO: 116294 - DNA, 34 bp, Homo sapiens; identical to SEQ ID NO: 83525
  misc_feature 1..34: note = chr19:40286084-40286118
  misc_feature 1..34: note = Hypo
  source 1..34: mol_type = genomic DNA

SEQ ID NO: 116295 - DNA, 764 bp, Homo sapiens; identical to SEQ ID NO: 83526
  misc_feature 1..764: note = chr19:40324254-40325018
  misc_feature 1..764: note = Hyper
  source 1..764: mol_type = genomic DNA

SEQ ID NO: 116296 - DNA, 30 bp, Homo sapiens; identical to SEQ ID NO: 83528
  misc_feature 1..30: note = chr19:40430529-40430559
  misc_feature 1..30: note = Hypo
  source 1..30: mol_type = genomic DNA

SEQ ID NO: 116297 - DNA, 30 bp, Homo sapiens; identical to SEQ ID NO: 83532
  misc_feature 1..30: note = chr19:40449764-40449794
  misc_feature 1..30: note = Hypo
  source 1..30: mol_type = genomic DNA

SEQ ID NO: 116298 - DNA, 55 bp, Homo sapiens; identical to SEQ ID NO: 83533
  misc_feature 1..55: note = chr19:40503231-40503286
  misc_feature 1..55: note = Hyper
  source 1..55: mol_type = genomic DNA

SEQ ID NO: 116299 - DNA, 47 bp, Homo sapiens; identical to SEQ ID NO: 83538
  misc_feature 1..47: note = chr19:40561332-40561379
  misc_feature 1..47: note = Hyper
  source 1..47: mol_type = genomic DNA

SEQ ID NO: 116300 - DNA, 36 bp, Homo sapiens; identical to SEQ ID NO: 83540
  misc_feature 1..36: note = chr19:40723089-40723125
  misc_feature 1..36: note = Hyper
  source 1..36: mol_type = genomic DNA

SEQ ID NO: 116301 - DNA, 117 bp, Homo sapiens; identical to SEQ ID NO: 83541
  misc_feature 1..117: note = chr19:40723426-40723543
  misc_feature 1..117: note = Hyper
  source 1..117: mol_type = genomic DNA

SEQ ID NO: 116302 - DNA, 599 bp, Homo sapiens; identical to SEQ ID NO: 83542
  misc_feature 1..599: note = chr19:40723835-40724434
  misc_feature 1..599: note = Hyper
  source 1..599: mol_type = genomic DNA

SEQ ID NO: 116303 - DNA, 33 bp, Homo sapiens
  misc_feature 1..33: note = chr19:40732289-40732322
  misc_feature 1..33: note = Hyper
  source 1..33: mol_type = genomic DNA
cggcgaagatgtccccggcgtactcgcgttctc

SEQ ID NO: 116304 - DNA, 170 bp, Homo sapiens; identical to SEQ ID NO: 83545
  misc_feature 1..170: note = chr19:40829862-40830032
  misc_feature 1..170: note = Hypo
  source 1..170: mol_type = genomic DNA

SEQ ID NO: 116305 - DNA, 343 bp, Homo sapiens; identical to SEQ ID NO: 83547
  misc_feature 1..343: note = chr19:40889677-40890020
  misc_feature 1..343: note = Hypo
  source 1..343: mol_type = genomic DNA

SEQ ID NO: 116306 - DNA, 30 bp, Homo sapiens; identical to SEQ ID NO: 83548
  misc_feature 1..30: note = chr19:40900239-40900269
  misc_feature 1..30: note = Hypo
  source 1..30: mol_type = genomic DNA

SEQ ID NO: 116307 - DNA, 30 bp, Homo sapiens; identical to SEQ ID NO: 45889
  misc_feature 1..30: note = chr19:40901793-40901823
  misc_feature 1..30: note = Hypo
  source 1..30: mol_type = genomic DNA

SEQ ID NO: 116308 - DNA, 432 bp, Homo sapiens; identical to SEQ ID NO: 83550
  misc_feature 1..432: note = chr19:40902263-40902695
  misc_feature 1..432: note = Hypo
  source 1..432: mol_type = genomic DNA

SEQ ID NO: 116309 - DNA, 20 bp, Homo sapiens
  misc_feature 1..20: note = chr19:40908670-40908690
  misc_feature 1..20: note = Hypo
  source 1..20: mol_type = genomic DNA
gactccgtctcaaaaaaaaa

SEQ ID NO: 116310 - DNA, 95 bp, Homo sapiens; identical to SEQ ID NO: 83552
  misc_feature 1..95: note = chr19:40926574-40926669
  misc_feature 1..95: note = Hypo
  source 1..95: mol_type = genomic DNA

SEQ ID NO: 116311 - DNA, 22 bp, Homo sapiens
  misc_feature 1..22: note = chr19:40951175-40951197
  misc_feature 1..22: note = Hypo
  source 1..22: mol_type = genomic DNA
aatattattttttgccgggcgc

SEQ ID NO: 116312 - DNA, 221 bp, Homo sapiens; identical to SEQ ID NO: 83554
  misc_feature 1..221: note = chr19:40951614-40951835
  misc_feature 1..221: note = Hypo
  source 1..221: mol_type = genomic DNA

SEQ ID NO: 116313 - DNA, 406 bp, Homo sapiens; identical to SEQ ID NO: 83556
  misc_feature 1..406: note = chr19:40972742-40973148
  misc_feature 1..406: note = Hyper
  source 1..406: mol_type = genomic DNA

SEQ ID NO: 116314 - DNA, 70 bp, Homo sapiens; identical to SEQ ID NO: 83557
  misc_feature 1..70: note = chr19:41008366-41008436
  misc_feature 1..70: note = Hypo
  source 1..70: mol_type = genomic DNA

SEQ ID NO: 116315 - DNA, 30 bp, Homo sapiens; identical to SEQ ID NO: 83558
  misc_feature 1..30: note = chr19:41009824-41009854
  misc_feature 1..30: note = Hypo
  source 1..30: mol_type = genomic DNA

SEQ ID NO: 116316 - DNA, 626 bp, Homo sapiens
  misc_feature 1..626: note = chr19:41018532-41019158
  misc_feature 1..626: note = Hyper
  source 1..626: mol_type = genomic DNA
caggtcatctgcaaccgcgtgaaccacgtgcacggctgcctggcggagctgcaggagcaggcagcgcggcgacgcgcggagctggaggcttcgcggagcctgtgggcgctgctgcaggagctggaggaggccgagagctgggcgcgcgacaaggagcgtctcctggaggctgcgggcggcggcggtgcggcgggcgcagcgggcgcagcgggaacagcgggcggcgcgcatgacctgtccagcacagcgcgcctcctggcccagcacaagatcctgcagggcgagctgggcgggcggcgagcgttgctgcagcaggccctgcggtgtggcgaggagctggttgcggccggcggtgccgtcggcccgggagcagacaccgtgcacctggtaggcctggcggagcgcgcggcgagcgcccggcgccgctggcagaggctggaagaggcggcggcgcggcgagagcggcggctgcaggaggcgcgggcgctgcaccagttcggcgctgacctcgacgggctgctggactggcttcgcgacgcttaccgcctggcagccgccggtgacttcggccacgacgaagcttccagccgccgcctggcgcgccagcaccgcgcgctcaccgggga

SEQ ID NO: 116317 - DNA, 536 bp, Homo sapiens; identical to SEQ ID NO: 83561
  misc_feature 1..536: note = chr19:41025379-41025915
  misc_feature 1..536: note = Hyper
  source 1..536: mol_type = genomic DNA

SEQ ID NO: 116318 - DNA, 30 bp, Homo sapiens; identical to SEQ ID NO: 83562
  misc_feature 1..30: note = chr19:41028694-41028724
  misc_feature 1..30: note = Hypo
  source 1..30: mol_type = genomic DNA

SEQ ID NO: 116319 - DNA, 311 bp, Homo sapiens; identical to SEQ ID NO: 83563
  misc_feature 1..311: note = chr19:41055109-41055420
  misc_feature 1..311: note = Hyper
  source 1..311: mol_type = genomic DNA

SEQ ID NO: 116320 - DNA, 444 bp, Homo sapiens; identical to SEQ ID NO: 37525
  misc_feature 1..444: note = chr19:41059909-41060353
  misc_feature 1..444: note = Hyper
  source 1..444: mol_type = genomic DNA

SEQ ID NO: 116321 - DNA, 113 bp, Homo sapiens; identical to SEQ ID NO: 83565
  misc_feature 1..113: note = chr19:41062945-41063058
  misc_feature 1..113: note = Hypo
  source 1..113: mol_type = genomic DNA

SEQ ID NO: 116322 - DNA, 695 bp, Homo sapiens
  misc_feature 1..695: note = chr19:41073518-41074213
  misc_feature 1..695: note = Hyper
  source 1..695: mol_type = genomic DNA
cccgccccggccccacgcctccaacctaaccctggtccctccatcctcagatcgagaaaatcaaagcggaacagagcaagcagccgcctaccccactgctggggcgcaagttctttggggaccccacggaactggcggccaaggcggcgcccctgctgcggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggccgcaccagaggacgcggcggagacccccgcgacccccgcggcggcggagcaggtgcggccacgaccggagcgccaggagtcagctgatcgcgcggaggagctgcccaggaggcggcggcctgagcggcaagagtcagtcgatcaatccgaggaggctgcgcggaggcggcggccggagcggcaggagtcagcggagcacgaggcggcacacagccttaccctgggccgctatgagcagatggagcggcggcgcgagcggcgtgagcggcgcttggagcggcaggagtccagcgaacaggagatgcccatcagaggagacctggtcaaggggtgaggtgcccgccttatgaccaga

SEQ ID NO: 116323 - DNA, 221 bp, Homo sapiens; identical to SEQ ID NO: 83568
  misc_feature 1..221: note = chr19:41102775-41102996
  misc_feature 1..221: note = Hyper
  source 1..221: mol_type = genomic DNA

SEQ ID NO: 116324 - DNA, 434 bp, Homo sapiens
  misc_feature 1..434: note = chr19:41105986-41106420
  misc_feature 1..434: note = Hyper
  source 1..434: mol_type = genomic DNA
agagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgc

SEQ ID NO: 116325 - DNA, 290 bp, Homo sapiens; identical to SEQ ID NO: 83571
  misc_feature 1..290: note = chr19:41115521-41115811
  misc_feature 1..290: note = Hyper
  source 1..290: mol_type = genomic DNA

SEQ ID NO: 116326 - DNA, 558 bp, Homo sapiens
  misc_feature 1..558: note = chr19:41119177-41119735
  misc_feature 1..558: note = Hyper
  source 1..558: mol_type = genomic DNA
gaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctagg

SEQ ID NO: 116327 - DNA, 391 bp, Homo sapiens; identical to SEQ ID NO: 83575
  misc_feature 1..391: note = chr19:41198090-41198481
  misc_feature 1..391: note = Hypo
  source 1..391: mol_type = genomic DNA

SEQ ID NO: 116328 - DNA, 39 bp, Homo sapiens; identical to SEQ ID NO: 83576
  misc_feature 1..39: note = chr19:41245584-41245623
  misc_feature 1..39: note = Hypo
  source 1..39: mol_type = genomic DNA

SEQ ID NO: 116329 - DNA, 439 bp, Homo sapiens
  misc_feature 1..439: note = chr19:41354396-41354835
  misc_feature 1..439: note = Hyper
  source 1..439: mol_type = genomic DNA
ccagggctggaagtgcgggcgcctttccccacctagtccccatccccaggcagaacgcgcgcgggttcctcgtcctgggtgttttccttctcctgcccccgcactcggggtcccctgctcaccgccagtgccccggagggcgtcgatgaggaagcccgcctcctcctggatgcgctcctcgatgcctcgcttgcccaccccgaagtcccgcagggtggcgatggagaagcgccggagctgcttggcgcgctccccgttgctgaataccacgcctggggaggtgaacgcgggaatggagacaggccagggggcggcaggggcaggagcggagcagctccaaggggctccccaagggtggaggagagagggagtagggtgggagagagatggattcagcgccattgcccagcagagctgcaaactcagtcagagaaacacg

SEQ ID NO: 116330 - DNA, 30 bp, Homo sapiens; identical to SEQ ID NO: 83581
  misc_feature 1..30: note = chr19:41381504-41381534
  misc_feature 1..30: note = Hyper
  source 1..30: mol_type = genomic DNA

SEQ ID NO: 116331 - DNA, 30 bp, Homo sapiens; identical to SEQ ID NO: 83582
  misc_feature 1..30: note = chr19:41416060-41416090
  misc_feature 1..30: note = Hypo
  source 1..30: mol_type = genomic DNA

SEQ ID NO: 116332 - DNA, 165 bp, Homo sapiens
  misc_feature 1..165: note = chr19:41595988-41596153
  misc_feature 1..165: note = Hyper
  source 1..165: mol_type = genomic DNA
ccggcgcttctccatcgccaccctaaggggttttggcgtgggcaagcgcggcatcgaggaacgcatccaggaggaggcgggcttcctcatcgacgccctccggggcacgcacggtgagtaggggaccccgagtgcgagggcgggaacccgcgctttctgcctggg

SEQ ID NO: 116333 - DNA, 30 bp, Homo sapiens; identical to SEQ ID NO: 45895
  misc_feature 1..30: note = chr19:41615907-41615937
  misc_feature 1..30: note = Hypo
  source 1..30: mol_type = genomic DNA

SEQ ID NO: 116334 - DNA, 290 bp, Homo sapiens
  misc_feature 1..290: note = chr19:41641726-41642016
  misc_feature 1..290: note = Hyper
  source 1..290: mol_type = genomic DNA
ggagcccagcaaaggcggggccaatgtgtggatagggcacttggaggtctggtaaggcagcaaaacgaacgaagccggccgcaggagtcggaggccccgaaagggatgtagccagtgacccggcgcttcctggatggggcgtggccggttcccgggcccgcctcctttcccgtccccaccacaggaatcttgttttctaaccggccgtgctggtggacactgcgcaattttgcacttggagcgccgaagaagttcgggttggatacgcggaccatcgaggcgcgtgtcct

SEQ ID NO: 116335 - DNA, 168 bp, Homo sapiens; identical to SEQ ID NO: 83589
  misc_feature 1..168: note = chr19:41673489-41673657
  misc_feature 1..168: note = Hypo
  source 1..168: mol_type = genomic DNA

SEQ ID NO: 116336 - DNA, 30 bp, Homo sapiens; identical to SEQ ID NO: 83590
  misc_feature 1..30: note = chr19:41681188-41681218
  misc_feature 1..30: note = Hypo
  source 1..30: mol_type = genomic DNA

SEQ ID NO: 116337 - DNA, 23 bp, Homo sapiens
  misc_feature 1..23: note = chr19:41694633-41694656
  misc_feature 1..23: note = Hypo
  source 1..23: mol_type = genomic DNA
accacgcccggcaagaactttta

SEQ ID NO: 116338 - DNA, 95 bp, Homo sapiens; identical to SEQ ID NO: 83592
  misc_feature 1..95: note = chr19:41699111-41699206
  misc_feature 1..95: note = Hyper
  source 1..95: mol_type = genomic DNA

SEQ ID NO: 116339 - DNA, 30 bp, Homo sapiens; identical to SEQ ID NO: 83593
  misc_feature 1..30: note = chr19:41732411-41732441
  misc_feature 1..30: note = Hyper
  source 1..30: mol_type = genomic DNA

SEQ ID NO: 116340 - DNA, 65 bp, Homo sapiens; identical to SEQ ID NO: 83594
  misc_feature 1..65: note = chr19:41854198-41854263
  misc_feature 1..65: note = Hypo
  source 1..65: mol_type = genomic DNA

SEQ ID NO: 116341 - DNA, 16 bp, Homo sapiens
  misc_feature 1..16: note = chr19:41881147-41881163
  misc_feature 1..16: note = Hypo
  source 1..16: mol_type = genomic DNA
gcatgcaagtgagccc

SEQ ID NO: 116342 - DNA, 120 bp, Homo sapiens; identical to SEQ ID NO: 83596
  misc_feature 1..120: note = chr19:41881463-41881583
  misc_feature 1..120: note = Hypo
  source 1..120: mol_type = genomic DNA

SEQ ID NO: 116343 - DNA, 93 bp, Homo sapiens; identical to SEQ ID NO: 83597
  misc_feature 1..93: note = chr19:41927388-41927481
  misc_feature 1..93: note = Hypo
  source 1..93: mol_type = genomic DNA

SEQ ID NO: 116344 - DNA, 25 bp, Homo sapiens
  misc_feature 1..25: note = chr19:41947444-41947469
  misc_feature 1..25: note = Hypo
  source 1..25: mol_type = genomic DNA
tcttgctgtgcggcccagttcctag

SEQ ID NO: 116345 - DNA, 104 bp, Homo sapiens; identical to SEQ ID NO: 83599
  misc_feature 1..104: note = chr19:41956235-41956339
  misc_feature 1..104: note = Hypo
  source 1..104: mol_type = genomic DNA

SEQ ID NO: 116346 - DNA, 470 bp, Homo sapiens; identical to SEQ ID NO: 83601
  misc_feature 1..470: note = chr19:42028283-42028753
  misc_feature 1..470: note = Hyper
  source 1..470: mol_type = genomic DNA

SEQ ID NO: 116347 - DNA, 86 bp, Homo sapiens; identical to SEQ ID NO: 83602
  misc_feature 1..86: note = chr19:42069045-42069131
  misc_feature 1..86: note = Hypo
  source 1..86: mol_type = genomic DNA

SEQ ID NO: 116348 - DNA, 30 bp, Homo sapiens; identical to SEQ ID NO: 83604
  misc_feature 1..30: note = chr19:42195459-42195489
  misc_feature 1..30: note = Hyper
  source 1..30: mol_type = genomic DNA

SEQ ID NO: 116349 - DNA, 22 bp, Homo sapiens
  misc_feature 1..22: note = chr19:42202343-42202365
  misc_feature 1..22: note = Hypo
  source 1..22: mol_type = genomic DNA
ttcattttacttcaccggaaaa

SEQ ID NO: 116350 - DNA, 30 bp, Homo sapiens; identical to SEQ ID NO: 83606
  misc_feature 1..30: note = chr19:42257218-42257248
  misc_feature 1..30: note = Hyper
  source 1..30: mol_type = genomic DNA

SEQ ID NO: 116351 - DNA, 30 bp, Homo sapiens; identical to SEQ ID NO: 83608
  misc_feature 1..30: note = chr19:42297369-42297399
  misc_feature 1..30: note = Hyper
  source 1..30: mol_type = genomic DNA

SEQ ID NO: 116352 - DNA, 155 bp, Homo sapiens; identical to SEQ ID NO: 83609
  misc_feature 1..155: note = chr19:42348878-42349033
  misc_feature 1..155: note = Hypo
  source 1..155: mol_type = genomic DNA

SEQ ID NO: 116353 - DNA, 141 bp, Homo sapiens; identical to SEQ ID NO: 83610
  misc_feature 1..141: note = chr19:42349292-42349433
  misc_feature 1..141: note = Hypo
  source 1..141: mol_type = genomic DNA

SEQ ID NO: 116354 - DNA, 154 bp, Homo sapiens; identical to SEQ ID NO: 45900
  misc_feature 1..154: note = chr19:42373753-42373907
  misc_feature 1..154: note = Hypo
  source 1..154: mol_type = genomic DNA

SEQ ID NO: 116355 - DNA, 757 bp, Homo sapiens; identical to SEQ ID NO: 83612
  misc_feature 1..757: note = chr19:42408203-42408960
  misc_feature 1..757: note = Hypo
  source 1..757: mol_type = genomic DNA

SEQ ID NO: 116356 - DNA, 40 bp, Homo sapiens; identical to SEQ ID NO: 83613
  misc_feature 1..40: note = chr19:42409381-42409421
  misc_feature 1..40: note = Hypo
  source 1..40: mol_type = genomic DNA

SEQ ID NO: 116357 - DNA, 116 bp, Homo sapiens; identical to SEQ ID NO: 83614
  misc_feature 1..116: note = chr19:42419358-42419474
  misc_feature 1..116: note = Hyper
  source 1..116: mol_type = genomic DNA

SEQ ID NO: 116358 - DNA, 149 bp, Homo sapiens; identical to SEQ ID NO: 83615
  misc_feature 1..149: note = chr19:42444147-42444296
  misc_feature 1..149: note = Hyper
  source 1..149: mol_type = genomic DNA

SEQ ID NO: 116359 - DNA, 193 bp, Homo sapiens
  misc_feature 1..193: note = chr19:42445005-42445198
  misc_feature 1..193: note = Hyper
  source 1..193: mol_type = genomic DNA
ccccgaggcagaaagcgcggaccccgcctgtcgccgccgccgccgcccgctcccggactcgcgccccccgcgcgtccactctgatttctcggcccatttttcttcctctcctgtcactccggcgctcgccctcccgccgccggctgccccgccgcgctccgcttcccgcgggaacccccgctgcagccagccc

SEQ ID NO: 116360 - DNA, 30 bp, Homo sapiens; identical to SEQ ID NO: 83618
  misc_feature 1..30: note = chr19:42474541-42474571
  misc_feature 1..30: note = Hypo
  source 1..30: mol_type = genomic DNA

SEQ ID NO: 116361 - DNA, 30 bp, Homo sapiens; identical to SEQ ID NO: 83619
  misc_feature 1..30: note = chr19:42484215-42484245
  misc_feature 1..30: note = Hypo
  source 1..30: mol_type = genomic DNA

SEQ ID NO: 116362 - DNA, 22 bp, Homo sapiens
  misc_feature 1..22: note = chr19:42493742-42493764
  misc_feature 1..22: note = Hypo
  source 1..22: mol_type = genomic DNA
ttacaggcgtgagccaccgtgc

SEQ ID NO: 116363 - DNA, 50 bp, Homo sapiens; identical to SEQ ID NO: 83621
  misc_feature 1..50: note = chr19:42496595-42496645
  misc_feature 1..50: note = Hypo
  source 1..50: mol_type = genomic DNA

SEQ ID NO: 116364 - DNA, 30 bp, Homo sapiens; identical to SEQ ID NO: 83622
  misc_feature 1..30: note = chr19:42501421-42501451
  misc_feature 1..30: note = Hyper
  source 1..30: mol_type = genomic DNA

SEQ ID NO: 116365 - DNA, 50 bp, Homo sapiens; identical to SEQ ID NO: 83623
  misc_feature 1..50: note = chr19:42507833-42507883
  misc_feature 1..50: note = Hypo
  source 1..50: mol_type = genomic DNA

SEQ ID NO: 116366 - DNA, 166 bp, Homo sapiens; identical to SEQ ID NO: 83624
  misc_feature 1..166: note = chr19:42573985-42574151
  misc_feature 1..166: note = Hyper
  source 1..166: mol_type = genomic DNA

SEQ ID NO: 116367 - DNA, 82 bp, Homo sapiens; identical to SEQ ID NO: 83625
  misc_feature 1..82: note = chr19:42578971-42579053
  misc_feature 1..82: note = Hypo
  source 1..82: mol_type = genomic DNA

SEQ ID NO: 116368 - DNA, 285 bp, Homo sapiens; identical to SEQ ID NO: 83626
  misc_feature 1..285: note = chr19:42636368-42636653
  misc_feature 1..285: note = Hyper
  source 1..285: mol_type = genomic DNA

SEQ ID NO: 116369 - DNA, 85 bp, Homo sapiens; identical to SEQ ID NO: 83627
  misc_feature 1..85: note = chr19:42680612-42680697
  misc_feature 1..85: note = Hyper
  source 1..85: mol_type = genomic DNA

SEQ ID NO: 116370 - DNA, 152 bp, Homo sapiens; identical to SEQ ID NO: 83629
  misc_feature 1..152: note = chr19:42683697-42683849
  misc_feature 1..152: note = Hyper
  source 1..152: mol_type = genomic DNA

SEQ ID NO: 116371 - DNA, 43 bp, Homo sapiens; identical to SEQ ID NO: 45904
  misc_feature 1..43: note = chr19:42697082-42697125
  misc_feature 1..43: note = Hypo
  source 1..43: mol_type = genomic DNA

SEQ ID NO: 116372 - DNA, 143 bp, Homo sapiens; identical to SEQ ID NO: 83631
  misc_feature 1..143: note = chr19:42722596-42722739
  misc_feature 1..143: note = Hypo
  source 1..143: mol_type = genomic DNA

SEQ ID NO: 116373 - DNA, 127 bp, Homo sapiens; identical to SEQ ID NO: 83632
  misc_feature 1..127: note = chr19:42774775-42774902
  misc_feature 1..127: note = Hyper
  source 1..127: mol_type = genomic DNA

SEQ ID NO: 116374 - DNA, 644 bp, Homo sapiens
  misc_feature 1..644: note = chr19:42827856-42828500
  misc_feature 1..644: note = Hyper
  source 1..644: mol_type = genomic DNA
gcacgtctatgggaacgtgacgtttatcagcgactcggtgcccaacttcacggagctcttctccatccccccgcccgccacctccgtaagccccgcggccccagcgcccgaggagctgctggcgccgcccctggagtacctgaccccgctcccggccccgccgccgcccccagcgcccggacccctgagccctcctcctgcctttcgcactccccgcgccccaacaccgcgccgcgaccgtcccctggcgcccgcgcccaccctgcctgactgggttctggcgctgttgcgcacacccccgcagactccctgcgccgtgcccccaccgcccgccttccgcggctctcccccagctccccggccgccgccggagttcgccccgcgcgccccgacgccgccctttgagtacctggccccgctgcccaggcgccccgccacccagtccttccctgactgacaacgtgcgtccacacctggggtggaagggttctccgggggagggggacgggccttcggggccgcatctgccccccgagggtcccggacggcctctgaccctgacccccctcccaggccgggaagcaggtggaggagacagcggtggcggcggcggtggccccgaggggccgcgtggtgaccatggc

SEQ ID NO: 116375 - DNA, 34 bp, Homo sapiens; identical to SEQ ID NO: 83640
  misc_feature 1..34: note = chr19:42856588-42856622
  misc_feature 1..34: note = Hypo
  source 1..34: mol_type = genomic DNA

SEQ ID NO: 116376 - DNA, 16 bp, Homo sapiens
  misc_feature 1..16: note = chr19:42884253-42884269
  misc_feature 1..16: note = Hypo
  source 1..16: mol_type = genomic DNA
gcgcccagcccagtga

SEQ ID NO: 116377 - DNA, 516 bp, Homo sapiens; identical to SEQ ID NO: 83643
  misc_feature 1..516: note = chr19:42905683-42906199
  misc_feature 1..516: note = Hyper
  source 1..516: mol_type = genomic DNA

SEQ ID NO: 116378 - DNA, 46 bp, Homo sapiens; identical to SEQ ID NO: 83644
  misc_feature 1..46: note = chr19:42906867-42906913
  misc_feature 1..46: note = Hypo
  source 1..46: mol_type = genomic DNA

SEQ ID NO: 116379 - DNA, 93 bp, Homo sapiens; identical to SEQ ID NO: 83645
  misc_feature 1..93: note = chr19:42907199-42907292
  misc_feature 1..93: note = Hypo
  source 1..93: mol_type = genomic DNA

SEQ ID NO: 116380 - DNA, 30 bp, Homo sapiens; identical to SEQ ID NO: 83646
  misc_feature 1..30: note = chr19:42916465-42916495
  misc_feature 1..30: note = Hypo
  source 1..30: mol_type = genomic DNA

SEQ ID NO: 116381 - DNA, 101 bp, Homo sapiens; identical to SEQ ID NO: 83648
  misc_feature 1..101: note = chr19:42927377-42927478
  misc_feature 1..101: note = Hyper
  source 1..101: mol_type = genomic DNA

SEQ ID NO: 116382 - DNA, 675 bp, Homo sapiens; identical to SEQ ID NO: 83649
  misc_feature 1..675: note = chr19:42927725-42928400
  misc_feature 1..675: note = Hyper
  source 1..675: mol_type = genomic DNA

SEQ ID NO: 116383 - DNA, 30 bp, Homo sapiens; identical to SEQ ID NO: 83651
  misc_feature 1..30: note = chr19:43044394-43044424
  misc_feature 1..30: note = Hypo
  source 1..30: mol_type = genomic DNA

SEQ ID NO: 116384 - DNA, 152 bp, Homo sapiens; identical to SEQ ID NO: 83655
  misc_feature 1..152: note = chr19:43258522-43258674
  misc_feature 1..152: note = Hypo
  source 1..152: mol_type = genomic DNA

SEQ ID NO: 116385 - DNA, 30 bp, Homo sapiens; identical to SEQ ID NO: 83656
  misc_feature 1..30: note = chr19:43385119-43385149
  misc_feature 1..30: note = Hypo
  source 1..30: mol_type = genomic DNA

SEQ ID NO: 116386 - DNA, 32 bp, Homo sapiens; identical to SEQ ID NO: 83662
  misc_feature 1..32: note = chr19:43692087-43692119
  misc_feature 1..32: note = Hypo
  source 1..32: mol_type = genomic DNA

SEQ ID NO: 116387 - DNA, 30 bp, Homo sapiens; identical to SEQ ID NO: 83665
  misc_feature 1..30: note = chr19:44022537-44022567
  misc_feature 1..30: note = Hypo
  source 1..30: mol_type = genomic DNA

SEQ ID NO: 116388 - DNA, 38 bp, Homo sapiens; identical to SEQ ID NO: 83666
  misc_feature 1..38: note = chr19:44029701-44029739
  misc_feature 1..38: note = Hyper
  source 1..38: mol_type = genomic DNA

SEQ ID NO: 116389 - DNA, 202 bp, Homo sapiens; identical to SEQ ID NO: 83667
  misc_feature 1..202: note = chr19:44030617-44030819
  misc_feature 1..202: note = Hyper
  source 1..202: mol_type = genomic DNA

SEQ ID NO: 116390 - DNA, 225 bp, Homo sapiens; identical to SEQ ID NO: 83668
  misc_feature 1..225: note = chr19:44203639-44203864
  misc_feature 1..225: note = Hyper
  source 1..225: mol_type = genomic DNA

SEQ ID NO: 116391 - DNA, 54 bp, Homo sapiens; identical to SEQ ID NO: 83669
  misc_feature 1..54: note = chr19:44223121-44223175
  misc_feature 1..54: note = Hypo
  source 1..54: mol_type = genomic DNA

SEQ ID NO: 116392 - DNA, 137 bp, Homo sapiens; identical to SEQ ID NO: 83670
  misc_feature 1..137: note = chr19:44223519-44223656
  misc_feature 1..137: note = Hypo
  source 1..137: mol_type = genomic DNA

SEQ ID NO: 116393 - DNA, 133 bp, Homo sapiens; identical to SEQ ID NO: 83671
  misc_feature 1..133: note = chr19:44274041-44274174
  misc_feature 1..133: note = Hypo
  source 1..133: mol_type = genomic DNA

SEQ ID NO: 116394 - DNA, 318 bp, Homo sapiens; identical to SEQ ID NO: 83672
  misc_feature 1..318: note = chr19:44302850-44303168
  misc_feature 1..318: note = Hyper
  source 1..318: mol_type = genomic DNA

SEQ ID NO: 116395 - DNA, 115 bp, Homo sapiens
  misc_feature 1..115: note = chr19:44324802-44324917
  misc_feature 1..115: note = Hyper
  source 1..115: mol_type = genomic DNA
cggatcaggagcgcacgctcattcggcccagtgacctgtgggaattgtagtcccgggccggaaacgcaggagacgccagaaacccaagtttgggacggcgcgtcccaagggtttc

SEQ ID NO: 116396 - DNA, 49 bp, Homo sapiens; identical to SEQ ID NO: 83675
  misc_feature 1..49: note = chr19:44331793-44331842
  misc_feature 1..49: note = Hyper
  source 1..49: mol_type = genomic DNA

SEQ ID NO: 116397 - DNA, 215 bp, Homo sapiens
  misc_feature 1..215: note = chr19:44405908-44406123
  misc_feature 1..215: note = Hyper
  source 1..215: mol_type = genomic DNA
tgatttctgtggagacgatctactcaccacgtaggggctacagcagctcggacaccggaaaaagatctagagctcgagggtgaccctagcgcggtgacttctgggaaatgtagtccacccggaataaccatgtccacggcgcccgccattctgtagcctatgctcggagggcacatgagcaagagcttgaccatctgtaccgttggttgacttgc

SEQ ID NO: 116398 - DNA, 45 bp, Homo sapiens; identical to SEQ ID NO: 83678
  misc_feature 1..45: note = chr19:44455296-44455341
  misc_feature 1..45: note = Hyper
  source 1..45: mol_type = genomic DNA

SEQ ID NO: 116399 - DNA, 46 bp, Homo sapiens; identical to SEQ ID NO: 37556
  misc_feature 1..46: note = chr19:44455621-44455667
  misc_feature 1..46: note = Hyper
  source 1..46: mol_type = genomic DNA

SEQ ID NO: 116400 - DNA, 490 bp, Homo sapiens; identical to SEQ ID NO: 83680
  misc_feature 1..490: note = chr19:44488127-44488617
  misc_feature 1..490: note = Hyper
  source 1..490: mol_type = genomic DNA

SEQ ID NO: 116401 - DNA, 60 bp, Homo sapiens; identical to SEQ ID NO: 83681
  misc_feature 1..60: note = chr19:44529378-44529438
  misc_feature 1..60: note = Hyper
  source 1..60: mol_type = genomic DNA

SEQ ID NO: 116402 - DNA, 67 bp, Homo sapiens; identical to SEQ ID NO: 83682
  misc_feature 1..67: note = chr19:44529707-44529774
  misc_feature 1..67: note = Hyper
  source 1..67: mol_type = genomic DNA

SEQ ID NO: 116403 - DNA, 104 bp, Homo sapiens; identical to SEQ ID NO: 83683
  misc_feature 1..104: note = chr19:44556147-44556251
  misc_feature 1..104: note = Hyper
  source 1..104: mol_type = genomic DNA

SEQ ID NO: 116404 - DNA, 304 bp, Homo sapiens; identical to SEQ ID NO: 83684
  misc_feature 1..304: note = chr19:44576101-44576405
  misc_feature 1..304: note = Hyper
  source 1..304: mol_type = genomic DNA

SEQ ID NO: 116405 - DNA, 27 bp, Homo sapiens
  misc_feature 1..27: note = chr19:44599783-44599810
  misc_feature 1..27: note = Hypo
  source 1..27: mol_type = genomic DNA
acaaaatgggcctggcgcggtggctta

SEQ ID NO: 116406 - DNA, 30 bp, Homo sapiens; identical to SEQ ID NO: 83686
  misc_feature 1..30: note = chr19:44615558-44615588
  misc_feature 1..30: note = Hypo
  source 1..30: mol_type = genomic DNA

SEQ ID NO: 116407 - DNA, 55 bp, Homo sapiens; identical to SEQ ID NO: 83687
  misc_feature 1..55: note = chr19:44645516-44645571
  misc_feature 1..55: note = Hyper
  source 1..55: mol_type = genomic DNA

SEQ ID NO: 116408 - DNA, 448 bp, Homo sapiens; identical to SEQ ID NO: 83688
  misc_feature 1..448: note = chr19:44711515-44711963
  misc_feature 1..448: note = Hyper
  source 1..448: mol_type = genomic DNA

SEQ ID NO: 116409 - DNA, 247 bp, Homo sapiens; identical to SEQ ID NO: 83689
  misc_feature 1..247: note = chr19:44905364-44905611
  misc_feature 1..247: note = Hyper
  source 1..247: mol_type = genomic DNA

SEQ ID NO: 116410 - DNA, 35 bp, Homo sapiens; identical to SEQ ID NO: 83690
  misc_feature 1..35: note = chr19:44907102-44907137
  misc_feature 1..35: note = Hypo
  source 1..35: mol_type = genomic DNA

SEQ ID NO: 116411 - DNA, 533 bp, Homo sapiens
  misc_feature 1..533: note = chr19:44952282-44952815
  misc_feature 1..533: note = Hyper
  source 1..533: mol_type = genomic DNA
ccacaagtgggtgggcggctaccctgagaaaattcatgtcatcgatccgcaactgacacagtggagtctcccgcactgcagatctcatctcaaagccagagctggcctcaaactgcttttccaagcctggactgcgagggctgccgacccgggcccaccccgcacaggcgctcagaatgttcgatacgtgcgcctccttacacccctgcctcaccaggccgagctcatggaaatccgtgggcttcgaccctccgccgcacgttgtcccttcacactggtcctatagagccgatcctaattcccatggcctgacagtacaaccgcatggagatgcacgtctctaagacgcctcaccactgcctaagaagcaatcaaggtgacgcgcccaccggaaacggaagtagtcgactcgaggtgtgggactacctttcccagaaccctccgcagcgcagtccgatcctaggggcgatggtgtcgtaaatgcgcgtccacctcgagtcacgcccactgcgaggcggcgggaggcggcatgc

SEQ ID NO: 116412 - DNA, 124 bp, Homo sapiens; identical to SEQ ID NO: 83694
  misc_feature 1..124: note = chr19:45003229-45003353
  misc_feature 1..124: note = Hypo
  source 1..124: mol_type = genomic DNA

SEQ ID NO: 116413 - DNA, 251 bp, Homo sapiens; identical to SEQ ID NO: 83697
  misc_feature 1..251: note = chr19:45147116-45147367
  misc_feature 1..251: note = Hyper
  source 1..251: mol_type = genomic DNA

SEQ ID NO: 116414 - DNA, 35 bp, Homo sapiens; identical to SEQ ID NO: 83698
  misc_feature 1..35: note = chr19:45147699-45147734
  misc_feature 1..35: note = Hyper
  source 1..35: mol_type = genomic DNA

SEQ ID NO: 116415 - DNA, 77 bp, Homo sapiens; identical to SEQ ID NO: 83699
  misc_feature 1..77: note = chr19:45207322-45207399
  misc_feature 1..77: note = Hypo
  source 1..77: mol_type = genomic DNA

SEQ ID NO: 116416 - DNA, 30 bp, Homo sapiens; identical to SEQ ID NO: 83702
  misc_feature 1..30: note = chr19:45257135-45257165
  misc_feature 1..30: note = Hyper
  source 1..30: mol_type = genomic DNA

SEQ ID NO: 116417 - DNA, 30 bp, Homo sapiens; identical to SEQ ID NO: 83703
  misc_feature 1..30: note = chr19:45257570-45257600
  misc_feature 1..30: note = Hyper
  source 1..30: mol_type = genomic DNA

SEQ ID NO: 116418 - DNA, 30 bp, Homo sapiens; identical to SEQ ID NO: 83704
  misc_feature 1..30: note = chr19:45257848-45257878
  misc_feature 1..30: note = Hyper
  source 1..30: mol_type = genomic DNA

SEQ ID NO: 116419 - DNA, 41 bp, Homo sapiens; identical to SEQ ID NO: 83705
  misc_feature 1..41: note = chr19:45279876-45279917
  misc_feature 1..41: note = Hypo
  source 1..41: mol_type = genomic DNA

SEQ ID NO: 116420 - DNA, 30 bp, Homo sapiens; identical to SEQ ID NO: 83706
  misc_feature 1..30: note = chr19:45287728-45287758
  misc_feature 1..30: note = Hyper
  source 1..30: mol_type = genomic DNA

SEQ ID NO: 116421 - DNA, 98 bp, Homo sapiens; identical to SEQ ID NO: 83707
  misc_feature 1..98: note = chr19:45300099-45300197
  misc_feature 1..98: note = Hyper
  source 1..98: mol_type = genomic DNA

SEQ ID NO: 116422 - DNA, 63 bp, Homo sapiens; identical to SEQ ID NO: 83708
  misc_feature 1..63: note = chr19:45316633-45316696
  misc_feature 1..63: note = Hypo
  source 1..63: mol_type = genomic DNA

SEQ ID NO: 116423 - DNA, 30 bp, Homo sapiens; identical to SEQ ID NO: 83709
  misc_feature 1..30: note = chr19:45316929-45316959
  misc_feature 1..30: note = Hypo
  source 1..30: mol_type = genomic DNA

SEQ ID NO: 116424 - DNA, 39 bp, Homo sapiens; identical to SEQ ID NO: 83710
  misc_feature 1..39: note = chr19:45350901-45350940
  misc_feature 1..39: note = Hyper
  source 1..39: mol_type = genomic DNA

SEQ ID NO: 116425 - DNA, 33 bp, Homo sapiens; identical to SEQ ID NO: 16517
  misc_feature 1..33: note = chr19:45381918-45381951
  misc_feature 1..33: note = Hypo
  source 1..33: mol_type = genomic DNA

SEQ ID NO: 116426 - DNA, 30 bp, Homo sapiens; identical to SEQ ID NO: 83715
  misc_feature 1..30: note = chr19:45511777-45511807
  misc_feature 1..30: note = Hypo
  source 1..30: mol_type = genomic DNA

SEQ ID NO: 116427 - DNA, 107 bp, Homo sapiens; identical to SEQ ID NO: 45911
  misc_feature 1..107: note = chr19:45570386-45570493
  misc_feature 1..107: note = Hypo
  source 1..107: mol_type = genomic DNA

SEQ ID NO: 116428 - DNA, 257 bp, Homo sapiens; identical to SEQ ID NO: 83721
  misc_feature 1..257: note = chr19:45574443-45574700
  misc_feature 1..257: note = Hypo
  source 1..257: mol_type = genomic DNA

SEQ ID NO: 116429 - DNA, 221 bp, Homo sapiens; identical to SEQ ID NO: 83722
  misc_feature 1..221: note = chr19:45574935-45575156
  misc_feature 1..221: note = Hypo
  source 1..221: mol_type = genomic DNA

SEQ ID NO: 116430 - DNA, 30 bp, Homo sapiens; identical to SEQ ID NO: 45914
  misc_feature 1..30: note = chr19:45601584-45601614
  misc_feature 1..30: note = Hypo
  source 1..30: mol_type = genomic DNA

SEQ ID NO: 116431 - DNA, 30 bp, Homo sapiens; identical to SEQ ID NO: 83724
  misc_feature 1..30: note = chr19:45603183-45603213
  misc_feature 1..30: note = Hypo
  source 1..30: mol_type = genomic DNA

SEQ ID NO: 116432 - DNA, 33 bp, Homo sapiens; identical to SEQ ID NO: 83725
  misc_feature 1..33: note = chr19:45603877-45603910
  misc_feature 1..33: note = Hypo
  source 1..33: mol_type = genomic DNA

SEQ ID NO: 116433 - DNA, 30 bp, Homo sapiens; identical to SEQ ID NO: 45915
  misc_feature 1..30: note = chr19:45616778-45616808
  misc_feature 1..30: note = Hypo
  source 1..30: mol_type = genomic DNA

SEQ ID NO: 116434 - DNA, 30 bp, Homo sapiens; identical to SEQ ID NO: 83727
  misc_feature 1..30: note = chr19:45622695-45622725
  misc_feature 1..30: note = Hypo
  source 1..30: mol_type = genomic DNA

SEQ ID NO: 116435 - DNA, 515 bp, Homo sapiens; identical to SEQ ID NO: 83728
  misc_feature 1..515: note = chr19:45626532-45627047
  misc_feature 1..515: note = Hypo
  source 1..515: mol_type = genomic DNA

SEQ ID NO: 116436 - DNA, 30 bp, Homo sapiens; identical to SEQ ID NO: 83729
  misc_feature 1..30: note = chr19:45633892-45633922
  misc_feature 1..30: note = Hypo
  source 1..30: mol_type = genomic DNA

SEQ ID NO: 116437 - DNA, 30 bp, Homo sapiens; identical to SEQ ID NO: 83730
  misc_feature 1..30: note = chr19:45654552-45654582
  misc_feature 1..30: note = Hypo
  source 1..30: mol_type = genomic DNA

SEQ ID NO: 116438 - DNA, 1163 bp, Homo sapiens
  misc_feature 1..1163: note = chr19:45655298-45656461
  misc_feature 1..1163: note = Hyper
  source 1..1163: mol_type = genomic DNA
gcttgccctgaggcacggcccgacgggggcgccctggaggcgctgttggcccggtgggcagcgtggggggtatcgcgggtaggggacttgggcgggctgggcggcttgagcgcgctgacggctcggatgagacccatgcgccggcggatggagtggtccaggttgaccgtgcagcgcagcaggctctgcgcctcggccacggtgaaggggaagtcggcgcccaggaagcgctcgaagagctcggggtcgccgtccaggtcgagcacgttctgcaacgccttggtcatggtgtgcagctcgcggctgttgtcgcggaaaacgtcccagaggcgcgcgcggccctcgggcgcgcccccggtctgctgccggtcctccaggcactgcagcgcccagctcaggcggcacggccactggttggcgagcaccacccacgccaccgcctggcgcggcgtggggcccccaaagtccccctgctgctgctgctgctgcagcaggcgcacggtgatgggcacggtgttgacgatgcgccgcatggacaccacgttgtcgggcacgtactcgtagaggcagtcgcgctcgtcgtgaaggcagaagagcgcctcctggattcgccgcgccgcctcgtcgtcgatgcggccctgcccgcgctccgtccccgcctgcgcctgcaccgccagcagctgcgcgctctcgcccccggcgtcccccggcagccacggcttgcgcgtcatctcgcggtacaacaggtcgtcgcggctctgcaccgcatcgtgcaggaactgcagcttggtgcggcggcccataatgggcacagagaagggcagcgtgacagtgcggttgaggaagaggtagccgttatcggccgtgcccttcatgttgcccgcgctctctaggcacgcggccaggatgctggggtccacgaccaggatgaagatgaagggcgcgtggctgtcggacagcagcgtgttgatggcgttgagcacgcccaccacgcgctccgggtagcacgtgtccagcccggtgacctccagcaccacgcgcagcctgcgccgctggtagatctccaggaagcacaggaagtcggtgagcagctccacctccttcttcacctcgcacatgaaacccagctggctgccgaacttttcacgcgacaccagccgctc

SEQ ID NO: 116439 - DNA, 720 bp, Homo sapiens
  misc_feature 1..720: note = chr19:45656661-45657381
  misc_feature 1..720: note = Hyper
  source 1..720: mol_type = genomic DNA
gcagccccaggcacacgcggcgccgacaatgccactcgctctggcagcagtcctgcctggtggccggcttgttgcccagcaccgagtacacgctgaagggcagtgcgccatagtggcggcggatgccctcgcacaacgtggtcaccaggccggcccacagcttgtcggtgcccgcgtactgccaggcgctaaagcggatgaaaaggaactgcacgttcctgcgccgcaggtgcacctcggtgatgatgggctgcaggaacaccaggtaccacagtagctgcgggacgccccagccgctcacggcacgcggccgccactgcacgtgctgcagctcctcgctctcgcgctgcgcggcctcctgctgcatcagcgctgcgggaagggagcccgggagccgcgtgagccgcagacccgccggggtgggcggggcctagtacgggcagggcggagcgctcctggagaggcgaggggcgcccagcagaggcgaggggctggaagcgagccgcggccgctccttaaagagctggaagccggtgcagaagcgggggcgtggagaggcctggagccgggcttggaccggaagcggtctgaaggccaggctgtggggtcgggatgggcagaggtagagccggcagaggagagatgggaggaggcaaaaagagatacgaggaagagccagggatgggcaagaggctggaggcggagcgagggtgtggaggg

SEQ ID NO: 116440 - DNA, 30 bp, Homo sapiens; identical to SEQ ID NO: 16519
  misc_feature 1..30: note = chr19:45709152-45709182
  misc_feature 1..30: note = Hypo
  source 1..30: mol_type = genomic DNA

SEQ ID NO: 116441 - DNA, 120 bp, Homo sapiens; identical to SEQ ID NO: 83738
  misc_feature 1..120: note = chr19:45751309-45751429
  misc_feature 1..120: note = Hypo
  source 1..120: mol_type = genomic DNA

SEQ ID NO: 116442 - DNA, 44 bp, Homo sapiens; identical to SEQ ID NO: 83739
  misc_feature 1..44: note = chr19:45753553-45753597
  misc_feature 1..44: note = Hypo
  source 1..44: mol_type = genomic DNA

SEQ ID NO: 116443 - DNA, 83 bp, Homo sapiens; identical to SEQ ID NO: 83740
  misc_feature 1..83: note = chr19:45755351-45755434
  misc_feature 1..83: note = Hyper
  source 1..83: mol_type = genomic DNA

SEQ ID NO: 116444 - DNA, 264 bp, Homo sapiens; identical to SEQ ID NO: 83741
  misc_feature 1..264: note = chr19:45810003-45810267
  misc_feature 1..264: note = Hypo
  source 1..264: mol_type = genomic DNA

SEQ ID NO: 116445 - DNA, 92 bp, Homo sapiens; identical to SEQ ID NO: 45921
  misc_feature 1..92: note = chr19:45810770-45810862
  misc_feature 1..92: note = Hypo
  source 1..92: mol_type = genomic DNA

SEQ ID NO: 116446 - DNA, 492 bp, Homo sapiens; identical to SEQ ID NO: 83743
  misc_feature 1..492: note = chr19:45826794-45827286
  misc_feature 1..492: note = Hyper
  source 1..492: mol_type = genomic DNA

SEQ ID NO: 116447 - DNA, 35 bp, Homo sapiens; identical to SEQ ID NO: 83744
  misc_feature 1..35: note = chr19:45835233-45835268
  misc_feature 1..35: note = Hypo
  source 1..35: mol_type = genomic DNA

SEQ ID NO: 116448 - DNA, 250 bp, Homo sapiens; identical to SEQ ID NO: 83745
  misc_feature 1..250: note = chr19:45851193-45851443
  misc_feature 1..250: note = Hypo
  source 1..250: mol_type = genomic DNA

SEQ ID NO: 116449 - DNA, 77 bp, Homo sapiens; identical to SEQ ID NO: 83746
  misc_feature 1..77: note = chr19:45852140-45852217
  misc_feature 1..77: note = Hypo
  source 1..77: mol_type = genomic DNA

SEQ ID NO: 116450 - DNA, 30 bp, Homo sapiens; identical to SEQ ID NO: 83747
  misc_feature 1..30: note = chr19:45855901-45855931
  misc_feature 1..30: note = Hypo
  source 1..30: mol_type = genomic DNA

SEQ ID NO: 116451 - DNA, 624 bp, Homo sapiens
  misc_feature 1..624: note = chr19:45888782-45889406
  misc_feature 1..624: note = Hyper
  source 1..624: mol_type = genomic DNA
cgccaggtacccaggcgccagcagccctgcctcgcacctgccaggtaggtggcgcagtcagcataaccctcgcggtaagggtcgcacttctcgaaggcggtggcgccgtcgctgagcgtggtggcgaagattgcagcgccgtgctgcaccagcgccatgcagatgactgtgtcgttgcacgacgccgcgcagtgcaagggtgtcctaggcgtgggggtggggggttgcggggaacgatgcgtgagaggctgcgcgtccgcccacgggggacccagcccaccgcgcgggtcggggctcaccagccgtggctgtcgggggagttgacattggcacccgcggtgatgaggaaatccacgatagagtagttggcgccgcagatggcgttgtgcaaggcagtgatgccctcctcgttgggctggctcgggtcgttcatctgagtgcaccgggggagggggaagactcagtcccgcggctggcatctgcgatgcccccgccgtgcccacctcccgctcagcagcgctcacctccttcaccgcctgctgcaccacctccagctccccggtcagcgccgcgtccaggaggagcaccagagggttgaggcgcgcgcggcgggccttgcgcggg

SEQ ID NO: 116452 - DNA, 30 bp, Homo sapiens; identical to SEQ ID NO: 83750
  misc_feature 1..30: note = chr19:45926223-45926253
  misc_feature 1..30: note = Hypo
  source 1..30: mol_type = genomic DNA

SEQ ID NO: 116453 - DNA, 163 bp, Homo sapiens; identical to SEQ ID NO: 83751
  misc_feature 1..163: note = chr19:45931112-45931275
  misc_feature 1..163: note = Hyper
  source 1..163: mol_type = genomic DNA

SEQ ID NO: 116454 - DNA, 53 bp, Homo sapiens; identical to SEQ ID NO: 83752
  misc_feature 1..53: note = chr19:45931735-45931788
  misc_feature 1..53: note = Hyper
  source 1..53: mol_type = genomic DNA

SEQ ID NO: 116455 - DNA, 34 bp, Homo sapiens; identical to SEQ ID NO: 83753
  misc_feature 1..34: note = chr19:45941595-45941629
  misc_feature 1..34: note = Hypo
  source 1..34: mol_type = genomic DNA

SEQ ID NO: 116456 - DNA, 30 bp, Homo sapiens; identical to SEQ ID NO: 83755
  misc_feature 1..30: note = chr19:45976163-45976193
  misc_feature 1..30: note = Hyper
  source 1..30: mol_type = genomic DNA

SEQ ID NO: 116457 - DNA, 264 bp, Homo sapiens; identical to SEQ ID NO: 83756
  misc_feature 1..264: note = chr19:45997416-45997680
  misc_feature 1..264: note = Hypo
  source 1..264: mol_type = genomic DNA

SEQ ID NO: 116458 - DNA, 783 bp, Homo sapiens
  misc_feature 1..783: note = chr19:46001719-46002502
  misc_feature 1..783: note = Hyper
  source 1..783: mol_type = genomic DNA
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggtggggctcgagctgcccgcttcggtgcacgccatttgccaggccatgtgctccaggagctgggcccggagcctagcgagcccgagggcgtgcgcgaggcgctgcgccgagccttcttgagcgccgacgagcgcctgcgctccctctggccccgcgtggaaacgggcggctgcacggccgtggtgttgctggtctccccgcggtttctgtacctggcgcactgcggtgactcccgcgcggtgctgagccgcgctggcgccgtggccttcagcacagaggaccaccggccccttcgaccccgggaacgcgagcgcatccacgccgctggcggcaccatccgccgccgccgcgtcgagggctctctggccgtgtcgcgagcgttgggcgactttacctacaaggaggctccggggaggccccccgagctacagctcgtttctgcggagccagaggtgg

SEQ ID NO: 116459 - DNA, 32 bp, Homo sapiens; identical to SEQ ID NO: 83760
  misc_feature 1..32: note = chr19:46012412-46012444
  misc_feature 1..32: note = Hyper
  source 1..32: mol_type = genomic DNA

SEQ ID NO: 116460 - DNA, 21 bp, Homo sapiens
  misc_feature 1..21: note = chr19:46087047-46087068
  misc_feature 1..21: note = Hypo
  source 1..21: mol_type = genomic DNA
ccgcgccggaccttactatgc

SEQ ID NO: 116461 - DNA, 150 bp, Homo sapiens
  misc_feature 1..150: note = chr19:46105207-46105357
  misc_feature 1..150: note = Hyper
  source 1..150: mol_type = genomic DNA
gagcaacagagggggcgggcaccgagacggcgcgggagactgaggcagcccccgagggggcggggaggagcggtctcgccacgagcagggcaacctagtgagaccccgcagcatcgcgggcagccggggaggacccggcacttacctgcg

SEQ ID NO: 116462 - DNA, 86 bp, Homo sapiens; identical to SEQ ID NO: 83765
  misc_feature 1..86: note = chr19:46144079-46144165
  misc_feature 1..86: note = Hypo
  source 1..86: mol_type = genomic DNA

SEQ ID NO: 116463 - DNA, 45 bp, Homo sapiens; identical to SEQ ID NO: 83766
  misc_feature 1..45: note = chr19:46146928-46146973
  misc_feature 1..45: note = Hyper
  source 1..45: mol_type = genomic DNA

SEQ ID NO: 116464 - DNA, 61 bp, Homo sapiens; identical to SEQ ID NO: 83767
  misc_feature 1..61: note = chr19:46148823-46148884
  misc_feature 1..61: note = Hyper
  source 1..61: mol_type = genomic DNA

SEQ ID NO: 116465 - DNA, 30 bp, Homo sapiens; identical to SEQ ID NO: 83768
  misc_feature 1..30: note = chr19:46172830-46172860
  misc_feature 1..30: note = Hyper
  source 1..30: mol_type = genomic DNA

SEQ ID NO: 116466 - DNA, 355 bp, Homo sapiens; identical to SEQ ID NO: 83769
  misc_feature 1..355: note = chr19:46173896-46174251
  misc_feature 1..355: note = Hyper
  source 1..355: mol_type = genomic DNA

SEQ ID NO: 116467 - DNA, 200 bp, Homo sapiens; identical to SEQ ID NO: 83771
  misc_feature 1..200: note = chr19:46180359-46180559
  misc_feature 1..200: note = Hyper
  source 1..200: mol_type = genomic DNA

SEQ ID NO: 116468 - DNA, 151 bp, Homo sapiens; identical to SEQ ID NO: 83773
  misc_feature 1..151: note = chr19:46234852-46235003
  misc_feature 1..151: note = Hypo
  source 1..151: mol_type = genomic DNA

SEQ ID NO: 116469 - DNA, 60 bp, Homo sapiens; identical to SEQ ID NO: 83774
  misc_feature 1..60: note = chr19:46269160-46269220
  misc_feature 1..60: note = Hypo
  source 1..60: mol_type = genomic DNA

SEQ ID NO: 116470 - DNA, 146 bp, Homo sapiens
  misc_feature 1..146: note = chr19:46283022-46283168
  misc_feature 1..146: note = Hyper
  source 1..146: mol_type = genomic DNA
cggttcggcttacctcgctgaacgccccgcgtccgatcaccttcagaatctcgaagtcgtccctctgcagtcggacctccttaagcctcaccacgatgggctccgctgggggggtggtgggggaaaagaaccgagggtcaccagaa

SEQ ID NO: 116471 - DNA, 244 bp, Homo sapiens; identical to SEQ ID NO: 83777
  misc_feature 1..244: note = chr19:46321178-46321422
  misc_feature 1..244: note = Hypo
  source 1..244: mol_type = genomic DNA

SEQ ID NO: 116472 - DNA, 85 bp, Homo sapiens; identical to SEQ ID NO: 83778
  misc_feature 1..85: note = chr19:46324647-46324732
  misc_feature 1..85: note = Hypo
  source 1..85: mol_type = genomic DNA

SEQ ID NO: 116473 - DNA, 149 bp, Homo sapiens; identical to SEQ ID NO: 83779
  misc_feature 1..149: note = chr19:46327091-46327240
  misc_feature 1..149: note = Hypo
  source 1..149: mol_type = genomic DNA

SEQ ID NO: 116474 - DNA, 30 bp, Homo sapiens; identical to SEQ ID NO: 45930
  misc_feature 1..30: note = chr19:46346873-46346903
  misc_feature 1..30: note = Hypo
  source 1..30: mol_type = genomic DNA

SEQ ID NO: 116475 - DNA, 95 bp, Homo sapiens; identical to SEQ ID NO: 45931
  misc_feature 1..95: note = chr19:46356540-46356635
  misc_feature 1..95: note = Hypo
  source 1..95: mol_type = genomic DNA

SEQ ID NO: 116476 - DNA, 599 bp, Homo sapiens
  misc_feature 1..599: note = chr19:46379843-46380442
  misc_feature 1..599: note = Hyper
  source 1..599: mol_type = genomic DNA
ctctacctgccacctcgcaggccaggccctctattcctgtcgctgcgccccgccttgccggctgcgtgtcacccccgccccctgccgcgctggctccccgtccgtcccaccagccttgctgtcctgggcaggccggggaattcctcccggttcctggaaaaaacaactggggccgagagaaaggccctcagtctccccaggcacccgcccccctccctcgggcctgggggtctctcccggagtcggccagcccgaggcaggaagccctgcggtttctggcttctcccaggcggcctccggatctggcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtggccaccagctctgctggcgtgggcaggtgtgacccccaccccagggacagccggctgatgtccagc

SEQ ID NO: 116477 - DNA, 149 bp, Homo sapiens; identical to SEQ ID NO: 83784
  misc_feature 1..149: note = chr19:46404522-46404671
  misc_feature 1..149: note = Hypo
  source 1..149: mol_type = genomic DNA

SEQ ID NO: 116478 - DNA, 22 bp, Homo sapiens
  misc_feature 1..22: note = chr19:46461106-46461128
  misc_feature 1..22: note = Hypo
  source 1..22: mol_type = genomic DNA
agcactttgggaggccgaggcg

SEQ ID NO: 116479 - DNA, 30 bp, Homo sapiens; identical to SEQ ID NO: 83786
  misc_feature 1..30: note = chr19:46474960-46474990
  misc_feature 1..30: note = Hyper
  source 1..30: mol_type = genomic DNA

SEQ ID NO: 116480 - DNA, 529 bp, Homo sapiens
  misc_feature 1..529: note = chr19:46476943-46477472
  misc_feature 1..529: note = Hyper
  source 1..529: mol_type = genomic DNA
acagagcctggagagcggccgtgagcaggatggcagggccgaggggggtctccgatagggccgggaaagaactgagaggtggggtctctcctgggaccacagaggctggggactggacgcgccactggggggacgggactccccgcttcttcttggctccctggggcaagagggccgagccccccagaccctgctcggggtggggggccggaggagcgtggccggagtgggaggcggaggcggccgctagtgggggcccggggggcggcgggcgcgggcggcggcggcgacggggctggcggtggctgctggcccgagcatcttcttcccggaggctcccacagcgcctggcccctcccacccaacgaggtcacgcccatgccgggtagggccacgcccttcggcgcccccattggtccagccttgaagcctggaccacgtccctctgggttggccacgcccctcccggcggcagagagctggacccgactcccccaggctgctgggaggaccccgggctcctccaagc

SEQ ID NO: 116481 - DNA, 327 bp, Homo sapiens; identical to SEQ ID NO: 83789
  misc_feature 1..327: note = chr19:46519255-46519582
  misc_feature 1..327: note = Hyper
  source 1..327: mol_type = genomic DNA

SEQ ID NO: 116482 - DNA, 30 bp, Homo sapiens; identical to SEQ ID NO: 83790
  misc_feature 1..30: note = chr19:46580568-46580598
  misc_feature 1..30: note = Hyper
  source 1..30: mol_type = genomic DNA

SEQ ID NO: 116483 - DNA, 25 bp, Homo sapiens
  misc_feature 1..25: note = chr19:46763496-46763521
  misc_feature 1..25: note = Hypo
  source 1..25: mol_type = genomic DNA
ctaccgcgcccggccttttttgtct

SEQ ID NO: 116484 - DNA, 45 bp, Homo sapiens; identical to SEQ ID NO: 83795
  misc_feature 1..45: note = chr19:46800530-46800575
  misc_feature 1..45: note = Hyper
  source 1..45: mol_type = genomic DNA

SEQ ID NO: 116485 - DNA, 30 bp, Homo sapiens; identical to SEQ ID NO: 83796
  misc_feature 1..30: note = chr19:46807600-46807630
  misc_feature 1..30: note = Hypo
  source 1..30: mol_type = genomic DNA

SEQ ID NO: 116486 - DNA, 238 bp, Homo sapiens; identical to SEQ ID NO: 83797
  misc_feature 1..238: note = chr19:46811841-46812079
  misc_feature 1..238: note = Hypo
  source 1..238: mol_type = genomic DNA

SEQ ID NO: 116487 - DNA, 35 bp, Homo sapiens; identical to SEQ ID NO: 83799
  misc_feature 1..35: note = chr19:46876191-46876226
  misc_feature 1..35: note = Hypo
  source 1..35: mol_type = genomic DNA

SEQ ID NO: 116488 - DNA, 635 bp, Homo sapiens; identical to SEQ ID NO: 83800
  misc_feature 1..635: note = chr19:46907187-46907822
  misc_feature 1..635: note = Hyper
  source 1..635: mol_type = genomic DNA

SEQ ID NO: 116489 - DNA, 51 bp, Homo sapiens; identical to SEQ ID NO: 83801
  misc_feature 1..51: note = chr19:46908071-46908122
  misc_feature 1..51: note = Hyper
  source 1..51: mol_type = genomic DNA

SEQ ID NO: 116490 - DNA, 604 bp, Homo sapiens
  misc_feature 1..604: note = chr19:46916491-46917095
  misc_feature 1..604: note = Hyper
  source 1..604: mol_type = genomic DNA
tttccaggatgcctacgtgagccgggggcgaggtcagtcccaaggctcaaggcccactccaagctggaaacgtggtgtcccagctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcctccagtagggtcccccgcccccaggcaggccgccacccagctccaggctgaccttgacgcgccgcagcctgccagcccgcgcgcttagagctctgcaccgtggagcgcgcgggcaggaagttcctcctcgccctccgccagaatgaggcccaccttcccccgtctcatcttacactcccagactctggaagactgacaggggggctgtccactcccttcggggcggcctccttcccctcccccacaggggtgtggccgcgccccgggcctagctgggcccattgcttcccagcgaagcggcagtggcccacgtcagcacctttcctgaaaggcagcggttcccaaacctgccatccgaaatgtgcaagtt

SEQ ID NO: 116491 - DNA, 205 bp, Homo sapiens; identical to SEQ ID NO: 83804
  misc_feature 1..205: note = chr19:46929995-46930200
  misc_feature 1..205: note = Hyper
  source 1..205: mol_type = genomic DNA

SEQ ID NO: 116492 - DNA, 52 bp, Homo sapiens; identical to SEQ ID NO: 83805
  misc_feature 1..52: note = chr19:46931467-46931519
  misc_feature 1..52: note = Hypo
  source 1..52: mol_type = genomic DNA

SEQ ID NO: 116493 - DNA, 283 bp, Homo sapiens; identical to SEQ ID NO: 83806
  misc_feature 1..283: note = chr19:46932053-46932336
  misc_feature 1..283: note = Hyper
  source 1..283: mol_type = genomic DNA

SEQ ID NO: 116494 - DNA, 471 bp, Homo sapiens
  misc_feature 1..471: note = chr19:46974489-46974960
  misc_feature 1..471: note = Hyper
  source 1..471: mol_type = genomic DNA
ccccaacccaggccccggtgctcacacgtgtccctgaatctgcagcaaaaggccctaggaccctcccccgggcctgacgctccgcctgcccagccgggacttacttggcagatcagcctccgaccgcccagccaggccaaggagacgcagtggaatgcagccgtttcccagtcgctggctccggctaccccggcgccgctgctagaggcagaaagggccaagaaggcgccgtccgcccccgctccggcccaggcgggtcacggggcgtccagactcgatgccgttagcggcgagaagccgaggttggcgtcgcagcgcgcgcctgcgcactggctcccgcaccgccgctcgggggtcttgggctgcgcaggtgccgacgtctccatggcaaccgggcgtgggttgctagggctgagcccggccggcgcgccggcgctgcaattggacctagggagccgggtgcaagagtgg

SEQ ID NO: 116495 - DNA, 1017 bp, Homo sapiens
  misc_feature 1..1017: note = chr19:46992698-46993715
  misc_feature 1..1017: note = Hyper
  source 1..1017: mol_type = genomic DNA
tcctcatctagggagcgtaaccccagcctccccaccgcatgctccctgcgggagggtcctgtttcctgcaccaagaacagggcctgggacgcgccagccctggataaatctcatggactgcgcggatggcgctgagggctcctcccagacagtcgccttctctcccaggagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcgaccccaaacactcctccccatccccgccggagcactccctccaggaatgagggaatgaaaacaatgtttctttccagcacattccccaccaggcctatctgggatctgactcacccagtccgcgtggttcattccgaccgtcagtcattcaacaaataacagccgccgccgcgtgccaggcacggtgttggggctggggacacgaaggggaaaggccaagccacactttttccctacggagctggccctaagccgctctgccgcgcctctccccgccacgcccacctgcccccatgccgcataggtccccacagccaccgctcagggccctctgcaggggctgctgctgctgcaagcccacggggcgctggggggagtttgaaagcaggaggaaagggacgccatttgggggaatgctcaggccgtggtggcagcagcagctggcggtcactgcggtgaaccaggggctcccgggtctctcctcaagcaagccggccccgtgcgtggaacttggcagtcctacactagggctctgatcaccagcctttcccaagtggctcctccagccctcgggagggagcagctccctgcattgctaatattgggacaaaacgatctccctgtttttgcacttcctgattgcaataccccagtcaccaatttcctctattaacctccctgacaagtacagtcggtgtgccaggggg

SEQ ID NO: 116496 - DNA, 77 bp, Homo sapiens; identical to SEQ ID NO: 37596
  misc_feature 1..77: note = chr19:46996589-46996666
  misc_feature 1..77: note = Hyper
  source 1..77: mol_type = genomic DNA

SEQ ID NO: 116497 - DNA, 225 bp, Homo sapiens
  misc_feature 1..225: note = chr19:46996871-46997096
  misc_feature 1..225: note = Hyper
  source 1..225: mol_type = genomic DNA
cttggatccagtgggcgcctggcccttggcctcgcctgccctggcatgggccccggcgcccgcgctccccttcttcttcctgcttcctgcggcgtcgtcctgggccgagccccggctcccggctttcttctcgggagtgacgccccggcctcggcctcggccgcccgcgcgggttttgcgggccccggaagcggtgggaggcgcgccggccggagtcaggcccct

SEQ ID NO: 116498 - DNA, 30 bp, Homo sapiens; identical to SEQ ID NO: 83816
  misc_feature 1..30: note = chr19:47017854-47017884
  misc_feature 1..30: note = Hypo
  source 1..30: mol_type = genomic DNA

SEQ ID NO: 116499 - DNA, 30 bp, Homo sapiens; identical to SEQ ID NO: 83818
  misc_feature 1..30: note = chr19:47105822-47105852
  misc_feature 1..30: note = Hyper
  source 1..30: mol_type = genomic DNA

SEQ ID NO: 116500 - DNA, 20 bp, Homo sapiens
  misc_feature 1..20: note = chr19:47116638-47116658
  misc_feature 1..20: note = Hypo
  source 1..20: mol_type = genomic DNA
gctggaatgcagtggcgcca

SEQ ID NO: 116501 - DNA, 260 bp, Homo sapiens; identical to SEQ ID NO: 83820
  misc_feature 1..260: note = chr19:47116898-47117158
  misc_feature 1..260: note = Hypo
  source 1..260: mol_type = genomic DNA

SEQ ID NO: 116502 - DNA, 337 bp, Homo sapiens; identical to SEQ ID NO: 83822
  misc_feature 1..337: note = chr19:47142808-47143145
  misc_feature 1..337: note = Hyper
  source 1..337: mol_type = genomic DNA

SEQ ID NO: 116503 - DNA, 542 bp, Homo sapiens
  misc_feature 1..542: note = chr19:47152566-47153108
  misc_feature 1..542: note = Hyper
  source 1..542: mol_type = genomic DNA
caagcggccctcagccgggctgtcggggggtgagggggcggcgggcggcgcagcgggctcgggtgccgcctccgactcccacgacgacgcccaggcgcggctcaaggcggcagggctggtggggtggcccccgacgcgctccaacgagggctcccgcgcgggtcgcgcgctgccgggggacggagacgcgtcgggcggccgctggcgcacgctgttctggcgccgcgggccgccgtccgcgcccccgggactggtccggggctggcccgccccccggcggcggcgcctgcgcaggagcgccgagatgtagccgtccaggggccgccctgcgccccccgcgtcgggcgagtcggtgggagggcggccgcagggccgcgggctgcgcatcgccacggcgtgcagggggctgggcgtcagaaagggcccggcgcgggcccgccgctccgccgaggagcaggcctccgggccggcggacccccctgccgtcgggtagggcgctgagaaggaccgcggcaccgctgcccgcgcgcccaccacctccg

SEQ ID NO: 116504 - DNA, 377 bp, Homo sapiens; identical to SEQ ID NO: 83824
  misc_feature 1..377: note = chr19:47200235-47200612
  misc_feature 1..377: note = Hypo
  source 1..377: mol_type = genomic DNA

SEQ ID NO: 116505 - DNA, 37 bp, Homo sapiens; identical to SEQ ID NO: 83827
  misc_feature 1..37: note = chr19:47273996-47274033
  misc_feature 1..37: note = Hypo
  source 1..37: mol_type = genomic DNA

SEQ ID NO: 116506 - DNA, 37 bp, Homo sapiens; identical to SEQ ID NO: 45936
  misc_feature 1..37: note = chr19:47284561-47284598
  misc_feature 1..37: note = Hypo
  source 1..37: mol_type = genomic DNA

SEQ ID NO: 116507 - DNA, 30 bp, Homo sapiens; identical to SEQ ID NO: 83829
  misc_feature 1..30: note = chr19:47345049-47345079
  misc_feature 1..30: note = Hypo
  source 1..30: mol_type = genomic DNA

SEQ ID NO: 116508 - DNA, 44 bp, Homo sapiens; identical to SEQ ID NO: 16528
  misc_feature 1..44: note = chr19:47429440-47429484
  misc_feature 1..44: note = Hypo
  source 1..44: mol_type = genomic DNA

SEQ ID NO: 116509 - DNA, 32 bp, Homo sapiens; identical to SEQ ID NO: 83831
  misc_feature 1..32: note = chr19:47482387-47482419
  misc_feature 1..32: note = Hypo
  source 1..32: mol_type = genomic DNA

SEQ ID NO: 116510 - DNA, 294 bp, Homo sapiens; identical to SEQ ID NO: 83832
  misc_feature 1..294: note = chr19:47522989-47523283
  misc_feature 1..294: note = Hyper
  source 1..294: mol_type = genomic DNA

SEQ ID NO: 116511 - DNA, 162 bp, Homo sapiens; identical to SEQ ID NO: 37600
  misc_feature 1..162: note = chr19:47523562-47523724
  misc_feature 1..162: note = Hyper
  source 1..162: mol_type = genomic DNA

SEQ ID NO: 116512 - DNA, 248 bp, Homo sapiens; identical to SEQ ID NO: 83834
  misc_feature 1..248: note = chr19:47524686-47524934
  misc_feature 1..248: note = Hyper
  source 1..248: mol_type = genomic DNA

SEQ ID NO: 116513 - DNA, 35 bp, Homo sapiens; identical to SEQ ID NO: 83835
  misc_feature 1..35: note = chr19:47540684-47540719
  misc_feature 1..35: note = Hypo
  source 1..35: mol_type = genomic DNA

SEQ ID NO: 116514 - DNA, 76 bp, Homo sapiens; identical to SEQ ID NO: 83836
  misc_feature 1..76: note = chr19:47593170-47593246
  misc_feature 1..76: note = Hypo
  source 1..76: mol_type = genomic DNA

SEQ ID NO: 116515 - DNA, 66 bp, Homo sapiens; identical to SEQ ID NO: 83837
  misc_feature 1..66: note = chr19:47603348-47603414
  misc_feature 1..66: note = Hypo
  source 1..66: mol_type = genomic DNA

SEQ ID NO: 116516 - DNA, 30 bp, Homo sapiens; identical to SEQ ID NO: 45939
  misc_feature 1..30: note = chr19:47633375-47633405
  misc_feature 1..30: note = Hypo
  source 1..30: mol_type = genomic DNA

SEQ ID NO: 116517 - DNA, 666 bp, Homo sapiens
  misc_feature 1..666: note = chr19:47742597-47743263
  misc_feature 1..666: note = Hyper
  source 1..666: mol_type = genomic DNA
ctgcagacctaaaaccgtctcgtctccaagatcttgtctgccattctgggcaagcagatttcgcagcctggggagagggagttgggaaggacttaacttttcaccgcagggcctgagtcctggctttccgcggtggggaaggggtctcccgggtcccctcggtgtggccggccctgcaggccgggaggctggaccggggccgggtgggggctgggcgggggcgcgggcgtccgcagggtccgagcggccggcgcgcgtgtgaaggttaccgcttcccggcggggcgggggccgcgcgctgttgctggggtctgcggggcctgcctgcgcccgcgccccccctccttcccggccagccagtgagcggtacccgccgccgttgccaggggaaactcgccgccccgttacccagcaacaagcctggcccaaccaggcgcgaggaccccccaggccccgcccgccgctgcccaccgcgtgcccaatgccaggcgggcagagccggcccagctcccggagacggcgagcgcgctcattggccaccgccgcgtccgcccggatctgggggagccctcggcgcggggggcggggaaccgggccccggggagctgccgggcgcgcggcctgcaaacctgcgaccggctggggtgatacccgggctgtgcaccat

SEQ ID NO: 116518 - DNA, 30 bp, Homo sapiens; identical to SEQ ID NO: 37603
  misc_feature 1..30: note = chr19:47746438-47746468
  misc_feature 1..30: note = Hyper
  source 1..30: mol_type = genomic DNA

SEQ ID NO: 116519 - DNA, 77 bp, Homo sapiens; identical to SEQ ID NO: 83842
  misc_feature 1..77: note = chr19:47783551-47783628
  misc_feature 1..77: note = Hypo
  source 1..77: mol_type = genomic DNA

SEQ ID NO: 116520 - DNA, 26 bp, Homo sapiens
  misc_feature 1..26: note = chr19:47819208-47819234
  misc_feature 1..26: note = Hypo
  source 1..26: mol_type = genomic DNA
catccatctgtccatcgattcatcca

SEQ ID NO: 116521 - DNA, 30 bp, Homo sapiens; identical to SEQ ID NO: 45941
  misc_feature 1..30: note = chr19:47847634-47847664
  misc_feature 1..30: note = Hypo
  source 1..30: mol_type = genomic DNA

SEQ ID NO: 116522 - DNA, 146 bp, Homo sapiens; identical to SEQ ID NO: 83845
  misc_feature 1..146: note = chr19:47848947-47849093
  misc_feature 1..146: note = Hypo
  source 1..146: mol_type = genomic DNA

SEQ ID NO: 116523 - DNA, 30 bp, Homo sapiens; identical to SEQ ID NO: 83846
  misc_feature 1..30: note = chr19:47861508-47861538
  misc_feature 1..30: note = Hypo
  source 1..30: mol_type = genomic DNA

SEQ ID NO: 116524 - DNA, 23 bp, Homo sapiens
  misc_feature 1..23: note = chr19:47864411-47864434
  misc_feature 1..23: note = Hypo
  source 1..23: mol_type = genomic DNA
atgacaatggcaggccgtcccgg

SEQ ID NO: 116525 - DNA, 83 bp, Homo sapiens
  misc_feature 1..83: note = chr19:47910482-47910565
  misc_feature 1..83: note = Hyper
  source 1..83: mol_type = genomic DNA
gcgggggaggcagagcggggcgagcaggggcagtggctctgcggggctcggggcctccgtcagcaccgcggacagcgcccggg

SEQ ID NO: 116526 - DNA, 508 bp, Homo sapiens; identical to SEQ ID NO: 83850
  misc_feature 1..508: note = chr19:47921346-47921854
  misc_feature 1..508: note = Hyper
  source 1..508: mol_type = genomic DNA

SEQ ID NO: 116527 - DNA, 39 bp, Homo sapiens; identical to SEQ ID NO: 83851
  misc_feature 1..39: note = chr19:47923045-47923084
  misc_feature 1..39: note = Hyper
  source 1..39: mol_type = genomic DNA

SEQ ID NO: 116528 - DNA, 99 bp, Homo sapiens; identical to SEQ ID NO: 83852
  misc_feature 1..99: note = chr19:47923344-47923443
  misc_feature 1..99: note = Hyper
  source 1..99: mol_type = genomic DNA

SEQ ID NO: 116529 - DNA, 77 bp, Homo sapiens; identical to SEQ ID NO: 83853
  misc_feature 1..77: note = chr19:47924604-47924681
  misc_feature 1..77: note = Hyper
  source 1..77: mol_type = genomic DNA

SEQ ID NO: 116530 - DNA, 39 bp, Homo sapiens; identical to SEQ ID NO: 37606
  misc_feature 1..39: note = chr19:47925553-47925592
  misc_feature 1..39: note = Hyper
  source 1..39: mol_type = genomic DNA

SEQ ID NO: 116531 - DNA, 623 bp, Homo sapiens; identical to SEQ ID NO: 83856
  misc_feature 1..623: note = chr19:47933200-47933823
  misc_feature 1..623: note = Hyper
  source 1..623: mol_type = genomic DNA

SEQ ID NO: 116532 - DNA, 137 bp, Homo sapiens; identical to SEQ ID NO: 83858
  misc_feature 1..137: note = chr19:47947714-47947851
  misc_feature 1..137: note = Hyper
  source 1..137: mol_type = genomic DNA

SEQ ID NO: 116533 - DNA, 146 bp, Homo sapiens; identical to SEQ ID NO: 83859
  misc_feature 1..146: note = chr19:47950977-47951123
  misc_feature 1..146: note = Hyper
  source 1..146: mol_type = genomic DNA

SEQ ID NO: 116534 - DNA, 420 bp, Homo sapiens
  misc_feature 1..420: note = chr19:47960571-47960991
  misc_feature 1..420: note = Hyper
  source 1..420: mol_type = genomic DNA
ggatctggatgacctcgcggcggctggcgtccagctcgcgcgcctcggcggggcccgggcccaggccgcccagctcacctggggcctcggcgcccacgaacgtgccgtccagctcgatgctcttcggggggtcgccctcggcgcctatgatgatgccgctgcgtgggtcggtgcggtagcgcttgtacacgtacttgtagaagagcagccgcttgtcggccatccaggcgaataccacgcacaccgggaagaagaccagggtcagcagcgcctcccacacctgcgggcggcgggcgtcagggcgaggccgggcgggccgccttctccctccccgcctctctgtctcagtctctgtccgcctctgccactcctcatctctctccccaacccccaaccccgccccgtcgtctctccctatcc

SEQ ID NO: 116535 - DNA, 30 bp, Homo sapiens; identical to SEQ ID NO: 83863
  misc_feature 1..30: note = chr19:47969433-47969463
  misc_feature 1..30: note = Hypo
  source 1..30: mol_type = genomic DNA

SEQ ID NO: 116536 - DNA, 78 bp, Homo sapiens; identical to SEQ ID NO: 83865
  misc_feature 1..78: note = chr19:47986518-47986596
  misc_feature 1..78: note = Hypo
  source 1..78: mol_type = genomic DNA

SEQ ID NO: 116537 - DNA, 319 bp, Homo sapiens; identical to SEQ ID NO: 83866
  misc_feature 1..319: note = chr19:48003347-48003666
  misc_feature 1..319: note = Hypo
  source 1..319: mol_type = genomic DNA

SEQ ID NO: 116538 - DNA, 186 bp, Homo sapiens; identical to SEQ ID NO: 83867
  misc_feature 1..186: note = chr19:48003928-48004114
  misc_feature 1..186: note = Hypo
  source 1..186: mol_type = genomic DNA

SEQ ID NO: 116539 - DNA, 324 bp, Homo sapiens; identical to SEQ ID NO: 83869
  misc_feature 1..324: note = chr19:48076446-48076770
  misc_feature 1..324: note = Hyper
  source 1..324: mol_type = genomic DNA

SEQ ID NO: 116540 - DNA, 31 bp, Homo sapiens; identical to SEQ ID NO: 83870
  misc_feature 1..31: note = chr19:48106994-48107025
  misc_feature 1..31: note = Hypo
  source 1..31: mol_type = genomic DNA

SEQ ID NO: 116541 - DNA, 71 bp, Homo sapiens; identical to SEQ ID NO: 83871
  misc_feature 1..71: note = chr19:48137031-48137102
  misc_feature 1..71: note = Hypo
  source 1..71: mol_type = genomic DNA

SEQ ID NO: 116542 - DNA, 30 bp, Homo sapiens; identical to SEQ ID NO: 45947
  misc_feature 1..30: note = chr19:48137321-48137351
  misc_feature 1..30: note = Hypo
  source 1..30: mol_type = genomic DNA

SEQ ID NO: 116543 - DNA, 146 bp, Homo sapiens; identical to SEQ ID NO: 83873
  misc_feature 1..146: note = chr19:48151265-48151411
  misc_feature 1..146: note = Hypo
  source 1..146: mol_type = genomic DNA

SEQ ID NO: 116544 - DNA, 30 bp, Homo sapiens; identical to SEQ ID NO: 83876
  misc_feature 1..30: note = chr19:48207394-48207424
  misc_feature 1..30: note = Hypo
  source 1..30: mol_type = genomic DNA

SEQ ID NO: 116545 - DNA, 24 bp, Homo sapiens
  misc_feature 1..24: note = chr19:48213122-48213146
  misc_feature 1..24: note = Hypo
  source 1..24: mol_type = genomic DNA
agttcacagatcctccggaatttt

SEQ ID NO: 116546 - DNA, 80 bp, Homo sapiens; identical to SEQ ID NO: 83878
  misc_feature 1..80: note = chr19:48237374-48237454
  misc_feature 1..80: note = Hypo
  source 1..80: mol_type = genomic DNA

SEQ ID NO: 116547 - DNA, 94 bp, Homo sapiens; identical to SEQ ID NO: 83879
  misc_feature 1..94: note = chr19:48244303-48244397
  misc_feature 1..94: note = Hypo
  source 1..94: mol_type = genomic DNA

SEQ ID NO: 116548 - DNA, 37 bp, Homo sapiens; identical to SEQ ID NO: 83880
  misc_feature 1..37: note = chr19:48293267-48293304
  misc_feature 1..37: note = Hypo
  source 1..37: mol_type = genomic DNA

SEQ ID NO: 116549 - DNA, 38 bp, Homo sapiens; identical to SEQ ID NO: 83881
  misc_feature 1..38: note = chr19:48297784-48297822
  misc_feature 1..38: note = Hypo
  source 1..38: mol_type = genomic DNA

SEQ ID NO: 116550 - DNA, 30 bp, Homo sapiens; identical to SEQ ID NO: 83882
  misc_feature 1..30: note = chr19:48313221-48313251
  misc_feature 1..30: note = Hypo
  source 1..30: mol_type = genomic DNA

SEQ ID NO: 116551 - DNA, 30 bp, Homo sapiens; identical to SEQ ID NO: 83883
  misc_feature 1..30: note = chr19:48334093-48334123
  misc_feature 1..30: note = Hypo
  source 1..30: mol_type = genomic DNA

SEQ ID NO: 116552 - DNA, 300 bp, Homo sapiens; identical to SEQ ID NO: 83886
  misc_feature 1..300: note = chr19:48478580-48478880
  misc_feature 1..300: note = Hypo
  source 1..300: mol_type = genomic DNA

SEQ ID NO: 116553 - DNA, 182 bp, Homo sapiens; identical to SEQ ID NO: 83888
  misc_feature 1..182: note = chr19:48525268-48525450
  misc_feature 1..182: note = Hypo
  source 1..182: mol_type = genomic DNA

SEQ ID NO: 116554 - DNA, 44 bp, Homo sapiens; identical to SEQ ID NO: 83889
  misc_feature 1..44: note = chr19:48563530-48563574
  misc_feature 1..44: note = Hypo
  source 1..44: mol_type = genomic DNA

SEQ ID NO: 116555 - DNA, 21 bp, Homo sapiens
  misc_feature 1..21: note = chr19:48586356-48586377
  misc_feature 1..21: note = Hypo
  source 1..21: mol_type = genomic DNA
ccaccgcgcctggccctggct

SEQ ID NO: 116556 - DNA, 21 bp, Homo sapiens
  misc_feature 1..21: note = chr19:48614830-48614851
  misc_feature 1..21: note = Hypo
  source 1..21: mol_type = genomic DNA
aagcccagcactaagcgtcat

SEQ ID NO: 116557 - DNA, 30 bp, Homo sapiens; identical to SEQ ID NO: 83892
  misc_feature 1..30: note = chr19:48771570-48771600
  misc_feature 1..30: note = Hypo
  source 1..30: mol_type = genomic DNA

SEQ ID NO: 116558 - DNA, 115 bp, Homo sapiens; identical to SEQ ID NO: 83893
  misc_feature 1..115: note = chr19:48774859-48774974
  misc_feature 1..115: note = Hyper
  source 1..115: mol_type = genomic DNA

SEQ ID NO: 116559 - DNA, 60 bp, Homo sapiens; identical to SEQ ID NO: 83894
  misc_feature 1..60: note = chr19:48775188-48775248
  misc_feature 1..60: note = Hyper
  source 1..60: mol_type = genomic DNA

SEQ ID NO: 116560 - DNA, 84 bp, Homo sapiens; identical to SEQ ID NO: 83895
  misc_feature 1..84: note = chr19:48775999-48776083
  misc_feature 1..84: note = Hypo
  source 1..84: mol_type = genomic DNA

SEQ ID NO: 116561 - DNA, 30 bp, Homo sapiens; identical to SEQ ID NO: 83896
  misc_feature 1..30: note = chr19:48800316-48800346
  misc_feature 1..30: note = Hypo
  source 1..30: mol_type = genomic DNA

SEQ ID NO: 116562 - DNA, 274 bp, Homo sapiens; identical to SEQ ID NO: 83897
  misc_feature 1..274: note = chr19:48800569-48800843
  misc_feature 1..274: note = Hypo
  source 1..274: mol_type = genomic DNA

SEQ ID NO: 116563 - DNA, 168 bp, Homo sapiens; identical to SEQ ID NO: 83898
  misc_feature 1..168: note = chr19:48806475-48806643
  misc_feature 1..168: note = Hypo
  source 1..168: mol_type = genomic DNA

SEQ ID NO: 116564 - DNA, 16 bp, Homo sapiens
  misc_feature 1..16: note = chr19:48834248-48834264
  misc_feature 1..16: note = Hypo
  source 1..16: mol_type = genomic DNA
tggagtgcagtggtac

SEQ ID NO: 116565 - DNA, 30 bp, Homo sapiens; identical to SEQ ID NO: 45957
  misc_feature 1..30: note = chr19:48844484-48844514
  misc_feature 1..30: note = Hypo
  source 1..30: mol_type = genomic DNA

SEQ ID NO: 116566 - DNA, 18 bp, Homo sapiens
  misc_feature 1..18: note = chr19:48857797-48857815
  misc_feature 1..18: note = Hypo
  source 1..18: mol_type = genomic DNA
aagcgtgagtcactgtgc

SEQ ID NO: 116567 - DNA, 32 bp, Homo sapiens; identical to SEQ ID NO: 37612
  misc_feature 1..32: note = chr19:48867764-48867796
  misc_feature 1..32: note = Hyper
  source 1..32: mol_type = genomic DNA

SEQ ID NO: 116568 - DNA, 325 bp, Homo sapiens; identical to SEQ ID NO: 83903
  misc_feature 1..325: note = chr19:48901815-48902140
  misc_feature 1..325: note = Hyper
  source 1..325: mol_type = genomic DNA

SEQ ID NO: 116569 - DNA, 33 bp, Homo sapiens; identical to SEQ ID NO: 83904
  misc_feature 1..33: note = chr19:48902532-48902565
  misc_feature 1..33: note = Hypo
  source 1..33: mol_type = genomic DNA

SEQ ID NO: 116570 - DNA, 153 bp, Homo sapiens; identical to SEQ ID NO: 83905
  misc_feature 1..153: note = chr19:48902805-48902958
  misc_feature 1..153: note = Hypo
  source 1..153: mol_type = genomic DNA

SEQ ID NO: 116571 - DNA, 30 bp, Homo sapiens; identical to SEQ ID NO: 83906
  misc_feature 1..30: note = chr19:48903408-48903438
  misc_feature 1..30: note = Hypo
  source 1..30: mol_type = genomic DNA

SEQ ID NO: 116572 - DNA, 215 bp, Homo sapiens; identical to SEQ ID NO: 83907
  misc_feature 1..215: note = chr19:48918124-48918339
  misc_feature 1..215: note = Hyper
  source 1..215: mol_type = genomic DNA

SEQ ID NO: 116573 - DNA, 95 bp, Homo sapiens; identical to SEQ ID NO: 83908
  misc_feature 1..95: note = chr19:48918639-48918734
  misc_feature 1..95: note = Hyper
  source 1..95: mol_type = genomic DNA

SEQ ID NO: 116574 - DNA, 291 bp, Homo sapiens
  misc_feature 1..291: note = chr19:48946736-48947027
  misc_feature 1..291: note = Hyper
  source 1..291: mol_type = genomic DNA
gcctggagctgctgccgccgccgcgccatctcagctgctcgcacgatggcctggacggcggctggtgggcgccaccgcctccaccctgggccgccgggcccctgccccgacgccgggcccgctgcgggtgcccgcggtcgcacccgcaccgcccgcgggcctcgcaccgcacgcccgccgccgccgcgccccaccaccacaggcaccggcgcgccgctgggggctgggacctcccgccgcccgcgcccacctcgcgctcgctcgaggacctcagctcgtgccctcgcgccg

SEQ ID NO: 116575 - DNA, 236 bp, Homo sapiens
  misc_feature 1..236: note = chr19:48947309-48947545
  misc_feature 1..236: note = Hyper
  source 1..236: mol_type = genomic DNA
ccccgcctggagcagcgtcctgcgccccctggttctggaggaaccgcaagccggagaggatttggtccctcaactatcacccagcctgagaacgagggggcgggggccttggagcccaccggacttttttttaaacccgacaagggctttttaacgtcaccagatggggcgggaggtggggggttcacgccactcccgcgtcccacctccacgcccggggccgtggcccccacatc

SEQ ID NO: 116576 - DNA, 48 bp, Homo sapiens
  misc_feature 1..48: note = chr19:48947850-48947898
  misc_feature 1..48: note = Hyper
  source 1..48: mol_type = genomic DNA
ctctgacctaggacacgtccccaacggaagccccgccttcccttgcac

SEQ ID NO: 116577 - DNA, 22 bp, Homo sapiens
  misc_feature 1..22: note = chr19:48989603-48989625
  misc_feature 1..22: note = Hypo
  source 1..22: mol_type = genomic DNA
ccgcgcccggccttttggaaca

SEQ ID NO: 116578 - DNA, 66 bp, Homo sapiens; identical to SEQ ID NO: 83912
  misc_feature 1..66: note = chr19:48994825-48994891
  misc_feature 1..66: note = Hyper
  source 1..66: mol_type = genomic DNA

SEQ ID NO: 116579 - DNA, 43 bp, Homo sapiens; identical to SEQ ID NO: 83913
  misc_feature 1..43: note = chr19:48997015-48997058
  misc_feature 1..43: note = Hyper
  source 1..43: mol_type = genomic DNA

SEQ ID NO: 116580 - DNA, 30 bp, Homo sapiens; identical to SEQ ID NO: 83914
  misc_feature 1..30: note = chr19:49002701-49002731
  misc_feature 1..30: note = Hyper
  source 1..30: mol_type = genomic DNA

SEQ ID NO: 116581 - DNA, 30 bp, Homo sapiens; identical to SEQ ID NO: 83915
  misc_feature 1..30: note = chr19:49012484-49012514
  misc_feature 1..30: note = Hypo
  source 1..30: mol_type = genomic DNA

SEQ ID NO: 116582 - DNA, 217 bp, Homo sapiens; identical to SEQ ID NO: 83916
  misc_feature 1..217: note = chr19:49014319-49014536
  misc_feature 1..217: note = Hyper
  source 1..217: mol_type = genomic DNA

SEQ ID NO: 116583 - DNA, 32 bp, Homo sapiens; identical to SEQ ID NO: 83917
  misc_feature 1..32: note = chr19:49015396-49015428
  misc_feature 1..32: note = Hyper
  source 1..32: mol_type = genomic DNA

SEQ ID NO: 116584 - DNA, 25 bp, Homo sapiens
  misc_feature 1..25: note = chr19:49043152-49043177
  misc_feature 1..25: note = Hypo
  source 1..25: mol_type = genomic DNA
agcactttaggaggccgaggcaggt

SEQ ID NO: 116585 - DNA, 84 bp, Homo sapiens; identical to SEQ ID NO: 83919
  misc_feature 1..84: note = chr19:49043417-49043501
  misc_feature 1..84: note = Hypo
  source 1..84: mol_type = genomic DNA

SEQ ID NO: 116586 - DNA, 177 bp, Homo sapiens; identical to SEQ ID NO: 83920
  misc_feature 1..177: note = chr19:49117219-49117396
  misc_feature 1..177: note = Hypo
  source 1..177: mol_type = genomic DNA

SEQ ID NO: 116587 - DNA, 374 bp, Homo sapiens; identical to SEQ ID NO: 45960
  misc_feature 1..374: note = chr19:49119027-49119401
  misc_feature 1..374: note = Hypo
  source 1..374: mol_type = genomic DNA

SEQ ID NO: 116588 - DNA, 420 bp, Homo sapiens; identical to SEQ ID NO: 83922
  misc_feature 1..420: note = chr19:49127373-49127793
  misc_feature 1..420: note = Hyper
  source 1..420: mol_type = genomic DNA

SEQ ID NO: 116589 - DNA, 105 bp, Homo sapiens; identical to SEQ ID NO: 83924
  misc_feature 1..105: note = chr19:49143016-49143121
  misc_feature 1..105: note = Hypo
  source 1..105: mol_type = genomic DNA

SEQ ID NO: 116590 - DNA, 55 bp, Homo sapiens; identical to SEQ ID NO: 83925
  misc_feature 1..55: note = chr19:49180462-49180517
  misc_feature 1..55: note = Hypo
  source 1..55: mol_type = genomic DNA

SEQ ID NO: 116591 - DNA, 30 bp, Homo sapiens; identical to SEQ ID NO: 83926
  misc_feature 1..30: note = chr19:49218773-49218803
  misc_feature 1..30: note = Hypo
  source 1..30: mol_type = genomic DNA

SEQ ID NO: 116592 - DNA, 239 bp, Homo sapiens; identical to SEQ ID NO: 83927
  misc_feature 1..239: note = chr19:49242534-49242773
  misc_feature 1..239: note = Hyper
  source 1..239: mol_type = genomic DNA

SEQ ID NO: 116593 - DNA, 61 bp, Homo sapiens; identical to SEQ ID NO: 83928
  misc_feature 1..61: note = chr19:49244940-49245001
  misc_feature 1..61: note = Hyper
  source 1..61: mol_type = genomic DNA

SEQ ID NO: 116594 - DNA, 24 bp, Homo sapiens
  misc_feature 1..24: note = chr19:49266812-49266836
  misc_feature 1..24: note = Hypo
  source 1..24: mol_type = genomic DNA
gcgagactccgtctatttaaaaaa

SEQ ID NO: 116595 - DNA, 20 bp, Homo sapiens
  misc_feature 1..20: note = chr19:49285394-49285414
  misc_feature 1..20: note = Hypo
  source 1..20: mol_type = genomic DNA
gagacagctctctgtcgcct

SEQ ID NO: 116596 - DNA, 76 bp, Homo sapiens; identical to SEQ ID NO: 45962
  misc_feature 1..76: note = chr19:49328490-49328566
  misc_feature 1..76: note = Hypo
  source 1..76: mol_type = genomic DNA

SEQ ID NO: 116597 - DNA, 29 bp, Homo sapiens
  misc_feature 1..29: note = chr19:49394189-49394218
  misc_feature 1..29: note = Hypo
  source 1..29: mol_type = genomic DNA
gaaaataaaaggaaacgtcaccacaatgg

SEQ ID NO: 116598 - DNA, 173 bp, Homo sapiens; identical to SEQ ID NO: 83933
  misc_feature 1..173: note = chr19:49399218-49399391
  misc_feature 1..173: note = Hyper
  source 1..173: mol_type = genomic DNA

SEQ ID NO: 116599 - DNA, 85 bp, Homo sapiens; identical to SEQ ID NO: 83934
  misc_feature 1..85: note = chr19:49402037-49402122
  misc_feature 1..85: note = Hypo
  source 1..85: mol_type = genomic DNA

SEQ ID NO: 116600 - DNA, 41 bp, Homo sapiens; identical to SEQ ID NO: 83935
  misc_feature 1..41: note = chr19:49459034-49459075
  misc_feature 1..41: note = Hypo
  source 1..41: mol_type = genomic DNA

SEQ ID NO: 116601 - DNA, 31 bp, Homo sapiens; identical to SEQ ID NO: 83936
  misc_feature 1..31: note = chr19:49463923-49463954
  misc_feature 1..31: note = Hypo
  source 1..31: mol_type = genomic DNA

SEQ ID NO: 116602 - DNA, 30 bp, Homo sapiens; identical to SEQ ID NO: 45965
  misc_feature 1..30: note = chr19:49482126-49482156
  misc_feature 1..30: note = Hypo
  source 1..30: mol_type = genomic DNA

SEQ ID NO: 116603 - DNA, 113 bp, Homo sapiens; identical to SEQ ID NO: 83938
  misc_feature 1..113: note = chr19:49541820-49541933
  misc_feature 1..113: note = Hypo
  source 1..113: mol_type = genomic DNA

SEQ ID NO: 116604 - DNA, 199 bp, Homo sapiens; identical to SEQ ID NO: 83939
  misc_feature 1..199: note = chr19:49545552-49545751
  misc_feature 1..199: note = Hypo
  source 1..199: mol_type = genomic DNA

SEQ ID NO: 116605 - DNA, 177 bp, Homo sapiens; identical to SEQ ID NO: 83940
  misc_feature 1..177: note = chr19:49553709-49553886
  misc_feature 1..177: note = Hypo
  source 1..177: mol_type = genomic DNA

SEQ ID NO: 116606 - DNA, 30 bp, Homo sapiens; identical to SEQ ID NO: 83941
  misc_feature 1..30: note = chr19:49558182-49558212
  misc_feature 1..30: note = Hypo
  source 1..30: mol_type = genomic DNA

SEQ ID NO: 116607 - DNA, 30 bp, Homo sapiens
  misc_feature 1..30: note = chr19:49560012-49560042
  misc_feature 1..30: note = Hyper
  source 1..30: mol_type = genomic DNA
cctcgaggtacttaacgtcctggaagctga

SEQ ID NO: 116608 - DNA, 116 bp, Homo sapiens; identical to SEQ ID NO: 83943
  misc_feature 1..116: note = chr19:49560299-49560415
  misc_feature 1..116: note = Hyper
  source 1..116: mol_type = genomic DNA

SEQ ID NO: 116609 - DNA, 311 bp, Homo sapiens
  misc_feature 1..311: note = chr19:49575257-49575568
  misc_feature 1..311: note = Hyper
  source 1..311: mol_type = genomic DNA
gcccgtctccacccacgccccgcctctcaccgggccggctgcggctgcagcagcaagccccgtgccgtcgcggtcgtcgcggaagtcaggcagcgtctcgaggcagaagacgacgatggagacgaggatgaccagcacggagactacggcgagcacgcgcgcggcctgagagctctcgggaaactcgaaaagcagccacagctggcgggcgaaggcgcggcggggcagggggcgctcgggcggcaccgggcagccctcgtcctcgcgcaggcgtgccagggccgccgcgcccagcccgtagaaggccacct

SEQ ID NO: 116610 - DNA, 45 bp, Homo sapiens
  misc_feature 1..45: note = chr19:49576081-49576126
  misc_feature 1..45: note = Hyper
  source 1..45: mol_type = genomic DNA
cctgccctgccccgccgccgccgccgcccgcgcctgctctgcgcc

SEQ ID NO: 116611 - DNA, 95 bp, Homo sapiens; identical to SEQ ID NO: 83947
  misc_feature 1..95: note = chr19:49628304-49628399
  misc_feature 1..95: note = Hypo
  source 1..95: mol_type = genomic DNA

SEQ ID NO: 116612 - DNA, 88 bp, Homo sapiens
  misc_feature 1..88: note = chr19:49646130-49646218
  misc_feature 1..88: note = Hyper
  source 1..88: mol_type = genomic DNA
ccaacctgtcagacacggagatccagcgcgagatcggcatcagcaacccgctgcaccgactcaagctacgcctcgccatccaggagat

SEQ ID NO: 116613 - DNA, 30 bp, Homo sapiens; identical to SEQ ID NO: 37622
  misc_feature 1..30: note = chr19:49649675-49649705
  misc_feature 1..30: note = Hyper
  source 1..30: mol_type = genomic DNA

SEQ ID NO: 116614 - DNA, 137 bp, Homo sapiens; identical to SEQ ID NO: 83950
  misc_feature 1..137: note = chr19:49652128-49652265
  misc_feature 1..137: note = Hyper
  source 1..137: mol_type = genomic DNA

SEQ ID NO: 116615 - DNA, 88 bp, Homo sapiens; identical to SEQ ID NO: 83951
  misc_feature 1..88: note = chr19:49661511-49661599
  misc_feature 1..88: note = Hyper
  source 1..88: mol_type = genomic DNA

SEQ ID NO: 116616 - DNA, 88 bp, Homo sapiens; identical to SEQ ID NO: 83952
  misc_feature 1..88: note = chr19:49703569-49703657
  misc_feature 1..88: note = Hypo
  source 1..88: mol_type = genomic DNA

SEQ ID NO: 116617 - DNA, 30 bp, Homo sapiens; identical to SEQ ID NO: 83955
  misc_feature 1..30: note = chr19:49867107-49867137
  misc_feature 1..30: note = Hyper
  source 1..30: mol_type = genomic DNA

SEQ ID NO: 116618 - DNA, 42 bp, Homo sapiens; identical to SEQ ID NO: 83956
  misc_feature 1..42: note = chr19:49890887-49890929
  misc_feature 1..42: note = Hypo
  source 1..42: mol_type = genomic DNA

SEQ ID NO: 116619 - DNA, 200 bp, Homo sapiens; identical to SEQ ID NO: 83957
  misc_feature 1..200: note = chr19:49924370-49924570
  misc_feature 1..200: note = Hyper
  source 1..200: mol_type = genomic DNA

SEQ ID NO: 116620 - DNA, 939 bp, Homo sapiens; identical to SEQ ID NO: 83958
  misc_feature 1..939: note = chr19:49925640-49926579
  misc_feature 1..939: note = Hyper
  source 1..939: mol_type = genomic DNA

SEQ ID NO: 116621 - DNA, 49 bp, Homo sapiens; identical to SEQ ID NO: 83959
  misc_feature 1..49: note = chr19:49929427-49929476
  misc_feature 1..49: note = Hyper
  source 1..49: mol_type = genomic DNA

SEQ ID NO: 116622 - DNA, 135 bp, Homo sapiens; identical to SEQ ID NO: 83960
  misc_feature 1..135: note = chr19:49931210-49931345
  misc_feature 1..135: note = Hyper
  source 1..135: mol_type = genomic DNA

SEQ ID NO: 116623 - DNA, 189 bp, Homo sapiens
  misc_feature 1..189: note = chr19:49931986-49932175
  misc_feature 1..189: note = Hyper
  source 1..189: mol_type = genomic DNA
caccaaagctgcccccgccgccccgcgggggtcgcccgcagcgtctggaggccctgtcccccgccacgctccccaacaacttcgtgtgagccccaccgagttctgccggacctgcacatccccacagtgaaggaaaaccctgcgcttctggtatgcttagctagagtagtgccccggataaagggtcta

SEQ ID NO: 116624 - DNA, 664 bp, Homo sapiens; identical to SEQ ID NO: 83962
  misc_feature 1..664: note = chr19:49935705-49936369
  misc_feature 1..664: note = Hyper
  source 1..664: mol_type = genomic DNA

SEQ ID NO: 116625 - DNA, 366 bp, Homo sapiens; identical to SEQ ID NO: 83963
  misc_feature 1..366: note = chr19:49936853-49937219
  misc_feature 1..366: note = Hyper
  source 1..366: mol_type = genomic DNA

SEQ ID NO: 116626 - DNA, 30 bp, Homo sapiens; identical to SEQ ID NO: 83964
  misc_feature 1..30: note = chr19:49939994-49940024
  misc_feature 1..30: note = Hyper
  source 1..30: mol_type = genomic DNA

SEQ ID NO: 116627 - DNA, 46 bp, Homo sapiens; identical to SEQ ID NO: 83965
  misc_feature 1..46: note = chr19:49944610-49944656
  misc_feature 1..46: note = Hyper
  source 1..46: mol_type = genomic DNA

SEQ ID NO: 116628 - DNA, 178 bp, Homo sapiens; identical to SEQ ID NO: 83966
  misc_feature 1..178: note = chr19:49954045-49954223
  misc_feature 1..178: note = Hypo
  source 1..178: mol_type = genomic DNA

SEQ ID NO: 116629 - DNA, 71 bp, Homo sapiens; identical to SEQ ID NO: 83967
  misc_feature 1..71: note = chr19:49971866-49971937
  misc_feature 1..71: note = Hypo
  source 1..71: mol_type = genomic DNA

SEQ ID NO: 116630 - DNA, 30 bp, Homo sapiens; identical to SEQ ID NO: 83969
  misc_feature 1..30: note = chr19:49976596-49976626
  misc_feature 1..30: note = Hypo
  source 1..30: mol_type = genomic DNA

SEQ ID NO: 116631 - DNA, 86 bp, Homo sapiens; identical to SEQ ID NO: 83970
  misc_feature 1..86: note = chr19:49979926-49980012
  misc_feature 1..86: note = Hypo
  source 1..86: mol_type = genomic DNA

SEQ ID NO: 116632 - DNA, 28 bp, Homo sapiens
  misc_feature 1..28: note = chr19:49997370-49997398
  misc_feature 1..28: note = Hypo
  source 1..28: mol_type = genomic DNA
gagccatcgcgcccggccaatttttttt

SEQ ID NO: 116633 - DNA, 93 bp, Homo sapiens; identical to SEQ ID NO: 83972
  misc_feature 1..93: note = chr19:49998339-49998432
  misc_feature 1..93: note = Hypo
  source 1..93: mol_type = genomic DNA

SEQ ID NO: 116634 - DNA, 102 bp, Homo sapiens
  misc_feature 1..102: note = chr19:50028553-50028655
  misc_feature 1..102: note = Hypo
  source 1..102: mol_type = genomic DNA
gcagtctgcccagatcgcctgcctggcctcgcctctgcccatcagacacttggtgctggaatctccgaggctgggagggactgggagcgccccagttctgtg

SEQ ID NO: 116635 - DNA, 96 bp, Homo sapiens
  misc_feature 1..96: note = chr19:50030845-50030941
  misc_feature 1..96: note = Hypo
  source 1..96: mol_type = genomic DNA
cgcccggccttttttcttttctttcgttctttttgtttatttttgttttgttttgttttgtttggtatagaagtgttggaacgtacacctctttct

SEQ ID NO: 116636 - DNA, 120 bp, Homo sapiens; identical to SEQ ID NO: 83973
  misc_feature 1..120: note = chr19:50049634-50049754
  misc_feature 1..120: note = Hypo
  source 1..120: mol_type = genomic DNA

SEQ ID NO: 116637 - DNA, 140 bp, Homo sapiens; identical to SEQ ID NO: 83974
  misc_feature 1..140: note = chr19:50050702-50050842
  misc_feature 1..140: note = Hypo
  source 1..140: mol_type = genomic DNA

SEQ ID NO: 116638 - DNA, 31 bp, Homo sapiens; identical to SEQ ID NO: 83975
  misc_feature 1..31: note = chr19:50053089-50053120
  misc_feature 1..31: note = Hypo
  source 1..31: mol_type = genomic DNA

SEQ ID NO: 116639 - DNA, 59 bp, Homo sapiens; identical to SEQ ID NO: 83976
  misc_feature 1..59: note = chr19:50129682-50129741
  misc_feature 1..59: note = Hypo
  source 1..59: mol_type = genomic DNA

SEQ ID NO: 116640 - DNA, 244 bp, Homo sapiens; identical to SEQ ID NO: 83977
  misc_feature 1..244: note = chr19:50166617-50166861
  misc_feature 1..244: note = Hypo
  source 1..244: mol_type = genomic DNA

SEQ ID NO: 116641 - DNA, 796 bp, Homo sapiens; identical to SEQ ID NO: 83978
  misc_feature 1..796: note = chr19:50194078-50194874
  misc_feature 1..796: note = Hyper
  source 1..796: mol_type = genomic DNA

SEQ ID NO: 116642 - DNA, 130 bp, Homo sapiens; identical to SEQ ID NO: 45976
  misc_feature 1..130: note = chr19:50216075-50216205
  misc_feature 1..130: note = Hypo
  source 1..130: mol_type = genomic DNA

SEQ ID NO: 116643 - DNA, 174 bp, Homo sapiens; identical to SEQ ID NO: 45977
  misc_feature 1..174: note = chr19:50216693-50216867
  misc_feature 1..174: note = Hypo
  source 1..174: mol_type = genomic DNA

SEQ ID NO: 116644 - DNA, 87 bp, Homo sapiens; identical to SEQ ID NO: 83982
  misc_feature 1..87: note = chr19:50250231-50250318
  misc_feature 1..87: note = Hypo
  source 1..87: mol_type = genomic DNA

SEQ ID NO: 116645 - DNA, 98 bp, Homo sapiens; identical to SEQ ID NO: 83983
  misc_feature 1..98: note = chr19:50292243-50292341
  misc_feature 1..98: note = Hypo
  source 1..98: mol_type = genomic DNA

SEQ ID NO: 116646 - DNA, 33 bp, Homo sapiens; identical to SEQ ID NO: 83984
  misc_feature 1..33: note = chr19:50297021-50297054
  misc_feature 1..33: note = Hypo
  source 1..33: mol_type = genomic DNA

SEQ ID NO: 116647 - DNA, 30 bp, Homo sapiens; identical to SEQ ID NO: 83985
  misc_feature 1..30: note = chr19:50302697-50302727
  misc_feature 1..30: note = Hypo
  source 1..30: mol_type = genomic DNA

SEQ ID NO: 116648 - DNA, 30 bp, Homo sapiens; identical to SEQ ID NO: 83986
  misc_feature 1..30: note = chr19:50305210-50305240
  misc_feature 1..30: note = Hypo
  source 1..30: mol_type = genomic DNA

SEQ ID NO: 116649 - DNA, 41 bp, Homo sapiens; identical to SEQ ID NO: 83987
  misc_feature 1..41: note = chr19:50306672-50306713
  misc_feature 1..41: note = Hypo
  source 1..41: mol_type = genomic DNA

SEQ ID NO: 116650 - DNA, 30 bp, Homo sapiens; identical to SEQ ID NO: 83988
  misc_feature 1..30: note = chr19:50308605-50308635
  misc_feature 1..30: note = Hypo
  source 1..30: mol_type = genomic DNA

SEQ ID NO: 116651 - DNA, 30 bp, Homo sapiens; identical to SEQ ID NO: 83989
  misc_feature 1..30: note = chr19:50309103-50309133
  misc_feature 1..30: note = Hypo
  source 1..30: mol_type = genomic DNA

SEQ ID NO: 116652 - DNA, 133 bp, Homo sapiens; identical to SEQ ID NO: 83990
  misc_feature 1..133: note = chr19:50315790-50315923
  misc_feature 1..133: note = Hypo
  source 1..133: mol_type = genomic DNA

SEQ ID NO: 116653 - DNA, 525 bp, Homo sapiens; identical to SEQ ID NO: 83991
  misc_feature 1..525: note = chr19:50316196-50316721
  misc_feature 1..525: note = Hyper
  source 1..525: mol_type = genomic DNA

SEQ ID NO: 116654 - DNA, 120 bp, Homo sapiens; identical to SEQ ID NO: 83992
  misc_feature 1..120: note = chr19:50318985-50319105
  misc_feature 1..120: note = Hypo
  source 1..120: mol_type = genomic DNA

SEQ ID NO: 116655 - DNA, 120 bp, Homo sapiens; identical to SEQ ID NO: 83993
  misc_feature 1..120: note = chr19:50319645-50319765
  misc_feature 1..120: note = Hypo
  source 1..120: mol_type = genomic DNA

SEQ ID NO: 116656 - DNA, 120 bp, Homo sapiens; identical to SEQ ID NO: 83994
  misc_feature 1..120: note = chr19:50320005-50320125
  misc_feature 1..120: note = Hypo
  source 1..120: mol_type = genomic DNA

SEQ ID NO: 116657 - DNA, 30 bp, Homo sapiens; identical to SEQ ID NO: 83995
  misc_feature 1..30: note = chr19:50326491-50326521
  misc_feature 1..30: note = Hypo
  source 1..30: mol_type = genomic DNA

SEQ ID NO: 116658 - DNA, 124 bp, Homo sapiens; identical to SEQ ID NO: 83996
  misc_feature 1..124: note = chr19:50326993-50327117
  misc_feature 1..124: note = Hypo
  source 1..124: mol_type = genomic DNA

SEQ ID NO: 116659 - DNA, 45 bp, Homo sapiens; identical to SEQ ID NO: 45981
  misc_feature 1..45: note = chr19:50331949-50331994
  misc_feature 1..45: note = Hypo
  source 1..45: mol_type = genomic DNA

SEQ ID NO: 116660 - DNA, 432 bp, Homo sapiens; identical to SEQ ID NO: 83998
  misc_feature 1..432: note = chr19:50353152-50353584
  misc_feature 1..432: note = Hypo
  source 1..432: mol_type = genomic DNA

SEQ ID NO: 116661 - DNA, 30 bp, Homo sapiens; identical to SEQ ID NO: 45983
  misc_feature 1..30: note = chr19:50362485-50362515
  misc_feature 1..30: note = Hypo
  source 1..30: mol_type = genomic DNA

SEQ ID NO: 116662 - DNA, 389 bp, Homo sapiens; identical to SEQ ID NO: 84000
  misc_feature 1..389: note = chr19:50364773-50365162
  misc_feature 1..389: note = Hypo
  source 1..389: mol_type = genomic DNA

SEQ ID NO: 116663 - DNA, 75 bp, Homo sapiens; identical to SEQ ID NO: 84003
  misc_feature 1..75: note = chr19:50387489-50387564
  misc_feature 1..75: note = Hypo
  source 1..75: mol_type = genomic DNA

SEQ ID NO: 116664 - DNA, 714 bp, Homo sapiens
  misc_feature 1..714: note = chr19:50393297-50394011
  misc_feature 1..714: note = Hyper
  source 1..714: mol_type = genomic DNA
cccaacgcttgacgacgccggtgccgtcccagagctggcgcacgacaggcccgtgcaatgccgccacgtcgtcgagcgccaagcgcaacgcctcttcccggctcaagccggcgaacgctgccgccgcgtccgaccacgtgtacgaggccagcagcagcgcgccctcgcgcggcggcgggtagaaaatcatgcgcgacgggcgatcggtgtttgagtggccgccttcaatgtgctcctcgcgccagaagggcctgcggaagcttaggaacaccttggtggccggcacgtagtgcagcctccgcagcgcctcctgcatgtggcggggcagcggcggcgagaaggtgatgcgcttcaccgccggtccgctcgccgtcagcagcaccacgtcggccttcagcaccttcagattccgcgccgggggagaggtctcgatctgcacgtgcacatcgtgcggtccctgggtcatcgccaccacgggcgcgttcaacagcacaagcccggacagcgagctcagcagcgcgcgcggcagcaggtcccagccacccacgatgcggctgtacctgcaggcggggcggggcggggtgggggcgtgacctgggctctgcggccctgcccctctgccttgccccacccaccccggcagctggcccttatgggcaccggcccgctcccccgtcatccacctctcccgaccccgcccgtccctgacatccc

SEQ ID NO: 116665 - DNA, 212 bp, Homo sapiens; identical to SEQ ID NO: 84007
  misc_feature 1..212: note = chr19:50394919-50395131
  misc_feature 1..212: note = Hypo
  source 1..212: mol_type = genomic DNA

SEQ ID NO: 116666 - DNA, 30 bp, Homo sapiens; identical to SEQ ID NO: 84009
  misc_feature 1..30: note = chr19:50441485-50441515
  misc_feature 1..30: note = Hypo
  source 1..30: mol_type = genomic DNA

SEQ ID NO: 116667 - DNA, 30 bp, Homo sapiens; identical to SEQ ID NO: 84011
  misc_feature 1..30: note = chr19:50475206-50475236
  misc_feature 1..30: note = Hypo
  source 1..30: mol_type = genomic DNA

SEQ ID NO: 116668 - DNA, 30 bp, Homo sapiens; identical to SEQ ID NO: 84012
  misc_feature 1..30: note = chr19:50477609-50477639
  misc_feature 1..30: note = Hypo
  source 1..30: mol_type = genomic DNA

SEQ ID NO: 116669 - DNA, 51 bp, Homo sapiens; identical to SEQ ID NO: 45986
  misc_feature 1..51: note = chr19:50481531-50481582
  misc_feature 1..51: note = Hypo
  source 1..51: mol_type = genomic DNA

SEQ ID NO: 116670 - DNA, 438 bp, Homo sapiens; identical to SEQ ID NO: 84014
  misc_feature 1..438: note = chr19:50553997-50554435
  misc_feature 1..438: note = Hyper
  source 1..438: mol_type = genomic DNA

SEQ ID NO: 116671 - DNA, 30 bp, Homo sapiens; identical to SEQ ID NO: 84015
  misc_feature 1..30: note = chr19:50578991-50579021
  misc_feature 1..30: note = Hypo
  source 1..30: mol_type = genomic DNA

SEQ ID NO: 116672 - DNA, 30 bp, Homo sapiens; identical to SEQ ID NO: 37635
  misc_feature 1..30: note = chr19:50651036-50651066
  misc_feature 1..30: note = Hyper
  source 1..30: mol_type = genomic DNA

SEQ ID NO: 116673 - DNA, 30 bp, Homo sapiens; identical to SEQ ID NO: 37636
  misc_feature 1..30: note = chr19:50651328-50651358
  misc_feature 1..30: note = Hyper
  source 1..30: mol_type = genomic DNA

SEQ ID NO: 116674 - DNA, 30 bp, Homo sapiens; identical to SEQ ID NO: 84020
  misc_feature 1..30: note = chr19:50694460-50694490
  misc_feature 1..30: note = Hypo
  source 1..30: mol_type = genomic DNA

SEQ ID NO: 116675 - DNA, 30 bp, Homo sapiens; identical to SEQ ID NO: 37637
  misc_feature 1..30: note = chr19:50706864-50706894
  misc_feature 1..30: note = Hyper
  source 1..30: mol_type = genomic DNA

SEQ ID NO: 116676 - DNA, 76 bp, Homo sapiens; identical to SEQ ID NO: 84022
  misc_feature 1..76: note = chr19:50762327-50762403
  misc_feature 1..76: note = Hyper
  source 1..76: mol_type = genomic DNA

SEQ ID NO: 116677 - DNA, 758 bp, Homo sapiens; identical to SEQ ID NO: 84023
  misc_feature 1..758: note = chr19:50815293-50816051
  misc_feature 1..758: note = Hyper
  source 1..758: mol_type = genomic DNA

SEQ ID NO: 116678 - DNA, 53 bp, Homo sapiens; identical to SEQ ID NO: 13470
  misc_feature 1..53: note = chr19:50816431-50816484
  misc_feature 1..53: note = Hyper
  source 1..53: mol_type = genomic DNA

SEQ ID NO: 116679 - DNA, 30 bp, Homo sapiens; identical to SEQ ID NO: 84025
  misc_feature 1..30: note = chr19:50817841-50817871
  misc_feature 1..30: note = Hyper
  source 1..30: mol_type = genomic DNA

SEQ ID NO: 116680 - DNA, 37 bp, Homo sapiens; identical to SEQ ID NO: 84026
  misc_feature 1..37: note = chr19:50818167-50818204
  misc_feature 1..37: note = Hyper
  source 1..37: mol_type = genomic DNA

SEQ ID NO: 116681 - DNA, 734 bp, Homo sapiens; identical to SEQ ID NO: 37641
  misc_feature 1..734: note = chr19:50818424-50819158
  misc_feature 1..734: note = Hyper
  source 1..734: mol_type = genomic DNA

SEQ ID NO: 116682 - DNA, 149 bp, Homo sapiens; identical to SEQ ID NO: 84028
  misc_feature 1..149: note = chr19:50829560-50829709
  misc_feature 1..149: note = Hyper
  source 1..149: mol_type = genomic DNA

SEQ ID NO: 116683 - DNA, 636 bp, Homo sapiens; identical to SEQ ID NO: 84029
  misc_feature 1..636: note = chr19:50831403-50832039
  misc_feature 1..636: note = Hyper
  source 1..636: mol_type = genomic DNA

SEQ ID NO: 116684 - DNA, 91 bp, Homo sapiens; identical to SEQ ID NO: 84031
  misc_feature 1..91: note = chr19:50832951-50833042
  misc_feature 1..91: note = Hyper
  source 1..91: mol_type = genomic DNA

SEQ ID NO: 116685 - DNA, 142 bp, Homo sapiens; identical to SEQ ID NO: 37645
  misc_feature 1..142: note = chr19:50833828-50833970
  misc_feature 1..142: note = Hyper
  source 1..142: mol_type = genomic DNA

SEQ ID NO: 116686 - DNA, 160 bp, Homo sapiens
  misc_feature 1..160: note = chr19:50836291-50836451
  misc_feature 1..160: note = Hyper
  source 1..160: mol_type = genomic DNA
caagtaccttggccccgaaagctcagagtcgaggggaatctccccgctataatctttgggtccctggatcccaagtcccccgtctccaaaactaggattcgggctgtcttaccgcccccggaccctgagccttcgccccctcccccgtactcaccccaag

SEQ ID NO: 116687 - DNA, 350 bp, Homo sapiens; identical to SEQ ID NO: 84035
  misc_feature 1..350: note = chr19:50837039-50837389
  misc_feature 1..350: note = Hyper
  source 1..350: mol_type = genomic DNA

SEQ ID NO: 116688 - DNA, 306 bp, Homo sapiens; identical to SEQ ID NO: 84036
  misc_feature 1..306: note = chr19:50919769-50920075
  misc_feature 1..306: note = Hypo
  source 1..306: mol_type = genomic DNA

SEQ ID NO: 116689 - DNA, 95 bp, Homo sapiens; identical to SEQ ID NO: 45988
  misc_feature 1..95: note = chr19:50926491-50926586
  misc_feature 1..95: note = Hypo
  source 1..95: mol_type = genomic DNA

SEQ ID NO: 116690 - DNA, 170 bp, Homo sapiens; identical to SEQ ID NO: 84038
  misc_feature 1..170: note = chr19:50938552-50938722
  misc_feature 1..170: note = Hypo
  source 1..170: mol_type = genomic DNA

SEQ ID NO: 116691 - DNA, 89 bp, Homo sapiens; identical to SEQ ID NO: 84039
  misc_feature 1..89: note = chr19:50947770-50947859
  misc_feature 1..89: note = Hypo
  source 1..89: mol_type = genomic DNA

SEQ ID NO: 116692 - DNA, 104 bp, Homo sapiens; identical to SEQ ID NO: 84040
  misc_feature 1..104: note = chr19:50967770-50967874
  misc_feature 1..104: note = Hypo
  source 1..104: mol_type = genomic DNA

SEQ ID NO: 116693 - DNA, 30 bp, Homo sapiens; identical to SEQ ID NO: 84041
  misc_feature 1..30: note = chr19:50979216-50979246
  misc_feature 1..30: note = Hypo
  source 1..30: mol_type = genomic DNA

SEQ ID NO: 116694 - DNA, 100 bp, Homo sapiens; identical to SEQ ID NO: 84042
  misc_feature 1..100: note = chr19:51022774-51022874
  misc_feature 1..100: note = Hypo
  source 1..100: mol_type = genomic DNA

SEQ ID NO: 116695 - DNA, 183 bp, Homo sapiens; identical to SEQ ID NO: 84044
  misc_feature 1..183: note = chr19:51046349-51046532
  misc_feature 1..183: note = Hypo
  source 1..183: mol_type = genomic DNA

SEQ ID NO: 116696 - DNA, 45 bp, Homo sapiens; identical to SEQ ID NO: 84045
  misc_feature 1..45: note = chr19:51049613-51049658
  misc_feature 1..45: note = Hypo
  source 1..45: mol_type = genomic DNA

SEQ ID NO: 116697 - DNA, 30 bp, Homo sapiens; identical to SEQ ID NO: 84046
  misc_feature 1..30: note = chr19:51051953-51051983
  misc_feature 1..30: note = Hypo
  source 1..30: mol_type = genomic DNA

SEQ ID NO: 116698 - DNA, 30 bp, Homo sapiens; identical to SEQ ID NO: 37649
  misc_feature 1..30: note = chr19:51055016-51055046
  misc_feature 1..30: note = Hyper
  source 1..30: mol_type = genomic DNA

SEQ ID NO: 116699 - DNA, 213 bp, Homo sapiens; identical to SEQ ID NO: 84048
  misc_feature 1..213: note = chr19:51071278-51071491
  misc_feature 1..213: note = Hyper
  source 1..213: mol_type = genomic DNA

SEQ ID NO: 116700 - DNA, 56 bp, Homo sapiens; identical to SEQ ID NO: 37650
  misc_feature 1..56: note = chr19:51111640-51111696
  misc_feature 1..56: note = Hyper
  source 1..56: mol_type = genomic DNA

SEQ ID NO: 116701 - DNA, 33 bp, Homo sapiens; identical to SEQ ID NO: 45994
  misc_feature 1..33: note = chr19:51128766-51128799
  misc_feature 1..33: note = Hypo
  source 1..33: mol_type = genomic DNA

SEQ ID NO: 116702 - DNA, 30 bp, Homo sapiens; identical to SEQ ID NO: 84051
  misc_feature 1..30: note = chr19:51132785-51132815
  misc_feature 1..30: note = Hypo
  source 1..30: mol_type = genomic DNA

SEQ ID NO: 116703 - DNA, 619 bp, Homo sapiens
  misc_feature 1..619: note = chr19:51142492-51143111
  misc_feature 1..619: note = Hyper
  source 1..619: mol_type = genomic DNA
gacccactgggagcccggccaccccctcccacctccgggcccccagctcccgttgagggcttagagactacaattcccggcaggtctcgcgctcgcgctgctgcggcttcatagacccggcgctgcaggatctgctgggagttgaagtccttaatgcctccgggctgcagagaggatgggattttttttttttttttaaggttttggggggttaagatgctggggtcccaagacgcttcaggggaggggaacgatgtccgggacttcgaaaagccacggagccctaagtccttaggggccacggaatgaggaaacgatccccccgcgctggggatcggtgggcgaggggtgggatacacccaggtgtttcgggacccccttccagggccacgtgcccctcccccggggtggccagagagcgctgcagcgctcccactccccggcccgagatccacgcgcctctgcatctaccccgcccccatgcgccggggccgaccccagggatttgactggggctggggctgtggcaggaggagggggaggagcggactcacccggagccgccgctgccgccgctgccgccgccgccgccgccgcagccccgcgcgccagccgcggt

SEQ ID NO: 116704 - DNA, 46 bp, Homo sapiens; identical to SEQ ID NO: 84055
  misc_feature 1..46: note = chr19:51143316-51143362
  misc_feature 1..46: note = Hyper
  source 1..46: mol_type = genomic DNA

SEQ ID NO: 116705 - DNA, 230 bp, Homo sapiens; identical to SEQ ID NO: 84056
  misc_feature 1..230: note = chr19:51161225-51161455
  misc_feature 1..230: note = Hyper
  source 1..230: mol_type = genomic DNA

SEQ ID NO: 116706 - DNA, 1318 bp, Homo sapiens
  misc_feature 1..1318: note = chr19:51161685-51163003
  misc_feature 1..1318: note = Hyper
  source 1..1318: mol_type = genomic DNA
agagccactgaggggcggggccaagagtgagcgcggttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccaccccccttacaggtggctcatcgcggtcacggacttccagacgcgctcgcgcttgctgcgctccgggctcagtccccgcgggcttgcgcaccagatcgtgcgccacgacgacctcctgctgggcgactaccgcctgcacctgcgccgctccctggtccggcggcgcatgctcgaggccctgggggcggagccgaacgaggaggcctgacgcccgggcgggccccggcagcgcttgcgcaccgccccgcgggctggggccacccacccggagccccggaggacagggggcgttgccttcccaggaaggaggcggggccggctcgagggggtggatactgtgagtttaattataaagaatgacctggtacaaaagccatttctctctgcaaaatcttggtggggagtcaggggaagggaggtgatggggggtaggaatgaacccccatgttataatcccgcgtccctaatcttcctccagtccctgtacgtggacgcctgggtcccaatcccttgagggatgaactgaagcccgcgaaagggaagacctgggcaccggggctttcagcgcgtgccgagccctgtctcagcgagaatcagacgtcctcatccgcccccctcctcttcccctcccacccccccttggaagacaattctcgggcttttatttcaggttttttttctggatttttttgtgtgttctaggggttttgtgttttttttttctgttttttatattttcttcttttgttattgttcctctttttgctttttctctcctctccaccccgcgctgtccccgcattcggtccctc

SEQ ID NO: 116707 - DNA, 664 bp, Homo sapiens
  misc_feature 1..664: note = chr19:51170699-51171363
  misc_feature 1..664: note = Hyper
  source 1..664: mol_type = genomic DNA
ctcgtcacaggggcccggggctggcagttttcaaggaaccgcacgtgcagcggcagccgctcgggttcttcgggggctgcggacctccagggcttgcttactccggggtgcggggccgggggctccgtccccagctgcagcaggaggggccccaccccgggagcggtgggcggcaggcggtgtagcagggaacgccgggcggcgggcgggctggcgggaagggacttctcctggctgcccagcccggccctgtaccccagctcccggcgcgcagggtccggcggggaggccccccagagacgcagcactggctcgtggtgggcgtggggcgagtggtggtgcggggtgggcggcggggcctcgtagcggggcgatgggggcctgggaggcggctggggggccccgccgccctccgaggactccttcagcgctcgctcgcgggcggccagggccagccccagcggggaggcgggatccagggccttgccggtcagcgggtgcaccaggggtcgcgggggcaggaagctggtgaaggcgctgctgcccccgccacccccgtaggctcggctaccggccccgtagccgccgtagcccgcgccgctgcccgcagactccagtcggaggtagggctcggcggagaacatgccctcgtcgatggatttgg

SEQ ID NO: 116708 - DNA, 357 bp, Homo sapiens; identical to SEQ ID NO: 84061
  misc_feature 1..357: note = chr19:51197437-51197794
  misc_feature 1..357: note = Hyper
  source 1..357: mol_type = genomic DNA

SEQ ID NO: 116709 - DNA, 143 bp, Homo sapiens
  misc_feature 1..143: note = chr19:51198128-51198271
  misc_feature 1..143: note = Hyper
  source 1..143: mol_type = genomic DNA
ccgcaaagcaggaggcggcgcgctccgttacctgtagatgtaccagacgctgcgccgccggggccccagggctggccagctggaggacagcgcggggggcggctgcggcagggagctcccaccggggccgcccccgagacccc

SEQ ID NO: 116710 - DNA, 689 bp, Homo sapiens; identical to SEQ ID NO: 84063
  misc_feature 1..689: note = chr19:51198505-51199194
  misc_feature 1..689: note = Hyper
  source 1..689: mol_type = genomic DNA

SEQ ID NO: 116711 - DNA, 82 bp, Homo sapiens; identical to SEQ ID NO: 45995
  misc_feature 1..82: note = chr19:51203231-51203313
  misc_feature 1..82: note = Hypo
  source 1..82: mol_type = genomic DNA

SEQ ID NO: 116712 - DNA, 78 bp, Homo sapiens; identical to SEQ ID NO: 84065
  misc_feature 1..78: note = chr19:51211065-51211143
  misc_feature 1..78: note = Hypo
  source 1..78: mol_type = genomic DNA

SEQ ID NO: 116713 - DNA, 69 bp, Homo sapiens; identical to SEQ ID NO: 84066
  misc_feature 1..69: note = chr19:51222519-51222588
  misc_feature 1..69: note = Hyper
  source 1..69: mol_type = genomic DNA

SEQ ID NO: 116714 - DNA, 1207 bp, Homo sapiens
  misc_feature 1..1207: note = chr19:51227602-51228809
  misc_feature 1..1207: note = Hyper
  source 1..1207: mol_type = genomic DNA
ggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagctgggaggctgaatgcagggagcgggtgggcactccagacccgcgcggacccgactggggcagcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcc

SEQ ID NO: 116715 - DNA, 27 bp, Homo sapiens
  misc_feature 1..27: note = chr19:51250646-51250673
  misc_feature 1..27: note = Hypo
  source 1..27: mol_type = genomic DNA
cagcctgggtgacggagcaagactctg

SEQ ID NO: 116716 - DNA, 85 bp, Homo sapiens; identical to SEQ ID NO: 84071
  misc_feature 1..85: note = chr19:51269827-51269912
  misc_feature 1..85: note = Hypo
  source 1..85: mol_type = genomic DNA

SEQ ID NO: 116717 - DNA, 30 bp, Homo sapiens; identical to SEQ ID NO: 84072
  misc_feature 1..30: note = chr19:51274279-51274309
  misc_feature 1..30: note = Hypo
  source 1..30: mol_type = genomic DNA

SEQ ID NO: 116718 - DNA, 30 bp, Homo sapiens; identical to SEQ ID NO: 84073
  misc_feature 1..30: note = chr19:51281105-51281135
  misc_feature 1..30: note = Hyper
  source 1..30: mol_type = genomic DNA

SEQ ID NO: 116719 - DNA, 328 bp, Homo sapiens; identical to SEQ ID NO: 84074
  misc_feature 1..328: note = chr19:51281335-51281663
  misc_feature 1..328: note = Hyper
  source 1..328: mol_type = genomic DNA

SEQ ID NO: 116720 - DNA, 30 bp, Homo sapiens; identical to SEQ ID NO: 84075
  misc_feature 1..30: note = chr19:51295128-51295158
  misc_feature 1..30: note = Hypo
  source 1..30: mol_type = genomic DNA

SEQ ID NO: 116721 - DNA, 93 bp, Homo sapiens; identical to SEQ ID NO: 84076
  misc_feature 1..93: note = chr19:51295373-51295466
  misc_feature 1..93: note = Hypo
  source 1..93: mol_type = genomic DNA

SEQ ID NO: 116722 - DNA, 30 bp, Homo sapiens; identical to SEQ ID NO: 45996
  misc_feature 1..30: note = chr19:51304561-51304591
  misc_feature 1..30: note = Hypo
  source 1..30: mol_type = genomic DNA

SEQ ID NO: 116723 - DNA, 48 bp, Homo sapiens; identical to SEQ ID NO: 45997
  misc_feature 1..48: note = chr19:51340799-51340847
  misc_feature 1..48: note = Hypo
  source 1..48: mol_type = genomic DNA

SEQ ID NO: 116724 - DNA, 138 bp, Homo sapiens; identical to SEQ ID NO: 84079
  misc_feature 1..138: note = chr19:51412508-51412646
  misc_feature 1..138: note = Hyper
  source 1..138: mol_type = genomic DNA

SEQ ID NO: 116725 - DNA, 30 bp, Homo sapiens; identical to SEQ ID NO: 84080
  misc_feature 1..30: note = chr19:51413099-51413129
  misc_feature 1..30: note = Hyper
  source 1..30: mol_type = genomic DNA

SEQ ID NO: 116726 - DNA, 33 bp, Homo sapiens; identical to SEQ ID NO: 84082
  misc_feature 1..33: note = chr19:51451909-51451942
  misc_feature 1..33: note = Hypo
  source 1..33: mol_type = genomic DNA

SEQ ID NO: 116727 - DNA, 354 bp, Homo sapiens; identical to SEQ ID NO: 37669
  misc_feature 1..354: note = chr19:51520138-51520492
  misc_feature 1..354: note = Hyper
  source 1..354: mol_type = genomic DNA

SEQ ID NO: 116728 - DNA, 210 bp, Homo sapiens; identical to SEQ ID NO: 84085
  misc_feature 1..210: note = chr19:51520740-51520950
  misc_feature 1..210: note = Hyper
  source 1..210: mol_type = genomic DNA

SEQ ID NO: 116729 - DNA, 937 bp, Homo sapiens
  misc_feature 1..937: note = chr19:51521998-51522935
  misc_feature 1..937: note = Hyper
  source 1..937: mol_type = genomic DNA
atggagcggggccgggatggggcggcgtaagaggaggagaaagaacgcggcgaagagtccacggaagagcgaggatccgggtggcagaaatcggacagggcctgagtggggcgggtcacccaggggccgagccagaagaagggcccagctgacttgggggcgggccgtgctccggagcgctgggtgggtgctggggtctcgggggaggagaggtgcgcggggcttggtgacgggaacacattctcctcccgcccgtgcctcccaccggcgcctctccccgccccctgcccccgaccttaccccagagttgcgccatcagcagcggcagcagcttcgccagagcccgggcgccagaggcggcggagaggtggaggtgcggagctctcatggccaggatctgctggggtgtgtgcaggggcgggttaaaacagatgctccgttagagacccccacctcgccgcgctcatccgcccagcctgggccaccccagcccgcaagcacccttttgacctgcagccgataaccccaggggctggcagacgggagattcgggctggaacagcggtaatgggcacaattaccctaatgacgcccctcgcggcatcttcccgtcctccctgtgcccgagtggagcgctctccgcgccccagctaccctggctgcagccacgccgcgcccgaggtttccccctccttcacgcgcggggtggggatccgaggctcggagccagtgggagcctctttctcaacctcacagcggggggacttccgcgtcccgcaggtggagaaaccgaggctctaagccggctcctgcctgtggcccgggggtccccacccatcctctcgcaatccaccccaacccgggtggggtgcaggtagcttcacctgggagtcgccgataggaaggagggaggggacccagacgtgcctctgccctg

SEQ ID NO: 116730 - DNA, 90 bp, Homo sapiens; identical to SEQ ID NO: 84088
  misc_feature 1..90: note = chr19:51523176-51523266
  misc_feature 1..90: note = Hyper
  source 1..90: mol_type = genomic DNA

SEQ ID NO: 116731 - DNA, 105 bp, Homo sapiens; identical to SEQ ID NO: 84089
  misc_feature 1..105: note = chr19:51535305-51535410
  misc_feature 1..105: note = Hypo
  source 1..105: mol_type = genomic DNA

SEQ ID NO: 116732 - DNA, 642 bp, Homo sapiens; identical to SEQ ID NO: 84091
  misc_feature 1..642: note = chr19:51568062-51568704
  misc_feature 1..642: note = Hyper
  source 1..642: mol_type = genomic DNA

SEQ ID NO: 116733 - DNA, 150 bp, Homo sapiens; identical to SEQ ID NO: 84092
  misc_feature 1..150: note = chr19:51684620-51684770
  misc_feature 1..150: note = Hypo
  source 1..150: mol_type = genomic DNA

SEQ ID NO: 116734 - DNA, 36 bp, Homo sapiens; identical to SEQ ID NO: 84093
  misc_feature 1..36: note = chr19:51688376-51688412
  misc_feature 1..36: note = Hypo
  source 1..36: mol_type = genomic DNA

SEQ ID NO: 116735 - DNA, 30 bp, Homo sapiens; identical to SEQ ID NO: 45999
  misc_feature 1..30: note = chr19:51715131-51715161
  misc_feature 1..30: note = Hypo
  source 1..30: mol_type = genomic DNA

SEQ ID NO: 116736 - DNA, 95 bp, Homo sapiens; identical to SEQ ID NO: 84095
  misc_feature 1..95: note = chr19:51754542-51754637
  misc_feature 1..95: note = Hypo
  source 1..95: mol_type = genomic DNA

SEQ ID NO: 116737 - DNA, 30 bp, Homo sapiens; identical to SEQ ID NO: 37672
  misc_feature 1..30: note = chr19:51814766-51814796
  misc_feature 1..30: note = Hyper
  source 1..30: mol_type = genomic DNA

SEQ ID NO: 116738 - DNA, 176 bp, Homo sapiens; identical to SEQ ID NO: 84097
  misc_feature 1..176: note = chr19:51815099-51815275
  misc_feature 1..176: note = Hyper
  source 1..176: mol_type = genomic DNA

SEQ ID NO: 116739 - DNA, 166 bp, Homo sapiens; identical to SEQ ID NO: 84098
  misc_feature 1..166: note = chr19:51830260-51830426
  misc_feature 1..166: note = Hyper
  source 1..166: mol_type = genomic DNA

SEQ ID NO: 116740 - DNA, 631 bp, Homo sapiens
  misc_feature 1..631: note = chr19:51830759-51831390
  misc_feature 1..631: note = Hyper
  source 1..631: mol_type = genomic DNA
actaggggtgcactacgggagagtccagagtcctgagaggccagggtgcctggaggggggcggcggtgggagtgacccgaggtacatgaggtgctagaacccgaggcgatgggtcactggggtagggggcagaatgctgggtcaccggggaacggaggagcctgagagtcggggggctggcctggctgggcgctgcggcccggcccctgacccggatccctggcaggctgagcagcggcacggccgaaggcctgaaggtgcagacggagcgcacccgctcgatgcttctctttgccaacgtgagcgcccggcattacggcaactatacgtgtcgcgccgccaaccgactgggagcgtccagcgcctccatgcggctcctgcgtgcgtcttcgggcggggcggggccgggaaggtgggcggggccgggggcggggctagggaagtggagacgccgggaccgcccttcaggctggccctgaacttaggagatggacgctgagactgaaaagcaatgcgagtaagaaaccgatccacgcaatcaatattcattgagtgccagctaagggtttgtcgtgggggacgcagctgtgcacaaaagaaacaaggtttggggattcgcagagcttatagt

SEQ ID NO: 116741 - DNA, 126 bp, Homo sapiens; identical to SEQ ID NO: 84101
  misc_feature 1..126: note = chr19:51843467-51843593
  misc_feature 1..126: note = Hyper
  source 1..126: mol_type = genomic DNA

SEQ ID NO: 116742 - DNA, 45 bp, Homo sapiens; identical to SEQ ID NO: 84102
  misc_feature 1..45: note = chr19:51843801-51843846
  misc_feature 1..45: note = Hyper
  source 1..45: mol_type = genomic DNA

SEQ ID NO: 116743 - DNA, 30 bp, Homo sapiens; identical to SEQ ID NO: 84103
  misc_feature 1..30: note = chr19:51857522-51857552
  misc_feature 1..30: note = Hypo
  source 1..30: mol_type = genomic DNA

SEQ ID NO: 116744 - DNA, 60 bp, Homo sapiens; identical to SEQ ID NO: 84104
  misc_feature 1..60: note = chr19:51914569-51914629
  misc_feature 1..60: note = Hypo
  source 1..60: mol_type = genomic DNA

SEQ ID NO: 116745 - DNA, 30 bp, Homo sapiens; identical to SEQ ID NO: 84105
  misc_feature 1..30: note = chr19:51918050-51918080
  misc_feature 1..30: note = Hypo
  source 1..30: mol_type = genomic DNA

SEQ ID NO: 116746 - DNA, 137 bp, Homo sapiens; identical to SEQ ID NO: 84106
  misc_feature 1..137: note = chr19:51950127-51950264
  misc_feature 1..137: note = Hypo
  source 1..137: mol_type = genomic DNA

SEQ ID NO: 116747 - DNA, 240 bp, Homo sapiens; identical to SEQ ID NO: 84107
  misc_feature 1..240: note = chr19:52058092-52058332
  misc_feature 1..240: note = Hypo
  source 1..240: mol_type = genomic DNA

SEQ ID NO: 116748 - DNA, 256 bp, Homo sapiens; identical to SEQ ID NO: 84108
  misc_feature 1..256: note = chr19:52074277-52074533
  misc_feature 1..256: note = Hyper
  source 1..256: mol_type = genomic DNA

SEQ ID NO: 116749 - DNA, 84 bp, Homo sapiens; identical to SEQ ID NO: 84109
  misc_feature 1..84: note = chr19:52077608-52077692
  misc_feature 1..84: note = Hypo
  source 1..84: mol_type = genomic DNA

SEQ ID NO: 116750 - DNA, 30 bp, Homo sapiens; identical to SEQ ID NO: 84110
  misc_feature 1..30: note = chr19:52079361-52079391
  misc_feature 1..30: note = Hypo
  source 1..30: mol_type = genomic DNA

SEQ ID NO: 116751 - DNA, 30 bp, Homo sapiens; identical to SEQ ID NO: 84111
  misc_feature 1..30: note = chr19:52079718-52079748
  misc_feature 1..30: note = Hypo
  source 1..30: mol_type = genomic DNA

SEQ ID NO: 116752 - DNA, 25 bp, Homo sapiens
  misc_feature 1..25: note = chr19:52081316-52081341
  misc_feature 1..25: note = Hypo
  source 1..25: mol_type = genomic DNA
aaagttaactactttcgtcactttt

SEQ ID NO: 116753 - DNA, 120 bp, Homo sapiens; identical to SEQ ID NO: 84114
  misc_feature 1..120: note = chr19:52081641-52081761
  misc_feature 1..120: note = Hypo
  source 1..120: mol_type = genomic DNA

SEQ ID NO: 116754 - DNA, 22 bp, Homo sapiens
  misc_feature 1..22: note = chr19:52086395-52086417
  misc_feature 1..22: note = Hypo
  source 1..22: mol_type = genomic DNA
ccgtgcccggctatgggcatct

SEQ ID NO: 116755 - DNA, 40 bp, Homo sapiens; identical to SEQ ID NO: 84116
  misc_feature 1..40: note = chr19:52091303-52091343
  misc_feature 1..40: note = Hypo
  source 1..40: mol_type = genomic DNA

SEQ ID NO: 116756 - DNA, 795 bp, Homo sapiens
  misc_feature 1..795: note = chr19:52097245-52098040
  misc_feature 1..795: note = Hyper
  source 1..795: mol_type = genomic DNA
agaaagacgattgtgcgtaactgttcaccgcgtccacgtcccgagagttgcgcacgcgtggagatctgcaaaacgctccctttcagctccgcgcatgcacagagaccccaccccgcaagtccttgcccttcggcctgggcaggcgtccactcccatggctgcagggcgcgccgaagagcccactctgcatccccgagacgcggcccaatcctaggaatgtgcttagcgcaggtgctatcttcccttttcacattcccaatctctttctccgccccctcaaactcttgccatactcccacaacagcagaaaatctgaaaaaaaagtccatcccatctttgcactgacagcagtgcacagcagctggcagagaattctggcacggctattgtgcttgcgcaggcgcagacgggaagcgggccggaccggcctagtacactctgggaggcgtgcgcagaatgcgcagcgctgccgcgaggatctctgggaactgtaggcccagtttgtccgagagccgcaagtgtttcgggacgacgcaacgcaggggcacctgggagtcgtaggcggatgggcccaaagccttccgggagtcgtagtccttccgcccgctcctcgtttctttggaggttggcccttccagctccagttctgcccaggtgagcgcccatcccgcggccggccggtcctggccctttgtcgcgatgacgtggcggagttgagggtctctgtatttctctcccccgcgttctggtaggcgtccctggaaagatggcacccttttccgtgatctctcaatc

SEQ ID NO: 116757 - DNA, 34 bp, Homo sapiens; identical to SEQ ID NO: 84119
  misc_feature 1..34: note = chr19:52102053-52102087
  misc_feature 1..34: note = Hypo
  source 1..34: mol_type = genomic DNA

SEQ ID NO: 116758 - DNA, 57 bp, Homo sapiens
  misc_feature 1..57: note = chr19:52104552-52104609
  misc_feature 1..57: note = Hyper
  source 1..57: mol_type = genomic DNA
aggggggtgcccttccgcgctgccgcccgctgcagttcgcctcgcaggaggtggtgc

SEQ ID NO: 116759 - DNA, 143 bp, Homo sapiens; identical to SEQ ID NO: 84121
  misc_feature 1..143: note = chr19:52205697-52205840
  misc_feature 1..143: note = Hyper
  source 1..143: mol_type = genomic DNA

SEQ ID NO: 116760 - DNA, 721 bp, Homo sapiens; identical to SEQ ID NO: 84122
  misc_feature 1..721: note = chr19:52207085-52207806
  misc_feature 1..721: note = Hyper
  source 1..721: mol_type = genomic DNA

SEQ ID NO: 116761 - DNA, 30 bp, Homo sapiens; identical to SEQ ID NO: 84123
  misc_feature 1..30: note = chr19:52217139-52217169
  misc_feature 1..30: note = Hypo
  source 1..30: mol_type = genomic DNA

SEQ ID NO: 116762 - DNA, 743 bp, Homo sapiens
  misc_feature 1..743: note = chr19:52222430-52223173
  misc_feature 1..743: note = Hyper
  source 1..743: mol_type = genomic DNA
cgagtgggctgaaggcgcctctactcacctgcacgtagtccaccgaatctccgagcgccttgaaggctgtgtacatgacctcgcgcttgccgccccagcgctgcgccacgcacacgcacctgcgagtcctcaccagcgcctccactgccagccgcccaggatcctccgcctccacctcccgataggctccggcgcccaccgcgcccgccgccgcgggttcccagggctggtggtagttgccgtcccacacgtacgtggcggggtcctcgtcagcgaagacctcgcggaacatgtcgaccatgtagaggtcctcggcgcggttgccatccaccaccatgaggacgcgcagccgcgcgcgcgggtacagcagggcgcgggcggacgccaggcactggcgcaggtacgcggggtcctcctggtaggcggagatggtcagcgccacactgcgcgcggtggctgcatccagcggcccccgcgccgccgccgccacccgccggtgctccaggtacgcgaagaggctctgcgccaccaggtgcgctgaaaggaaggccccgtagaggccgaaggccaggaggccgtagcgatcggaggccagcggcaccccggcggcgtaggcccaggtcatgaggcccaggatgagcagggcgaaggcgatggtcagcaccctccgggccaggccggagcagcggcaggctgcaggagtgggcttgggcgcgtcctgctgggagcgagaggggaaagga

SEQ ID NO: 116763 - DNA, 105 bp, Homo sapiens; identical to SEQ ID NO: 84126
  misc_feature 1..105: note = chr19:52248329-52248434
  misc_feature 1..105: note = Hypo
  source 1..105: mol_type = genomic DNA

SEQ ID NO: 116764 - DNA, 30 bp, Homo sapiens; identical to SEQ ID NO: 84128
  misc_feature 1..30: note = chr19:52355375-52355405
  misc_feature 1..30: note = Hypo
  source 1..30: mol_type = genomic DNA

SEQ ID NO: 116765 - DNA, 214 bp, Homo sapiens; identical to SEQ ID NO: 37683
  misc_feature 1..214: note = chr19:52408028-52408242
  misc_feature 1..214: note = Hyper
  source 1..214: mol_type = genomic DNA

SEQ ID NO: 116766 - DNA, 251 bp, Homo sapiens; identical to SEQ ID NO: 84131
  misc_feature 1..251: note = chr19:52430054-52430305
  misc_feature 1..251: note = Hyper
  source 1..251: mol_type = genomic DNA

SEQ ID NO: 116767 - DNA, 83 bp, Homo sapiens; identical to SEQ ID NO: 84132
  misc_feature 1..83: note = chr19:52430563-52430646
  misc_feature 1..83: note = Hyper
  source 1..83: mol_type = genomic DNA

SEQ ID NO: 116768 - DNA, 18 bp, Homo sapiens
  misc_feature 1..18: note = chr19:52431077-52431095
  misc_feature 1..18: note = Hyper
  source 1..18: mol_type = genomic DNA
aaactgtgtctgcttcgg

SEQ ID NO: 116769 - DNA, 17 bp, Homo sapiens
  misc_feature 1..17: note = chr19:52456101-52456118
  misc_feature 1..17: note = Hypo
  source 1..17: mol_type = genomic DNA
ggggggtcagccccccg

SEQ ID NO: 116770 - DNA, 30 bp, Homo sapiens; identical to SEQ ID NO: 84135
  misc_feature 1..30: note = chr19:52489503-52489533
  misc_feature 1..30: note = Hyper
  source 1..30: mol_type = genomic DNA

SEQ ID NO: 116771 - DNA, 88 bp, Homo sapiens; identical to SEQ ID NO: 84136
  misc_feature 1..88: note = chr19:52490149-52490237
  misc_feature 1..88: note = Hyper
  source 1..88: mol_type = genomic DNA

SEQ ID NO: 116772 - DNA, 76 bp, Homo sapiens; identical to SEQ ID NO: 37685
  misc_feature 1..76: note = chr19:52511308-52511384
  misc_feature 1..76: note = Hyper
  source 1..76: mol_type = genomic DNA

SEQ ID NO: 116773 - DNA, 143 bp, Homo sapiens; identical to SEQ ID NO: 84138
  misc_feature 1..143: note = chr19:52512030-52512173
  misc_feature 1..143: note = Hypo
  source 1..143: mol_type = genomic DNA

SEQ ID NO: 116774 - DNA, 525 bp, Homo sapiens; identical to SEQ ID NO: 84139
  misc_feature 1..525: note = chr19:52531359-52531884
  misc_feature 1..525: note = Hyper
  source 1..525: mol_type = genomic DNA

SEQ ID NO: 116775 - DNA, 39 bp, Homo sapiens
  misc_feature 1..39: note = chr19:52552188-52552227
  misc_feature 1..39: note = Hyper
  source 1..39: mol_type = genomic DNA
acagcggccgggagacgcggtggacggaggcctcttaaa

SEQ ID NO: 116776 - DNA, 116 bp, Homo sapiens; identical to SEQ ID NO: 84140
  misc_feature 1..116: note = chr19:52598475-52598591
  misc_feature 1..116: note = Hyper
  source 1..116: mol_type = genomic DNA

SEQ ID NO: 116777 - DNA, 30 bp, Homo sapiens; identical to SEQ ID NO: 84141
  misc_feature 1..30: note = chr19:52599113-52599143
  misc_feature 1..30: note = Hyper
  source 1..30: mol_type = genomic DNA

SEQ ID NO: 116778 - DNA, 30 bp, Homo sapiens; identical to SEQ ID NO: 84142
  misc_feature 1..30: note = chr19:52614030-52614060
  misc_feature 1..30: note = Hypo
  source 1..30: mol_type = genomic DNA

SEQ ID NO: 116779 - DNA, 30 bp, Homo sapiens; identical to SEQ ID NO: 84144
  misc_feature 1..30: note = chr19:52753552-52753582
  misc_feature 1..30: note = Hypo
  source 1..30: mol_type = genomic DNA

SEQ ID NO: 116780 - DNA, 174 bp, Homo sapiens; identical to SEQ ID NO: 84145
  misc_feature 1..174: note = chr19:52774623-52774797
  misc_feature 1..174: note = Hypo
  source 1..174: mol_type = genomic DNA

SEQ ID NO: 116781 - DNA, 137 bp, Homo sapiens; identical to SEQ ID NO: 46005
  misc_feature 1..137: note = chr19:52780320-52780457
  misc_feature 1..137: note = Hypo
  source 1..137: mol_type = genomic DNA

SEQ ID NO: 116782 - DNA, 16 bp, Homo sapiens
  misc_feature 1..16: note = chr19:52800002-52800018
  misc_feature 1..16: note = Hyper
  source 1..16: mol_type = genomic DNA
ctggagtgcagtggcc

SEQ ID NO: 116783 - DNA, 136 bp, Homo sapiens; identical to SEQ ID NO: 84148
  misc_feature 1..136: note = chr19:52800078-52800214
  misc_feature 1..136: note = Hyper
  source 1..136: mol_type = genomic DNA

SEQ ID NO: 116784 - DNA, 222 bp, Homo sapiens; identical to SEQ ID NO: 84149
  misc_feature 1..222: note = chr19:52800693-52800915
  misc_feature 1..222: note = Hyper
  source 1..222: mol_type = genomic DNA

SEQ ID NO: 116785 - DNA, 145 bp, Homo sapiens; identical to SEQ ID NO: 84150
  misc_feature 1..145: note = chr19:52839411-52839556
  misc_feature 1..145: note = Hyper
  source 1..145: mol_type = genomic DNA

SEQ ID NO: 116786 - DNA, 284 bp, Homo sapiens
  misc_feature 1..284: note = chr19:52839797-52840081
  misc_feature 1..284: note = Hyper
  source 1..284: mol_type = genomic DNA
tctttactgacccaacgtcctgccccgcgcttttaaaagtccttaccgcaaggtggattcccgcccggggagcctcccaacctcgcccccggcccctgaagcgcagcgccgcagccccagtcccggcgggggaggccgcgtcctgtactgggtcctgggacccttgagaccccacacttctaataattcagccccacccttttcctccttgatccgggccttcctactccccaggcctccccttcgcagccatcgctactcccgacccccgggtgtggggacgt

SEQ ID NO: 116787 - DNA, 38 bp, Homo sapiens; identical to SEQ ID NO: 84154
  misc_feature 1..38: note = chr19:52872835-52872873
  misc_feature 1..38: note = Hyper
  source 1..38: mol_type = genomic DNA

SEQ ID NO: 116788 - DNA, 637 bp, Homo sapiens
  misc_feature 1..637: note = chr19:52872933-52873570
  misc_feature 1..637: note = Hyper
  source 1..637: mol_type = genomic DNA
tgcgagcgcccctacagccgatttaaaattaattttaatagcaggaattttcctggatctaatcatcaacaaactttccctctgccgggacacaatctatttccagatagctgagttcttccagtctccacggcaggtctagcctccaaaacgagacgagctgggagcgaggcggagggaagcgcaggctccgcccaatcccacccgggcctggcctcgcctcgcctctcagctgcgcgcgcagtttcctggagacccggaagcagattacgtggagtgacggtcatgctgcggcgtgtgagtttccctttgtttagattaaatctgggatgctgagtcccctcgcgcttctgtacccggcatctcaggggtcacacagaccttgaaatccccgcatcgctccctccaccccgactaaactcagacgttctaatgagagtctggcggtcgcttccctgagtgttaaaatcgctcggaggctggtcctgtccccggtctttcaccacagggccatgtagacagctcctgtcgcggagtttgcctgcttcaaatccttcagtgacccctagacacggcccgcgctgcgtaaagttctcacccgcgagatggatccacgtctttccggtcccccaagcct

SEQ ID NO: 116789 - DNA, 161 bp, Homo sapiens; identical to SEQ ID NO: 84157
  misc_feature 1..161: note = chr19:52893581-52893742
  misc_feature 1..161: note = Hypo
  source 1..161: mol_type = genomic DNA

SEQ ID NO: 116790 - DNA, 272 bp, Homo sapiens
  misc_feature 1..272: note = chr19:52900866-52901138
  misc_feature 1..272: note = Hyper
  source 1..272: mol_type = genomic DNA
aatagaaggaattttcgtggatataatctacaaccgattttgctctgcgcaggtaagatccgttttcagaccaaaaccctgaaaacaagcgcagccagtcaagcgaacggaagcgcaggcccggcccaggctttgtcccggcccgccctggtcccagccagtccggcctctaggatgcgcgcgcaatttcgtgcaaacccggaagcggaccgcggggggcgaacgcctagagcgcagtttccggtagacccggaagccgattgcagggagaa

SEQ ID NO: 116791 - DNA, 30 bp, Homo sapiens; identical to SEQ ID NO: 84160
  misc_feature 1..30: note = chr19:52907400-52907430
  misc_feature 1..30: note = Hypo
  source 1..30: mol_type = genomic DNA

SEQ ID NO: 116792 - DNA, 42 bp, Homo sapiens; identical to SEQ ID NO: 84162
  misc_feature 1..42: note = chr19:52927555-52927597
  misc_feature 1..42: note = Hypo
  source 1..42: mol_type = genomic DNA

SEQ ID NO: 116793 - DNA, 327 bp, Homo sapiens; identical to SEQ ID NO: 84165
  misc_feature 1..327: note = chr19:52956606-52956933
  misc_feature 1..327: note = Hyper
  source 1..327: mol_type = genomic DNA

SEQ ID NO: 116794 - DNA, 90 bp, Homo sapiens
  misc_feature 1..90: note = chr19:52957141-52957231
  misc_feature 1..90: note = Hyper
  source 1..90: mol_type = genomic DNA
catgaggtgtattcacgcccagtgggtcctccaagcctcgcccttctggcctcttggagctcggtcccgcagtctcgatgcatcagcgcc

SEQ ID NO: 116795 - DNA, 25 bp, Homo sapiens
  misc_feature 1..25: note = chr19:52983447-52983472
  misc_feature 1..25: note = Hypo
  source 1..25: mol_type = genomic DNA
cgtgcccagtcgattatgaatctta

SEQ ID NO: 116796 - DNA, 156 bp, Homo sapiens; identical to SEQ ID NO: 84168
  misc_feature 1..156: note = chr19:53007644-53007800
  misc_feature 1..156: note = Hypo
  source 1..156: mol_type = genomic DNA

SEQ ID NO: 116797 - DNA, 26 bp, Homo sapiens
  misc_feature 1..26: note = chr19:53028928-53028954
  misc_feature 1..26: note = Hypo
  source 1..26: mol_type = genomic DNA
ttatttatttagagacggaatctctt

SEQ ID NO: 116798 - DNA, 30 bp, Homo sapiens; identical to SEQ ID NO: 84171
  misc_feature 1..30: note = chr19:53030640-53030670
  misc_feature 1..30: note = Hyper
  source 1..30: mol_type = genomic DNA

SEQ ID NO: 116799 - DNA, 53 bp, Homo sapiens; identical to SEQ ID NO: 84172
  misc_feature 1..53: note = chr19:53031294-53031347
  misc_feature 1..53: note = Hyper
  source 1..53: mol_type = genomic DNA

SEQ ID NO: 116800 - DNA, 19 bp, Homo sapiens
  misc_feature 1..19: note = chr19:53064806-53064825
  misc_feature 1..19: note = Hypo
  source 1..19: mol_type = genomic DNA
tttttttttttgagacgga

SEQ ID NO: 116801 - DNA, 30 bp, Homo sapiens; identical to SEQ ID NO: 84174
  misc_feature 1..30: note = chr19:53071305-53071335
  misc_feature 1..30: note = Hypo
  source 1..30: mol_type = genomic DNA

SEQ ID NO: 116802 - DNA, 864 bp, Homo sapiens
  misc_feature 1..864: note = chr19:53073288-53074152
  misc_feature 1..864: note = Hyper
  source 1..864: mol_type = genomic DNA
ccagacaattccagggctttcgaatcgtgcttcagccttcctgaccgctctcgcctccaaagcccgaaaaatagagtcgctgggagcgaggctgagagacgcacaggtcccgccccggccccgccctctgccggttctaaagggcaaggtctctccgcctggggccccgcctctacctcgatcaggccccgcccaccttctcgttggctccacccaggcctggctttagtcctgtgcgcacacatccgcgcagaccaggaagcggatcccgtggagtgaaggtcgcaccgcggcggtgagttttgctctgtgttgtattaagtctgcactccccatatccccggcacttccgtacctgggacgtggggtcaccacagacctgtaaattctcgcccatcttccttcaaccagagcaaatgcagacgttcccctgggaatccggaagtcgcttccttttgtgtttaaagtcgccctgaggctgttcccgtctccagtctttctgctacagggcgctgtatacacttcctatcgcgtagtttctgtgctcaaaaccgttttttaactcctccctccccgcgcttttcaaagtcctcacccgagatgtgtatttccgcctgggcgcctcccagtctcaacctttaggcgcctgaagcgcaaacgtcgcgatcccagtctcagggaggccgagttctctgcctggtgctgggatcttgtggaccccaccgaaggcgtcgtcgcaccccacctcccgcctcatgctgggccttgctgcaccccaagtctccccttagcagtcaccactttccttgagccagcgttggggaggtgccaggggccagtcctgtgacacggtgtgttcttgcc

SEQ ID NO: 116803 - DNA, 20 bp, Homo sapiens
  misc_feature 1..20: note = chr19:53098049-53098069
  misc_feature 1..20: note = Hypo
  source 1..20: mol_type = genomic DNA
gccaccgcacctggcccgtt

SEQ ID NO: 116804 - DNA, 30 bp, Homo sapiens; identical to SEQ ID NO: 84180
  misc_feature 1..30: note = chr19:53102914-53102944
  misc_feature 1..30: note = Hypo
  source 1..30: mol_type = genomic DNA

SEQ ID NO: 116805 - DNA, 740 bp, Homo sapiens; identical to SEQ ID NO: 84181
  misc_feature 1..740: note = chr19:53104346-53105086
  misc_feature 1..740: note = Hyper
  source 1..740: mol_type = genomic DNA

SEQ ID NO: 116806 - DNA, 39 bp, Homo sapiens; identical to SEQ ID NO: 46009
  misc_feature 1..39: note = chr19:53105829-53105868
  misc_feature 1..39: note = Hypo
  source 1..39: mol_type = genomic DNA

SEQ ID NO: 116807 - DNA, 98 bp, Homo sapiens; identical to SEQ ID NO: 84183
  misc_feature 1..98: note = chr19:53137932-53138030
  misc_feature 1..98: note = Hypo
  source 1..98: mol_type = genomic DNA

SEQ ID NO: 116808 - DNA, 454 bp, Homo sapiens; identical to SEQ ID NO: 84184
  misc_feature 1..454: note = chr19:53140899-53141353
  misc_feature 1..454: note = Hyper
  source 1..454: mol_type = genomic DNA

SEQ ID NO: 116809 - DNA, 394 bp, Homo sapiens
  misc_feature 1..394: note = chr19:53141413-53141807
  misc_feature 1..394: note = Hyper
  source 1..394: mol_type = genomic DNA
agcgatatccggactctcatggggacgtctcaatttgtcctgggtgaaggaagaagggagagaatttccaggtctgtggggaccccacgtctcaggtacagcagcgccggggacctggtaagcgcagacttaatagaagagcgaaactcaccgccacggtgtaactttcactccacataatccgcttccgggtttgcgcgcatgtgcgcgcgcagtacagaagccaggtctgggcggggcccgcgaggtgggcggggcctggatgaggtaggggcggggtgggaagccgagagactttcccctttagaaccagcagtgggcggggccagggcgggacctgtgagtctctcagcatcgttcccagcgcagaggcatttttcgggttttggaggcg

SEQ ID NO: 116810 - DNA, 76 bp, Homo sapiens; identical to SEQ ID NO: 46010
  misc_feature 1..76: note = chr19:53148247-53148323
  misc_feature 1..76: note = Hypo
  source 1..76: mol_type = genomic DNA

SEQ ID NO: 116811 - DNA, 811 bp, Homo sapiens; identical to SEQ ID NO: 84188
  misc_feature 1..811: note = chr19:53193195-53194006
  misc_feature 1..811: note = Hyper
  source 1..811: mol_type = genomic DNA

SEQ ID NO: 116812 - DNA, 240 bp, Homo sapiens; identical to SEQ ID NO: 84189
  misc_feature 1..240: note = chr19:53194126-53194366
  misc_feature 1..240: note = Hyper
  source 1..240: mol_type = genomic DNA

SEQ ID NO: 116813 - DNA, 96 bp, Homo sapiens; identical to SEQ ID NO: 84191
  misc_feature 1..96: note = chr19:53211156-53211252
  misc_feature 1..96: note = Hypo
  source 1..96: mol_type = genomic DNA

SEQ ID NO: 116814 - DNA, 30 bp, Homo sapiens; identical to SEQ ID NO: 46011
  misc_feature 1..30: note = chr19:53225425-53225455
  misc_feature 1..30: note = Hypo
  source 1..30: mol_type = genomic DNA

SEQ ID NO: 116815 - DNA, 16 bp, Homo sapiens
  misc_feature 1..16: note = chr19:53238443-53238459
  misc_feature 1..16: note = Hyper
  source 1..16: mol_type = genomic DNA
gcgtctctcagcctcg

SEQ ID NO: 116816 - DNA, 34 bp, Homo sapiens; identical to SEQ ID NO: 84194
  misc_feature 1..34: note = chr19:53240317-53240351
  misc_feature 1..34: note = Hypo
  source 1..34: mol_type = genomic DNA

SEQ ID NO: 116817 - DNA, 79 bp, Homo sapiens; identical to SEQ ID NO: 84195
  misc_feature 1..79: note = chr19:53289871-53289950
  misc_feature 1..79: note = Hyper
  source 1..79: mol_type = genomic DNA

SEQ ID NO: 116818 - DNA, 30 bp, Homo sapiens; identical to SEQ ID NO: 46012
  misc_feature 1..30: note = chr19:53299504-53299534
  misc_feature 1..30: note = Hypo
  source 1..30: mol_type = genomic DNA

SEQ ID NO: 116819 - DNA, 47 bp, Homo sapiens
  misc_feature 1..47: note = chr19:53324245-53324292
  misc_feature 1..47: note = Hyper
  source 1..47: mol_type = genomic DNA
agagctggagctgggcgggcaagaacaccccgcgtcacaggacaagc

SEQ ID NO: 116820 - DNA, 30 bp, Homo sapiens; identical to SEQ ID NO: 84198
  misc_feature 1..30: note = chr19:53324547-53324577
  misc_feature 1..30: note = Hyper
  source 1..30: mol_type = genomic DNA

SEQ ID NO: 116821 - DNA, 50 bp, Homo sapiens; identical to SEQ ID NO: 84199
  misc_feature 1..50: note = chr19:53324990-53325040
  misc_feature 1..50: note = Hyper
  source 1..50: mol_type = genomic DNA

SEQ ID NO: 116822 - DNA, 27 bp, Homo sapiens
  misc_feature 1..27: note = chr19:53330844-53330871
  misc_feature 1..27: note = Hypo
  source 1..27: mol_type = genomic DNA
tgagatggagtcttgcggtgtctgctc

SEQ ID NO: 116823 - DNA, 111 bp, Homo sapiens; identical to SEQ ID NO: 37710
  misc_feature 1..111: note = chr19:53361072-53361183
  misc_feature 1..111: note = Hyper
  source 1..111: mol_type = genomic DNA

SEQ ID NO: 116824 - DNA, 30 bp, Homo sapiens; identical to SEQ ID NO: 84202
  misc_feature 1..30: note = chr19:53363084-53363114
  misc_feature 1..30: note = Hypo
  source 1..30: mol_type = genomic DNA

SEQ ID NO: 116825 - DNA, 141 bp, Homo sapiens; identical to SEQ ID NO: 84205
  misc_feature 1..141: note = chr19:53387484-53387625
  misc_feature 1..141: note = Hypo
  source 1..141: mol_type = genomic DNA

SEQ ID NO: 116826 - DNA, 403 bp, Homo sapiens; identical to SEQ ID NO: 37711
  misc_feature 1..403: note = chr19:53400389-53400792
  misc_feature 1..403: note = Hyper
  source 1..403: mol_type = genomic DNA

SEQ ID NO: 116827 - DNA, 30 bp, Homo sapiens; identical to SEQ ID NO: 46014
  misc_feature 1..30: note = chr19:53412458-53412488
  misc_feature 1..30: note = Hypo
  source 1..30: mol_type = genomic DNA

SEQ ID NO: 116828 - DNA, 30 bp, Homo sapiens; identical to SEQ ID NO: 84212
  misc_feature 1..30: note = chr19:53426134-53426164
  misc_feature 1..30: note = Hyper
  source 1..30: mol_type = genomic DNA

SEQ ID NO: 116829 - DNA, 359 bp, Homo sapiens; identical to SEQ ID NO: 84213
  misc_feature 1..359: note = chr19:53426510-53426869
  misc_feature 1..359: note = Hyper
  source 1..359: mol_type = genomic DNA

SEQ ID NO: 116830 - DNA, 24 bp, Homo sapiens
  misc_feature 1..24: note = chr19:53429320-53429344
  misc_feature 1..24: note = Hypo
  source 1..24: mol_type = genomic DNA
ataagaagggacaatcggccaggt

SEQ ID NO: 116831 - DNA, 112 bp, Homo sapiens; identical to SEQ ID NO: 84215
  misc_feature 1..112: note = chr19:53445710-53445822
  misc_feature 1..112: note = Hyper
  source 1..112: mol_type = genomic DNA

SEQ ID NO: 116832 - DNA, 45 bp, Homo sapiens; identical to SEQ ID NO: 84216
  misc_feature 1..45: note = chr19:53446430-53446475
  misc_feature 1..45: note = Hyper
  source 1..45: mol_type = genomic DNA

SEQ ID NO: 116833 - DNA, 652 bp, Homo sapiens; identical to SEQ ID NO: 84217
  misc_feature 1..652: note = chr19:53465861-53466513
  misc_feature 1..652: note = Hyper
  source 1..652: mol_type = genomic DNA

SEQ ID NO: 116834 - DNA, 246 bp, Homo sapiens; identical to SEQ ID NO: 84218
  misc_feature 1..246: note = chr19:53496159-53496405
  misc_feature 1..246: note = Hyper
  source 1..246: mol_type = genomic DNA

SEQ ID NO: 116835 - DNA, 461 bp, Homo sapiens
  misc_feature 1..461: note = chr19:53496648-53497109
  misc_feature 1..461: note = Hyper
  source 1..461: mol_type = genomic DNA
tatgtggggaccccacgtcccctgggacagaagtcccagggacctgcggagcgcagacataacacaacacagagcaaaactcaccgctgcggtgactttcactccacgcgatccgcttcccggtttacgctaaactgggcgctcgggacagaagccaggtctcggcgggacatggcagggggtgggcggggcctgggcgaggtgggggcggggcgcgaggcggagagaccttcccctatagaaccggcagggggcggggcgcgaggcggagagaccttcccctatagaaccggcagggggcggggcgcgaggcggagagaccttcccctatagaaccggcagagggcggggcgggatctgtgagtctctcagcctcggcgtgtttttgggttttggagacgagacctgccaggaaagctgaggcatgattcaaaagccctggaactgtctggaaggggaat

SEQ ID NO: 116836 - DNA, 100 bp, Homo sapiens; identical to SEQ ID NO: 84221
  misc_feature 1..100: note = chr19:53497289-53497389
  misc_feature 1..100: note = Hyper
  source 1..100: mol_type = genomic DNA

SEQ ID NO: 116837 - DNA, 20 bp, Homo sapiens
  misc_feature 1..20: note = chr19:53497973-53497993
  misc_feature 1..20: note = Hypo
  source 1..20: mol_type = genomic DNA
gttaccgtgcctgtcccaag

SEQ ID NO: 116838 - DNA, 30 bp, Homo sapiens; identical to SEQ ID NO: 84223
  misc_feature 1..30: note = chr19:53507239-53507269
  misc_feature 1..30: note = Hypo
  source 1..30: mol_type = genomic DNA

SEQ ID NO: 116839 - DNA, 28 bp, Homo sapiens
  misc_feature 1..28: note = chr19:53549226-53549254
  misc_feature 1..28: note = Hypo
  source 1..28: mol_type = genomic DNA
cattttggccgggcacggtggctcatgc

SEQ ID NO: 116840 - DNA, 472 bp, Homo sapiens; identical to SEQ ID NO: 84225
  misc_feature 1..472: note = chr19:53561353-53561825
  misc_feature 1..472: note = Hyper
  source 1..472: mol_type = genomic DNA

SEQ ID NO: 116841 - DNA, 142 bp, Homo sapiens; identical to SEQ ID NO: 84226
  misc_feature 1..142: note = chr19:53606212-53606354
  misc_feature 1..142: note = Hyper
  source 1..142: mol_type = genomic DNA

SEQ ID NO: 116842 - DNA, 30 bp, Homo sapiens; identical to SEQ ID NO: 84227
  misc_feature 1..30: note = chr19:53606575-53606605
  misc_feature 1..30: note = Hyper
  source 1..30: mol_type = genomic DNA

SEQ ID NO: 116843 - DNA, 79 bp, Homo sapiens; identical to SEQ ID NO: 84228
  misc_feature 1..79: note = chr19:53607032-53607111
  misc_feature 1..79: note = Hyper
  source 1..79: mol_type = genomic DNA

SEQ ID NO: 116844 - DNA, 132 bp, Homo sapiens; identical to SEQ ID NO: 84229
  misc_feature 1..132: note = chr19:53635472-53635604
  misc_feature 1..132: note = Hyper
  source 1..132: mol_type = genomic DNA

SEQ ID NO: 116845 - DNA, 206 bp, Homo sapiens; identical to SEQ ID NO: 84230
  misc_feature 1..206: note = chr19:53635885-53636091
  misc_feature 1..206: note = Hyper
  source 1..206: mol_type = genomic DNA

SEQ ID NO: 116846 - DNA, 452 bp, Homo sapiens; identical to SEQ ID NO: 84231
  misc_feature 1..452: note = chr19:53661430-53661882
  misc_feature 1..452: note = Hyper
  source 1..452: mol_type = genomic DNA

SEQ ID NO: 116847 - DNA, 452 bp, Homo sapiens; identical to SEQ ID NO: 84232
  misc_feature 1..452: note = chr19:53662182-53662634
  misc_feature 1..452: note = Hyper
  source 1..452: mol_type = genomic DNA

SEQ ID NO: 116848 - DNA, 634 bp, Homo sapiens
  misc_feature 1..634: note = chr19:53696112-53696746
  misc_feature 1..634: note = Hyper
  source 1..634: mol_type = genomic DNA
gagggaggtggggggcgacggcgccttaggagaggggtggggtatgcaggatcccaggaccaggcagaggcgcggcctccccgggactggggctgcggcgctaacgctccagtagctgactagggcgaggttaggggacggtaaaatcctgcacccacttcgcagatgaggacttcacagggcgcaggtcagtaaagggttttaagcaggaaacggcgcaggaaaggaggtgtctgcatggtctgaaggccgaaagaccgcgggcaggaccagcctgtgtgattttaacccaaagcgatgcgacccccagagtctcgcggcaaagtctgaatttacatggaatggagggagccgtgcggggactttaagggctatacgaacccccggacatcgggtacggaggagcaggggactccgaaacgcaggtttaatctagatagagggaaactcacgcggcgactaacagccttcactccaagagatctgcttccgggtttgcaagaaactgcccgcgcagtaggcaaaggggcgggttgcggtggggaaaggccaggcgttgggagggactgagagcatagggtgggcggggccggggcggggcctgaaccctggaggcggaggttgcaatgagccg

SEQ ID NO: 116849 - DNA, 94 bp, Homo sapiens; identical to SEQ ID NO: 84235
  misc_feature 1..94: note = chr19:53696806-53696900
  misc_feature 1..94: note = Hyper
  source 1..94: mol_type = genomic DNA

SEQ ID NO: 116850 - DNA, 30 bp, Homo sapiens; identical to SEQ ID NO: 84236
  misc_feature 1..30: note = chr19:53700031-53700061
  misc_feature 1..30: note = Hyper
  source 1..30: mol_type = genomic DNA

SEQ ID NO: 116851 - DNA, 392 bp, Homo sapiens; identical to SEQ ID NO: 84237
  misc_feature 1..392: note = chr19:53700307-53700699
  misc_feature 1..392: note = Hyper
  source 1..392: mol_type = genomic DNA

SEQ ID NO: 116852 - DNA, 82 bp, Homo sapiens; identical to SEQ ID NO: 84238
  misc_feature 1..82: note = chr19:53701633-53701715
  misc_feature 1..82: note = Hypo
  source 1..82: mol_type = genomic DNA

SEQ ID NO: 116853 - DNA, 33 bp, Homo sapiens; identical to SEQ ID NO: 84239
  misc_feature 1..33: note = chr19:53702028-53702061
  misc_feature 1..33: note = Hypo
  source 1..33: mol_type = genomic DNA

SEQ ID NO: 116854 - DNA, 20 bp, Homo sapiens
  misc_feature 1..20: note = chr19:53704275-53704295
  misc_feature 1..20: note = Hypo
  source 1..20: mol_type = genomic DNA
gccaccgtgcccagcttgtt

SEQ ID NO: 116855 - DNA, 33 bp, Homo sapiens; identical to SEQ ID NO: 84241
  misc_feature 1..33: note = chr19:53728442-53728475
  misc_feature 1..33: note = Hypo
  source 1..33: mol_type = genomic DNA

SEQ ID NO: 116856 - DNA, 40 bp, Homo sapiens; identical to SEQ ID NO: 84242
  misc_feature 1..40: note = chr19:53733589-53733629
  misc_feature 1..40: note = Hypo
  source 1..40: mol_type = genomic DNA

SEQ ID NO: 116857 - DNA, 525 bp, Homo sapiens
  misc_feature 1..525: note = chr19:53757722-53758247
  misc_feature 1..525: note = Hyper
  source 1..525: mol_type = genomic DNA
ctccctggagaagggcgaagggtgtgtatccaccccgagtgagggctttaccagggggagggaagagggagtcagagaagagttttaagcagagaaacgacgcggtgggcggtcggtgtccacactgacctaaagcaaaaaggtcggggccagtacccacttcagaacgattttaatccgaaatggacgcagatctctagaccctctcggagcgacgggactgggaacgtcttagggccacgccgcgagaggaatgagcaggttcggggttttaacctacagggcgaccccaaaacccgacagcggagcgtgggaacctgtggcccgcgaggcgcaggcttgaacccgaaagacggagactcacccgagagcgccagtagccccgcgagatccgcttccgggtcggcaggaacctgcgcgtacgcgagtgcactggggcggcgcaaggggcaagggcaggggcagggcgcggacaactgtggggatgggcgggcaaatggcggggatgggcggggacaatggcgg

SEQ ID NO: 116858 - DNA, 107 bp, Homo sapiens; identical to SEQ ID NO: 84244
  misc_feature 1..107: note = chr19:53794273-53794380
  misc_feature 1..107: note = Hypo
  source 1..107: mol_type = genomic DNA

SEQ ID NO: 116859 - DNA, 76 bp, Homo sapiens; identical to SEQ ID NO: 84245
  misc_feature 1..76: note = chr19:53811828-53811904
  misc_feature 1..76: note = Hyper
  source 1..76: mol_type = genomic DNA

SEQ ID NO: 116860 - DNA, 39 bp, Homo sapiens; identical to SEQ ID NO: 84246
  misc_feature 1..39: note = chr19:53836812-53836851
  misc_feature 1..39: note = Hyper
  source 1..39: mol_type = genomic DNA

SEQ ID NO: 116861 - DNA, 780 bp, Homo sapiens
  misc_feature 1..780: note = chr19:53868628-53869408
  misc_feature 1..780: note = Hyper
  source 1..780: mol_type = genomic DNA
ttctattctctgggccgtcagcatgacattgtaagttctgcccaagcagggctttgcatttcacattctactttgcatccgcgtttcagacaattccagggcttttgaatcatggatcggccttcctggccatctcgcctccaaaacccaaaaacagaggcggtgggagggaggctgagagacgcacagatcccgccccagcccagccccgccccgccctctgccggtactaaagggcaaggtctctccgcctctacccctacctggcccaggccccgcccacctcctcgcaggccccgcccaggcctggcttctgtccttccccgctcagacgcgcgcaaacccggaagcagatcgcgtggagtgaaggtccctcagcggcgcgtgagtttcgctccatcttgtatgaagtctgctcttcccaggtccccggcgcttctgtccctgggacgtggggtccctacagacctggaaattctcacccgtcttccttcgcccagagcaaattgagacgtccccgtgagagcccgggggtcacttccttttgggtttaaagtctccctgaggctggtcccgttccggatctttctgctatagggcaatatatacactttctatcgcgtagttttcctgctctaaacctttttctgactcctcccgccccgcgctttttaaagtcctcacccgagaggtgaattcccgccctgggcgcctcccagcctcgccctcgtcggcccctagagcgcagcgtcgcagctccggtcccggggaggccgagtt

SEQ ID NO: 116862 - DNA, 30 bp, Homo sapiens; identical to SEQ ID NO: 84249
  misc_feature 1..30: note = chr19:53886601-53886631
  misc_feature 1..30: note = Hypo
  source 1..30: mol_type = genomic DNA

SEQ ID NO: 116863 - DNA, 38 bp, Homo sapiens; identical to SEQ ID NO: 84250
  misc_feature 1..38: note = chr19:53934719-53934757
  misc_feature 1..38: note = Hyper
  source 1..38: mol_type = genomic DNA

SEQ ID NO: 116864 - DNA, 100 bp, Homo sapiens; identical to SEQ ID NO: 84251
  misc_feature 1..100: note = chr19:53935204-53935304
  misc_feature 1..100: note = Hyper
  source 1..100: mol_type = genomic DNA

SEQ ID NO: 116865 - DNA, 38 bp, Homo sapiens; identical to SEQ ID NO: 46018
  misc_feature 1..38: note = chr19:53965321-53965359
  misc_feature 1..38: note = Hypo
  source 1..38: mol_type = genomic DNA

SEQ ID NO: 116866 - DNA, 28 bp, Homo sapiens
  misc_feature 1..28: note = chr19:53965595-53965623
  misc_feature 1..28: note = Hypo
  source 1..28: mol_type = genomic DNA
cagtgtcagcccacccgcaggtagacat

SEQ ID NO: 116867 - DNA, 285 bp, Homo sapiens
  misc_feature 1..285: note = chr19:53966611-53966896
  misc_feature 1..285: note = Hyper
  source 1..285: mol_type = genomic DNA
ggcagctttggaaaccgggcctggttagagggtgggggtggggcctggaatgggagtgggcggggcaagagggaggaggctgcctgggggccgggctggacagcaggaaaaggcgggacccgagggttagcgtcatcttgggggtggggtctggaaggggttttttgttctgaagggcggggcctggagggggcgggtccggattcttttctcagctgggccgtggatgtcgcctgctctcatcctcttgccctccaggactgggtcctccgggttctgattggt

SEQ ID NO: 116868 - DNA, 38 bp, Homo sapiens; identical to SEQ ID NO: 84256
  misc_feature 1..38: note = chr19:53970358-53970396
  misc_feature 1..38: note = Hyper
  source 1..38: mol_type = genomic DNA

SEQ ID NO: 116869 - DNA, 180 bp, Homo sapiens; identical to SEQ ID NO: 84257
  misc_feature 1..180: note = chr19:53970456-53970636
  misc_feature 1..180: note = Hyper
  source 1..180: mol_type = genomic DNA

SEQ ID NO: 116870 - DNA, 817 bp, Homo sapiens
  misc_feature 1..817: note = chr19:53970756-53971573
  misc_feature 1..817: note = Hyper
  source 1..817: mol_type = genomic DNA
tccagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggcctggcttctgtcctgcgcgcagattcgcgaaaacccggaagcggatcgcgtggagtgacggtcccacggcagcgcgtgagtttggctctgtgttgtattaggtctgcacttcccaggtccctggcgcttctgtacctggggcgtggggtccccacaaacctggaaattctcagccgtcttccttcacccagagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagaccccacccttgtcttaaggcgccctcgcgcccccccccccccacctccctcctcctgccgggccctgctgcttcctaggtctcccctccgcagtcacggcttcccctgagcccacgttggggaggtgcc

SEQ ID NO: 116871 - DNA, 30 bp, Homo sapiens; identical to SEQ ID NO: 84260
  misc_feature 1..30: note = chr19:53982737-53982767
  misc_feature 1..30: note = Hypo
  source 1..30: mol_type = genomic DNA

SEQ ID NO: 116872 - DNA, 31 bp, Homo sapiens; identical to SEQ ID NO: 84261
  misc_feature 1..31: note = chr19:54005694-54005725
  misc_feature 1..31: note = Hypo
  source 1..31: mol_type = genomic DNA

SEQ ID NO: 116873 - DNA, 687 bp, Homo sapiens
  misc_feature 1..687: note = chr19:54023871-54024558
  misc_feature 1..687: note = Hyper
  source 1..687: mol_type = genomic DNA
cgaaaagcattctgacggccgcgcttccagcgctaaggattcccgcgtagtgagcatttcccagaggtctctggggcatggctccattagggccgtgtgcagttgcctgcagggaaacactgatgggcgcccttccagatacgtcgattcccgggttatgagctacatttcccagaagccctcaaggcaggacgcccttagggtcgcgtagagttgcatgctgggaaatcctgacagccgcttccaactctgtggatttccgggttatggactacatttcccagaggcctctgggtcacggctccatttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcgg

SEQ ID NO: 116874 - DNA, 266 bp, Homo sapiens; identical to SEQ ID NO: 84264
  misc_feature 1..266: note = chr19:54024618-54024884
  misc_feature 1..266: note = Hyper
  source 1..266: mol_type = genomic DNA

SEQ ID NO: 116875 - DNA, 114 bp, Homo sapiens; identical to SEQ ID NO: 46019
  misc_feature 1..114: note = chr19:54033275-54033389
  misc_feature 1..114: note = Hypo
  source 1..114: mol_type = genomic DNA

SEQ ID NO: 116876 - DNA, 21 bp, Homo sapiens
  misc_feature 1..21: note = chr19:54039855-54039876
  misc_feature 1..21: note = Hypo
  source 1..21: mol_type = genomic DNA
tttaaaaattattctcgactg

SEQ ID NO: 116877 - DNA, 30 bp, Homo sapiens; identical to SEQ ID NO: 46021
  misc_feature 1..30: note = chr19:54046025-54046055
  misc_feature 1..30: note = Hypo
  source 1..30: mol_type = genomic DNA

SEQ ID NO: 116878 - DNA, 34 bp, Homo sapiens; identical to SEQ ID NO: 84268
  misc_feature 1..34: note = chr19:54074852-54074886
  misc_feature 1..34: note = Hypo
  source 1..34: mol_type = genomic DNA

SEQ ID NO: 116879 - DNA, 58 bp, Homo sapiens; identical to SEQ ID NO: 84269
  misc_feature 1..58: note = chr19:54109845-54109903
  misc_feature 1..58: note = Hypo
  source 1..58: mol_type = genomic DNA

SEQ ID NO: 116880 - DNA, 30 bp, Homo sapiens; identical to SEQ ID NO: 84270
  misc_feature 1..30: note = chr19:54162709-54162739
  misc_feature 1..30: note = Hyper
  source 1..30: mol_type = genomic DNA

SEQ ID NO: 116881 - DNA, 144 bp, Homo sapiens; identical to SEQ ID NO: 84271
  misc_feature 1..144: note = chr19:54224540-54224684
  misc_feature 1..144: note = Hypo
  source 1..144: mol_type = genomic DNA

SEQ ID NO: 116882 - DNA, 19 bp, Homo sapiens
  misc_feature 1..19: note = chr19:54232634-54232653
  misc_feature 1..19: note = Hypo
  source 1..19: mol_type = genomic DNA
caggcgtgagccaccgcgc

SEQ ID NO: 116883 - DNA, 47 bp, Homo sapiens; identical to SEQ ID NO: 84273
  misc_feature 1..47: note = chr19:54314338-54314385
  misc_feature 1..47: note = Hypo
  source 1..47: mol_type = genomic DNA

SEQ ID NO: 116884 - DNA, 16 bp, Homo sapiens
  misc_feature 1..16: note = chr19:54347071-54347087
  misc_feature 1..16: note = Hypo
  source 1..16: mol_type = genomic DNA
tcggcaaagtcacagc

SEQ ID NO: 116885 - DNA, 37 bp, Homo sapiens; identical to SEQ ID NO: 84275
  misc_feature 1..37: note = chr19:54351799-54351836
  misc_feature 1..37: note = Hypo
  source 1..37: mol_type = genomic DNA

SEQ ID NO: 116886 - DNA, 66 bp, Homo sapiens; identical to SEQ ID NO: 84278
  misc_feature 1..66: note = chr19:54371989-54372055
  misc_feature 1..66: note = Hyper
  source 1..66: mol_type = genomic DNA

SEQ ID NO: 116887 - DNA, 68 bp, Homo sapiens; identical to SEQ ID NO: 84279
  misc_feature 1..68: note = chr19:54372332-54372400
  misc_feature 1..68: note = Hyper
  source 1..68: mol_type = genomic DNA

SEQ ID NO: 116888 - DNA, 139 bp, Homo sapiens; identical to SEQ ID NO: 84280
  misc_feature 1..139: note = chr19:54372963-54373102
  misc_feature 1..139: note = Hyper
  source 1..139: mol_type = genomic DNA

SEQ ID NO: 116889 - DNA, 90 bp, Homo sapiens; identical to SEQ ID NO: 84281
  misc_feature 1..90: note = chr19:54382714-54382804
  misc_feature 1..90: note = Hyper
  source 1..90: mol_type = genomic DNA

SEQ ID NO: 116890 - DNA, 30 bp, Homo sapiens; identical to SEQ ID NO: 84282
  misc_feature 1..30: note = chr19:54393087-54393117
  misc_feature 1..30: note = Hyper
  source 1..30: mol_type = genomic DNA

SEQ ID NO: 116891 - DNA, 34 bp, Homo sapiens; identical to SEQ ID NO: 84283
  misc_feature 1..34: note = chr19:54395866-54395900
  misc_feature 1..34: note = Hypo
  source 1..34: mol_type = genomic DNA

SEQ ID NO: 116892 - DNA, 54 bp, Homo sapiens; identical to SEQ ID NO: 84284
  misc_feature 1..54: note = chr19:54401772-54401826
  misc_feature 1..54: note = Hyper
  source 1..54: mol_type = genomic DNA

SEQ ID NO: 116893 - DNA, 30 bp, Homo sapiens; identical to SEQ ID NO: 84285
  misc_feature 1..30: note = chr19:54402455-54402485
  misc_feature 1..30: note = Hyper
  source 1..30: mol_type = genomic DNA

SEQ ID NO: 116894 - DNA, 159 bp, Homo sapiens; identical to SEQ ID NO: 84286
  misc_feature 1..159: note = chr19:54403442-54403601
  misc_feature 1..159: note = Hypo
  source 1..159: mol_type = genomic DNA

SEQ ID NO: 116895 - DNA, 435 bp, Homo sapiens; identical to SEQ ID NO: 84287
  misc_feature 1..435: note = chr19:54409951-54410386
  misc_feature 1..435: note = Hyper
  source 1..435: mol_type = genomic DNA

SEQ ID NO: 116896 - DNA, 772 bp, Homo sapiens; identical to SEQ ID NO: 84288
  misc_feature 1..772: note = chr19:54411125-54411897
  misc_feature 1..772: note = Hyper
  source 1..772: mol_type = genomic DNA

SEQ ID NO: 116897 - DNA, 511 bp, Homo sapiens
  misc_feature 1..511: note = chr19:54412648-54413159
  misc_feature 1..511: note = Hyper
  source 1..511: mol_type = genomic DNA
cgggggcggggggcgcgggcaccggcgaccccggtggcggcggcggcggccgggggaagcctcggggccggtcatgcggctgcggggcccgcggcccggagcgtccgcccagccctgagcgaggtgagcgctagcggagggtcctgggaggaagaaggggcgcccctcgaggtggctgcgagccgggtttggggcaacaagggacccgagtggctccaggggtggtgagatcctggcggtcgggacgcccgaattcgagcggctatgggggatgcagggacacctgggcctggcgatcccggaggacggggtccgagggtcccggagtgggaaactgcactcctcgcgtccgagtcgcagcgagcgtgggctggggagggcagaggccgggtccctgaggaaggcgaggtacggggcgagggcggaggacccaggcccggccagagcaggatgtgggtctggaaaggggtcccagaaagggggagttacggtctcccgagagatggaggag

SEQ ID NO: 116898 - DNA, 239 bp, Homo sapiens; identical to SEQ ID NO: 84292
  misc_feature 1..239: note = chr19:54413373-54413612
  misc_feature 1..239: note = Hyper
  source 1..239: mol_type = genomic DNA

SEQ ID NO: 116899 - DNA, 435 bp, Homo sapiens
  misc_feature 1..435: note = chr19:54445310-54445745
  misc_feature 1..435: note = Hyper
  source 1..435: mol_type = genomic DNA
tacctgttcaccaagcgctacgcggaggaggagatgtaccgtccacacccggccttctaccgcccgcgtctcagcgactgctccgactactcgggccagttcctgcagcccgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttaggggggtctccctgcaatgcagcgcccccttccgtcctcgggactcctcgctcccacccggaggaggctgcgccagctttaggccccgccctcctcccaatggctccgcccacagactcccttatttcaatggccgcgccctcttttcccg

SEQ ID NO: 116900 - DNA, 268 bp, Homo sapiens; identical to SEQ ID NO: 84295
  misc_feature 1..268: note = chr19:54445948-54446216
  misc_feature 1..268: note = Hyper
  source 1..268: mol_type = genomic DNA

SEQ ID NO: 116901 - DNA, 39 bp, Homo sapiens; identical to SEQ ID NO: 84296
  misc_feature 1..39: note = chr19:54446419-54446458
  misc_feature 1..39: note = Hyper
  source 1..39: mol_type = genomic DNA

SEQ ID NO: 116902 - DNA, 30 bp, Homo sapiens; identical to SEQ ID NO: 84297
  misc_feature 1..30: note = chr19:54461145-54461175
  misc_feature 1..30: note = Hyper
  source 1..30: mol_type = genomic DNA

SEQ ID NO: 116903 - DNA, 57 bp, Homo sapiens; identical to SEQ ID NO: 84298
  misc_feature 1..57: note = chr19:54461664-54461721
  misc_feature 1..57: note = Hyper
  source 1..57: mol_type = genomic DNA

SEQ ID NO: 116904 - DNA, 52 bp, Homo sapiens; identical to SEQ ID NO: 84299
  misc_feature 1..52: note = chr19:54463017-54463069
  misc_feature 1..52: note = Hyper
  source 1..52: mol_type = genomic DNA

SEQ ID NO: 116905 - DNA, 459 bp, Homo sapiens; identical to SEQ ID NO: 84300
  misc_feature 1..459: note = chr19:54465275-54465734
  misc_feature 1..459: note = Hyper
  source 1..459: mol_type = genomic DNA

SEQ ID NO: 116906 - DNA, 493 bp, Homo sapiens; identical to SEQ ID NO: 84301
  misc_feature 1..493: note = chr19:54466121-54466614
  misc_feature 1..493: note = Hyper
  source 1..493: mol_type = genomic DNA

SEQ ID NO: 116907 - DNA, 637 bp, Homo sapiens
  misc_feature 1..637: note = chr19:54481331-54481968
  misc_feature 1..637: note = Hyper
  source 1..637: mol_type = genomic DNA
tcagtggggttgccccgcccccaaccctgaagtatccgcccccaccactgccctccccgctcctccagggttgaaaagaggcgtctgcgtgaagatcaatcatttcccggaggacacggactacgaccacgacagcgcggagtatctactccgtacgtgggggtccgggacagacgtggggagtgggtcaaatcgcggggcctggaaggcgtcggggtgggtgccgggaaaaggcactgggactccggcacttggatcgacacgccgaggttagcctcccagccaatccgagtccagatagtgagatcctctggtccccgattggctgactgatctcgttcccgccccctcctctcaccttggggcgggctgagggaggatcctgggcgctaattggccgctttgctctctttggccctcgcggcgactctgcgccgtgactggttgtggaatcccggactgggattggccaccgcgccgcagagctgtggggcaatctgcggcggtgacgggccactactgggagccggctgggaaagcctgtattgccattggtagctaccccgagaacgcggcaaatcctaaatgatgattggctgcggcctcagccaggttccgaaatcgcaaaatctagttg

SEQ ID NO: 116908 - DNA, 913 bp, Homo sapiens
  misc_feature 1..913: note = chr19:54482817-54483730
  misc_feature 1..913: note = Hyper
  source 1..913: mol_type = genomic DNA
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggtgagaggcagagggagggggcgaccggggcggcccacctgggcgcgcacgtgtgtgtgtgtgtgtgtgtgtgtgtgtgcgcgcgcgcgcgtgagtgcaagtgcgcgttcgtgtgtctgcaaagccaccttgccccgagcacccccgggggcccggagccttcctaggcggtccccaagctccatcgccacccgctgggtaaggtgggtgtagttctcgcgtcgccttcggaggagtaaaccgacacaggcaggtgtctggcgcgtaagacgccgggcgcttaggatcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagac

SEQ ID NO: 116909 - DNA, 673 bp, Homo sapiens
  misc_feature 1..673: note = chr19:54485524-54486197
  misc_feature 1..673: note = Hyper
  source 1..673: mol_type = genomic DNA
gcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttccc

SEQ ID NO: 116910 - DNA, 30 bp, Homo sapiens; identical to SEQ ID NO: 84311
  misc_feature 1..30: note = chr19:54487792-54487822
  misc_feature 1..30: note = Hypo
  source 1..30: mol_type = genomic DNA

SEQ ID NO: 116911 - DNA, 246 bp, Homo sapiens; identical to SEQ ID NO: 84312
  misc_feature 1..246: note = chr19:54494857-54495103
  misc_feature 1..246: note = Hyper
  source 1..246: mol_type = genomic DNA

SEQ ID NO: 116912 - DNA, 30 bp, Homo sapiens; identical to SEQ ID NO: 84313
  misc_feature 1..30: note = chr19:54523707-54523737
  misc_feature 1..30: note = Hyper
  source 1..30: mol_type = genomic DNA

SEQ ID NO: 116913 - DNA, 123 bp, Homo sapiens; identical to SEQ ID NO: 84323
  misc_feature 1..123: note = chr19:55597901-55598024
  misc_feature 1..123: note = Hyper
  source 1..123: mol_type = genomic DNA

SEQ ID NO: 116914 - DNA, 16 bp, Homo sapiens
  misc_feature 1..16: note = chr19:55643097-55643113
  misc_feature 1..16: note = Hypo
  source 1..16: mol_type = genomic DNA
attatgaaaaactagc

SEQ ID NO: 116915 - DNA, 76 bp, Homo sapiens; identical to SEQ ID NO: 84325
  misc_feature 1..76: note = chr19:55645710-55645786
  misc_feature 1..76: note = Hypo
  source 1..76: mol_type = genomic DNA

SEQ ID NO: 116916 - DNA, 155 bp, Homo sapiens; identical to SEQ ID NO: 84326
  misc_feature 1..155: note = chr19:55648515-55648670
  misc_feature 1..155: note = Hypo
  source 1..155: mol_type = genomic DNA

SEQ ID NO: 116917 - DNA, 30 bp, Homo sapiens; identical to SEQ ID NO: 84327
  misc_feature 1..30: note = chr19:55666172-55666202
  misc_feature 1..30: note = Hypo
  source 1..30: mol_type = genomic DNA

SEQ ID NO: 116918 - DNA, 79 bp, Homo sapiens; identical to SEQ ID NO: 84328
  misc_feature 1..79: note = chr19:55673951-55674030
  misc_feature 1..79: note = Hypo
  source 1..79: mol_type = genomic DNA

SEQ ID NO: 116919 - DNA, 146 bp, Homo sapiens; identical to SEQ ID NO: 84330
  misc_feature 1..146: note = chr19:55684817-55684963
  misc_feature 1..146: note = Hyper
  source 1..146: mol_type = genomic DNA

SEQ ID NO: 116920 - DNA, 135 bp, Homo sapiens; identical to SEQ ID NO: 84331
  misc_feature 1..135: note = chr19:55685225-55685360
  misc_feature 1..135: note = Hyper
  source 1..135: mol_type = genomic DNA

SEQ ID NO: 116921 - DNA, 928 bp, Homo sapiens; identical to SEQ ID NO: 84332
  misc_feature 1..928: note = chr19:55690230-55691158
  misc_feature 1..928: note = Hyper
  source 1..928: mol_type = genomic DNA

SEQ ID NO: 116922 - DNA, 30 bp, Homo sapiens; identical to SEQ ID NO: 84334
  misc_feature 1..30: note = chr19:55721224-55721254
  misc_feature 1..30: note = Hypo
  source 1..30: mol_type = genomic DNA

SEQ ID NO: 116923 - DNA, 30 bp, Homo sapiens; identical to SEQ ID NO: 84335
  misc_feature 1..30: note = chr19:55723238-55723268
  misc_feature 1..30: note = Hypo
  source 1..30: mol_type = genomic DNA

SEQ ID NO: 116924 - DNA, 16 bp, Homo sapiens
  misc_feature 1..16: note = chr19:55727832-55727848
  misc_feature 1..16: note = Hypo
  source 1..16: mol_type = genomic DNA
gcgattagatcattga

SEQ ID NO: 116925 - DNA, 78 bp, Homo sapiens; identical to SEQ ID NO: 84337
  misc_feature 1..78: note = chr19:55729117-55729195
  misc_feature 1..78: note = Hypo
  source 1..78: mol_type = genomic DNA

SEQ ID NO: 116926 - DNA, 44 bp, Homo sapiens; identical to SEQ ID NO: 84338
  misc_feature 1..44: note = chr19:55752054-55752098
  misc_feature 1..44: note = Hypo
  source 1..44: mol_type = genomic DNA

SEQ ID NO: 116927 - DNA, 224 bp, Homo sapiens; identical to SEQ ID NO: 84339
  misc_feature 1..224: note = chr19:55798440-55798664
  misc_feature 1..224: note = Hypo
  source 1..224: mol_type = genomic DNA

SEQ ID NO: 116928 - DNA, 58 bp, Homo sapiens; identical to SEQ ID NO: 46027
  misc_feature 1..58: note = chr19:55853009-55853067
  misc_feature 1..58: note = Hypo
  source 1..58: mol_type = genomic DNA

SEQ ID NO: 116929 - DNA, 83 bp, Homo sapiens; identical to SEQ ID NO: 84342
  misc_feature 1..83: note = chr19:55865272-55865355
  misc_feature 1..83: note = Hyper
  source 1..83: mol_type = genomic DNA

SEQ ID NO: 116930 - DNA, 261 bp, Homo sapiens; identical to SEQ ID NO: 84343
  misc_feature 1..261: note = chr19:55865785-55866046
  misc_feature 1..261: note = Hyper
  source 1..261: mol_type = genomic DNA

SEQ ID NO: 116931 - DNA, 204 bp, Homo sapiens; identical to SEQ ID NO: 84344
  misc_feature 1..204: note = chr19:55868920-55869124
  misc_feature 1..204: note = Hypo
  source 1..204: mol_type = genomic DNA

SEQ ID NO: 116932 - DNA, 44 bp, Homo sapiens; identical to SEQ ID NO: 84345
  misc_feature 1..44: note = chr19:55870737-55870781
  misc_feature 1..44: note = Hypo
  source 1..44: mol_type = genomic DNA

SEQ ID NO: 116933 - DNA, 24 bp, Homo sapiens
  misc_feature 1..24: note = chr19:55904166-55904190
  misc_feature 1..24: note = Hypo
  source 1..24: mol_type = genomic DNA
gattacaggcgtgagccaccgcgt

SEQ ID NO: 116934 - DNA, 98 bp, Homo sapiens; identical to SEQ ID NO: 84348
  misc_feature 1..98: note = chr19:55912265-55912363
  misc_feature 1..98: note = Hypo
  source 1..98: mol_type = genomic DNA

SEQ ID NO: 116935 - DNA, 30 bp, Homo sapiens; identical to SEQ ID NO: 84349
  misc_feature 1..30: note = chr19:55917603-55917633
  misc_feature 1..30: note = Hypo
  source 1..30: mol_type = genomic DNA

SEQ ID NO: 116936 - DNA, 30 bp, Homo sapiens; identical to SEQ ID NO: 46029
  misc_feature 1..30: note = chr19:55927698-55927728
  misc_feature 1..30: note = Hypo
  source 1..30: mol_type = genomic DNA

SEQ ID NO: 116937 - DNA, 37 bp, Homo sapiens; identical to SEQ ID NO: 84352
  misc_feature 1..37: note = chr19:55944725-55944762
  misc_feature 1..37: note = Hyper
  source 1..37: mol_type = genomic DNA

SEQ ID NO: 116938 - DNA, 39 bp, Homo sapiens; identical to SEQ ID NO: 84353
  misc_feature 1..39: note = chr19:55951941-55951980
  misc_feature 1..39: note = Hyper
  source 1..39: mol_type = genomic DNA

SEQ ID NO: 116939 - DNA, 314 bp, Homo sapiens; identical to SEQ ID NO: 84355
  misc_feature 1..314: note = chr19:55952650-55952964
  misc_feature 1..314: note = Hyper
  source 1..314: mol_type = genomic DNA

SEQ ID NO: 116940 - DNA, 1428 bp, Homo sapiens; identical to SEQ ID NO: 84356
  misc_feature 1..1428: note = chr19:55953539-55954967
  misc_feature 1..1428: note = Hyper
  source 1..1428: mol_type = genomic DNA

SEQ ID NO: 116941 - DNA, 178 bp, Homo sapiens; identical to SEQ ID NO: 84357
  misc_feature 1..178: note = chr19:55962347-55962525
  misc_feature 1..178: note = Hyper
  source 1..178: mol_type = genomic DNA

SEQ ID NO: 116942 - DNA, 189 bp, Homo sapiens; identical to SEQ ID NO: 84358
  misc_feature 1..189: note = chr19:55963107-55963296
  misc_feature 1..189: note = Hyper
  source 1..189: mol_type = genomic DNA

SEQ ID NO: 116943 - DNA, 209 bp, Homo sapiens; identical to SEQ ID NO: 84359
  misc_feature 1..209: note = chr19:55963515-55963724
  misc_feature 1..209: note = Hyper
  source 1..209: mol_type = genomic DNA

SEQ ID NO: 116944 - DNA, 30 bp, Homo sapiens; identical to SEQ ID NO: 84361
  misc_feature 1..30: note = chr19:55974384-55974414
  misc_feature 1..30: note = Hypo
  source 1..30: mol_type = genomic DNA

SEQ ID NO: 116945 - DNA, 173 bp, Homo sapiens; identical to SEQ ID NO: 84362
  misc_feature 1..173: note = chr19:55976810-55976983
  misc_feature 1..173: note = Hypo
  source 1..173: mol_type = genomic DNA

SEQ ID NO: 116946 - DNA, 30 bp, Homo sapiens; identical to SEQ ID NO: 46031
  misc_feature 1..30: note = chr19:55982821-55982851
  misc_feature 1..30: note = Hypo
  source 1..30: mol_type = genomic DNA

SEQ ID NO: 116947 - DNA, 30 bp, Homo sapiens; identical to SEQ ID NO: 84364
  misc_feature 1..30: note = chr19:55989384-55989414
  misc_feature 1..30: note = Hypo
  source 1..30: mol_type = genomic DNA

SEQ ID NO: 116948 - DNA, 53 bp, Homo sapiens; identical to SEQ ID NO: 37770
  misc_feature 1..53: note = chr19:56015184-56015237
  misc_feature 1..53: note = Hyper
  source 1..53: mol_type = genomic DNA

SEQ ID NO: 116949 - DNA, 68 bp, Homo sapiens; identical to SEQ ID NO: 84366
  misc_feature 1..68: note = chr19:56067053-56067121
  misc_feature 1..68: note = Hypo
  source 1..68: mol_type = genomic DNA

SEQ ID NO: 116950 - DNA, 30 bp, Homo sapiens; identical to SEQ ID NO: 84367
  misc_feature 1..30: note = chr19:56101733-56101763
  misc_feature 1..30: note = Hypo
  source 1..30: mol_type = genomic DNA

SEQ ID NO: 116951 - DNA, 94 bp, Homo sapiens; identical to SEQ ID NO: 84368
  misc_feature 1..94: note = chr19:56156432-56156526
  misc_feature 1..94: note = Hypo
  source 1..94: mol_type = genomic DNA

SEQ ID NO: 116952 - DNA, 220 bp, Homo sapiens; identical to SEQ ID NO: 84369
  misc_feature 1..220: note = chr19:56159449-56159669
  misc_feature 1..220: note = Hyper
  source 1..220: mol_type = genomic DNA

SEQ ID NO: 116953 - DNA, 36 bp, Homo sapiens; identical to SEQ ID NO: 84370
  misc_feature 1..36: note = chr19:56159914-56159950
  misc_feature 1..36: note = Hyper
  source 1..36: mol_type = genomic DNA

SEQ ID NO: 116954 - DNA, 33 bp, Homo sapiens; identical to SEQ ID NO: 84371
  misc_feature 1..33: note = chr19:56163910-56163943
  misc_feature 1..33: note = Hypo
  source 1..33: mol_type = genomic DNA

SEQ ID NO: 116955 - DNA, 30 bp, Homo sapiens; identical to SEQ ID NO: 84372
  misc_feature 1..30: note = chr19:56164542-56164572
  misc_feature 1..30: note = Hypo
  source 1..30: mol_type = genomic DNA

SEQ ID NO: 116956 - DNA, 39 bp, Homo sapiens; identical to SEQ ID NO: 46032
  misc_feature 1..39: note = chr19:56179648-56179687
  misc_feature 1..39: note = Hypo
  source 1..39: mol_type = genomic DNA

SEQ ID NO: 116957 - DNA, 145 bp, Homo sapiens; identical to SEQ ID NO: 84374
  misc_feature 1..145: note = chr19:56181784-56181929
  misc_feature 1..145: note = Hypo
  source 1..145: mol_type = genomic DNA

SEQ ID NO: 116958 - DNA, 202 bp, Homo sapiens; identical to SEQ ID NO: 84375
  misc_feature 1..202: note = chr19:56199417-56199619
  misc_feature 1..202: note = Hypo
  source 1..202: mol_type = genomic DNA

SEQ ID NO: 116959 - DNA, 100 bp, Homo sapiens; identical to SEQ ID NO: 46034
  misc_feature 1..100: note = chr19:56200496-56200596
  misc_feature 1..100: note = Hypo
  source 1..100: mol_type = genomic DNA

SEQ ID NO: 116960 - DNA, 53 bp, Homo sapiens; identical to SEQ ID NO: 84377
  misc_feature 1..53: note = chr19:56201665-56201718
  misc_feature 1..53: note = Hypo
  source 1..53: mol_type = genomic DNA

SEQ ID NO: 116961 - DNA, 95 bp, Homo sapiens; identical to SEQ ID NO: 84378
  misc_feature 1..95: note = chr19:56205701-56205796
  misc_feature 1..95: note = Hypo
  source 1..95: mol_type = genomic DNA

SEQ ID NO: 116962 - DNA, 30 bp, Homo sapiens; identical to SEQ ID NO: 84379
  misc_feature 1..30: note = chr19:56209262-56209292
  misc_feature 1..30: note = Hypo
  source 1..30: mol_type = genomic DNA

SEQ ID NO: 116963 - DNA, 207 bp, Homo sapiens; identical to SEQ ID NO: 84380
  misc_feature 1..207: note = chr19:56230798-56231005
  misc_feature 1..207: note = Hypo
  source 1..207: mol_type = genomic DNA

SEQ ID NO: 116964 - DNA, 210 bp, Homo sapiens; identical to SEQ ID NO: 84381
  misc_feature 1..210: note = chr19:56253382-56253592
  misc_feature 1..210: note = Hypo
  source 1..210: mol_type = genomic DNA

SEQ ID NO: 116965 - DNA, 31 bp, Homo sapiens; identical to SEQ ID NO: 84382
  misc_feature 1..31: note = chr19:56256348-56256379
  misc_feature 1..31: note = Hypo
  source 1..31: mol_type = genomic DNA

SEQ ID NO: 116966 - DNA, 196 bp, Homo sapiens; identical to SEQ ID NO: 84383
  misc_feature 1..196: note = chr19:56262254-56262450
  misc_feature 1..196: note = Hypo
  source 1..196: mol_type = genomic DNA

SEQ ID NO: 116967 - DNA, 30 bp, Homo sapiens; identical to SEQ ID NO: 84384
  misc_feature 1..30: note = chr19:56321275-56321305
  misc_feature 1..30: note = Hypo
  source 1..30: mol_type = genomic DNA

SEQ ID NO: 116968 - DNA, 30 bp, Homo sapiens; identical to SEQ ID NO: 84385
  misc_feature 1..30: note = chr19:56346696-56346726
  misc_feature 1..30: note = Hypo
  source 1..30: mol_type = genomic DNA

SEQ ID NO: 116969 - DNA, 30 bp, Homo sapiens; identical to SEQ ID NO: 84386
  misc_feature 1..30: note = chr19:56347904-56347934
  misc_feature 1..30: note = Hypo
  source 1..30: mol_type = genomic DNA

SEQ ID NO: 116970 - DNA, 196 bp, Homo sapiens; identical to SEQ ID NO: 84387
  misc_feature 1..196: note = chr19:56451612-56451808
  misc_feature 1..196: note = Hypo
  source 1..196: mol_type = genomic DNA

SEQ ID NO: 116971 - DNA, 36 bp, Homo sapiens; identical to SEQ ID NO: 84388
  misc_feature 1..36: note = chr19:56477708-56477744
  misc_feature 1..36: note = Hypo
  source 1..36: mol_type = genomic DNA

SEQ ID NO: 116972 - DNA, 209 bp, Homo sapiens; identical to SEQ ID NO: 84389
  misc_feature 1..209: note = chr19:56538913-56539122
  misc_feature 1..209: note = Hypo
  source 1..209: mol_type = genomic DNA

SEQ ID NO: 116973 - DNA, 30 bp, Homo sapiens; identical to SEQ ID NO: 46038
  misc_feature 1..30: note = chr19:56543855-56543885
  misc_feature 1..30: note = Hypo
  source 1..30: mol_type = genomic DNA

SEQ ID NO: 116974 - DNA, 30 bp, Homo sapiens; identical to SEQ ID NO: 84391
  misc_feature 1..30: note = chr19:56588880-56588910
  misc_feature 1..30: note = Hypo
  source 1..30: mol_type = genomic DNA

SEQ ID NO: 116975 - DNA, 30 bp, Homo sapiens; identical to SEQ ID NO: 84392
  misc_feature 1..30: note = chr19:56602324-56602354
  misc_feature 1..30: note = Hypo
  source 1..30: mol_type = genomic DNA

SEQ ID NO: 116976 - DNA, 30 bp, Homo sapiens; identical to SEQ ID NO: 46039
  misc_feature 1..30: note = chr19:56603841-56603871
  misc_feature 1..30: note = Hypo
  source 1..30: mol_type = genomic DNA

SEQ ID NO: 116977 - DNA, 154 bp, Homo sapiens; identical to SEQ ID NO: 84394
  misc_feature 1..154: note = chr19:56617206-56617360
  misc_feature 1..154: note = Hypo
  source 1..154: mol_type = genomic DNA

SEQ ID NO: 116978 - DNA, 46 bp, Homo sapiens; identical to SEQ ID NO: 84395
  misc_feature 1..46: note = chr19:56638732-56638778
  misc_feature 1..46: note = Hypo
  source 1..46: mol_type = genomic DNA

SEQ ID NO: 116979 - DNA, 40 bp, Homo sapiens; identical to SEQ ID NO: 46041
  misc_feature 1..40: note = chr19:56686390-56686430
  misc_feature 1..40: note = Hypo
  source 1..40: mol_type = genomic DNA

SEQ ID NO: 116980 - DNA, 111 bp, Homo sapiens; identical to SEQ ID NO: 84398
  misc_feature 1..111: note = chr19:56688368-56688479
  misc_feature 1..111: note = Hypo
  source 1..111: mol_type = genomic DNA

SEQ ID NO: 116981 - DNA, 50 bp, Homo sapiens; identical to SEQ ID NO: 84399
  misc_feature 1..50: note = chr19:56709053-56709103
  misc_feature 1..50: note = Hypo
  source 1..50: mol_type = genomic DNA

SEQ ID NO: 116982 - DNA, 30 bp, Homo sapiens; identical to SEQ ID NO: 84400
  misc_feature 1..30: note = chr19:56709484-56709514
  misc_feature 1..30: note = Hypo
  source 1..30: mol_type = genomic DNA

SEQ ID NO: 116983 - DNA, 217 bp, Homo sapiens; identical to SEQ ID NO: 84401
  misc_feature 1..217: note = chr19:56727700-56727917
  misc_feature 1..217: note = Hypo
  source 1..217: mol_type = genomic DNA

SEQ ID NO: 116984 - DNA, 656 bp, Homo sapiens
  misc_feature 1..656: note = chr19:56728469-56729125
  misc_feature 1..656: note = Hyper
  source 1..656: mol_type = genomic DNA
tgccaggaaacacaccgcgtggagacccagcatgactgctgactgattgcaagtccccaggagggctttatttttgcttttcaacatcctgttctgcaggttccttggctctttttgcccgtatgccgaagagccgggcattgggacgggccatgcggagactagcgaaggctttgaaattcttctcctcgatgatgactccagctttctccttctaggcattccggttgggcatgaccggtcctgtcagccgagcggccagtttcagttcttcagcagaactgtctcccttctcggaggccgagggcttcccggggaagcggatgcgtttggagcggggctccttcagccgccgcacgttggcctgcagggactgcgcctcctcggatccgcagaaatgccggcgtccgggcccccttcttcgcgtgccggccaccctgagctcctccaggcggaggccgcggccgtgcgcaccttcgtgtggtaccgaaccgtggggcagcgcacgatgggccggatgggccccgacgcggggcaggggcgaggcggcgcgccttggcttgcccggcctggcgcctgcggatcttctgggccggctggttgaaccgcttggccacgcgccgctgcagtccttggggaagcggggcttcgagatc

SEQ ID NO: 116985 - DNA, 99 bp, Homo sapiens; identical to SEQ ID NO: 84405
  misc_feature 1..99: note = chr19:56806322-56806421
  misc_feature 1..99: note = Hypo
  source 1..99: mol_type = genomic DNA

SEQ ID NO: 116986 - DNA, 38 bp, Homo sapiens; identical to SEQ ID NO: 84407
  misc_feature 1..38: note = chr19:56877841-56877879
  misc_feature 1..38: note = Hypo
  source 1..38: mol_type = genomic DNA

SEQ ID NO: 116987 - DNA, 552 bp, Homo sapiens
  misc_feature 1..552: note = chr19:56879439-56879991
  misc_feature 1..552: note = Hyper
  source 1..552: mol_type = genomic DNA
cagcgttctcaacaccgccaacgggcacaaagccacgcccccacggccgaactcacgcctacgtactcagtcaccagcggaaccctctccaccaggctccgcgtcgaggccctacggggcgtcaatacgcacgcgtactttgtgtcccaggtagctcgtctcttagccatgtacgcctctgcattccggtcactgggagcggggccgtgggggctgcacatgcgcactgcgagtcctcgcctactcccagaaaccacccgggcgcatacgcggtgcggccgctgcttcaggtcggcgggctccagggagacctgggtgggcagcgtcgccgtttctcctttcttgggcagtatttttcccagcgccacgcggaggctgggccattatgaggtttgtgttgcgtcggggcggtccgtctcagaggcgctccggggaggagtgggcggctgaatggccagaggcccagggatccgttcaggtcagcgctggcgtccgggcctgagtttggaggtggcgggtgccttacaagaatgctcgcgtgatcagtgtgtt

SEQ ID NO: 116988 - DNA, 30 bp, Homo sapiens; identical to SEQ ID NO: 84412
  misc_feature 1..30: note = chr19:56888933-56888963
  misc_feature 1..30: note = Hypo
  source 1..30: mol_type = genomic DNA

SEQ ID NO: 116989 - DNA, 34 bp, Homo sapiens; identical to SEQ ID NO: 84413
  misc_feature 1..34: note = chr19:56893758-56893792
  misc_feature 1..34: note = Hypo
  source 1..34: mol_type = genomic DNA

SEQ ID NO: 116990 - DNA, 857 bp, Homo sapiens
  misc_feature 1..857: note = chr19:56904511-56905368
  misc_feature 1..857: note = Hyper
  source 1..857: mol_type = genomic DNA
aaaaaaaaaaaggcacgcataacagtgaatgcaaaacatccgcaatttcagggggtcggagacccctgcgcacccacctaaggggtccatgcacctgggctatgaggctggaagcagaaagggggcgccagaaagcgcacgccgcgagggccggcgggaaatgtagtctcacgccggtaaagccacagagcgacgatgaggcgagacgtctgcgttcttctcaggcctgagacccaaccggcccgggcaccagctcctgctggaccccagagcgcctggaaagctccggaacctctcacctgccgcctcctcgggtccaagtgccaccgcggccgcgcccccggcagcccagggcgcgcttccaccacggtaccggtggattcgccgtgcgcagccggaagatggcgcagacgcacaaagcacaccgatgctgcgccatgatagggccggcgccgcagtgtcttccgggaaacatagtctttaggcgtaaaggcagcagcccggccttgaagccggatctcgcgatgtttcagggtgagccggacgcaggcgtgcctgcgcagtgcgcggaggagtgctgttcgtgtgttcgagtccctgggttgcttcctggggtctgtggtgctgggtgtgctatctgcgtgtgattctctagcgagagattgtgggcgagtgaccgagtgggcaaggggccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgtggaacaacagtt

SEQ ID NO: 116991 - DNA, 803 bp, Homo sapiens
  misc_feature 1..803: note = chr19:56915132-56915935
  misc_feature 1..803: note = Hyper
  source 1..803: mol_type = genomic DNA
tgtgcccagggcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctccagctcccttttctcagcgatggactcacagccccacccggagcgctggagcgcggacgcggtcactgcgcgtgcgcctcaccgcgctggcaccccggcctggcagcctttggggacctgaaccagctgcgcctgcgcaggtggaacgggtggaacgggtgggggagcggacagtcgaacggcctgagagggctcagctggtccgggtgggattctgaaggccagcggaggtgggcttactagggaaaggggcgcagcagtaactacccgcaactgagcggcgggatctgcggccgcccggggccctcggccaacatcccagcatcctctgcgccgcgccggccccggactccatttcccagcggcccctgcggcctgccctagggctgcggcgcctttgtgagcgcggccgccggccaggatcgagccctggcccgggccctggcccagccccggcctccaaggaccgcgccgaaggaggtgcccactggagggaggaggcggtgaggagcgcgggatggagctgacgccgggagcggccatgccaccatgtgtgggaccgtgtgtgacagtgtgtgagaatgtgtgagacattaaggaaccgtgtgtgacaatgt

SEQ ID NO: 116992 - DNA, 30 bp, Homo sapiens; identical to SEQ ID NO: 84419
  misc_feature 1..30: note = chr19:56921699-56921729
  misc_feature 1..30: note = Hypo
  source 1..30: mol_type = genomic DNA

SEQ ID NO: 116993 - DNA, 35 bp, Homo sapiens; identical to SEQ ID NO: 46044
  misc_feature 1..35: note = chr19:56987547-56987582
  misc_feature 1..35: note = Hypo
  source 1..35: mol_type = genomic DNA

SEQ ID NO: 116994 - DNA, 1624 bp, Homo sapiens
  misc_feature 1..1624: note = chr19:56988309-56989933
  misc_feature 1..1624: note = Hyper
  source 1..1624: mol_type = genomic DNA
ccttcgcgtgggtcacgcagcgatacacatccgcggtcccgacatagctccctcacacacaggcacacacggctcgcctcacacgcggcgccaacttcacacttgggcgcacaagccccgagaaccacagcagcgaagggcgcaaaccccacgccgtggcgggccgagaacccacgcaggcgcgagcccaccgcccacgcaagcacccgcgcagacgcccacgccatcgtggatgcgcaaacccacgcgcgccttggcaggaacgtccacgcagtggcgggcgcgccgcccacgccctcagacacacccacactctcgccagcccccttacctcggtcttcccgggctcagaccccggcggcgaccaccgagacagccgagcagggactcagcgcctgcgcactcccctccgggaccccgggaccgcgcgctgcaccccccttcacacacgcaccacgcatgcgggcgcgtggccccgcccccaaacaaggccacgcggcgtgcgctcacccgcctctcggggacagtaccaccagccccggcctgaggccccgacccctcagcgccacacgcacaagcgcgttcgcacgattggtgcaggcggacgcgcgaggtcccgcgcctgcgcacacccccgaggctggcacgcacaccggtctcctaggggactggcgcctggccctgcttttcatcctctcaggagatcacgtgtggacactgaggcccttcctcgagctctttaaccaaacccaacctccccaattcgccgccttccccgctcccacaaccacacgttcccgtgtgagggcttattgcctccagccagccagcgtccttcgcccccacattcacgaggtttggagccggcctcacccgcggaggcggacaccgcccacccgcgcgtgcgcactacgcagtcatcctgcgacctccagaatccaccggggtgcagcgaggctgtggaaagtcccacccagaacgtgaggtgaagaaggcttgggctgcgctggttctgctctgtccgggtcggagatgaactgacccgggagagcagcggagggatgtttcttttggccaacagtggggactcacctgcacgttttgcgaagaggcccacagtcctttgcgtggcgctcggactacatttcccaacggcccctgcacgccctgggggctgttccatgcggtgttgcgcctgcgtagccggcgggctggcagtgagactgactgcgtcggggttgagactgggtggatgaggctcaccccggcggggagaagggacgaggaggggcggacagcggaaggtccgggagtgtccgccataaagtcgtttgaggtgaccgttgcgtaattgtgagtctgtgagagaagatgtgaagtatggcctcgtcccggtcatctgggcgtgcgggtcccgggttttgatcgcgcgtttgtgtaggtgagacccacattgtgttaccctgaacatgtgtgaggacgaacctttgtgttttcttatacgtgtgtctctgaggcgatttttgtggttttgtacgtggcggggggcactgattttgaatatgtgtgtatgttctggacatttgtttagcttctgcatccacttctgcggaagggcagagtt

SEQ ID NO: 116995 - DNA, 775 bp, Homo sapiens
  misc_feature 1..775: note = chr19:57018744-57019519
  misc_feature 1..775: note = Hyper
  source 1..775: mol_type = genomic DNA
gccagagtcacaacacggtcggggttcctcgtcgctgtcttattccaaaataagcttaacacagaaagataatgacactcccacggactggcacagaaggccgcgctccgaatgacatcgcgatcacagaggcacagacagcgtcacaaagccccacgcgtactcacaccgaaggctcagccgtcgcgcgtttccctcccaggccccaggaactagtaactagggacgcttctggtctctaggcgaggagagggggagagcgcaatctttgcgcctgcgcacactcctgctcttacccgccggaaccctgggccacgcccggctcgcgtaatcacgcactgcgcaggcaccgcccgctctgctctaaggtccctctcactccttcagcagcccgaggacaatcccctcaacactaggccacgccttgtctccgcccctctcgtccgacccctggagagaggctggcgcctgcgcgatggggggttccagcgtcgactcacggagtccttcggatgagagcgtctgggtgccagacgaggccgggggtttgttttgggtggtttgggagtccgagctcgagggctgggccaggaagggcaggcgaggcgggcggctccgacgcgggtcgcgaaggcccagccgcgtcctctgtccccaggacgactacatttcccagaggccagcggggcgcgcgtactcgagtctgcggggcggaggccgcggctcggggctgctgggcgttcggggcggcttggggcggcgggaccactggagt

SEQ ID NO: 116996 - DNA, 41 bp, Homo sapiens; identical to SEQ ID NO: 84428
  misc_feature 1..41: note = chr19:57019931-57019972
  misc_feature 1..41: note = Hyper
  source 1..41: mol_type = genomic DNA

SEQ ID NO: 116997 - DNA, 271 bp, Homo sapiens
  misc_feature 1..271: note = chr19:57049841-57050112
  misc_feature 1..271: note = Hyper
  source 1..271: mol_type = genomic DNA
ggtgtgtagtcagagcggcctctgcttccggccacacccaggcccagcgttggccaccacttatgcggcggctgcggtccagggacaagtgagagcgacccgcagagggcaggacggacgggcgttgcataggcccggggccaaaccgtatcttgcaacctgagctccgagggccgccgcatccgtccctgcttgggactacgcttcccagcgggcattgcgccgaggccacgcccggttccggcggcgctgcctgcgcactggaagtggg

SEQ ID NO: 116998 - DNA, 30 bp, Homo sapiens; identical to SEQ ID NO: 84431
  misc_feature 1..30: note = chr19:57050463-57050493
  misc_feature 1..30: note = Hyper
  source 1..30: mol_type = genomic DNA

SEQ ID NO: 116999 - DNA, 53 bp, Homo sapiens; identical to SEQ ID NO: 84432
  misc_feature 1..53: note = chr19:57051194-57051247
  misc_feature 1..53: note = Hypo
  source 1..53: mol_type = genomic DNA

SEQ ID NO: 117000 - DNA, 903 bp, Homo sapiens; identical to SEQ ID NO: 84433
  misc_feature 1..903: note = chr19:57078350-57079253
  misc_feature 1..903: note = Hyper
  source 1..903: mol_type = genomic DNA

SEQ ID NO: 117001 - DNA, 444 bp, Homo sapiens
  misc_feature 1..444: note = chr19:57106465-57106909
  misc_feature 1..444: note = Hyper
  source 1..444: mol_type = genomic DNA
ctcaatcctccctctcgccccagcctccttggccgcggagtcctctgtgagatggaggagctcagttggctccgctcggctccactcggctgggctcggctgaaaaaagccggggggaggtggcgcgcgcgggtttctgggaagcgtagtccggcgcagtccgcgcaggcgcactgccgtcgggcgggcctagcgggcgcggtcattgtcctggcagagcggcgagccggtgagtgtggctgcggggtcgcgcccaccctctacctgtgccgggggccggaacctggccccggggagggcgcggcctcggggagacggcgtgcaggcccaggtacggggagtgcagggctgggtgctggtccagggcgtgcgggcgcaggagagggcgtgcaggccgggaccgaggtgcgcctggagaggctgagcggccgaggagaggctgag

SEQ ID NO: 117002 - DNA, 272 bp, Homo sapiens; identical to SEQ ID NO: 37793
  misc_feature 1..272: note = chr19:57149347-57149619
  misc_feature 1..272: note = Hyper
  source 1..272: mol_type = genomic DNA

SEQ ID NO: 117003 - DNA, 875 bp, Homo sapiens; identical to SEQ ID NO: 84437
  misc_feature 1..875: note = chr19:57154182-57155057
  misc_feature 1..875: note = Hyper
  source 1..875: mol_type = genomic DNA

SEQ ID NO: 117004 - DNA, 22 bp, Homo sapiens
  misc_feature 1..22: note = chr19:57174105-57174127
  misc_feature 1..22: note = Hypo
  source 1..22: mol_type = genomic DNA
cagctggccaggcaccgtagct

SEQ ID NO: 117005 - DNA, 87 bp, Homo sapiens; identical to SEQ ID NO: 84439
  misc_feature 1..87: note = chr19:57174706-57174793
  misc_feature 1..87: note = Hypo
  source 1..87: mol_type = genomic DNA

SEQ ID NO: 117006 - DNA, 421 bp, Homo sapiens
  misc_feature 1..421: note = chr19:57182912-57183333
  misc_feature 1..421: note = Hyper
  source 1..421: mol_type = genomic DNA
acacctgcaggaacacgcgcacactacacaccgttgctctcgcctcccggtatcaccttcgaacgcgctggccggccccctcctagcctggtgcagtcggctccgcttctactcagtctcgggtcctcctgggccaacgcagaccctggtgcctccttccttagacgagctaaggtcaagacttctgctgctgcggaggagcccgcgcaccaggccggggtggactgcgcctgcgcatcgggcccgcctggttcttaggaactacgactcccagggggcgctgcgcgctcgccggcaccgcgactaaagcttgcaaagcctgggtcatcgaaactacaactcccagaaggctaagcgtctgcacacgctaggtccgcagggcgctgacccctgggggcccgaggagcgccgggctgctgcc

SEQ ID NO: 117007 - DNA, 30 bp, Homo sapiens; identical to SEQ ID NO: 84441
  misc_feature 1..30: note = chr19:57189156-57189186
  misc_feature 1..30: note = Hypo
  source 1..30: mol_type = genomic DNA

SEQ ID NO: 117008 - DNA, 325 bp, Homo sapiens; identical to SEQ ID NO: 84443
  misc_feature 1..325: note = chr19:57276606-57276931
  misc_feature 1..325: note = Hyper
  source 1..325: mol_type = genomic DNA

SEQ ID NO: 117009 - DNA, 198 bp, Homo sapiens; identical to SEQ ID NO: 84444
  misc_feature 1..198: note = chr19:57334837-57335035
  misc_feature 1..198: note = Hypo
  source 1..198: mol_type = genomic DNA

SEQ ID NO: 117010 - DNA, 30 bp, Homo sapiens; identical to SEQ ID NO: 84445
  misc_feature 1..30: note = chr19:57335688-57335718
  misc_feature 1..30: note = Hypo
  source 1..30: mol_type = genomic DNA

SEQ ID NO: 117011 - DNA, 35 bp, Homo sapiens; identical to SEQ ID NO: 84446
  misc_feature 1..35: note = chr19:57399472-57399507
  misc_feature 1..35: note = Hypo
  source 1..35: mol_type = genomic DNA

SEQ ID NO: 117012 - DNA, 159 bp, Homo sapiens; identical to SEQ ID NO: 84447
  misc_feature 1..159: note = chr19:57418761-57418920
  misc_feature 1..159: note = Hypo
  source 1..159: mol_type = genomic DNA

SEQ ID NO: 117013 - DNA, 40 bp, Homo sapiens; identical to SEQ ID NO: 84449
  misc_feature 1..40: note = chr19:57477131-57477171
  misc_feature 1..40: note = Hypo
  source 1..40: mol_type = genomic DNA

SEQ ID NO: 117014 - DNA, 170 bp, Homo sapiens; identical to SEQ ID NO: 84450
  misc_feature 1..170: note = chr19:57491242-57491412
  misc_feature 1..170: note = Hypo
  source 1..170: mol_type = genomic DNA

SEQ ID NO: 117015 - DNA, 368 bp, Homo sapiens
  misc_feature 1..368: note = chr19:57610673-57611041
  misc_feature 1..368: note = Hyper
  source 1..368: mol_type = genomic DNA
tctgcacagtcagatcgcaggaacgcggcctagctgcttcagccacgttctcgcggcgccacctggtggccatggaccgccatcgccgctggacgtcagggccgccaggcccagcgagatgtcacctcctctgaggagccttccaggatcgcacccggcacgcgctccacgcctcgttgtctgttcttcggagcaccgaccatgatcacaaatcagctcgctcgctgtgtttcctgccgggtcgctaccgccatgatccgcacgtagtggtcaaggctgaggttgtatgaatgtggacgttataaccctggctccctctccctccctatgctgggctcccctcgatccccaggcggtggggtgcccct

SEQ ID NO: 117016 - DNA, 941 bp, Homo sapiens
  misc_feature 1..941: note = chr19:57617484-57618425
  misc_feature 1..941: note = Hyper
  source 1..941: mol_type = genomic DNA
ggcctccctgcatcccggagcgcactggggatgaggactcacccaggagagcccgagacacctgagcggccggcacaaaggccctagggaagtgtgggggtacccttggtctcaaagcgctgatccgcctgtgccccctgacctgccagggccggcccccgcttgggtcttggagggcgctgcgcaagcctgcgccccgcactcgcccgggaagggaagggcagggaaggggcgcgcacagcctggcacctgctgtgcaccaggggagacgcgcggcgctccaggtggagtcggcggcggccgagctgcgcggggctgtgcggggctggattctagcctgcaggacgcgaaaacggcctgggtccggcttcctcctcccctgaagcagcgaaggggcgtcactggcgcgctgttaaacgtcttcgccatcggttccctgcatcctccctcctgcctgggtagccagctcctgggcgcgcccaggcgcacacgcttccctcgctcctcctgcagccacaacgcccccaccccccccgcccgcccgccttgtgcggcagcggtgaccgccttctcctgctgccaccccctccaccccctgttcaaggtctgtcaccgtagggggcgggggggcgcgtggagccgctgggggttcggcccaccccgcgaaccgagctcccggccctgtgcgccctcagctctgccgcgggcgttggcctgggcgggcgcaggactgcctggtcgccctggagctcagggtcggggccccgcgtttaaccaccaggcggaggcgcaggcggagcccggagaggacgcgacccctctgggcggccttgggcccctggacgtgccagactctggacccctgcgggggctgccgtggagagcagaggcaccgcgtcctgcccagagctccgataggcgggccgcgttgggggattgtg

SEQ ID NO: 117017 - DNA, 25 bp, Homo sapiens
  misc_feature 1..25: note = chr19:57628160-57628185
  misc_feature 1..25: note = Hypo
  source 1..25: mol_type = genomic DNA
tgagacacggcgcctggccaatccc

SEQ ID NO: 117018 - DNA, 206 bp, Homo sapiens
  misc_feature 1..206: note = chr19:57683154-57683360
  misc_feature 1..206: note = Hyper
  source 1..206: mol_type = genomic DNA
ctctctgtgcggctccgcaagtatgttggtctccctgagagagtggggcctgcaacctgctgggcgcaggcgccttgagctgccacgtctgcccttttaccggcttgggtgcaggcaagggaaatgcgtccccgggccggggggcgcgagcgggggtccggggccgcgagctggggtccggggagcgcgagcgggggtccgggggg

SEQ ID NO: 117019 - DNA, 333 bp, Homo sapiens
  misc_feature 1..333: note = chr19:57683566-57683899
  misc_feature 1..333: note = Hyper
  source 1..333: mol_type = genomic DNA
cgagggggcggggcgcgcgagggggcggggcgcgccgggctcgtcctctccgcggcgctcagtggcagcagggagggccggtgagatgccagagcaaggtagggtcctgtatttggggaccgctgacgtttgggtccccctcccgcggctgttagcgctgcgtggcccgagacctgcggtcgggcggggattaaggctgctttccggagggccccggccgcgtggtcgccctgccagagcggttgatgtcaggcagtgctgggaggcgttgctctccgggttcgcttctctcctgttgtcctaactctgcatctctcccgggtgaatcacaga

SEQ ID NO: 117020 - DNA, 633 bp, Homo sapiens; identical to SEQ ID NO: 84462
  misc_feature 1..633: note = chr19:57702752-57703385
  misc_feature 1..633: note = Hyper
  source 1..633: mol_type = genomic DNA

SEQ ID NO: 117021 - DNA, 23 bp, Homo sapiens
  misc_feature 1..23: note = chr19:57715571-57715594
  misc_feature 1..23: note = Hypo
  source 1..23: mol_type = genomic DNA
cgagactccgtctcaaaaaaaaa

SEQ ID NO: 117022 - DNA, 80 bp, Homo sapiens
  misc_feature 1..80: note = chr19:57751675-57751755
  misc_feature 1..80: note = Hyper
  source 1..80: mol_type = genomic DNA
ctgactcctggggctcgatttcctccggccaagaatggacggtctcgcgcttggtccctggcctccgagttgtgccccca

SEQ ID NO: 117023 - DNA, 787 bp, Homo sapiens
  misc_feature 1..787: note = chr19:57831613-57832400
  misc_feature 1..787: note = Hyper
  source 1..787: mol_type = genomic DNA
gtgcccatagtaaagcggcggccctaagacgacgcgggggtccttgtgcgcacttaaatggagtcggctgcgcttggtgagttcccacacccggtagatgtgagggaaaaactgccttactcagaaggcaccaccccttgcgtcggccgcggactctaggccaatgacgggccaggacacgggcgatttctgcgggccagggcggcggaggtgggacttccgcttcgtcgcgtgacgtcatctccgtgagcaggattggccctggaacagtgtggggcctggaccgctgggtaggcgcgtccagcggcctgagcaggggagggtaatgaggctgttacgcgccttctccgcatcttggcgggagcctgacgccccgcttcttccctaacggggtgttccaccggcgcctgccgaggcctaggcctccgcagccgccctccgtctcctcagccccgacgctgcgcccgctttgtgcgcatttttctctggggaaactgaggctccgagtgcgaaagtcagccgaggtcgccccgcccaggacagagaagggctgggggtcggctgagccgcggcattcccgggccccgctagggctgcagggtctcaggatggcagcctcggcgcaggtgagtggacgaggttttggccttgctgctgctctgctacttctggaggcctcgtgggcaggcagaagccaagacagccacaggatgtttctttgtcgccgtcgtttatttaagagaagtggccgtagcttgtcatttcctttatccgcagtcctgcaata

SEQ ID NO: 117024 - DNA, 29 bp, Homo sapiens
  misc_feature 1..29: note = chr19:57854360-57854389
  misc_feature 1..29: note = Hypo
  source 1..29: mol_type = genomic DNA
gctgggattacaggcgtgagccactgagc

SEQ ID NO: 117025 - DNA, 766 bp, Homo sapiens
  misc_feature 1..766: note = chr19:57862426-57863192
  misc_feature 1..766: note = Hyper
  source 1..766: mol_type = genomic DNA
ctccccctccctgcacgacgcctcttggcagacatccgggagaacccgaaaggcgctcgttgcctggttggatgcagggtacaaactacgttacccagaaatctgtgcccagctcattgttagccggcgtgcagccaatgacagcccagaaactgggcgtttcctgctgctctgggctgcaggggcgagacttctggcgtcgccgtcgtgacgtatttttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcaggtgagtgggggcatccctcaagcgcaccccggcctggttggtgtgtcctgggatgttcgctctcatcgcgcacttcagggtgctcactccgtcgcattatgtggaggggttccgctcccctcatcag

SEQ ID NO: 117026 - DNA, 30 bp, Homo sapiens; identical to SEQ ID NO: 84472
  misc_feature 1..30: note = chr19:57866789-57866819
  misc_feature 1..30: note = Hypo
  source 1..30: mol_type = genomic DNA

SEQ ID NO: 117027 - DNA, 133 bp, Homo sapiens; identical to SEQ ID NO: 84473
  misc_feature 1..133: note = chr19:57874872-57875005
  misc_feature 1..133: note = Hyper
  source 1..133: mol_type = genomic DNA

SEQ ID NO: 117028 - DNA, 30 bp, Homo sapiens; identical to SEQ ID NO: 84474
  misc_feature 1..30: note = chr19:57875222-57875252
  misc_feature 1..30: note = Hyper
  source 1..30: mol_type = genomic DNA

SEQ ID NO: 117029 - DNA, 30 bp, Homo sapiens; identical to SEQ ID NO: 84475
  misc_feature 1..30: note = chr19:57879906-57879936
  misc_feature 1..30: note = Hypo
  source 1..30: mol_type = genomic DNA

SEQ ID NO: 117030 - DNA, 67 bp, Homo sapiens; identical to SEQ ID NO: 84477
  misc_feature 1..67: note = chr19:57901622-57901689
  misc_feature 1..67: note = Hyper
  source 1..67: mol_type = genomic DNA

SEQ ID NO: 117031 - DNA, 38 bp, Homo sapiens
  misc_feature 1..38: note = chr19:57989030-57989068
  misc_feature 1..38: note = Hyper
  source 1..38: mol_type = genomic DNA
accaacactagtaagcggcgtctcgcttcacctccagg

SEQ ID NO: 117032 - DNA, 407 bp, Homo sapiens; identical to SEQ ID NO: 84481
  misc_feature 1..407: note = chr19:57998952-57999359
  misc_feature 1..407: note = Hyper
  source 1..407: mol_type = genomic DNA

SEQ ID NO: 117033 - DNA, 478 bp, Homo sapiens
  misc_feature 1..478: note = chr19:58011070-58011548
  misc_feature 1..478: note = Hyper
  source 1..478: mol_type = genomic DNA
atctccatcatctaccgtctccaatctccatctccgaagttatgcccacttcctcgaagtttggagccacgcgaactacactgcccagaaggcgccgcgccgtgagccgcgatgcttggccaatgaaaagaggtctacccgagagtgcgacgcgcaatgggcgggacttccggcgtctcccctcggcggttgctttcgctgccctcaagagaactcagcttgccggaagctggttgttcgctgcggcgaccagctccggaaagcgcggtggggacgcgctgtgttctcgcagctcagaggcgggtctgaggctcggtggcggcgcccagggtggcccgggccctttcctcggtcgttgtctcaccgccacaggctccgatggcggcggccacgctgagggaccccgctcaggtgagcgccgcgtcctcccggcctcccccgaatcctaaagccctgtgagggccgcctgctcaggtcc

SEQ ID NO: 117034 - DNA, 30 bp, Homo sapiens; identical to SEQ ID NO: 84484
  misc_feature 1..30: note = chr19:58013681-58013711
  misc_feature 1..30: note = Hypo
  source 1..30: mol_type = genomic DNA

SEQ ID NO: 117035 - DNA, 30 bp, Homo sapiens; identical to SEQ ID NO: 84485
  misc_feature 1..30: note = chr19:58019691-58019721
  misc_feature 1..30: note = Hypo
  source 1..30: mol_type = genomic DNA

SEQ ID NO: 117036 - DNA, 26 bp, Homo sapiens
  misc_feature 1..26: note = chr19:58032735-58032761
  misc_feature 1..26: note = Hypo
  source 1..26: mol_type = genomic DNA
gagagagactccgtctcaaaaaaaaa

SEQ ID NO: 117037 - DNA, 710 bp, Homo sapiens
  misc_feature 1..710: note = chr19:58038557-58039267
  misc_feature 1..710: note = Hyper
  source 1..710: mol_type = genomic DNA
attgagtcctcacagcgcggcggactgcggcgtggtaggaactacaccacccagaatactgtgcgccgagcgtgccggggccttagaccaatcattgcccaggaaaggggcacctccgtaagtgcgcaatacgccagaatcttccggcgtctttccggtggtggtcgtttttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaagggagagcgttgcgtaccgtgggggctgcacgcgcagagcctgggaggtgcgccggggtcgcgagcattcggaaacttgggggcggacctgtgtctgcagggagcagagagaatgaggagaagaaggcacggctgccatggcag

SEQ ID NO: 117038 - DNA, 176 bp, Homo sapiens; identical to SEQ ID NO: 84489
  misc_feature 1..176: note = chr19:58039797-58039973
  misc_feature 1..176: note = Hypo
  source 1..176: mol_type = genomic DNA

SEQ ID NO: 117039 - DNA, 30 bp, Homo sapiens; identical to SEQ ID NO: 84490
  misc_feature 1..30: note = chr19:58043143-58043173
  misc_feature 1..30: note = Hypo
  source 1..30: mol_type = genomic DNA

SEQ ID NO: 117040 - DNA, 166 bp, Homo sapiens; identical to SEQ ID NO: 84491
  misc_feature 1..166: note = chr19:58046095-58046261
  misc_feature 1..166: note = Hypo
  source 1..166: mol_type = genomic DNA

SEQ ID NO: 117041 - DNA, 937 bp, Homo sapiens; identical to SEQ ID NO: 84492
  misc_feature 1..937: note = chr19:58070569-58071506
  misc_feature 1..937: note = Hyper
  source 1..937: mol_type = genomic DNA

SEQ ID NO: 117042 - DNA, 878 bp, Homo sapiens
  misc_feature 1..878: note = chr19:58094961-58095839
  misc_feature 1..878: note = Hyper
  source 1..878: mol_type = genomic DNA
cagagcaggagcagccgggggcgcggcccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttccgctttgggaccaatgggtcggggagggacttccggtatcacttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgggcctcaccctccatccccaaattagtgccttcttgggtcactacggtcgagatcctcatgtc

SEQ ID NO: 117043 - DNA, 179 bp, Homo sapiens; identical to SEQ ID NO: 46051
  misc_feature 1..179: note = chr19:58101908-58102087
  misc_feature 1..179: note = Hypo
  source 1..179: mol_type = genomic DNA

SEQ ID NO: 117044 - DNA, 752 bp, Homo sapiens; identical to SEQ ID NO: 84496
  misc_feature 1..752: note = chr19:58111112-58111864
  misc_feature 1..752: note = Hyper
  source 1..752: mol_type = genomic DNA

SEQ ID NO: 117045 - DNA, 774 bp, Homo sapiens
  misc_feature 1..774: note = chr19:58125415-58126189
  misc_feature 1..774: note = Hyper
  source 1..774: mol_type = genomic DNA
ggcataatttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagcccgtagcagtcgggagcgtgtgtgaaccgtagtcaggcctgcaatgtcgaggggagaagttgctccttcattgcgaggacgataggagccatggcgggttttgaatggtggagggaagggatccgaaaaaggattttt

SEQ ID NO: 117046 - DNA, 375 bp, Homo sapiens; identical to SEQ ID NO: 84499
  misc_feature 1..375: note = chr19:58144370-58144745
  misc_feature 1..375: note = Hyper
  source 1..375: mol_type = genomic DNA

SEQ ID NO: 117047 - DNA, 33 bp, Homo sapiens; identical to SEQ ID NO: 84500
  misc_feature 1..33: note = chr19:58144954-58144987
  misc_feature 1..33: note = Hyper
  source 1..33: mol_type = genomic DNA

SEQ ID NO: 117048 - DNA, 30 bp, Homo sapiens; identical to SEQ ID NO: 84501
  misc_feature 1..30: note = chr19:58159508-58159538
  misc_feature 1..30: note = Hypo
  source 1..30: mol_type = genomic DNA

SEQ ID NO: 117049 - DNA, 375 bp, Homo sapiens; identical to SEQ ID NO: 84502
  misc_feature 1..375: note = chr19:58175608-58175983
  misc_feature 1..375: note = Hyper
  source 1..375: mol_type = genomic DNA

SEQ ID NO: 117050 - DNA, 157 bp, Homo sapiens; identical to SEQ ID NO: 84503
  misc_feature 1..157: note = chr19:58177578-58177735
  misc_feature 1..157: note = Hypo
  source 1..157: mol_type = genomic DNA

SEQ ID NO: 117051 - DNA, 148 bp, Homo sapiens; identical to SEQ ID NO: 84504
  misc_feature 1..148: note = chr19:58193437-58193585
  misc_feature 1..148: note = Hyper
  source 1..148: mol_type = genomic DNA

SEQ ID NO: 117052 - DNA, 32 bp, Homo sapiens; identical to SEQ ID NO: 84505
  misc_feature 1..32: note = chr19:58201272-58201304
  misc_feature 1..32: note = Hypo
  source 1..32: mol_type = genomic DNA

SEQ ID NO: 117053 - DNA, 864 bp, Homo sapiens
  misc_feature 1..864: note = chr19:58219923-58220787
  misc_feature 1..864: note = Hyper
  source 1..864: mol_type = genomic DNA
agagcgaaactccgtctcaaagaaaaaaaaactaacataaatggcgtccctcctttgttcagaactctccgtggcttctagcatcctcacaatgacagtacaaccctaggagtaactccgcctcatattcttcgttccctgcagaaaacagctttccgaattctcctggctcagtcgcgcctcaacctttgcacgcgccggttcctccgcctgtcacgctctcccacacctcgtcacacgcagtgtcaaaaaaagggccccacccacgaacgcctcagtgtccccgaccctgggcagcggggactcgagcaggcgcccctcactgatggctttagaacgtgggtgggggaaggtgtgtgaggacgggaagacgccgcactcacctgagttggcgtcctcagagtggccgctgccatcagactctgcgggtagagctgggccgggagcgacgggcgacattggtagggacccggggacagcggtccctatcccaggcctgacgtgggtcccccagggcggcgtcgccaaggcttagacgctttcgtgcaggagggacgacgactcccctcacgccttcgtggccccaactcggcgctctgctatctctgatccggtgaacacacctcagagaagctaaaatggccgccacgaagaggcccccccaaaagtcccgtcctttctttttgtgactctcaaggaaagtcggttttctgagctcttactggcttagtagcgtggcgttcaacgcagagcattctaggtaatgtagttttcatagatcccgaggtgggtgccggggaccctttgcaccaacctcttggagtaaaagcgaagctccagggcgctgggcgatgagaaatggct

SEQ ID NO: 117054 - DNA, 61 bp, Homo sapiens; identical to SEQ ID NO: 84508
  misc_feature 1..61: note = chr19:58233532-58233593
  misc_feature 1..61: note = Hypo
  source 1..61: mol_type = genomic DNA

SEQ ID NO: 117055 - DNA, 41 bp, Homo sapiens; identical to SEQ ID NO: 84509
  misc_feature 1..41: note = chr19:58237430-58237471
  misc_feature 1..41: note = Hypo
  source 1..41: mol_type = genomic DNA

SEQ ID NO: 117056 - DNA, 867 bp, Homo sapiens
  misc_feature 1..867: note = chr19:58238326-58239193
  misc_feature 1..867: note = Hyper
  source 1..867: mol_type = genomic DNA
cagtagcctccttaccggtctcctcgtatccatcctcgcagtccccaccccaaactaatgttctcccctgagcaaatttcgagacacttaaaatcccagctaagatcacgtccttctattcaaaaccctcagttaatctcaacgccctcagaatgaagcgacaacttctcagcctgccattccagtcacagttcctcaaactctgctctgtgttgatgagaaccctgtctcccaaatgtttgggggtcagcagcacccccgagcctttacctgcgccgtcccctccgcccgtaactctcccacacccacccacaccgagataggaccccgccccaagagtgcgtcgctgtcctgggacacaggggctgcaggcactttacgattcggagtcggagaaagggtgactgagggcccggaggacgcagcacccacccgcgcggagtccgttagctccgccataggaccgtgggcgcggacagctgccgggagcggcaggcgtctcgatcggggacgcaggcacttccgtccctgcagagcatcagacgcgtctcgggacactggggacaacatctcctccgcgctttcccaacacctccacctgcggcccacacaagcgttacagaaccccggccagggacagcctgacagaaacaaaatgtccgctacaaggaggagccggaagtcccgcccacgcaccccccgcaggcactgaaacacccctctcctgggccctcattgggtatgcaacgtataggtttgtgggtagagtgtggttcccactgagctatccttcaaggcaggggattctcggcctgggctcttgggaaaactcgaagtaggagggccaagttgtttgggaaaagtaac

SEQ ID NO: 117057 - DNA, 460 bp, Homo sapiens; identical to SEQ ID NO: 84517
  misc_feature 1..460: note = chr19:58280911-58281371
  misc_feature 1..460: note = Hyper
  source 1..460: mol_type = genomic DNA

SEQ ID NO: 117058 - DNA, 404 bp, Homo sapiens; identical to SEQ ID NO: 84519
  misc_feature 1..404: note = chr19:58361192-58361596
  misc_feature 1..404: note = Hyper
  source 1..404: mol_type = genomic DNA

SEQ ID NO: 117059 - DNA, 544 bp, Homo sapiens; identical to SEQ ID NO: 84520
  misc_feature 1..544: note = chr19:58400029-58400573
  misc_feature 1..544: note = Hyper
  source 1..544: mol_type = genomic DNA

SEQ ID NO: 117060 - DNA, 102 bp, Homo sapiens; identical to SEQ ID NO: 84521
  misc_feature 1..102: note = chr19:58433214-58433316
  misc_feature 1..102: note = Hypo
  source 1..102: mol_type = genomic DNA

SEQ ID NO: 117061 - DNA, 39 bp, Homo sapiens; identical to SEQ ID NO: 84522
  misc_feature 1..39: note = chr19:58438196-58438235
  misc_feature 1..39: note = Hypo
  source 1..39: mol_type = genomic DNA

SEQ ID NO: 117062 - DNA, 99 bp, Homo sapiens; identical to SEQ ID NO: 84523
  misc_feature 1..99: note = chr19:58438295-58438394
  misc_feature 1..99: note = Hypo
  source 1..99: mol_type = genomic DNA

SEQ ID NO: 117063 - DNA, 102 bp, Homo sapiens; identical to SEQ ID NO: 84524
  misc_feature 1..102: note = chr19:58445853-58445955
  misc_feature 1..102: note = Hypo
  source 1..102: mol_type = genomic DNA

SEQ ID NO: 117064 - DNA, 550 bp, Homo sapiens
  misc_feature 1..550: note = chr19:58446296-58446846
  misc_feature 1..550: note = Hyper
  source 1..550: mol_type = genomic DNA
caggttccatcctcccgggtctgtcctccaggccatagcccgcgccggtccctgtgcctgtcgctctccccaccgcatcccacaggtgtcagaaacaaggacctctcccgcgaacgcctcagtgtcccgacgccgggtccgggctgcagacctgtgaacagtcgccgctctctcgctgcttcaggattcgggttaggatgaggtgacctgagggcagggaaggcacaattacctgagccgggagcctcagcgcggccgccgccatcccgagtacgcggggaaagcactgccgggagcggcgggcgccgttacggggcctaagatctgcctctgtgcagcaagaaggactcttcaccttctgggttcagacaccgcggttcggacccatagctccagcgcctctcacctcacaaaccgcagaaacacacccaacattaaccaaaatggtcgctaccagagaacgctgagaatcccgccactacgttacgtgcgcacacagaaacgcctttattctgagcccttactggttctgttgcgctgtcattcaatg

SEQ ID NO: 117065 - DNA, 79 bp, Homo sapiens; identical to SEQ ID NO: 84527
  misc_feature 1..79: note = chr19:58447418-58447497
  misc_feature 1..79: note = Hypo
  source 1..79: mol_type = genomic DNA

SEQ ID NO: 117066 - DNA, 45 bp, Homo sapiens; identical to SEQ ID NO: 84528
  misc_feature 1..45: note = chr19:58448051-58448096
  misc_feature 1..45: note = Hypo
  source 1..45: mol_type = genomic DNA

SEQ ID NO: 117067 - DNA, 30 bp, Homo sapiens; identical to SEQ ID NO: 84529
  misc_feature 1..30: note = chr19:58455898-58455928
  misc_feature 1..30: note = Hypo
  source 1..30: mol_type = genomic DNA

SEQ ID NO: 117068 - DNA, 190 bp, Homo sapiens; identical to SEQ ID NO: 46056
  misc_feature 1..190: note = chr19:58457382-58457572
  misc_feature 1..190: note = Hypo
  source 1..190: mol_type = genomic DNA

SEQ ID NO: 117069 - DNA, 873 bp, Homo sapiens
  misc_feature 1..873: note = chr19:58458432-58459305
  misc_feature 1..873: note = Hyper
  source 1..873: mol_type = genomic DNA
ccctccccttcctggcgtagatttcataaccctttacagccaagggaaacgtagaaagagccaggcctcagagaagagcatctatggcggtattagatgggctcaagccaccccgtagccccatgcctggccttggagccgggtgccctcgcaatggctgtgtcacctctgtgccccagggctcagtggcgcctctcatcaggggctccttgccagtcgcgccctcccttccctagcacaccaggtgttggaaacgggagcccctccggcgagcccccgtgtcctgtcctgggcagcagggccgcgagcaagcgccctcgggggtgctaggactagcgtggggagggcggggaaggcccagaggacgcggcacatacctgggccggggccgtcagctcggccgccgccatctgactctgtgagcggagcggggccagagaggatgtccttattccgggccgggcctgggtaccctgggcgccgccgagcctcagccacgcctctgtgcagcggggaagactcctctcgcgccttctcagtcagtcacggatgatgctgacccagcgctccggggctttctaccaagtaatcagtccagacaaatgccaaaacgaccgccacaaggaggacaacggaagtcccgccgcgaccgcgcgtgcgcttacggaaacaccacctttcggaggcctcattggctgaaggtcgccgtcgcccaacgcaggccattctgggtaatgttcccacaggcgcacggcgggagagtgagggtcgcctccacctccttccggaagtaaaggccaaacccctgtagggggcgctgggaaatggacactccaggttggggcggaggcgaggcttcgttctttcttaaag

SEQ ID NO: 117070 - DNA, 30 bp, Homo sapiens; identical to SEQ ID NO: 46057
  misc_feature 1..30: note = chr19:58512170-58512200
  misc_feature 1..30: note = Hypo
  source 1..30: mol_type = genomic DNA

SEQ ID NO: 117071 - DNA, 1174 bp, Homo sapiens; identical to SEQ ID NO: 84534
  misc_feature 1..1174: note = chr19:58513537-58514711
  misc_feature 1..1174: note = Hyper
  source 1..1174: mol_type = genomic DNA

SEQ ID NO: 117072 - DNA, 75 bp, Homo sapiens; identical to SEQ ID NO: 46058
  misc_feature 1..75: note = chr19:58517427-58517502
  misc_feature 1..75: note = Hypo
  source 1..75: mol_type = genomic DNA

SEQ ID NO: 117073 - DNA, 634 bp, Homo sapiens
  misc_feature 1..634: note = chr19:58520713-58521347
  misc_feature 1..634: note = Hyper
  source 1..634: mol_type = genomic DNA
cacccatgctcctctcggcacctttcacccagcccaagcagcggcggcccagtggtggaaaaggtgccacggccaaacggattggagactcaccccgcattctaggccggagaagcgggcgggcttgggatgccggcaggaggcaatgactctccccaggcgctgcatcctggctccggggcacaagcgcctctccgccctgacgctgatgctcgtctggctgcccgttctttggcatcaaaataccagacgatggtggcgcaccctgtggcctgggctgcctcacctcattcggtcccgcctagaaagaccagaggaccagaaaaccagaagcctgtcagagcgactagaggctggctccagccaacagccgcgcgcctcagcgtccacgagggttacctgggtaacgcgccgcttgggctcggcgcccagccgatgacgtaacccgcgcttgcgtagtggcgccgccctgatgtgtagtctccaggccgccccgaacaccagcccagcgggtcctggacccctaggtcatgtggctacagtggaatccaggcttggccgaatccaggacgaccaggccagacccaccggcagtaccttgcccgcccgctttagtcacttgctctaggtggat

SEQ ID NO: 117074 - DNA, 102 bp, Homo sapiens; identical to SEQ ID NO: 84538
  misc_feature 1..102: note = chr19:58522940-58523042
  misc_feature 1..102: note = Hypo
  source 1..102: mol_type = genomic DNA

SEQ ID NO: 117075 - DNA, 30 bp, Homo sapiens; identical to SEQ ID NO: 84539
  misc_feature 1..30: note = chr19:58524599-58524629
  misc_feature 1..30: note = Hypo
  source 1..30: mol_type = genomic DNA

SEQ ID NO: 117076 - DNA, 412 bp, Homo sapiens; identical to SEQ ID NO: 84540
  misc_feature 1..412: note = chr19:58536147-58536559
  misc_feature 1..412: note = Hypo
  source 1..412: mol_type = genomic DNA

SEQ ID NO: 117077 - DNA, 645 bp, Homo sapiens
  misc_feature 1..645: note = chr19:58545100-58545745
  misc_feature 1..645: note = Hyper
  source 1..645: mol_type = genomic DNA
ggacactgtataaaacggttgcgtgtctggaatgccgtcgttttgccccgcggccccatcgtacatgcgcatccccgcagccgccaccgtctccactttccgcagcagcgtccctgacgctgcgcgacccgttgccaaggcgactggaaccgcggcccgaggtaactggagggcacggcgggggcggggcgctcatcccaggcggcttctgattggcctcggccgcctcgtgcgtcacagccccgcccctgcccgggagtcccgcagcggtgacttgtcaccgacgcccggcgtgatccagcggaccaatggcggccgcccgcggcgcgcagggtgcggggatggggtccgcccgcggcgttgggcgcgctcgccagcccaggggtcgccatgaccgagtggcccaggcccgagcgaagcccgcgcgcggtgagtccgccgcggcccatccgtccctccgcccgccagagcgtccatcgggacgcccacccgggagggtctcggcgccgcgtcggcgggagctggcccgggatcgcggtccaggggcgcgcgtcgggggaggcgggcccgggcccgggagggggcgggccgggccggggttccagagcccatcgggagtcctgaggtcgccgtaggggagggaag

SEQ ID NO: 117078 - DNA, 30 bp, Homo sapiens; identical to SEQ ID NO: 84544
  misc_feature 1..30: note = chr19:58551687-58551717
  misc_feature 1..30: note = Hypo
  source 1..30: mol_type = genomic DNA

SEQ ID NO: 117079 - DNA, 45 bp, Homo sapiens; identical to SEQ ID NO: 84545
  misc_feature 1..45: note = chr19:58552006-58552051
  misc_feature 1..45: note = Hypo
  source 1..45: mol_type = genomic DNA

SEQ ID NO: 117080 - DNA, 38 bp, Homo sapiens; identical to SEQ ID NO: 84546
  misc_feature 1..38: note = chr19:58559411-58559449
  misc_feature 1..38: note = Hypo
  source 1..38: mol_type = genomic DNA

SEQ ID NO: 117081 - DNA, 65 bp, Homo sapiens; identical to SEQ ID NO: 84547
  misc_feature 1..65: note = chr19:58565543-58565608
  misc_feature 1..65: note = Hypo
  source 1..65: mol_type = genomic DNA

SEQ ID NO: 117082 - DNA, 623 bp, Homo sapiens
  misc_feature 1..623: note = chr19:58570471-58571094
  misc_feature 1..623: note = Hyper
  source 1..623: mol_type = genomic DNA
gatgcccaggcaccccgcgcgccctgtttcaccaggcccagtcactccagctccagcagcactgagagctcacgaacgccaagggcgagagcgaggtgggggagggcggccggaaatgcgcgcgcggctctctgggaaatggagttaggctcgcgccggcgcagtgtcggctgccggtgccgcggcctttgtctcgcagtcaggagggtgagctaggccggcgaggagggggaggggaggccaggccgggccgggccgggccgggtgcggggggtccggggatcttcctgaggccctggcggggcgagtttccagcagcgcgcgtctgtgtggagtccgttttgctgcccggggcctggggaaggccgtttcggggctggcgggggcaggctttgcggggcatccctagtctgagaggagggcggggcccaacgcccagctggacaggagctgctccgacggcccctgagggaacgcgcgccccgcccctggccccacctctgccccacaccgggcactgggccgccacctttgttgatggaagagagaaactgaggcatagtgcccagggccaggggaccgcaaccacccggcccttgtcactgtagcgttaaggctcagag

SEQ ID NO: 117083 - DNA, 18 bp, Homo sapiens
  misc_feature 1..18: note = chr19:58590342-58590360
  misc_feature 1..18: note = Hypo
  source 1..18: mol_type = genomic DNA
gagcgagactctgtctaa

SEQ ID NO: 117084 - DNA, 169 bp, Homo sapiens; identical to SEQ ID NO: 84551
  misc_feature 1..169: note = chr19:58597308-58597477
  misc_feature 1..169: note = Hypo
  source 1..169: mol_type = genomic DNA

SEQ ID NO: 117085 - DNA, 30 bp, Homo sapiens; identical to SEQ ID NO: 84552
  misc_feature 1..30: note = chr19:58598247-58598277
  misc_feature 1..30: note = Hypo
  source 1..30: mol_type = genomic DNA

SEQ ID NO: 117086 - DNA, 30 bp, Homo sapiens; identical to SEQ ID NO: 84553
  misc_feature 1..30: note = chr19:58598654-58598684
  misc_feature 1..30: note = Hypo
  source 1..30: mol_type = genomic DNA

SEQ ID NO: 117087 - DNA, 626 bp, Homo sapiens
  misc_feature 1..626: note = chr19:58609375-58610001
  misc_feature 1..626: note = Hyper
  source 1..626: mol_type = genomic DNA
gggatgccagaccctcggcctcctggacgcacagcgggggctcgcaccccaaccccgggaacaccctggcccctttccctaacgctgcccactgaggcgtcctcaccgtctaccctgttggggtcgctctctgacccccgcgctgcatccccgggaccgacccacctgctgcgcagctaccccaggccggtcccagccgcccggagccccagtgcgcgatggcggccggcaaactgcgcctgcgcactgggcctcaccgcggactacgactcccacaatgccgcgaggctgtgccgcgcaccggggcgagcaagggagccgtgacaggtgacagtgcgcatggccaatcagacgcgagtgtggcctcccggcgtcccgcccactccggcgcctgcgtcattttgggcaccatggcaacgaagtaaacaagcgggtaaataatagacccctgacagccagagacccggagaaacaaagacggtgagaaacggagaaacaaagacaaaaagacgcgcagaccgggagggagagaagcatgaaggcccacagacgctcgggggcagaccaagacgccctggggtccccgaaacagagatgtacagagtcggacacggaaagggagagac

SEQ ID NO: 117088 - DNA, 20 bp, Homo sapiens
  misc_feature 1..20: note = chr19:58622562-58622582
  misc_feature 1..20: note = Hypo
  source 1..20: mol_type = genomic DNA
gtaatcgctgctctgacctc

SEQ ID NO: 117089 - DNA, 76 bp, Homo sapiens; identical to SEQ ID NO: 84558
  misc_feature 1..76: note = chr19:58623655-58623731
  misc_feature 1..76: note = Hypo
  source 1..76: mol_type = genomic DNA

SEQ ID NO: 117090 - DNA, 30 bp, Homo sapiens; identical to SEQ ID NO: 37846
  misc_feature 1..30: note = chr19:58629357-58629387
  misc_feature 1..30: note = Hyper
  source 1..30: mol_type = genomic DNA

SEQ ID NO: 117091 - DNA, 297 bp, Homo sapiens
  misc_feature 1..297: note = chr19:58629637-58629934
  misc_feature 1..297: note = Hyper
  source 1..297: mol_type = genomic DNA
actaggccttggctccgcgaccggtgggcgggaacggaggaaacagacccgagaggccgcgagaggacggaactcacttcccgccgccgtagcgtcctcgtcagctcgccctccgactctccgcatgggcgcgcagagttcccggatgcgatattccggtgacaccggacgctgggggcggggcctagtgcgacgagggcggggccggggccggcccggggcggggccgtggccgcagctgcctggcagccagaacctgggagcgctcgcagtgctgcctttcggggttctttgtcc

SEQ ID NO: 117092 - DNA, 731 bp, Homo sapiens; identical to SEQ ID NO: 84561
  misc_feature 1..731: note = chr19:58661613-58662344
  misc_feature 1..731: note = Hyper
  source 1..731: mol_type = genomic DNA

SEQ ID NO: 117093 - DNA, 48 bp, Homo sapiens; identical to SEQ ID NO: 84562
  misc_feature 1..48: note = chr19:58665878-58665926
  misc_feature 1..48: note = Hyper
  source 1..48: mol_type = genomic DNA

SEQ ID NO: 117094 - DNA, 592 bp, Homo sapiens
  misc_feature 1..592: note = chr19:58666141-58666733
  misc_feature 1..592: note = Hyper
  source 1..592: mol_type = genomic DNA
gcagtccgcgagaggcgaggaggatccttggactgtgggcaggatcgcaggcagcggaggccctgcccggaaggcgggatctggggacgatccccattcctcccagccgcagacgcggagcccacaggagtccccgcagccctagcccgtgcacccacggcggagccgaggccgcgactccgggcctgttggctggaacccgcagccgtgtctcgggccgccccggtagcggccacccctgagagcactcggccccgttctatcccgcagtggtttggggagtgcaggtcatcactcccacccgccaaggcggacgccggaccctccattgcgcatgagcgcccactgcggcgccgttgctgcgcatgagtgtgcttccaccgcctacatctcccagaaaaccccgcggcgcggcgctccaccgcttccgccctcgggttgcgttagccgcgacgatggcgccccccagtggcagcagggaggctgtgggggtgctgggcgttgcggtgtgcaggttttctgggaggatacctggcgccgaccttgaagggaccccaacgtgagagggaaagacgcccgtgatgccaaggct

SEQ ID NO: 117095 - DNA, 738 bp, Homo sapiens; identical to SEQ ID NO: 84565
  misc_feature 1..738: note = chr19:58694552-58695290
  misc_feature 1..738: note = Hyper
  source 1..738: mol_type = genomic DNA

SEQ ID NO: 117096 - DNA, 32 bp, Homo sapiens; identical to SEQ ID NO: 84566
  misc_feature 1..32: note = chr19:58711048-58711080
  misc_feature 1..32: note = Hypo
  source 1..32: mol_type = genomic DNA

SEQ ID NO: 117097 - DNA, 30 bp, Homo sapiens; identical to SEQ ID NO: 84567
  misc_feature 1..30: note = chr19:58728930-58728960
  misc_feature 1..30: note = Hypo
  source 1..30: mol_type = genomic DNA

SEQ ID NO: 117098 - DNA, 849 bp, Homo sapiens; identical to SEQ ID NO: 84568
  misc_feature 1..849: note = chr19:58739737-58740586
  misc_feature 1..849: note = Hyper
  source 1..849: mol_type = genomic DNA

SEQ ID NO: 117099 - DNA, 41 bp, Homo sapiens; identical to SEQ ID NO: 84569
  misc_feature 1..41: note = chr19:58749920-58749961
  misc_feature 1..41: note = Hypo
  source 1..41: mol_type = genomic DNA

SEQ ID NO: 117100 - DNA, 157 bp, Homo sapiens; identical to SEQ ID NO: 46060
  misc_feature 1..157: note = chr19:58836900-58837057
  misc_feature 1..157: note = Hypo
  source 1..157: mol_type = genomic DNA

SEQ ID NO: 117101 - DNA, 17 bp, Homo sapiens
  misc_feature 1..17: note = chr19:58855466-58855483
  misc_feature 1..17: note = Hypo
  source 1..17: mol_type = genomic DNA
gggcgcggtggctcacg

SEQ ID NO: 117102 - DNA, 120 bp, Homo sapiens; identical to SEQ ID NO: 84572
  misc_feature 1..120: note = chr19:58874833-58874953
  misc_feature 1..120: note = Hypo
  source 1..120: mol_type = genomic DNA

SEQ ID NO: 117103 - DNA, 103 bp, Homo sapiens; identical to SEQ ID NO: 84573
  misc_feature 1..103: note = chr19:58891154-58891257
  misc_feature 1..103: note = Hypo
  source 1..103: mol_type = genomic DNA

SEQ ID NO: 117104 - DNA, 623 bp, Homo sapiens
  misc_feature 1..623: note = chr19:58907596-58908219
  misc_feature 1..623: note = Hyper
  source 1..623: mol_type = genomic DNA
cggcagcccaggctccggccctatcctgccccccgcctccccggtggagtgcctcatctgcgtgtcgtccttcgacggcgtgttcaagctgcccaagcgcctggactgcggccacgtcttctgtctcgagtgcctggcgcgcctatcgttggccacggcgggcggcggcaacgcggtggcctgtccggtgtgccgcgcgcccacgcgcctggccccccgccgcggactccccgcgttgcccacgcagtccggtctcctgccccgcgacgcgcgcgcaccgccctctcgccagggctccgtgcgcttcgaccggcgccgcggccttctctacctgcggccgccgccgcccccgcccgggccgcgcaaggcccgcgccccgccgcccccgccgcctctgcgcctgggccgcccgctgtcgcgccgcttgtcgctggccagcccggcctgggtcttcaacgctgccgtggcgctggcggtgctggtggccgcgggcctcgtggtctcgggcgtctacatcttcttcctcatcccgcacgccacctcctccggccccccgcggccccagctcgtggcgctcgctccagcgcctggcttctcttggtttccgccgaggcccccgccgg

SEQ ID NO: 117105 - DNA, 30 bp, Homo sapiens; identical to SEQ ID NO: 84575
  misc_feature 1..30: note = chr19:58912378-58912408
  misc_feature 1..30: note = Hyper
  source 1..30: mol_type = genomic DNA

SEQ ID NO: 117106 - DNA, 19 bp, Homo sapiens
  misc_feature 1..19: note = chr19:58915315-58915334
  misc_feature 1..19: note = Hypo
  source 1..19: mol_type = genomic DNA
actccgtctcaaaaaaaaa

SEQ ID NO: 117107 - DNA, 1070 bp, Homo sapiens
  misc_feature 1..1070: note = chr19:58951068-58952138
  misc_feature 1..1070: note = Hyper
  source 1..1070: mol_type = genomic DNA
caggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtcttcccaaatgcaaaatgcgcgcaaggcctctgggcaccgcagggacgaaggctgggtatggagaccctggagacgcgtggcgctggctccactttcgggaacaccttggctcataaaagcagagtaattagccgggcactatggtgcgtgtgaaggcgcggtgacggtccctgcacccactcccgtgccctggtgtggctccagaggcctgctgtagcccaacccaccagcagcaaaatgaggaccgcaatggcggcgccggaagtcccgcctctcaatgacagctcggacttgccactggtccgagctttcattggctcaaggatccccgccgtctatgacgctatttccctatgcccgtcacgctactgctaggtcgttgccaaggtgattgaggaatggcgtttattgcgtcgctgctcaggcaacgcaaactacattatccagaaggaccctcgcggtgcctcagggctggccattggcagccgaggagacaggcacttccgggcggagtgtaagacgctggccaatcacagcctggcagcgggacttccgtcgtcgtcctcggaccatcactttggcatttctcgattttgtctgcttctgaagggaccgcgttgtcaggcgagggacggaatcttggaggctccctgggcccatggaaacaggagcgaggaaggcacgagagtcggggaagttccgccttcttgacatacaagcgcccccaccgcggcgaatatcgcccctgagcccagtgttcgccccccacaacaccgcaccccccttccccaccctgtgccttagataaagccggcccagtgggaccctcaggttgcaccgcgcggaggtgtccgcggctctcgggagtc

SEQ ID NO: 117108 - DNA, 104 bp, Homo sapiens; identical to SEQ ID NO: 84581
  misc_feature 1..104: note = chr19:58964180-58964284
  misc_feature 1..104: note = Hypo
  source 1..104: mol_type = genomic DNA

SEQ ID NO: 117109 - DNA, 150 bp, Homo sapiens; identical to SEQ ID NO: 84584
  misc_feature 1..150: note = chr19:58986525-58986675
  misc_feature 1..150: note = Hypo
  source 1..150: mol_type = genomic DNA

SEQ ID NO: 117110 - DNA, 30 bp, Homo sapiens; identical to SEQ ID NO: 84585
  misc_feature 1..30: note = chr19:58987127-58987157
  misc_feature 1..30: note = Hypo
  source 1..30: mol_type = genomic DNA

SEQ ID NO: 117111 - DNA, 74 bp, Homo sapiens; identical to SEQ ID NO: 84586
  misc_feature 1..74: note = chr19:59010888-59010962
  misc_feature 1..74: note = Hyper
  source 1..74: mol_type = genomic DNA

SEQ ID NO: 117112 - DNA, 30 bp, Homo sapiens; identical to SEQ ID NO: 84588
  misc_feature 1..30: note = chr19:59049735-59049765
  misc_feature 1..30: note = Hyper
  source 1..30: mol_type = genomic DNA

SEQ ID NO: 117113 - DNA, 43 bp, Homo sapiens; identical to SEQ ID NO: 84590
  misc_feature 1..43: note = chr19:59074323-59074366
  misc_feature 1..43: note = Hyper
  source 1..43: mol_type = genomic DNA

SEQ ID NO: 117114 - DNA, 97 bp, Homo sapiens; identical to SEQ ID NO: 85235
  misc_feature 1..97: note = chr2:142625-142722
  misc_feature 1..97: note = Hypo
  source 1..97: mol_type = genomic DNA

SEQ ID NO: 117115 - DNA, 1395 bp, Homo sapiens; identical to SEQ ID NO: 86391
  misc_feature 1..1395: note = chr2:287500-288895
  misc_feature 1..1395: note = Hyper
  source 1..1395: mol_type = genomic DNA

SEQ ID NO: 117116 - DNA, 1189 bp, Homo sapiens; identical to SEQ ID NO: 86393
  misc_feature 1..1189: note = chr2:289223-290412
  misc_feature 1..1189: note = Hyper
  source 1..1189: mol_type = genomic DNA

SEQ ID NO: 117117 - DNA, 252 bp, Homo sapiens; identical to SEQ ID NO: 86429
  misc_feature 1..252: note = chr2:314488-314740
  misc_feature 1..252: note = Hypo
  source 1..252: mol_type = genomic DNA

SEQ ID NO: 117118 - DNA, 30 bp, Homo sapiens; identical to SEQ ID NO: 86432
  misc_feature 1..30: note = chr2:314985-315015
  misc_feature 1..30: note = Hypo
  source 1..30: mol_type = genomic DNA

SEQ ID NO: 117119 - DNA, 737 bp, Homo sapiens
  misc_feature 1..737: note = chr2:467966-468703
  misc_feature 1..737: note = Hyper
  source 1..737: mol_type = genomic DNA
tgggcctgaaactcccgcgctgtgcattcagggccctcgtggctctcagaggcgcgtcccaggggcgcacactgcaccttgggctgggcagctccgccgggttgtggcgagcggatgagggaaggacgcagaaaccagggcggaggagccgcgaggggcaggacgaggctgcatgggccagcgagggggtcgacaccgagccagagtgagcgcggggcctggggcgcagagcccgcccagggagccgggagacgccgcgcaagctccccggacaaacgcaatgaccgaggacgcgcgggcgaggccgtccagggagccctggtccctcagctgcaccggactgagccgcgaccgctcagcacgcgctgcttataaatcaggggtgcgcttcccaagccccgggtgaggtcccctacgtcggcacagccttaggagctgcaaagcagcgcgcgcctccggggctcctgcgcgccccttgaaccccgcctcccgcatcctcctgcaacagcctggagctccctgtgcaggacgcagcggggggcggggggcggtcttaggaggctgcggggcgcactcccacctcctgcctccccgagacccccagcgccttctccagggtttagagcggaggtgaaggggcctcgtcctgcaccgccactgggcgcctgggctgttcatcatcggttaccgccgattcataggaactcctcaacacattggctcggaaatgtacagtc

SEQ ID NO: 117120 - DNA, 70 bp, Homo sapiens; identical to SEQ ID NO: 39383
  misc_feature 1..70: note = chr2:484928-484998
  misc_feature 1..70: note = Hypo
  source 1..70: mol_type = genomic DNA

SEQ ID NO: 117121 - DNA, 190 bp, Homo sapiens; identical to SEQ ID NO: 86611
  misc_feature 1..190: note = chr2:496190-496380
  misc_feature 1..190: note = Hypo
  source 1..190: mol_type = genomic DNA

SEQ ID NO: 117122 - DNA, 69 bp, Homo sapiens; identical to SEQ ID NO: 39385
  misc_feature 1..69: note = chr2:503076-503145
  misc_feature 1..69: note = Hypo
  source 1..69: mol_type = genomic DNA

SEQ ID NO: 117123 - DNA, 161 bp, Homo sapiens; identical to SEQ ID NO: 86613
  misc_feature 1..161: note = chr2:503840-504001
  misc_feature 1..161: note = Hypo
  source 1..161: mol_type = genomic DNA

SEQ ID NO: 117124 - DNA, 74 bp, Homo sapiens; identical to SEQ ID NO: 86621
  misc_feature 1..74: note = chr2:522014-522088
  misc_feature 1..74: note = Hypo
  source 1..74: mol_type = genomic DNA

SEQ ID NO: 117125 - DNA, 44 bp, Homo sapiens; identical to SEQ ID NO: 86673
  misc_feature 1..44: note = chr2:602373-602417
  misc_feature 1..44: note = Hypo
  source 1..44: mol_type = genomic DNA

SEQ ID NO: 117126 - DNA, 30 bp, Homo sapiens; identical to SEQ ID NO: 86674
  misc_feature 1..30: note = chr2:602842-602872
  misc_feature 1..30: note = Hypo
  source 1..30: mol_type = genomic DNA

SEQ ID NO: 117127 - DNA, 72 bp, Homo sapiens; identical to SEQ ID NO: 86721
  misc_feature 1..72: note = chr2:647851-647923
  misc_feature 1..72: note = Hypo
  source 1..72: mol_type = genomic DNA

SEQ ID NO: 117128 - DNA, 53 bp, Homo sapiens; identical to SEQ ID NO: 86727
  misc_feature 1..53: note = chr2:648647-648700
  misc_feature 1..53: note = Hypo
  source 1..53: mol_type = genomic DNA

SEQ ID NO: 117129 - DNA, 61 bp, Homo sapiens; identical to SEQ ID NO: 14369
  misc_feature 1..61: note = chr2:720836-720897
  misc_feature 1..61: note = Hypo
  source 1..61: mol_type = genomic DNA

SEQ ID NO: 117130 - DNA, 38 bp, Homo sapiens; identical to SEQ ID NO: 86848
  misc_feature 1..38: note = chr2:740885-740923
  misc_feature 1..38: note = Hyper
  source 1..38: mol_type = genomic DNA

SEQ ID NO: 117131 - DNA, 30 bp, Homo sapiens; identical to SEQ ID NO: 86871
  misc_feature 1..30: note = chr2:747532-747562
  misc_feature 1..30: note = Hypo
  source 1..30: mol_type = genomic DNA

SEQ ID NO: 117132 - DNA, 30 bp, Homo sapiens; identical to SEQ ID NO: 86915
  misc_feature 1..30: note = chr2:817019-817049
  misc_feature 1..30: note = Hypo
  source 1..30: mol_type = genomic DNA

SEQ ID NO: 117133 - DNA, 30 bp, Homo sapiens; identical to SEQ ID NO: 86937
  misc_feature 1..30: note = chr2:859874-859904
  misc_feature 1..30: note = Hypo
  source 1..30: mol_type = genomic DNA

SEQ ID NO: 117134 - DNA, 84 bp, Homo sapiens; identical to SEQ ID NO: 86956
  misc_feature 1..84: note = chr2:875937-876021
  misc_feature 1..84: note = Hypo
  source 1..84: mol_type = genomic DNA

SEQ ID NO: 117135 - DNA, 179 bp, Homo sapiens; identical to SEQ ID NO: 86959
  misc_feature 1..179: note = chr2:881951-882130
  misc_feature 1..179: note = Hypo
  source 1..179: mol_type = genomic DNA

SEQ ID NO: 117136 - DNA, 30 bp, Homo sapiens; identical to SEQ ID NO: 39390
  misc_feature 1..30: note = chr2:925888-925918
  misc_feature 1..30: note = Hypo
  source 1..30: mol_type = genomic DNA

SEQ ID NO: 117137 - DNA, 1629 bp, Homo sapiens
  misc_feature 1..1629: note = chr2:945552-947181
  misc_feature 1..1629: note = Hyper
  source 1..1629: mol_type = genomic DNA
agccttgcctgcccccgccgcactggaatttatcctaaacttactttcatttacattaaaacaagacgatttgagtctaccaaacccaatactgcatctgtgaggctccttttggcacaaacctgaatgaacagcgggaaacgccgtctcccctggcgtctgagatctggggtcccctccccacctggtctcctcgctcccgccccagccccgtgcgccccaggagggcaccgccgagcgccgggtccccgcagggttcgggagactccgcggaccggaggagggataggacccccgagctttgggggcgggaagggagggtggaaggaggaggggagcggggttggggaaagttggagcttcggtatcttttctccgggccaggccgtcctcggggccctgcgctgcgtctccaagtgctgggaagactccgcggggaaaggtctgaggacgcggccggctggcacaggtgtggcggcttcagagggccggggagaacccatggcttcgaggctgtggactagaaatgtccctgattagaagctgagaacctttggccagggaggtggggcggcggggaggggtcgtcaagccggtccagagcgcgcccacctgcgccacaagggagaagaggtgccccccgcccccctccgcccaccgccgccacgatgcgccgcggacctcggcgacccagcccgggtagaagcgcgcgctcccctcctccagcctcgtgcgccggcccctgccccgccagccccgctatggtcccccatccacccccgcgggagcgcccctgtccccccatcctgcacttcccccagagtcgcgcgccagtttcccgccccgtggaagcgcccctctcccgacttcggctgatccccgctcgccgccctccccgcgggtgcgcgcccggcccctccctcgcccggggcgggtctgcgtgggcggtgctccgggtcggcgggcggagctccggttccccagccctgcgccccggtggagcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcgggtgagtgcggcccctcagcgccccttcacctccggccccccttccctctccttcgcgcccttctccccccgcccctcctccctccacgccccctcgctccccgcgaccccttccctgtctccggggacggctggccggagggtgggcgccggagccccgggacgcagtgggcacccgccccctggccgctctgctccctccagcccagtgtcttactggaaacttgcaggctttgctcctccagcgtcttctaaggtttggttttgaggcgcccgggcttccctttactgcgtgggaagtagtgctttccagaatttgggatttgagattggcccggcattgcttcccaggagcggctctttcgggcccaggcggtggctcggaccggagcgtcccccctgcagccttcgggcgcccaggccaggtc

SEQ ID NO: 117138 - DNA, 30 bp, Homo sapiens; identical to SEQ ID NO: 39391
  misc_feature 1..30: note = chr2:951526-951556
  misc_feature 1..30: note = Hypo
  source 1..30: mol_type = genomic DNA

SEQ ID NO: 117139 - DNA, 127 bp, Homo sapiens; identical to SEQ ID NO: 87024
  misc_feature 1..127: note = chr2:961623-961750
  misc_feature 1..127: note = Hypo
  source 1..127: mol_type = genomic DNA

SEQ ID NO: 117140 - DNA, 49 bp, Homo sapiens; identical to SEQ ID NO: 39392
  misc_feature 1..49: note = chr2:973406-973455
  misc_feature 1..49: note = Hypo
  source 1..49: mol_type = genomic DNA

SEQ ID NO: 117141 - DNA, 30 bp, Homo sapiens; identical to SEQ ID NO: 87055
  misc_feature 1..30: note = chr2:980380-980410
  misc_feature 1..30: note = Hypo
  source 1..30: mol_type = genomic DNA

SEQ ID NO: 117142 - DNA, 184 bp, Homo sapiens; identical to SEQ ID NO: 84808
  misc_feature 1..184: note = chr2:1019337-1019521
  misc_feature 1..184: note = Hypo
  source 1..184: mol_type = genomic DNA

SEQ ID NO: 117143 - DNA, 173 bp, Homo sapiens; identical to SEQ ID NO: 84904
  misc_feature 1..173: note = chr2:1075449-1075622
  misc_feature 1..173: note = Hypo
  source 1..173: mol_type = genomic DNA

SEQ ID NO: 117144 - DNA, 138 bp, Homo sapiens; identical to SEQ ID NO: 85036
  misc_feature 1..138: note = chr2:1204780-1204918
  misc_feature 1..138: note = Hypo
  source 1..138: mol_type = genomic DNA

SEQ ID NO: 117145 - DNA, 96 bp, Homo sapiens; identical to SEQ ID NO: 85162
  misc_feature 1..96: note = chr2:1310590-1310686
  misc_feature 1..96: note = Hypo
  source 1..96: mol_type = genomic DNA

SEQ ID NO: 117146 - DNA, 64 bp, Homo sapiens; identical to SEQ ID NO: 85228
  misc_feature 1..64: note = chr2:1379782-1379846
  misc_feature 1..64: note = Hypo
  source 1..64: mol_type = genomic DNA

SEQ ID NO: 117147 - DNA, 62 bp, Homo sapiens; identical to SEQ ID NO: 39395
  misc_feature 1..62: note = chr2:1424987-1425049
  misc_feature 1..62: note = Hypo
  source 1..62: mol_type = genomic DNA

SEQ ID NO: 117148 - DNA, 73 bp, Homo sapiens; identical to SEQ ID NO: 85314
  misc_feature 1..73: note = chr2:1588152-1588225
  misc_feature 1..73: note = Hypo
  source 1..73: mol_type = genomic DNA

SEQ ID NO: 117149 - DNA, 222 bp, Homo sapiens; identical to SEQ ID NO: 85363
  misc_feature 1..222: note = chr2:1635805-1636027
  misc_feature 1..222: note = Hypo
  source 1..222: mol_type = genomic DNA

SEQ ID NO: 117150 - DNA, 30 bp, Homo sapiens; identical to SEQ ID NO: 39397
  misc_feature 1..30: note = chr2:1637034-1637064
  misc_feature 1..30: note = Hypo
  source 1..30: mol_type = genomic DNA

SEQ ID NO: 117151 - DNA, 79 bp, Homo sapiens; identical to SEQ ID NO: 85370
  misc_feature 1..79: note = chr2:1653102-1653181
  misc_feature 1..79: note = Hypo
  source 1..79: mol_type = genomic DNA

SEQ ID NO: 117152 - DNA, 39 bp, Homo sapiens; identical to SEQ ID NO: 85386
  misc_feature 1..39: note = chr2:1689084-1689123
  misc_feature 1..39: note = Hypo
  source 1..39: mol_type = genomic DNA

SEQ ID NO: 117153 - DNA, 30 bp, Homo sapiens; identical to SEQ ID NO: 85405
  misc_feature 1..30: note = chr2:1709360-1709390
  misc_feature 1..30: note = Hypo
  source 1..30: mol_type = genomic DNA

SEQ ID NO: 117154 - DNA, 868 bp, Homo sapiens
  misc_feature 1..868: note = chr2:1746445-1747313
  misc_feature 1..868: note = Hyper
  source 1..868: mol_type = genomic DNA
cagggaaacctcacccggctccattctaaaagtccactgctgttgagtgagatgcccccgagtcgtccggcctgggctgaccattcacgggctctggaaagaaagccttggtctctctgcggaggaggagaggaactcgggcccccgccccgccccagggcctccaggaagcagcctgcaaactcggcgacccctgggagccgtggtctgtcccagcactttgtttcggaggtaggcgcactggccgcccacttcctgaattgttcactcaatttttttacaacttttgcagactctttgctggtgccaaaaagtcctctggctcagctaagaaacgtgaaaactatttttggcatgcagaaaagtcgctacaggactaaattagagtcggcgcctgaaacgcagcccgcgttcacagatcccgaaaatgttgaatccgactcgcttcagaacacaggaggcctgcagcgaactctggcggcatctcggtacctggagccgcggggcggagggatggggattcctgctgtggagaccgtgacgcgggacggcccgcaggacagggtgtcaaccccaacgcaacgcatccggttaaacgtatagcgcaactgcgaacacgctcgcgtggattagaagcgaaagaagagaaatgcccgaggcagaaacccgctctgagtcccggctccatctagacccgggctgccccgagactaccgcgcggcccctctcgggaaccccggccgcccggctcgctccgggcgcaggaaaagcccctgagaagcgcggggcccccaggacaccccaggagaggacgctccgggcagatgcgggggcactgggagcgggggcgccgcggctgcgggaactg

SEQ ID NO: 117155 - DNA, 1182 bp, Homo sapiens
  misc_feature 1..1182: note = chr2:1747625-1748807
  misc_feature 1..1182: note = Hyper
  source 1..1182: mol_type = genomic DNA
gagcggaggaggggccgcgaaccagggggaagcgggaggccggcggagcatgagagggggcggcgggaggcgagcggggggagccccggaggctccaacaacttcccagtcctgcggggattccgagttccgaacaaaggcggctacgaaggccgcgcgcacagcgctctgttccgcccctcggcgtctcccgcagggcgaacaaaggcccagcgggtccccgcgcccaggtccccccacgtcccccttcggaggttcccttctgcgtcccaagtccccaggccccccgcgcgcccgatgccccctccaccctccgcgccccccacctccgatcacccctgcgctcccggatctccacgaagccccggaccccgcgcccccggcgtcccccgcggcactcacaggatggaggtctgcggcgccacggcgggcacggcctccagcagcagatgcatgcagcgcacggtggtgcggaagcacaggcagcggctcggacaccctgcgcccggcttctgggccaccacggccagcgtcccccaggcgcagaacagcacgagcgccaacaggcagcggcgcccggggcccctggagcgcttggccatggccgacggcgcggacggacgctcggacgcacggagccaccacggccggctcccgactgcgcccgcccggccgcggcccacgtcccagctgtgcgcggggggcggggggcgccagctgtgcacatgcgcgaggctcctcccggcccctctgaatccccgagggcggggcggggcgagaacccggggccccagcgtccggcctgagcgccctcatcccggtggggcggcccgcatggccaaggcgagcgctcgggggcgcggaggagagcattggcacccctgattctgcgctcgagactcggggctcgggaccctggggcctacgcgaagcttctccacttctcttacccgtggtttctgcctgcgctcactacgggttttttagttggcgccttaatgtttgtaacacttttagagcgcttgctctgatccgggcacgattccaggcgcgcaggcgcgctcctctctttctccttctccctacccgcaaccacgtaggaaattatttaacgttccaaaaaagcccctcattccttttgaggaaactgaggcccaagccccaaagcgcacagcaagggag

SEQ ID NO: 117156 - DNA, 153 bp, Homo sapiens; identical to SEQ ID NO: 85521
  misc_feature 1..153: note = chr2:1758012-1758165
  misc_feature 1..153: note = Hypo
  source 1..153: mol_type = genomic DNA

SEQ ID NO: 117157 - DNA, 171 bp, Homo sapiens; identical to SEQ ID NO: 85633
  misc_feature 1..171: note = chr2:1825400-1825571
  misc_feature 1..171: note = Hypo
  source 1..171: mol_type = genomic DNA

SEQ ID NO: 117158 - DNA, 96 bp, Homo sapiens; identical to SEQ ID NO: 85656
  misc_feature 1..96: note = chr2:1858658-1858754
  misc_feature 1..96: note = Hyper
  source 1..96: mol_type = genomic DNA

SEQ ID NO: 117159 - DNA, 132 bp, Homo sapiens; identical to SEQ ID NO: 85658
  misc_feature 1..132: note = chr2:1880288-1880420
  misc_feature 1..132: note = Hypo
  source 1..132: mol_type = genomic DNA

SEQ ID NO: 117160 - DNA, 30 bp, Homo sapiens; identical to SEQ ID NO: 85663
  misc_feature 1..30: note = chr2:1891322-1891352
  misc_feature 1..30: note = Hypo
  source 1..30: mol_type = genomic DNA

SEQ ID NO: 117161 - DNA, 41 bp, Homo sapiens; identical to SEQ ID NO: 39399
  misc_feature 1..41: note = chr2:1893020-1893061
  misc_feature 1..41: note = Hypo
  source 1..41: mol_type = genomic DNA

SEQ ID NO: 117162 - DNA, 42 bp, Homo sapiens; identical to SEQ ID NO: 85682
  misc_feature 1..42: note = chr2:1941410-1941452
  misc_feature 1..42: note = Hypo
  source 1..42: mol_type = genomic DNA

SEQ ID NO: 117163 - DNA, 39 bp, Homo sapiens; identical to SEQ ID NO: 85683
  misc_feature 1..39: note = chr2:1946870-1946909
  misc_feature 1..39: note = Hypo
  source 1..39: mol_type = genomic DNA

SEQ ID NO: 117164 - DNA, 30 bp, Homo sapiens; identical to SEQ ID NO: 39400
  misc_feature 1..30: note = chr2:1950712-1950742
  misc_feature 1..30: note = Hypo
  source 1..30: mol_type = genomic DNA

SEQ ID NO: 117165 - DNA, 156 bp, Homo sapiens; identical to SEQ ID NO: 39401
  misc_feature 1..156: note = chr2:1972852-1973008
  misc_feature 1..156: note = Hypo
  source 1..156: mol_type = genomic DNA

SEQ ID NO: 117166 - DNA, 21 bp, Homo sapiens
  misc_feature 1..21: note = chr2:2007674-2007695
  misc_feature 1..21: note = Hypo
  source 1..21: mol_type = genomic DNA
ttgattcatgcctttcgtgca

SEQ ID NO: 117167 - DNA, 30 bp, Homo sapiens; identical to SEQ ID NO: 39402
  misc_feature 1..30: note = chr2:2030884-2030914
  misc_feature 1..30: note = Hypo
  source 1..30: mol_type = genomic DNA

SEQ ID NO: 117168 - DNA, 159 bp, Homo sapiens; identical to SEQ ID NO: 85803
  misc_feature 1..159: note = chr2:2125816-2125975
  misc_feature 1..159: note = Hypo
  source 1..159: mol_type = genomic DNA

SEQ ID NO: 117169 - DNA, 30 bp, Homo sapiens; identical to SEQ ID NO: 85814
  misc_feature 1..30: note = chr2:2163389-2163419
  misc_feature 1..30: note = Hypo
  source 1..30: mol_type = genomic DNA

SEQ ID NO: 117170 - DNA, 30 bp, Homo sapiens; identical to SEQ ID NO: 85815
  misc_feature 1..30: note = chr2:2166008-2166038
  misc_feature 1..30: note = Hypo
  source 1..30: mol_type = genomic DNA

SEQ ID NO: 117171 - DNA, 149 bp, Homo sapiens; identical to SEQ ID NO: 85833
  misc_feature 1..149: note = chr2:2190096-2190245
  misc_feature 1..149: note = Hypo
  source 1..149: mol_type = genomic DNA

SEQ ID NO: 117172 - DNA, 109 bp, Homo sapiens; identical to SEQ ID NO: 86174
  misc_feature 1..109: note = chr2:2402544-2402653
  misc_feature 1..109: note = Hypo
  source 1..109: mol_type = genomic DNA

SEQ ID NO: 117173 - DNA, 189 bp, Homo sapiens; identical to SEQ ID NO: 14371
  misc_feature 1..189: note = chr2:2522670-2522859
  misc_feature 1..189: note = Hypo
  source 1..189: mol_type = genomic DNA

SEQ ID NO: 117174 - DNA, 50 bp, Homo sapiens; identical to SEQ ID NO: 86327
  misc_feature 1..50: note = chr2:2569541-2569591
  misc_feature 1..50: note = Hypo
  source 1..50: mol_type = genomic DNA

SEQ ID NO: 117175 - DNA, 87 bp, Homo sapiens; identical to SEQ ID NO: 86328
  misc_feature 1..87: note = chr2:2575682-2575769
  misc_feature 1..87: note = Hypo
  source 1..87: mol_type = genomic DNA

SEQ ID NO: 117176 - DNA, 20 bp, Homo sapiens
  misc_feature 1..20: note = chr2:2576136-2576156
  misc_feature 1..20: note = Hypo
  source 1..20: mol_type = genomic DNA
cacacacgccacacacgcca

SEQ ID NO: 117177 - DNA, 38 bp, Homo sapiens; identical to SEQ ID NO: 86332
  misc_feature 1..38: note = chr2:2584798-2584836
  misc_feature 1..38: note = Hypo
  source 1..38: mol_type = genomic DNA

SEQ ID NO: 117178 - DNA, 30 bp, Homo sapiens; identical to SEQ ID NO: 86341
  misc_feature 1..30: note = chr2:2648264-2648294
  misc_feature 1..30: note = Hypo
  source 1..30: mol_type = genomic DNA

SEQ ID NO: 117179 - DNA, 86 bp, Homo sapiens; identical to SEQ ID NO: 86345
  misc_feature 1..86: note = chr2:2665523-2665609
  misc_feature 1..86: note = Hypo
  source 1..86: mol_type = genomic DNA

SEQ ID NO: 117180 - DNA, 125 bp, Homo sapiens; identical to SEQ ID NO: 86346
  misc_feature 1..125: note = chr2:2669364-2669489
  misc_feature 1..125: note = Hypo
  source 1..125: mol_type = genomic DNA

SEQ ID NO: 117181 - DNA, 30 bp, Homo sapiens; identical to SEQ ID NO: 86348
  misc_feature 1..30: note = chr2:2673084-2673114
  misc_feature 1..30: note = Hypo
  source 1..30: mol_type = genomic DNA

SEQ ID NO: 117182 - DNA, 493 bp, Homo sapiens; identical to SEQ ID NO: 86360
  misc_feature 1..493: note = chr2:2725048-2725541
  misc_feature 1..493: note = Hypo
  source 1..493: mol_type = genomic DNA

SEQ ID NO: 117183 - DNA, 92 bp, Homo sapiens; identical to SEQ ID NO: 39409
  misc_feature 1..92: note = chr2:2730695-2730787
  misc_feature 1..92: note = Hypo
  source 1..92: mol_type = genomic DNA

SEQ ID NO: 117184 - DNA, 262 bp, Homo sapiens; identical to SEQ ID NO: 86371
  misc_feature 1..262: note = chr2:2752881-2753143
  misc_feature 1..262: note = Hypo
  source 1..262: mol_type = genomic DNA

SEQ ID NO: 117185 - DNA, 192 bp, Homo sapiens; identical to SEQ ID NO: 86381
  misc_feature 1..192: note = chr2:2799315-2799507
  misc_feature 1..192: note = Hypo
  source 1..192: mol_type = genomic DNA

SEQ ID NO: 117186 - DNA, 30 bp, Homo sapiens; identical to SEQ ID NO: 86382
  misc_feature 1..30: note = chr2:2829715-2829745
  misc_feature 1..30: note = Hypo
  source 1..30: mol_type = genomic DNA

SEQ ID NO: 117187 - DNA, 30 bp, Homo sapiens; identical to SEQ ID NO: 86383
  misc_feature 1..30: note = chr2:2844571-2844601
  misc_feature 1..30: note = Hypo
  source 1..30: mol_type = genomic DNA

SEQ ID NO: 117188 - DNA, 70 bp, Homo sapiens; identical to SEQ ID NO: 86384
  misc_feature 1..70: note = chr2:2844886-2844956
  misc_feature 1..70: note = Hypo
  source 1..70: mol_type = genomic DNA

SEQ ID NO: 117189 - DNA, 122 bp, Homo sapiens; identical to SEQ ID NO: 86386
  misc_feature 1..122: note = chr2:2854341-2854463
  misc_feature 1..122: note = Hypo
  source 1..122: mol_type = genomic DNA

SEQ ID NO: 117190 - DNA, 30 bp, Homo sapiens; identical to SEQ ID NO: 86387
  misc_feature 1..30: note = chr2:2854703-2854733
  misc_feature 1..30: note = Hypo
  source 1..30: mol_type = genomic DNA

SEQ ID NO: 117191 - DNA, 30 bp, Homo sapiens; identical to SEQ ID NO: 86388
  misc_feature 1..30: note = chr2:2863300-2863330
  misc_feature 1..30: note = Hypo
  source 1..30: mol_type = genomic DNA

SEQ ID NO: 117192 - DNA, 131 bp, Homo sapiens; identical to SEQ ID NO: 86392
  misc_feature 1..131: note = chr2:2875928-2876059
  misc_feature 1..131: note = Hypo
  source 1..131: mol_type = genomic DNA

SEQ ID NO: 117193 - DNA, 30 bp, Homo sapiens; identical to SEQ ID NO: 86396
  misc_feature 1..30: note = chr2:2913672-2913702
  misc_feature 1..30: note = Hypo
  source 1..30: mol_type = genomic DNA

SEQ ID NO: 117194 - DNA, 30 bp, Homo sapiens; identical to SEQ ID NO: 39414
  misc_feature 1..30: note = chr2:2939589-2939619
  misc_feature 1..30: note = Hypo
  source 1..30: mol_type = genomic DNA

SEQ ID NO: 117195 - DNA, 97 bp, Homo sapiens; identical to SEQ ID NO: 86401
  misc_feature 1..97: note = chr2:2941871-2941968
  misc_feature 1..97: note = Hypo
  source 1..97: mol_type = genomic DNA

SEQ ID NO: 117196 - DNA, 105 bp, Homo sapiens; identical to SEQ ID NO: 39416
  misc_feature 1..105: note = chr2:3050299-3050404
  misc_feature 1..105: note = Hypo
  source 1..105: mol_type = genomic DNA

SEQ ID NO: 117197 - DNA, 68 bp, Homo sapiens; identical to SEQ ID NO: 86433
  misc_feature 1..68: note = chr2:3175737-3175805
  misc_feature 1..68: note = Hypo
  source 1..68: mol_type = genomic DNA

SEQ ID NO: 117198 - DNA, 30 bp, Homo sapiens; identical to SEQ ID NO: 39417
  misc_feature 1..30: note = chr2:3176032-3176062
  misc_feature 1..30: note = Hypo
  source 1..30: mol_type = genomic DNA

SEQ ID NO: 117199 - DNA, 30 bp, Homo sapiens; identical to SEQ ID NO: 39418
  misc_feature 1..30: note = chr2:3285842-3285872
  misc_feature 1..30: note = Hypo
  source 1..30: mol_type = genomic DNA

SEQ ID NO: 117200 - DNA, 30 bp, Homo sapiens; identical to SEQ ID NO: 86446
  misc_feature 1..30: note = chr2:3286245-3286275
  misc_feature 1..30: note = Hypo
  source 1..30: mol_type = genomic DNA

SEQ ID NO: 117201 - DNA, 30 bp, Homo sapiens; identical to SEQ ID NO: 86447
  misc_feature 1..30: note = chr2:3290098-3290128
  misc_feature 1..30: note = Hypo
  source 1..30: mol_type = genomic DNA

SEQ ID NO: 117202 - DNA, 165 bp, Homo sapiens; identical to SEQ ID NO: 86448
  misc_feature 1..165: note = chr2:3290515-3290680
  misc_feature 1..165: note = Hypo
  source 1..165: mol_type = genomic DNA

SEQ ID NO: 117203 - DNA, 177 bp, Homo sapiens
  misc_feature 1..177: note = chr2:3292754-3292931
  misc_feature 1..177: note = Hypo
  source 1..177: mol_type = genomic DNA
cacggccgtatctcccgcaattaaaatgcaggctttcaaatccatgacgctcacgcactgctcagctttctggagttttaattgcccatttgctttcttcctaggcaacagaactgctctattaatatctccccaccggtttcaggggagaggggagacaagcgaggatttgtttct

SEQ ID NO: 117204 - DNA, 30 bp, Homo sapiens; identical to SEQ ID NO: 86449
  misc_feature 1..30: note = chr2:3307369-3307399
  misc_feature 1..30: note = Hyper
  source 1..30: mol_type = genomic DNA

SEQ ID NO: 117205 - DNA, 30 bp, Homo sapiens; identical to SEQ ID NO: 14373
  misc_feature 1..30: note = chr2:3331786-3331816
  misc_feature 1..30: note = Hypo
  source 1..30: mol_type = genomic DNA

SEQ ID NO: 117206 - DNA, 45 bp, Homo sapiens; identical to SEQ ID NO: 86455
  misc_feature 1..45: note = chr2:3347109-3347154
  misc_feature 1..45: note = Hypo
  source 1..45: mol_type = genomic DNA

SEQ ID NO: 117207 - DNA, 33 bp, Homo sapiens; identical to SEQ ID NO: 39420
  misc_feature 1..33: note = chr2:3352677-3352710
  misc_feature 1..33: note = Hypo
  source 1..33: mol_type = genomic DNA

SEQ ID NO: 117208 - DNA, 42 bp, Homo sapiens; identical to SEQ ID NO: 86465
  misc_feature 1..42: note = chr2:3438687-3438729
  misc_feature 1..42: note = Hypo
  source 1..42: mol_type = genomic DNA

SEQ ID NO: 117209 - DNA, 512 bp, Homo sapiens
  misc_feature 1..512: note = chr2:3750927-3751439
  misc_feature 1..512: note = Hyper
  source 1..512: mol_type = genomic DNA
cgcccctcacctgcccgggctccccgttgccccctcacctgtctccgccctgtgccgcgcctcacctgcttgggctccccattacccaatcacctgtccctgccccgtgccgcctgctcacctgcccgggttccccgtcgccccgtctcctgccccggccccgagcccctcgccctggcggccaggcggtcacaatcgcccagggtcgcgtcaacacgcagcctccgcccgcctggcagccccgtcccgtccccgtccagcccccgtcccgtccccgtcccgtccccgtcctgcgccagcggctggagcggacctcccgtcggcggtgcccgggcctgggcgcggctctgcaggcgtcgctgcccgcgctgccgcagcctctcggccccggcgagcgaggagcggggcgcggctatgggaacccgcgggccctccgcgccggtggacaccacgcccgccaagaccatcgtggtgtaccgcaacggggacccgttctacgtgggcaagaagtt

SEQ ID NO: 117210 - DNA, 205 bp, Homo sapiens; identical to SEQ ID NO: 86481
  misc_feature 1..205: note = chr2:3833780-3833985
  misc_feature 1..205: note = Hypo
  source 1..205: mol_type = genomic DNA

SEQ ID NO: 117211 - DNA, 129 bp, Homo sapiens; identical to SEQ ID NO: 39422
  misc_feature 1..129: note = chr2:3990793-3990922
  misc_feature 1..129: note = Hypo
  source 1..129: mol_type = genomic DNA

SEQ ID NO: 117212 - DNA, 49 bp, Homo sapiens; identical to SEQ ID NO: 86500
  misc_feature 1..49: note = chr2:4130725-4130774
  misc_feature 1..49: note = Hypo
  source 1..49: mol_type = genomic DNA

SEQ ID NO: 117213 - DNA, 50 bp, Homo sapiens; identical to SEQ ID NO: 86628
  misc_feature 1..50: note = chr2:5506198-5506248
  misc_feature 1..50: note = Hyper
  source 1..50: mol_type = genomic DNA

SEQ ID NO: 117214 - DNA, 30 bp, Homo sapiens; identical to SEQ ID NO: 86639
  misc_feature 1..30: note = chr2:5623242-5623272
  misc_feature 1..30: note = Hyper
  source 1..30: mol_type = genomic DNA

SEQ ID NO: 117215 - DNA, 57 bp, Homo sapiens; identical to SEQ ID NO: 14375
  misc_feature 1..57: note = chr2:5704308-5704365
  misc_feature 1..57: note = Hypo
  source 1..57: mol_type = genomic DNA

SEQ ID NO: 117216 - DNA, 253 bp, Homo sapiens; identical to SEQ ID NO: 86645
  misc_feature 1..253: note = chr2:5813654-5813907
  misc_feature 1..253: note = Hyper
  source 1..253: mol_type = genomic DNA

SEQ ID NO: 117217 - DNA, 1438 bp, Homo sapiens
  misc_feature 1..1438: note = chr2:5830956-5832394
  misc_feature 1..1438: note = Hyper
  source 1..1438: mol_type = genomic DNA
gaaaggaagcagattcggataattttcccagtcctacacggctgatttctctggtgaagggatccgggcagtgtcttaggaactgctcaaagttcccagatacccagtgctggggggtgtggagaaggcgagggtggcgacagaccatacctatgaagcggtgattttctttaattgcccccagaatatccgtagaggtagtagggactcaataaagaaacacaaaggagacgaacacggcacgatcgccggggtccgcggctgctctgcgaggcccagcgcgccccaggtcgcggctccccggccgccagcgcacctttccatctccagggaaaatatttagacgggaaactcgagtgcaccttattttctctttggtttatgagtgacccagaaggcttctagctcacaatcgcacgatttcaggacgaggctgccggagaagcgctggcgaccgaggatgggggaaggacaaagaggaagaggaggcctgggaaggagaaaggagcggcggaggggcggggagaggacggggcggggagaggaggggcggggagcagagggagaagggaaggagggcgccgggcccctcgcagggacgccgggcggggcgcgggcttgctggagcctgcgggacccagagcccgctccggagccagccctgggagtggccagcttgaacccgagggccccgcagaccgttactccggcccccgcccggggcggggcgcgcgggggcgcggcgcagcccaacccgcacagccgcgtccccaaacaccaccgaggagggaaaacagacggagaaaaaggacaaaacagaaaaatgcaaaacgggggagggagctcaccgcctctcgagctttaaattgatttctttgccttacaaaaagggagaaagggaaaaggagagcagagcccacgtgccgggaaggttgctgtcttcaagcgccaccttccgtcggccagggccgccgcggggctaccgggcgggctcggggcggcgacccgggggagcggccgagccccgcgaggggctcgccggggagcagctgcgcccaccccggggcaggccgggcgcggctgaccgcgagccgggcggaggccgccgtctcaggctgggcgcgtgcccgagtgtgtgcacccggggagtgagcgcgcgccgtccgctgtcgccgtcgggcctcccggggactgggcacaaaggcgcgcggggcctctcccgggacccggtcctcggttagcgccggcgcccgaaccatcccggttcgccccgggccgcccgctccccgtggtgccgcgcgccgcttccgagcatcccgggaacaggcgcatctgtgcacacacgcggattttttaaaaataacatatttctagacatgcctcctctccccccacccccatctttgcaaagcagcccggagggcggggtggaggggcg

SEQ ID NO: 117218 - DNA, 1418 bp, Homo sapiens
  misc_feature 1..1418: note = chr2:5832715-5834133
  misc_feature 1..1418: note = Hyper
  source 1..1418: mol_type = genomic DNA
ggggagggggggagccgcgaaagcggggtgccgaggactttgcaacttgcccaggaaggtggaggggtgggagggggagggggacctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcggg

SEQ ID NO: 117219 - DNA, 1444 bp, Homo sapiens
  misc_feature 1..1444: note = chr2:5836053-5837497
  misc_feature 1..1444: note = Hyper
  source 1..1444: mol_type = genomic DNA
ccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgca

SEQ ID NO: 117220 - DNA, 169 bp, Homo sapiens; identical to SEQ ID NO: 86664
  misc_feature 1..169: note = chr2:5866042-5866211
  misc_feature 1..169: note = Hyper
  source 1..169: mol_type = genomic DNA

SEQ ID NO: 117221 - DNA, 201 bp, Homo sapiens; identical to SEQ ID NO: 86665
  misc_feature 1..201: note = chr2:5886248-5886449
  misc_feature 1..201: note = Hypo
  source 1..201: mol_type = genomic DNA

SEQ ID NO: 117222 - DNA, 462 bp, Homo sapiens; identical to SEQ ID NO: 86690
  misc_feature 1..462: note = chr2:6121692-6122154
  misc_feature 1..462: note = Hyper
  source 1..462: mol_type = genomic DNA

SEQ ID NO: 117223 - DNA, 138 bp, Homo sapiens; identical to SEQ ID NO: 86717
  misc_feature 1..138: note = chr2:6402946-6403084
  misc_feature 1..138: note = Hypo
  source 1..138: mol_type = genomic DNA

SEQ ID NO: 117224 - DNA, 30 bp, Homo sapiens; identical to SEQ ID NO: 86731
  misc_feature 1..30: note = chr2:6635445-6635475
  misc_feature 1..30: note = Hypo
  source 1..30: mol_type = genomic DNA

SEQ ID NO: 117225 - DNA, 30 bp, Homo sapiens; identical to SEQ ID NO: 39426
  misc_feature 1..30: note = chr2:6809103-6809133
  misc_feature 1..30: note = Hypo
  source 1..30: mol_type = genomic DNA

SEQ ID NO: 117226 - DNA, 30 bp, Homo sapiens; identical to SEQ ID NO: 86755
  misc_feature 1..30: note = chr2:6859708-6859738
  misc_feature 1..30: note = Hypo
  source 1..30: mol_type = genomic DNA

SEQ ID NO: 117227 - DNA, 35 bp, Homo sapiens; identical to SEQ ID NO: 86766
  misc_feature 1..35: note = chr2:6936496-6936531
  misc_feature 1..35: note = Hypo
  source 1..35: mol_type = genomic DNA

SEQ ID NO: 117228 - DNA, 86 bp, Homo sapiens; identical to SEQ ID NO: 86770
  misc_feature 1..86: note = chr2:6989494-6989580
  misc_feature 1..86: note = Hypo
  source 1..86: mol_type = genomic DNA

SEQ ID NO: 117229 - DNA, 36 bp, Homo sapiens; identical to SEQ ID NO: 86773
  misc_feature 1..36: note = chr2:7005433-7005469
  misc_feature 1..36: note = Hyper
  source 1..36: mol_type = genomic DNA

SEQ ID NO: 117230 - DNA, 152 bp, Homo sapiens; identical to SEQ ID NO: 86777
  misc_feature 1..152: note = chr2:7024377-7024529
  misc_feature 1..152: note = Hypo
  source 1..152: mol_type = genomic DNA

SEQ ID NO: 117231 - DNA, 184 bp, Homo sapiens; identical to SEQ ID NO: 86780
  misc_feature 1..184: note = chr2:7035292-7035476
  misc_feature 1..184: note = Hypo
  source 1..184: mol_type = genomic DNA

SEQ ID NO: 117232 - DNA, 64 bp, Homo sapiens; identical to SEQ ID NO: 86781
  misc_feature 1..64: note = chr2:7036178-7036242
  misc_feature 1..64: note = Hypo
  source 1..64: mol_type = genomic DNA

SEQ ID NO: 117233 - DNA, 187 bp, Homo sapiens; identical to SEQ ID NO: 86789
  misc_feature 1..187: note = chr2:7057229-7057416
  misc_feature 1..187: note = Hyper
  source 1..187: mol_type = genomic DNA

SEQ ID NO: 117234 - DNA, 325 bp, Homo sapiens; identical to SEQ ID NO: 86790
  misc_feature 1..325: note = chr2:7058053-7058378
  misc_feature 1..325: note = Hyper
  source 1..325: mol_type = genomic DNA

SEQ ID NO: 117235 - DNA, 152 bp, Homo sapiens; identical to SEQ ID NO: 86800
  misc_feature 1..152: note = chr2:7164448-7164600
  misc_feature 1..152: note = Hypo
  source 1..152: mol_type = genomic DNA

SEQ ID NO: 117236 - DNA, 387 bp, Homo sapiens; identical to SEQ ID NO: 39430
  misc_feature 1..387: note = chr2:7172412-7172799
  misc_feature 1..387: note = Hypo
  source 1..387: mol_type = genomic DNA

SEQ ID NO: 117237 - DNA, 35 bp, Homo sapiens; identical to SEQ ID NO: 86805
  misc_feature 1..35: note = chr2:7185292-7185327
  misc_feature 1..35: note = Hypo
  source 1..35: mol_type = genomic DNA

SEQ ID NO: 117238 - DNA, 42 bp, Homo sapiens; identical to SEQ ID NO: 86806
  misc_feature 1..42: note = chr2:7190110-7190152
  misc_feature 1..42: note = Hypo
  source 1..42: mol_type = genomic DNA

SEQ ID NO: 117239 - DNA, 16 bp, Homo sapiens
  misc_feature 1..16: note = chr2:7237247-7237263
  misc_feature 1..16: note = Hypo
  source 1..16: mol_type = genomic DNA
ccgcccctcatggtgg

SEQ ID NO: 117240 - DNA, 127 bp, Homo sapiens; identical to SEQ ID NO: 86878
  misc_feature 1..127: note = chr2:7488706-7488833
  misc_feature 1..127: note = Hypo
  source 1..127: mol_type = genomic DNA

SEQ ID NO: 117241 - DNA, 636 bp, Homo sapiens
  misc_feature 1..636: note = chr2:7571090-7571726
  misc_feature 1..636: note = Hyper
  source 1..636: mol_type = genomic DNA
tgggctgcaggcctgcgagtggcaggcgcagcccggctgcaggagcgcggctggggctggccgctctcgctgccctctctccggaactgtttttttctgtcctggtctctgaaagccttattgattgctcaaagtgaacttctcagcccacggtttcctcacccccggggcagcttgcatttcctctgccgcggcctctgtcgcctcccctcccgcgcgcctcggccttttacatttcaaatgctcgacagctgggccaacttctgcttccgcccaaagaagggctctttgccgctcacaatggccggccagtggcgcgggggctcttttctctccagctgtgagagaggctttttcaaaggccggggggaagctgccgtccagctgcgcgcctggccgcgggggccctgcatgctaatcagcggcgcgcagagccgggctccgtggggccgcgcagatgcgccctctccgcccgcagagccttccgggcaggtgaggccaggccggccgggcgtcaccgcaggtgtgcactccgcgcgcgcactcagctcgctttggtgtttctccaggccctcagggcccaccactcctagtcccagcccacaggtctgcccgagtctccgcccaggaatgtgg

SEQ ID NO: 117242 - DNA, 40 bp, Homo sapiens; identical to SEQ ID NO: 86895
  misc_feature 1..40: note = chr2:7605196-7605236
  misc_feature 1..40: note = Hypo
  source 1..40: mol_type = genomic DNA

SEQ ID NO: 117243 - DNA, 54 bp, Homo sapiens; identical to SEQ ID NO: 86897
  misc_feature 1..54: note = chr2:7739638-7739692
  misc_feature 1..54: note = Hypo
  source 1..54: mol_type = genomic DNA

SEQ ID NO: 117244 - DNA, 213 bp, Homo sapiens; identical to SEQ ID NO: 86920
  misc_feature 1..213: note = chr2:8499980-8500193
  misc_feature 1..213: note = Hypo
  source 1..213: mol_type = genomic DNA

SEQ ID NO: 117245 - DNA, 142 bp, Homo sapiens; identical to SEQ ID NO: 86944
  misc_feature 1..142: note = chr2:8658308-8658450
  misc_feature 1..142: note = Hypo
  source 1..142: mol_type = genomic DNA

SEQ ID NO: 117246 - DNA, 37 bp, Homo sapiens; identical to SEQ ID NO: 86954
  misc_feature 1..37: note = chr2:8731409-8731446
  misc_feature 1..37: note = Hypo
  source 1..37: mol_type = genomic DNA

SEQ ID NO: 117247 - DNA, 155 bp, Homo sapiens; identical to SEQ ID NO: 86955
  misc_feature 1..155: note = chr2:8751867-8752022
  misc_feature 1..155: note = Hypo
  source 1..155: mol_type = genomic DNA

SEQ ID NO: 117248 - DNA, 118 bp, Homo sapiens; identical to SEQ ID NO: 86957
  misc_feature 1..118: note = chr2:8768562-8768680
  misc_feature 1..118: note = Hypo
  source 1..118: mol_type = genomic DNA

SEQ ID NO: 117249 - DNA, 171 bp, Homo sapiens; identical to SEQ ID NO: 14378
  misc_feature 1..171: note = chr2:8833973-8834144
  misc_feature 1..171: note = Hypo
  source 1..171: mol_type = genomic DNA

SEQ ID NO: 117250 - DNA, 174 bp, Homo sapiens; identical to SEQ ID NO: 86962
  misc_feature 1..174: note = chr2:8834722-8834896
  misc_feature 1..174: note = Hypo
  source 1..174: mol_type = genomic DNA

SEQ ID NO: 117251 - DNA, 28 bp, Homo sapiens
  misc_feature 1..28: note = chr2:8835589-8835617
  misc_feature 1..28: note = Hypo
  source 1..28: mol_type = genomic DNA
gaccccctgcgcccggcctgaccacaca

SEQ ID NO: 117252 - DNA, 30 bp, Homo sapiens
  misc_feature 1..30: note = chr2:8849857-8849887
  misc_feature 1..30: note = Hypo
  source 1..30: mol_type = genomic DNA
ctgctgagccagtagcgttgaaccctctca

SEQ ID NO: 117253 - DNA, 30 bp, Homo sapiens; identical to SEQ ID NO: 39438
  misc_feature 1..30: note = chr2:8860441-8860471
  misc_feature 1..30: note = Hypo
  source 1..30: mol_type = genomic DNA

SEQ ID NO: 117254 - DNA, 125 bp, Homo sapiens; identical to SEQ ID NO: 86971
  misc_feature 1..125: note = chr2:8870339-8870464
  misc_feature 1..125: note = Hypo
  source 1..125: mol_type = genomic DNA

SEQ ID NO: 117255 - DNA, 260 bp, Homo sapiens; identical to SEQ ID NO: 86985
  misc_feature 1..260: note = chr2:8978038-8978298
  misc_feature 1..260: note = Hypo
  source 1..260: mol_type = genomic DNA

SEQ ID NO: 117256 - DNA, 321 bp, Homo sapiens; identical to SEQ ID NO: 86990
  misc_feature 1..321: note = chr2:9134235-9134556
  misc_feature 1..321: note = Hypo
  source 1..321: mol_type = genomic DNA

SEQ ID NO: 117257 - DNA, 220 bp, Homo sapiens; identical to SEQ ID NO: 86991
  misc_feature 1..220: note = chr2:9143144-9143364
  misc_feature 1..220: note = Hyper
  source 1..220: mol_type = genomic DNA

SEQ ID NO: 117258 - DNA, 84 bp, Homo sapiens; identical to SEQ ID NO: 86995
  misc_feature 1..84: note = chr2:9242700-9242784
  misc_feature 1..84: note = Hypo
  source 1..84: mol_type = genomic DNA

SEQ ID NO: 117259 - DNA, 30 bp, Homo sapiens; identical to SEQ ID NO: 86996
  misc_feature 1..30: note = chr2:9244301-9244331
  misc_feature 1..30: note = Hypo
  source 1..30: mol_type = genomic DNA

SEQ ID NO: 117260 - DNA, 117 bp, Homo sapiens; identical to SEQ ID NO: 86998
  misc_feature 1..117: note = chr2:9347560-9347677
  misc_feature 1..117: note = Hyper
  source 1..117: mol_type = genomic DNA

SEQ ID NO: 117261 - DNA, 30 bp, Homo sapiens; identical to SEQ ID NO: 86999
  misc_feature 1..30: note = chr2:9347993-9348023
  misc_feature 1..30: note = Hyper
  source 1..30: mol_type = genomic DNA

SEQ ID NO: 117262 - DNA, 180 bp, Homo sapiens; identical to SEQ ID NO: 14383
  misc_feature 1..180: note = chr2:9352635-9352815
  misc_feature 1..180: note = Hypo
  source 1..180: mol_type = genomic DNA

SEQ ID NO: 117263 - DNA, 18 bp, Homo sapiens
  misc_feature 1..18: note = chr2:9580845-9580863
  misc_feature 1..18: note = Hypo
  source 1..18: mol_type = genomic DNA
tagtagtaggaggtacga

SEQ ID NO: 117264 - DNA, 30 bp, Homo sapiens; identical to SEQ ID NO: 87053
  misc_feature 1..30: note = chr2:9784906-9784936
  misc_feature 1..30: note = Hypo
  source 1..30: mol_type = genomic DNA

SEQ ID NO: 117265 - DNA, 30 bp, Homo sapiens; identical to SEQ ID NO: 87056
  misc_feature 1..30: note = chr2:9809292-9809322
  misc_feature 1..30: note = Hypo
  source 1..30: mol_type = genomic DNA

SEQ ID NO: 117266 - DNA, 30 bp, Homo sapiens; identical to SEQ ID NO: 87072
  misc_feature 1..30: note = chr2:9908748-9908778
  misc_feature 1..30: note = Hypo
  source 1..30: mol_type = genomic DNA

SEQ ID NO: 117267 - DNA, 30 bp, Homo sapiens; identical to SEQ ID NO: 87073
  misc_feature 1..30: note = chr2:9921447-9921477
  misc_feature 1..30: note = Hypo
  source 1..30: mol_type = genomic DNA

SEQ ID NO: 117268 - DNA, 142 bp, Homo sapiens; identical to SEQ ID NO: 87074
  misc_feature 1..142: note = chr2:9921692-9921834
  misc_feature 1..142: note = Hypo
  source 1..142: mol_type = genomic DNA

SEQ ID NO: 117269 - DNA, 30 bp, Homo sapiens; identical to SEQ ID NO: 87077
  misc_feature 1..30: note = chr2:9949207-9949237
  misc_feature 1..30: note = Hypo
  source 1..30: mol_type = genomic DNA

SEQ ID NO: 117270 - DNA, 30 bp, Homo sapiens; identical to SEQ ID NO: 87078
  misc_feature 1..30: note = chr2:9949649-9949679
  misc_feature 1..30: note = Hypo
  source 1..30: mol_type = genomic DNA

SEQ ID NO: 117271 - DNA, 590 bp, Homo sapiens; identical to SEQ ID NO: 87082
  misc_feature 1..590: note = chr2:9960219-9960809
  misc_feature 1..590: note = Hypo
  source 1..590: mol_type = genomic DNA

SEQ ID NO: 117272 - DNA, 24 bp, Homo sapiens
  misc_feature 1..24: note = chr2:10115715-10115739
  misc_feature 1..24: note = Hypo
  source 1..24: mol_type = genomic DNA
taaacacaggccgggcgcggtggc

SEQ ID NO: 117273 - DNA, 120 bp, Homo sapiens; identical to SEQ ID NO: 84795
  misc_feature 1..120: note = chr2:10151722-10151842
  misc_feature 1..120: note = Hypo
  source 1..120: mol_type = genomic DNA

SEQ ID NO: 117274 - DNA, 120 bp, Homo sapiens; identical to SEQ ID NO: 84796
  misc_feature 1..120: note = chr2:10151902-10152022
  misc_feature 1..120: note = Hypo
  source 1..120: mol_type = genomic DNA

SEQ ID NO: 117275 - DNA, 120 bp, Homo sapiens; identical to SEQ ID NO: 84798
  misc_feature 1..120: note = chr2:10153048-10153168
  misc_feature 1..120: note = Hypo
  source 1..120: mol_type = genomic DNA

SEQ ID NO: 117276 - DNA, 240 bp, Homo sapiens; identical to SEQ ID NO: 84799
  misc_feature 1..240: note = chr2:10153228-10153468
  misc_feature 1..240: note = Hypo
  source 1..240: mol_type = genomic DNA

SEQ ID NO: 117277 - DNA, 300 bp, Homo sapiens; identical to SEQ ID NO: 84800
  misc_feature 1..300: note = chr2:10153888-10154188
  misc_feature 1..300: note = Hypo
  source 1..300: mol_type = genomic DNA

SEQ ID NO: 117278 - DNA, 120 bp, Homo sapiens; identical to SEQ ID NO: 84801
  misc_feature 1..120: note = chr2:10154908-10155028
  misc_feature 1..120: note = Hypo
  source 1..120: mol_type = genomic DNA

SEQ ID NO: 117279 - DNA, 120 bp, Homo sapiens; identical to SEQ ID NO: 84802
  misc_feature 1..120: note = chr2:10155268-10155388
  misc_feature 1..120: note = Hypo
  source 1..120: mol_type = genomic DNA

SEQ ID NO: 117280 - DNA, 316 bp, Homo sapiens; identical to SEQ ID NO: 84803
  misc_feature 1..316: note = chr2:10156333-10156649
  misc_feature 1..316: note = Hypo
  source 1..316: mol_type = genomic DNA

SEQ ID NO: 117281 - DNA, 522 bp, Homo sapiens
  misc_feature 1..522: note = chr2:10182780-10183302
  misc_feature 1..522: note = Hyper
  source 1..522: mol_type = genomic DNA
aaccacaccaagagacgcgagcaaccgaaatatagggagaaaaaaaaaggtgccctggacagcgggctagatgtctcctgcaggctcgaggacttcccggagggggcggcgttttctcggggcctgggaagaatgggcgggtttcagcgggcgccttctgggtgactgcccgtttcggcttcccctgaccccgtaacagagcggaagaggcccagagacgccagaggaggggcgtcagcgggacactcaggccaataagctctgactcccgctgtctgcaaaaatgaccggatgcaggaatgtcacctagaaccggccagctttccgacctctccggtcaaggacgcattcctaagagacgaagggagaatgacagaagttaaaaacaaccaaacaaaagccaggttgaggcctctaggtgggtctccgctaccgatggattcagccggtggggctgcaggaggttcctataagcgtggtcccctctccccgcaccgagtccggccccggccctgggatttc

SEQ ID NO: 117282 - DNA, 30 bp, Homo sapiens; identical to SEQ ID NO: 84814
  misc_feature 1..30: note = chr2:10219664-10219694
  misc_feature 1..30: note = Hyper
  source 1..30: mol_type = genomic DNA

SEQ ID NO: 117283 - DNA, 247 bp, Homo sapiens
  misc_feature 1..247: note = chr2:10220760-10221007
  misc_feature 1..247: note = Hyper
  source 1..247: mol_type = genomic DNA
accctgcggggggcccggctgagtttgttcatttatggaaacgctccccagacgacgctcgccgggcccgtgggaggccgcgggagcttggggggacttcccaaagcctgagccccctagcgatgcgcggggtgggcgggggaaagaccctgagggctgcgcgcgctgcgttcgcgaggtccggccgtcagtgcgccccgacctttcagtgtccgccaggcctgagacgccccgggagggaaggggc

SEQ ID NO: 117284 - DNA, 30 bp, Homo sapiens; identical to SEQ ID NO: 39451
  misc_feature 1..30: note = chr2:10238076-10238106
  misc_feature 1..30: note = Hypo
  source 1..30: mol_type = genomic DNA

SEQ ID NO: 117285 - DNA, 29 bp, Homo sapiens
  misc_feature 1..29: note = chr2:10257577-10257606
  misc_feature 1..29: note = Hypo
  source 1..29: mol_type = genomic DNA
gctgggattacaggcgtgagccactgcgc

SEQ ID NO: 117286 - DNA, 30 bp, Homo sapiens; identical to SEQ ID NO: 39452
  misc_feature 1..30: note = chr2:10278078-10278108
  misc_feature 1..30: note = Hypo
  source 1..30: mol_type = genomic DNA

SEQ ID NO: 117287 - DNA, 68 bp, Homo sapiens; identical to SEQ ID NO: 84821
  misc_feature 1..68: note = chr2:10281126-10281194
  misc_feature 1..68: note = Hypo
  source 1..68: mol_type = genomic DNA

SEQ ID NO: 117288 - DNA, 30 bp, Homo sapiens; identical to SEQ ID NO: 84822
  misc_feature 1..30: note = chr2:10303018-10303048
  misc_feature 1..30: note = Hypo
  source 1..30: mol_type = genomic DNA

SEQ ID NO: 117289 - DNA, 70 bp, Homo sapiens; identical to SEQ ID NO: 84823
  misc_feature 1..70: note = chr2:10306845-10306915
  misc_feature 1..70: note = Hypo
  source 1..70: mol_type = genomic DNA

SEQ ID NO: 117290 - DNA, 49 bp, Homo sapiens; identical to SEQ ID NO: 84825
  misc_feature 1..49: note = chr2:10337316-10337365
  misc_feature 1..49: note = Hypo
  source 1..49: mol_type = genomic DNA

SEQ ID NO: 117291 - DNA, 217 bp, Homo sapiens; identical to SEQ ID NO: 84826
  misc_feature 1..217: note = chr2:10344641-10344858
  misc_feature 1..217: note = Hypo
  source 1..217: mol_type = genomic DNA

SEQ ID NO: 117292 - DNA, 22 bp, Homo sapiens
  misc_feature 1..22: note = chr2:10368174-10368196
  misc_feature 1..22: note = Hypo
  source 1..22: mol_type = genomic DNA
ccgtgcccggccagagctgcct

SEQ ID NO: 117293 - DNA, 30 bp, Homo sapiens; identical to SEQ ID NO: 39455
  misc_feature 1..30: note = chr2:10408242-10408272
  misc_feature 1..30: note = Hypo
  source 1..30: mol_type = genomic DNA

SEQ ID NO: 117294 - DNA, 316 bp, Homo sapiens; identical to SEQ ID NO: 84832
  misc_feature 1..316: note = chr2:10444358-10444674
  misc_feature 1..316: note = Hyper
  source 1..316: mol_type = genomic DNA

SEQ ID NO: 117295 - DNA, 30 bp, Homo sapiens; identical to SEQ ID NO: 84836
  misc_feature 1..30: note = chr2:10505694-10505724
  misc_feature 1..30: note = Hypo
  source 1..30: mol_type = genomic DNA

SEQ ID NO: 117296 - DNA, 30 bp, Homo sapiens; identical to SEQ ID NO: 39456
  misc_feature 1..30: note = chr2:10526275-10526305
  misc_feature 1..30: note = Hypo
  source 1..30: mol_type = genomic DNA

SEQ ID NO: 117297 - DNA, 30 bp, Homo sapiens; identical to SEQ ID NO: 39457
  misc_feature 1..30: note = chr2:10577316-10577346
  misc_feature 1..30: note = Hypo
  source 1..30: mol_type = genomic DNA

SEQ ID NO: 117298 - DNA, 126 bp, Homo sapiens; identical to SEQ ID NO: 84871
  misc_feature 1..126: note = chr2:10589172-10589298
  misc_feature 1..126: note = Hyper
  source 1..126: mol_type = genomic DNA

SEQ ID NO: 117299 - DNA, 172 bp, Homo sapiens; identical to SEQ ID NO: 84873
  misc_feature 1..172: note = chr2:10600641-10600813
  misc_feature 1..172: note = Hypo
  source 1..172: mol_type = genomic DNA

SEQ ID NO: 117300 - DNA, 30 bp, Homo sapiens; identical to SEQ ID NO: 84882
  misc_feature 1..30: note = chr2:10634441-10634471
  misc_feature 1..30: note = Hypo
  source 1..30: mol_type = genomic DNA

SEQ ID NO: 117301 - DNA, 264 bp, Homo sapiens
  misc_feature 1..264: note = chr2:10688798-10689062
  misc_feature 1..264: note = Hyper
  source 1..264: mol_type = genomic DNA
tttccttgctccaggcgccctcagtgcttgcagcctggccgcgtgtgcgcctctgctgggatgacccggtcctgttgccccggggccccatcggaaggccggctttccccaccttgagcggctcggcatctgccggctgaccccagcccttccttcctggaagcccttcctttctcggactctgacttgccacatggctttgctcagatgctcagtcggcgggcagcagatgccttaagcagccactgccgggtggatgtccca

SEQ ID NO: 117302 - DNA, 44 bp, Homo sapiens; identical to SEQ ID NO: 27049
  misc_feature 1..44: note = chr2:10861191-10861235
  misc_feature 1..44: note = Hyper
  source 1..44: mol_type = genomic DNA

SEQ ID NO: 117303 - DNA, 56 bp, Homo sapiens; identical to SEQ ID NO: 84912
  misc_feature 1..56: note = chr2:10862045-10862101
  misc_feature 1..56: note = Hyper
  source 1..56: mol_type = genomic DNA

SEQ ID NO: 117304 - DNA, 30 bp, Homo sapiens; identical to SEQ ID NO: 39459
  misc_feature 1..30: note = chr2:10911393-10911423
  misc_feature 1..30: note = Hypo
  source 1..30: mol_type = genomic DNA

SEQ ID NO: 117305 - DNA, 30 bp, Homo sapiens; identical to SEQ ID NO: 84914
  misc_feature 1..30: note = chr2:10916525-10916555
  misc_feature 1..30: note = Hypo
  source 1..30: mol_type = genomic DNA

SEQ ID NO: 117306 - DNA, 226 bp, Homo sapiens; identical to SEQ ID NO: 39460
  misc_feature 1..226: note = chr2:10924927-10925153
  misc_feature 1..226: note = Hypo
  source 1..226: mol_type = genomic DNA

SEQ ID NO: 117307 - DNA, 30 bp, Homo sapiens; identical to SEQ ID NO: 84922
  misc_feature 1..30: note = chr2:11018229-11018259
  misc_feature 1..30: note = Hypo
  source 1..30: mol_type = genomic DNA

SEQ ID NO: 117308 - DNA, 289 bp, Homo sapiens; identical to SEQ ID NO: 84926
  misc_feature 1..289: note = chr2:11051843-11052132
  misc_feature 1..289: note = Hyper
  source 1..289: mol_type = genomic DNA

SEQ ID NO: 117309 - DNA, 385 bp, Homo sapiens
  misc_feature 1..385: note = chr2:11052361-11052746
  misc_feature 1..385: note = Hyper
  source 1..385: mol_type = genomic DNA
ggtgcatgcctcccccgcggcgcgcccccgcaggctgctgcccgctgtgaccgcccttccccgcaggcgggcgccggccaggctctccccgagatcagcgcacgggtggcacccgccggacccccagcggcagcggcggcggcggctgcagggggcgcggggcggaggctgcgagggcgcgcgcggggaggatggacgggtccggggagcgcagcctcccggagccgggcagccagagctccgctgccagcgacgacatagagatagtcgtcaacgtggggggcgtgcggcaggtgctgtacggggacctcctcagtcagtaccctgagacccggctggcggagctcatcaactgcttggctgggggctacgacaccatcttctc

SEQ ID NO: 117310 - DNA, 315 bp, Homo sapiens; identical to SEQ ID NO: 84938
  misc_feature 1..315: note = chr2:11269903-11270218
  misc_feature 1..315: note = Hyper
  source 1..315: mol_type = genomic DNA

SEQ ID NO: 117311 - DNA, 32 bp, Homo sapiens; identical to SEQ ID NO: 84943
  misc_feature 1..32: note = chr2:11312055-11312087
  misc_feature 1..32: note = Hypo
  source 1..32: mol_type = genomic DNA

SEQ ID NO: 117312 - DNA, 62 bp, Homo sapiens; identical to SEQ ID NO: 84960
  misc_feature 1..62: note = chr2:11485462-11485524
  misc_feature 1..62: note = Hyper
  source 1..62: mol_type = genomic DNA

SEQ ID NO: 117313 - DNA, 30 bp, Homo sapiens; identical to SEQ ID NO: 84962
  misc_feature 1..30: note = chr2:11487939-11487969
  misc_feature 1..30: note = Hypo
  source 1..30: mol_type = genomic DNA

SEQ ID NO: 117314 - DNA, 67 bp, Homo sapiens; identical to SEQ ID NO: 84966
  misc_feature 1..67: note = chr2:11537219-11537286
  misc_feature 1..67: note = Hypo
  source 1..67: mol_type = genomic DNA

SEQ ID NO: 117315 - DNA, 93 bp, Homo sapiens; identical to SEQ ID NO: 84967
  misc_feature 1..93: note = chr2:11538637-11538730
  misc_feature 1..93: note = Hypo
  source 1..93: mol_type = genomic DNA

SEQ ID NO: 117316 - DNA, 32 bp, Homo sapiens; identical to SEQ ID NO: 84968
  misc_feature 1..32: note = chr2:11538910-11538942
  misc_feature 1..32: note = Hypo
  source 1..32: mol_type = genomic DNA

SEQ ID NO: 117317 - DNA, 690 bp, Homo sapiens; identical to SEQ ID NO: 84973
  misc_feature 1..690: note = chr2:11622659-11623349
  misc_feature 1..690: note = Hyper
  source 1..690: mol_type = genomic DNA

SEQ ID NO: 117318 - DNA, 90 bp, Homo sapiens; identical to SEQ ID NO: 84974
  misc_feature 1..90: note = chr2:11623469-11623559
  misc_feature 1..90: note = Hyper
  source 1..90: mol_type = genomic DNA

SEQ ID NO: 117319 - DNA, 171 bp, Homo sapiens; identical to SEQ ID NO: 84976
  misc_feature 1..171: note = chr2:11678128-11678299
  misc_feature 1..171: note = Hypo
  source 1..171: mol_type = genomic DNA

SEQ ID NO: 117320 - DNA, 181 bp, Homo sapiens; identical to SEQ ID NO: 84978
  misc_feature 1..181: note = chr2:11722451-11722632
  misc_feature 1..181: note = Hypo
  source 1..181: mol_type = genomic DNA

SEQ ID NO: 117321 - DNA, 375 bp, Homo sapiens
  misc_feature 1..375: note = chr2:11809912-11810287
  misc_feature 1..375: note = Hyper
  source 1..375: mol_type = genomic DNA
gcacgaagtagtagccgcggcagcccaggtcgccgaagacccaggggtagtggaaccacacgaagctgtagagctccaccggcacgccgaccagcagcagcagcaggcccgcgagcgccaggctgagcacgtggtggcgcaggcgccccgcgcgcccggcccgcgccttcagcaccacgtgcgcggacagcgcattgcccgccgcgcccagcgcccagatgagtgcgtagagcgcggtgaacagcaccttggcccagaggcgagtgtccacgcccagccgggcgtccaggctcagccccgggttggagctgggccgcgggggccgcgggctgctggtttccatcccgctcccgcggccggcgctccctccctctc

SEQ ID NO: 117322 - DNA, 147 bp, Homo sapiens; identical to SEQ ID NO: 84982
  misc_feature 1..147: note = chr2:11886072-11886219
  misc_feature 1..147: note = Hypo
  source 1..147: mol_type = genomic DNA

SEQ ID NO: 117323 - DNA, 60 bp, Homo sapiens; identical to SEQ ID NO: 85022
  misc_feature 1..60: note = chr2:11986834-11986894
  misc_feature 1..60: note = Hypo
  source 1..60: mol_type = genomic DNA

SEQ ID NO: 117324 - DNA, 30 bp, Homo sapiens; identical to SEQ ID NO: 85037
  misc_feature 1..30: note = chr2:12072116-12072146
  misc_feature 1..30: note = Hypo
  source 1..30: mol_type = genomic DNA

SEQ ID NO: 117325 - DNA, 59 bp, Homo sapiens; identical to SEQ ID NO: 85041
  misc_feature 1..59: note = chr2:12092493-12092552
  misc_feature 1..59: note = Hypo
  source 1..59: mol_type = genomic DNA

SEQ ID NO: 117326 - DNA, 152 bp, Homo sapiens; identical to SEQ ID NO: 85048
  misc_feature 1..152: note = chr2:12103180-12103332
  misc_feature 1..152: note = Hypo
  source 1..152: mol_type = genomic DNA

SEQ ID NO: 117327 - DNA, 30 bp, Homo sapiens; identical to SEQ ID NO: 85066
  misc_feature 1..30: note = chr2:12179974-12180004
  misc_feature 1..30: note = Hypo
  source 1..30: mol_type = genomic DNA

SEQ ID NO: 117328 - DNA, 30 bp, Homo sapiens; identical to SEQ ID NO: 85073
  misc_feature 1..30: note = chr2:12222158-12222188
  misc_feature 1..30: note = Hypo
  source 1..30: mol_type = genomic DNA

SEQ ID NO: 117329 - DNA, 30 bp, Homo sapiens; identical to SEQ ID NO: 85074
  misc_feature 1..30: note = chr2:12246101-12246131
  misc_feature 1..30: note = Hypo
  source 1..30: mol_type = genomic DNA

SEQ ID NO: 117330 - DNA, 30 bp, Homo sapiens; identical to SEQ ID NO: 85077
  misc_feature 1..30: note = chr2:12284474-12284504
  misc_feature 1..30: note = Hypo
  source 1..30: mol_type = genomic DNA

SEQ ID NO: 117331 - DNA, 30 bp, Homo sapiens; identical to SEQ ID NO: 39467
  misc_feature 1..30: note = chr2:12303872-12303902
  misc_feature 1..30: note = Hypo
  source 1..30: mol_type = genomic DNA

SEQ ID NO: 117332 - DNA, 26 bp, Homo sapiens
  misc_feature 1..26: note = chr2:12351331-12351357
  misc_feature 1..26: note = Hypo
  source 1..26: mol_type = genomic DNA
gtgagccactgcgtccagccgatttc

SEQ ID NO: 117333 - DNA, 76 bp, Homo sapiens; identical to SEQ ID NO: 39468
  misc_feature 1..76: note = chr2:12355766-12355842
  misc_feature 1..76: note = Hypo
  source 1..76: mol_type = genomic DNA

SEQ ID NO: 117334 - DNA, 170 bp, Homo sapiens; identical to SEQ ID NO: 85083
  misc_feature 1..170: note = chr2:12471019-12471189
  misc_feature 1..170: note = Hypo
  source 1..170: mol_type = genomic DNA

SEQ ID NO: 117335 - DNA, 30 bp, Homo sapiens; identical to SEQ ID NO: 85087
  misc_feature 1..30: note = chr2:12608741-12608771
  misc_feature 1..30: note = Hypo
  source 1..30: mol_type = genomic DNA

SEQ ID NO: 117336 - DNA, 30 bp, Homo sapiens; identical to SEQ ID NO: 85093
  misc_feature 1..30: note = chr2:12682673-12682703
  misc_feature 1..30: note = Hypo
  source 1..30: mol_type = genomic DNA

SEQ ID NO: 117337 - DNA, 29 bp, Homo sapiens
  misc_feature 1..29: note = chr2:12750064-12750093
  misc_feature 1..29: note = Hypo
  source 1..29: mol_type = genomic DNA
aaaaaaaagcaaatcgaacttgtagaagg

SEQ ID NO: 117338 - DNA, 68 bp, Homo sapiens; identical to SEQ ID NO: 85137
  misc_feature 1..68: note = chr2:12856481-12856549
  misc_feature 1..68: note = Hyper
  source 1..68: mol_type = genomic DNA

SEQ ID NO: 117339 - DNA, 537 bp, Homo sapiens; identical to SEQ ID NO: 85138
  misc_feature 1..537: note = chr2:12858144-12858681
  misc_feature 1..537: note = Hyper
  source 1..537: mol_type = genomic DNA

SEQ ID NO: 117340 - DNA, 32 bp, Homo sapiens; identical to SEQ ID NO: 85249
  misc_feature 1..32: note = chr2:14487999-14488031
  misc_feature 1..32: note = Hypo
  source 1..32: mol_type = genomic DNA

SEQ ID NO: 117341 - DNA, 33 bp, Homo sapiens; identical to SEQ ID NO: 85262
  misc_feature 1..33: note = chr2:14772249-14772282
  misc_feature 1..33: note = Hyper
  source 1..33: mol_type = genomic DNA

SEQ ID NO: 117342 - DNA, 226 bp, Homo sapiens; identical to SEQ ID NO: 85263
  misc_feature 1..226: note = chr2:14772565-14772791
  misc_feature 1..226: note = Hyper
  source 1..226: mol_type = genomic DNA

SEQ ID NO: 117343 - DNA, 30 bp, Homo sapiens; identical to SEQ ID NO: 27055
  misc_feature 1..30: note = chr2:14773043-14773073
  misc_feature 1..30: note = Hyper
  source 1..30: mol_type = genomic DNA

SEQ ID NO: 117344 - DNA, 135 bp, Homo sapiens; identical to SEQ ID NO: 85265
  misc_feature 1..135: note = chr2:14773907-14774042
  misc_feature 1..135: note = Hyper
  source 1..135: mol_type = genomic DNA

SEQ ID NO: 117345 - DNA, 120 bp, Homo sapiens; identical to SEQ ID NO: 85266
  misc_feature 1..120: note = chr2:14774564-14774684
  misc_feature 1..120: note = Hyper
  source 1..120: mol_type = genomic DNA

SEQ ID NO: 117346 - DNA, 348 bp, Homo sapiens; identical to SEQ ID NO: 85267
  misc_feature 1..348: note = chr2:14774939-14775287
  misc_feature 1..348: note = Hyper
  source 1..348: mol_type = genomic DNA

SEQ ID NO: 117347 - DNA, 296 bp, Homo sapiens; identical to SEQ ID NO: 85268
  misc_feature 1..296: note = chr2:14775526-14775822
  misc_feature 1..296: note = Hyper
  source 1..296: mol_type = genomic DNA

SEQ ID NO: 117348 - DNA, 30 bp, Homo sapiens; identical to SEQ ID NO: 85309
  misc_feature 1..30: note = chr2:15579677-15579707
  misc_feature 1..30: note = Hypo
  source 1..30: mol_type = genomic DNA

SEQ ID NO: 117349 - DNA, 30 bp, Homo sapiens; identical to SEQ ID NO: 39470
  misc_feature 1..30: note = chr2:15960211-15960241
  misc_feature 1..30: note = Hypo
  source 1..30: mol_type = genomic DNA

SEQ ID NO: 117350 - DNA, 30 bp, Homo sapiens; identical to SEQ ID NO: 85318
  misc_feature 1..30: note = chr2:15991627-15991657
  misc_feature 1..30: note = Hypo
  source 1..30: mol_type = genomic DNA

SEQ ID NO: 117351 - DNA, 114 bp, Homo sapiens; identical to SEQ ID NO: 85323
  misc_feature 1..114: note = chr2:16080876-16080990
  misc_feature 1..114: note = Hyper
  source 1..114: mol_type = genomic DNA

SEQ ID NO: 117352 - DNA, 105 bp, Homo sapiens; identical to SEQ ID NO: 85324
  misc_feature 1..105: note = chr2:16081299-16081404
  misc_feature 1..105: note = Hyper
  source 1..105: mol_type = genomic DNA

SEQ ID NO: 117353 - DNA, 1355 bp, Homo sapiens; identical to SEQ ID NO: 85325
  misc_feature 1..1355: note = chr2:16081656-16083011
  misc_feature 1..1355: note = Hyper
  source 1..1355: mol_type = genomic DNA

SEQ ID NO: 117354 - DNA, 30 bp, Homo sapiens; identical to SEQ ID NO: 85340
  misc_feature 1..30: note = chr2:16210239-16210269
  misc_feature 1..30: note = Hypo
  source 1..30: mol_type = genomic DNA

SEQ ID NO: 117355 - DNA, 77 bp, Homo sapiens; identical to SEQ ID NO: 85375
  misc_feature 1..77: note = chr2:16689362-16689439
  misc_feature 1..77: note = Hyper
  source 1..77: mol_type = genomic DNA

SEQ ID NO: 117356 - DNA, 114 bp, Homo sapiens; identical to SEQ ID NO: 85376
  misc_feature 1..114: note = chr2:16705700-16705814
  misc_feature 1..114: note = Hypo
  source 1..114: mol_type = genomic DNA

SEQ ID NO: 117357 - DNA, 30 bp, Homo sapiens; identical to SEQ ID NO: 85404
  misc_feature 1..30: note = chr2:17090745-17090775
  misc_feature 1..30: note = Hypo
  source 1..30: mol_type = genomic DNA

SEQ ID NO: 117358 - DNA, 69 bp, Homo sapiens; identical to SEQ ID NO: 85406
  misc_feature 1..69: note = chr2:17097513-17097582
  misc_feature 1..69: note = Hypo
  source 1..69: mol_type = genomic DNA

SEQ ID NO: 117359 - DNA, 60 bp, Homo sapiens; identical to SEQ ID NO: 85570
  misc_feature 1..60: note = chr2:17699403-17699463
  misc_feature 1..60: note = Hyper
  source 1..60: mol_type = genomic DNA

SEQ ID NO: 117360 - DNA, 753 bp, Homo sapiens; identical to SEQ ID NO: 85594
  misc_feature 1..753: note = chr2:17719677-17720430
  misc_feature 1..753: note = Hyper
  source 1..753: mol_type = genomic DNA

SEQ ID NO: 117361 - DNA, 345 bp, Homo sapiens
  misc_feature 1..345: note = chr2:17721522-17721867
  misc_feature 1..345: note = Hyper
  source 1..345: mol_type = genomic DNA
taacaaagggtgggccgggggtcggctaggacagaaagcagcgggaaaagcggctccacgtgttccatctctggcctcggccttcagcccccaggttcggtaaccactgggcgtggcgagtccgggtaacccgcagtccctcgcgcccgtccaggtgcgggttgctccggtagccggactcccttttcctatatactttccttttgagcttttgctaaaatctggagacgtggaatccacccgcggaaactccgagcccctccgactgagcatgcgccatcgccaggcggcttttggtcacaggctcccgagttctcctagctggggctgcggagctggggggag

SEQ ID NO: 117362 - DNA, 30 bp, Homo sapiens; identical to SEQ ID NO: 85606
  misc_feature 1..30: note = chr2:17830678-17830708
  misc_feature 1..30: note = Hypo
  source 1..30: mol_type = genomic DNA

SEQ ID NO: 117363 - DNA, 284 bp, Homo sapiens; identical to SEQ ID NO: 85616
  misc_feature 1..284: note = chr2:18011883-18012167
  misc_feature 1..284: note = Hyper
  source 1..284: mol_type = genomic DNA

SEQ ID NO: 117364 - DNA, 1244 bp, Homo sapiens
  misc_feature 1..1244: note = chr2:18058914-18060158
  misc_feature 1..1244: note = Hyper
  source 1..1244: mol_type = genomic DNA
gggcagctggcagggcgtatgctgcgggtaggaacccagggaacactgggcgccttagcttggagcagctggctccgaggaattgttccacgtctgcacaacttaaaaatctgcagtttgggggcgggagggggagcgcgggggtgggtcccgaagcgtcccatttctcctcctggctgttaactgagcgctctcgctcagtgcagcgaggccagcgatgccttctggaccacacgctgtcctcgccgaggtcctggtttgttcctcaacgtcggctgaaggcatcgtcccctgacttcctcttccattcgtccttccgaaaggggacccgactggttcctcttctacatatgaggcgcatctgcttggtgcaaatgtccaagcacctcttctgactcggtgagtggaggaataagacaaagcatcttgttctgcactgtgcctgagtcttcaggcagcgggaccgatggcaaacattggcaggaactggagctatatgtactctccttcgcactttgttttaaaacaagtttgggcctcgcgatttcctgaggaaatccaggcaaattagcaaagtgtcgcttgggccgcgactttagaaaggcggttgccccagccgccggggccgcgggggaggtcatctttttcccgcagggccacggcgcttccggcccaggagggcgcgcaggtgggaggcgcggggcgcgctcctggtcccacccggacagcgcctgccgctccggggtgactctgcacttgggcctgggcgggggcgcgcggccggcagggcagcatctaggtctatgggtctgtccgcctgtctggcggtcggagccccgcagtcctcagccgcccgcgccctcggcccggggcgcccggctgcgggcccgaagcgaggggctggcggagctgcgaccaatggggcggcggccgagcggcgggccccgccccgtcccgtccggccccgccccgcccgcagctcccgggagcctcgctctagcggggcgggaccgacggacagaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtacctggctggcgtccccacctccctgcgcgctccggagacttctccgggcgaccctgcaactttaccgcgccttcccccacct

SEQ ID NO: 117365 - DNA, 309 bp, Homo sapiens; identical to SEQ ID NO: 85618
  misc_feature 1..309: note = chr2:18060617-18060926
  misc_feature 1..309: note = Hyper
  source 1..309: mol_type = genomic DNA

SEQ ID NO: 117366 - DNA, 68 bp, Homo sapiens; identical to SEQ ID NO: 39471
  misc_feature 1..68: note = chr2:18453289-18453357
  misc_feature 1..68: note = Hypo
  source 1..68: mol_type = genomic DNA

SEQ ID NO: 117367 - DNA, 307 bp, Homo sapiens
  misc_feature 1..307: note = chr2:19550039-19550346
  misc_feature 1..307: note = Hyper
  source 1..307: mol_type = genomic DNA
gccagcagggggcagcgtggctctgagcgtggaggccagggctggtccgcgccggcagggccagcctccagtgcccagttgggttcccgggcctcgaagttctagcccgcacaggactcaggagcgttcccggaggaggtggggatggggtggtgaaagcccagagcgttttaacttctgcatcccctgccgctttctcagccagcagggcccggcttgaggctgggatttttggtgcctgcagcagggaagcttatagtccagttgtcatccgcggccgccgcgctccgggcgctgaagctggaga

SEQ ID NO: 117368 - DNA, 536 bp, Homo sapiens
  misc_feature 1..536: note = chr2:19551120-19551656
  misc_feature 1..536: note = Hyper
  source 1..536: mol_type = genomic DNA
gtcatcctaataagacggggtggtaggagggggacacgctggcgtccagcagagaaacctggtcctctcaaagagaggacccaaccggtttcctgcgtttaggagggaaattacccatcctgcaatgcctgtaaaataaccgtttatttaatagttaaaaaaaaaaaaaactccagtgataaatgtccgttaccgatggtcagcataaagtgccaatcgcaatataacgcccggctcttggctggctgctccctcgcagtgtcgcggcagcggaggccgggccccctgcagaccccaggcccgaggtccccgtcccgctctcctagtcccggagcccacggccgccagctgagctgcaagagctgggagggggctgccccgcggtccctagggcaggaggctgaagcagatacagggattacacttttgcaggctccgggggtgggggcaggggcgggaggaggaggtgggagctgccagtgctaaggacttcgttgcctctcctctctccactcactctccgcagtcagagttac

SEQ ID NO: 117369 - DNA, 34 bp, Homo sapiens; identical to SEQ ID NO: 85688
  misc_feature 1..34: note = chr2:19555853-19555887
  misc_feature 1..34: note = Hyper
  source 1..34: mol_type = genomic DNA

SEQ ID NO: 117370 - DNA, 354 bp, Homo sapiens; identical to SEQ ID NO: 85689
  misc_feature 1..354: note = chr2:19556318-19556672
  misc_feature 1..354: note = Hyper
  source 1..354: mol_type = genomic DNA

SEQ ID NO: 117371 - DNA, 133 bp, Homo sapiens
  misc_feature 1..133: note = chr2:19556965-19557098
  misc_feature 1..133: note = Hyper
  source 1..133: mol_type = genomic DNA
gatggaacatctacacgccgccggtcgctgctagtcccctccagcgcttctcttccctagggggttgtgaacctgggacacctagccttgcacgtggttttgttccgcagagccaatgcgcagctcttagcct

SEQ ID NO: 117372 - DNA, 30 bp, Homo sapiens; identical to SEQ ID NO: 85691
  misc_feature 1..30: note = chr2:19557459-19557489
  misc_feature 1..30: note = Hyper
  source 1..30: mol_type = genomic DNA

SEQ ID NO: 117373 - DNA, 80 bp, Homo sapiens; identical to SEQ ID NO: 85692
  misc_feature 1..80: note = chr2:19557961-19558041
  misc_feature 1..80: note = Hyper
  source 1..80: mol_type = genomic DNA

SEQ ID NO: 117374 - DNA, 603 bp, Homo sapiens; identical to SEQ ID NO: 85693
  misc_feature 1..603: note = chr2:19558381-19558984
  misc_feature 1..603: note = Hyper
  source 1..603: mol_type = genomic DNA

SEQ ID NO: 117375 - DNA, 636 bp, Homo sapiens
  misc_feature 1..636: note = chr2:19561071-19561707
  misc_feature 1..636: note = Hyper
  source 1..636: mol_type = genomic DNA
ttgacaagggaaggacgcaggacacctaagagcaacaagggtactttttaagcgaggttacatgtgtttaggactcgcgaggacgtcacgtttcgaatttggtaaaagtcctcggtagctaggacccaacagttctgccctcctggaaacccaatgaaggtgacaaaactcccatctcattactgggagtccagcgcactccgccaccgcggctgcagcttctgctagctcggagcctgcggactccagccggcgcgaactccgccgcgactctttctggctctctcgctcactgccttcggggcggaaccgcgggcgccggagtggtcccagactcggctgggaccgggcagcctagaagaagggtcccctcagtagagaccaggcctccagctctccgtccggcgctccgctccacaacccgccagtcgatgtgaggtccgtcaagggagcgatccctccgtctgcccgggcttccgggctgtggaccgcactgaacccagtcccgcagcaagccctgctgccgccttttcctgggcacgcctgcggtggtgacggcccgctgctcatgtctccacgccaaaccccagcccctctcccgattcctgctccttggtaaagcgccccagcctgtct

SEQ ID NO: 117376 - DNA, 122 bp, Homo sapiens; identical to SEQ ID NO: 85696
  misc_feature 1..122: note = chr2:19563311-19563433
  misc_feature 1..122: note = Hyper
  source 1..122: mol_type = genomic DNA

SEQ ID NO: 117377 - DNA, 477 bp, Homo sapiens; identical to SEQ ID NO: 85730
  misc_feature 1..477: note = chr2:20068489-20068966
  misc_feature 1..477: note = Hyper
  source 1..477: mol_type = genomic DNA

SEQ ID NO: 117378 - DNA, 337 bp, Homo sapiens; identical to SEQ ID NO: 85739
  misc_feature 1..337: note = chr2:20212448-20212785
  misc_feature 1..337: note = Hyper
  source 1..337: mol_type = genomic DNA

SEQ ID NO: 117379 - DNA, 39 bp, Homo sapiens; identical to SEQ ID NO: 39472
  misc_feature 1..39: note = chr2:20253274-20253313
  misc_feature 1..39: note = Hypo
  source 1..39: mol_type = genomic DNA

SEQ ID NO: 117380 - DNA, 215 bp, Homo sapiens; identical to SEQ ID NO: 85750
  misc_feature 1..215: note = chr2:20431241-20431456
  misc_feature 1..215: note = Hypo
  source 1..215: mol_type = genomic DNA

SEQ ID NO: 117381 - DNA, 142 bp, Homo sapiens; identical to SEQ ID NO: 14395
  misc_feature 1..142: note = chr2:20432683-20432825
  misc_feature 1..142: note = Hypo
  source 1..142: mol_type = genomic DNA

SEQ ID NO: 117382 - DNA, 104 bp, Homo sapiens; identical to SEQ ID NO: 85752
  misc_feature 1..104: note = chr2:20442320-20442424
  misc_feature 1..104: note = Hypo
  source 1..104: mol_type = genomic DNA

SEQ ID NO: 117383 - DNA, 44 bp, Homo sapiens; identical to SEQ ID NO: 85753
  misc_feature 1..44: note = chr2:20442484-20442528
  misc_feature 1..44: note = Hypo
  source 1..44: mol_type = genomic DNA

SEQ ID NO: 117384 - DNA, 30 bp, Homo sapiens; identical to SEQ ID NO: 14396
  misc_feature 1..30: note = chr2:20456198-20456228
  misc_feature 1..30: note = Hypo
  source 1..30: mol_type = genomic DNA

SEQ ID NO: 117385 - DNA, 30 bp, Homo sapiens; identical to SEQ ID NO: 39477
  misc_feature 1..30: note = chr2:20553860-20553890
  misc_feature 1..30: note = Hypo
  source 1..30: mol_type = genomic DNA

SEQ ID NO: 117386 - DNA, 33 bp, Homo sapiens; identical to SEQ ID NO: 85757
  misc_feature 1..33: note = chr2:20641885-20641918
  misc_feature 1..33: note = Hypo
  source 1..33: mol_type = genomic DNA

SEQ ID NO: 117387 - DNA, 33 bp, Homo sapiens; identical to SEQ ID NO: 85758
  misc_feature 1..33: note = chr2:20642218-20642251
  misc_feature 1..33: note = Hypo
  source 1..33: mol_type = genomic DNA

SEQ ID NO: 117388 - DNA, 163 bp, Homo sapiens; identical to SEQ ID NO: 85759
  misc_feature 1..163: note = chr2:20642613-20642776
  misc_feature 1..163: note = Hypo
  source 1..163: mol_type = genomic DNA

SEQ ID NO: 117389 - DNA, 43 bp, Homo sapiens; identical to SEQ ID NO: 85760
  misc_feature 1..43: note = chr2:20647266-20647309
  misc_feature 1..43: note = Hyper
  source 1..43: mol_type = genomic DNA

SEQ ID NO: 117390 - DNA, 1002 bp, Homo sapiens
  misc_feature 1..1002: note = chr2:20865658-20866660
  misc_feature 1..1002: note = Hyper
  source 1..1002: mol_type = genomic DNA
gtgatcacgacgtgccgacccagtctagattttgagttctgcagaaaatgcaattttaaaggaaaaggacccgcctgcccttcttcggcagttcgtttggcccaggccttcgatcagctgaaagtttccgatctagggggatgtccaggctgccggcggagcagagccgataacccccctctcctgcgcgttcccctgagacttggcctccgcaacctgtcccagccgcggagcaaactgctctgcggcccgcgcgagtgcgccccagggcttcgccgctgccgggcgtcccctccatccacctcgggacccgcgccatcaccgcggcggggtaagaagctcggaggcgccatcccggggctctgcgccgtccgctctcccggctcctggccgctcacgcacacagccggtagctggttttcgttagccgctgccctcgcccagaaggcgggtggaaggtcgccagttggacgcacagccaaactcttagcgcactcccgcgcgagatcccccatcacccggggctgccgtcctcatttcgagctctttctagagcttggctcccgctgaagcgcaacttccgcgcccaaaccttgcttttacgacgggcggtccgcgtccaaaggtctcttacaggcctgccctttcagctcctcgccctcccttcctcccctaccggccccctcccctgctctggccgcccgctgcaatcctttggggtctgtggctgagtggggaaccgccgacccgcgatccggaacgcgactttgaggccgccgggagcatcctgtggcctctctctgcgcggccacccggccgcggcgcgaagcggtctggagggcgagcccttccgcggccccaactctgccgccccgttcccggcattgggaaccagggcagggagggggcgggtgtttctctgcgggggagtggggaggaagctgggcgggtgcgcgcggtgccccgagcctggaaccacggagggcgcgttggtcttgggcg

SEQ ID NO: 117391 - DNA, 204 bp, Homo sapiens; identical to SEQ ID NO: 85787
  misc_feature 1..204: note = chr2:20867109-20867313
  misc_feature 1..204: note = Hyper
  source 1..204: mol_type = genomic DNA

SEQ ID NO: 117392 - DNA, 30 bp, Homo sapiens; identical to SEQ ID NO: 85788
  misc_feature 1..30: note = chr2:20867534-20867564
  misc_feature 1..30: note = Hyper
  source 1..30: mol_type = genomic DNA

SEQ ID NO: 117393 - DNA, 349 bp, Homo sapiens; identical to SEQ ID NO: 27085
  misc_feature 1..349: note = chr2:21022707-21023056
  misc_feature 1..349: note = Hyper
  source 1..349: mol_type = genomic DNA

SEQ ID NO: 117394 - DNA, 18 bp, Homo sapiens
  misc_feature 1..18: note = chr2:21089512-21089530
  misc_feature 1..18: note = Hypo
  source 1..18: mol_type = genomic DNA
tgttttaagacagagcgt

SEQ ID NO: 117395 - DNA, 16 bp, Homo sapiens
  misc_feature 1..16: note = chr2:22404338-22404354
  misc_feature 1..16: note = Hypo
  source 1..16: mol_type = genomic DNA
ccgcccccacaaaaaa

SEQ ID NO: 117396 - DNA, 141 bp, Homo sapiens; identical to SEQ ID NO: 86065
  misc_feature 1..141: note = chr2:23546899-23547040
  misc_feature 1..141: note = Hypo
  source 1..141: mol_type = genomic DNA

SEQ ID NO: 117397 - DNA, 196 bp, Homo sapiens; identical to SEQ ID NO: 86066
  misc_feature 1..196: note = chr2:23570208-23570404
  misc_feature 1..196: note = Hypo
  source 1..196: mol_type = genomic DNA

SEQ ID NO: 117398 - DNA, 30 bp, Homo sapiens; identical to SEQ ID NO: 86067
  misc_feature 1..30: note = chr2:23570986-23571016
  misc_feature 1..30: note = Hypo
  source 1..30: mol_type = genomic DNA

SEQ ID NO: 117399 - DNA, 1172 bp, Homo sapiens; identical to SEQ ID NO: 86070
  misc_feature 1..1172: note = chr2:23608475-23609647
  misc_feature 1..1172: note = Hyper
  source 1..1172: mol_type = genomic DNA

SEQ ID NO: 117400 - DNA, 174 bp, Homo sapiens; identical to SEQ ID NO: 27088
  misc_feature 1..174: note = chr2:23609896-23610070
  misc_feature 1..174: note = Hyper
  source 1..174: mol_type = genomic DNA

SEQ ID NO: 117401 - DNA, 42 bp, Homo sapiens; identical to SEQ ID NO: 86077
  misc_feature 1..42: note = chr2:23640423-23640465
  misc_feature 1..42: note = Hypo
  source 1..42: mol_type = genomic DNA

SEQ ID NO: 117402 - DNA, 66 bp, Homo sapiens; identical to SEQ ID NO: 86128
  misc_feature 1..66: note = chr2:23893248-23893314
  misc_feature 1..66: note = Hypo
  source 1..66: mol_type = genomic DNA

SEQ ID NO: 117403 - DNA, 707 bp, Homo sapiens
  misc_feature 1..707: note = chr2:24232756-24233463
  misc_feature 1..707: note = Hyper
  source 1..707: mol_type = genomic DNA
ccaccccaaggagaacggtcctgagggcctgccgggcctttccccccgcggattttggttcttcgctgtttccctttggggtgcccttcgcggtttctgcgtttcccccgcgttgccagcagccactcgcgccgcgcccctagcccagaaccgcccctcccaagggcgataaccccgagggcaacggccgcgggcggcgctgcggtggcaatggcggcgccccctgcaccagccgccaaggggtccccgcagccggagccgcacgccccagagcccggcccggggagcgccaagcgagggcgagaggtgagcggggcggcggggaccgggaaggggctgcgtcctcggggagctccagggcgtcgcctcgcagccccttttccagctgggggcagcccggaggggctcggcccaaacctgccagctcaggggctgccctcgcggggttacacggctgggagcggggaggctggtaggtgccggcgccggaaagagactaggacgggaagcctagccctagccaaggaagtaacttggggatgcgtggtcattgctgtcctgattcccggcttaggggtcttgtccgtgccaccgcaggtcctcccggggtccccgagctctgggcaggcagggctttctgaagcgcctggggaggctgcgtccttcccgacctcaggcagctgctgtggcctcggcctccctcccag

SEQ ID NO: 117404 - DNA, 284 bp, Homo sapiens; identical to SEQ ID NO: 86279
  misc_feature 1..284: note = chr2:24272963-24273247
  misc_feature 1..284: note = Hyper
  source 1..284: mol_type = genomic DNA

SEQ ID NO: 117405 - DNA, 76 bp, Homo sapiens; identical to SEQ ID NO: 86309
  misc_feature 1..76: note = chr2:24324877-24324953
  misc_feature 1..76: note = Hypo
  source 1..76: mol_type = genomic DNA

SEQ ID NO: 117406 - DNA, 21 bp, Homo sapiens
  misc_feature 1..21: note = chr2:24584330-24584351
  misc_feature 1..21: note = Hypo
  source 1..21: mol_type = genomic DNA
tggcacagtggctcacgcttg

SEQ ID NO: 117407 - DNA, 141 bp, Homo sapiens; identical to SEQ ID NO: 86311
  misc_feature 1..141: note = chr2:24645761-24645902
  misc_feature 1..141: note = Hypo
  source 1..141: mol_type = genomic DNA

SEQ ID NO: 117408 - DNA, 63 bp, Homo sapiens; identical to SEQ ID NO: 39480
  misc_feature 1..63: note = chr2:24775908-24775971
  misc_feature 1..63: note = Hypo
  source 1..63: mol_type = genomic DNA

SEQ ID NO: 117409 - DNA, 18 bp, Homo sapiens
  misc_feature 1..18: note = chr2:25047467-25047485
  misc_feature 1..18: note = Hypo
  source 1..18: mol_type = genomic DNA
acaggaatggccaggcgt

SEQ ID NO: 117410 - DNA, 30 bp, Homo sapiens; identical to SEQ ID NO: 86314
  misc_feature 1..30: note = chr2:25056369-25056399
  misc_feature 1..30: note = Hypo
  source 1..30: mol_type = genomic DNA

SEQ ID NO: 117411 - DNA, 25 bp, Homo sapiens
  misc_feature 1..25: note = chr2:25193340-25193365
  misc_feature 1..25: note = Hypo
  source 1..25: mol_type = genomic DNA
tttttttttttgagacggcgtctca

SEQ ID NO: 117412 - DNA, 44 bp, Homo sapiens; identical to SEQ ID NO: 39481
  misc_feature 1..44: note = chr2:25241776-25241820
  misc_feature 1..44: note = Hypo
  source 1..44: mol_type = genomic DNA

SEQ ID NO: 117413 - DNA, 209 bp, Homo sapiens; identical to SEQ ID NO: 27092
  misc_feature 1..209: note = chr2:25354748-25354957
  misc_feature 1..209: note = Hyper
  source 1..209: mol_type = genomic DNA

SEQ ID NO: 117414 - DNA, 18 bp, Homo sapiens
  misc_feature 1..18: note = chr2:25371415-25371433
  misc_feature 1..18: note = Hypo
  source 1..18: mol_type = genomic DNA
atccggcctgtcacttct

SEQ ID NO: 117415 - DNA, 675 bp, Homo sapiens; identical to SEQ ID NO: 86320
  misc_feature 1..675: note = chr2:25391059-25391734
  misc_feature 1..675: note = Hyper
  source 1..675: mol_type = genomic DNA

SEQ ID NO: 117416 - DNA, 556 bp, Homo sapiens
  misc_feature 1..556: note = chr2:25438800-25439356
  misc_feature 1..556: note = Hyper
  source 1..556: mol_type = genomic DNA
gacccgaaatacgcccgaggcatttatcctaaaaaacgacaaggtccgggcgcccagcagaacggcccggctcgaccgcgcgcagcttgcaggcaggggggtgtgcaggtcaccgcgccaccccggcgagcagagccgcggagggcgccacgtcggtgcgctggccccgcccgagcggggcgggaccttcctgtacccccggaagcccccgcgggcagctggggaggaaaccgcggccacgcgctcggggggcccggctcgggaagggcagtgcgcgcgcatgcgttggggcggggcgcctgggacctgcgggccccaggcccagcgcgccgccagccggagtgcccggcgcccgtcgaaaggcccctgcgccggttcaggacccgcacccagctacgctgcggagccccagctcgcagcaccctcccacccaccgctcctggctgcttttctcctgagtctgcggggcggggtcgtttttgttttttacaaaaatgtatgtaaaggtatttcgatgagtgaaggaacacgctataatgctcactcaatgcagcat

SEQ ID NO: 117417 - DNA, 32 bp, Homo sapiens; identical to SEQ ID NO: 86323
  misc_feature 1..32: note = chr2:25439961-25439993
  misc_feature 1..32: note = Hypo
  source 1..32: mol_type = genomic DNA

SEQ ID NO: 117418 - DNA, 119 bp, Homo sapiens; identical to SEQ ID NO: 86324
  misc_feature 1..119: note = chr2:25442329-25442448
  misc_feature 1..119: note = Hypo
  source 1..119: mol_type = genomic DNA

SEQ ID NO: 117419 - DNA, 30 bp, Homo sapiens; identical to SEQ ID NO: 86325
  misc_feature 1..30: note = chr2:25476260-25476290
  misc_feature 1..30: note = Hypo
  source 1..30: mol_type = genomic DNA

SEQ ID NO: 117420 - DNA, 63 bp, Homo sapiens; identical to SEQ ID NO: 86326
  misc_feature 1..63: note = chr2:25563485-25563548
  misc_feature 1..63: note = Hyper
  source 1..63: mol_type = genomic DNA

SEQ ID NO: 117421 - DNA, 84 bp, Homo sapiens; identical to SEQ ID NO: 86330
  misc_feature 1..84: note = chr2:25837886-25837970
  misc_feature 1..84: note = Hypo
  source 1..84: mol_type = genomic DNA

SEQ ID NO: 117422 - DNA, 84 bp, Homo sapiens; identical to SEQ ID NO: 86331
  misc_feature 1..84: note = chr2:25838030-25838114
  misc_feature 1..84: note = Hypo
  source 1..84: mol_type = genomic DNA

SEQ ID NO: 117423 - DNA, 33 bp, Homo sapiens; identical to SEQ ID NO: 86333
  misc_feature 1..33: note = chr2:26204584-26204617
  misc_feature 1..33: note = Hypo
  source 1..33: mol_type = genomic DNA

SEQ ID NO: 117424 - DNA, 145 bp, Homo sapiens; identical to SEQ ID NO: 86334
  misc_feature 1..145: note = chr2:26372899-26373044
  misc_feature 1..145: note = Hypo
  source 1..145: mol_type = genomic DNA

SEQ ID NO: 117425 - DNA, 221 bp, Homo sapiens
  misc_feature 1..221: note = chr2:26395401-26395622
  misc_feature 1..221: note = Hyper
  source 1..221: mol_type = genomic DNA
gcagaattcagaacccgagctttgggcggcggagcaggacagggcgcgggtgggcgcggcctccgggaggccagcacgagggggagcggcggggcccggacacacccagccagaaggaggaggccgaccccgcgccgactccgcagatgccgctcgggacttcgttgtccctccaggcgcccgccctggggtcctccatcacccgccgtcacctgggcgcg

SEQ ID NO: 117426 - DNA, 407 bp, Homo sapiens
  misc_feature 1..407: note = chr2:26396681-26397088
  misc_feature 1..407: note = Hyper
  source 1..407: mol_type = genomic DNA
ccctaggagcagcctcggtcctggggcgggcaggccaccttcgggagaggccggcgggagccgggtctgctgcccggcgtgacccccaaactcccggccctcccccgaatcttgtcccacttcttaataggacctggggcccccagccgctcggctgatggaaccacgcatgggggcccgagagggtacgcccggaggctgcatggagcgaggggaccgtttggggggaggggggtgctgcttggttgggggatgggcggtagccggggctggcagccaggccgggggttttgtgtgtgagaagaataggggtttggcccgcgttggcacactcgcttccatgaatgctaatggggcccgcggccgcaggctcctcgtctccccgtggggcccggcagcccctcctc

SEQ ID NO: 117427 - DNA, 544 bp, Homo sapiens; identical to SEQ ID NO: 86339
  misc_feature 1..544: note = chr2:26401682-26402226
  misc_feature 1..544: note = Hyper
  source 1..544: mol_type = genomic DNA

SEQ ID NO: 117428 - DNA, 548 bp, Homo sapiens
  misc_feature 1..548: note = chr2:26407451-26407999
  misc_feature 1..548: note = Hyper
  source 1..548: mol_type = genomic DNA
gcagatgcaagagggcgagcacacggtgcgcgccatcatcgagcgcgtgaggctgccggtgaacgtgctggtgcccagccggccgccgcgcaacccctacgacctgcacccggtgcgggagggtcattgctacaagctggttagcatcatctccaagacggtggtgctggggctggcgctgcgccgcgagggcccggcgccgctgcacttcctgctgctcacggacacgccgcgcttcgcgctgccgcagggcctgctggccggggacccgcgcgtcgagcgcctggtgcgcgacagcgcctcctactgccgcgagcgcttcgaccccgacgagtactccacggccgtgcgcgaggcgccagcggagctcgccgaagactgcgccagcccgcgccgcgcgcgcctctgcctgcccgcgccgcgcgcccccgggctcgcccgcgcccccggcccgctagcgccggctcccgccggcgagggcgaccaggagtacgtgagccccgactgggcagccgcgcccgagcccgccgcgccgcccgccgagatcc

SEQ ID NO: 117429 - DNA, 120 bp, Homo sapiens; identical to SEQ ID NO: 86342
  misc_feature 1..120: note = chr2:26521959-26522079
  misc_feature 1..120: note = Hyper
  source 1..120: mol_type = genomic DNA

SEQ ID NO: 117430 - DNA, 148 bp, Homo sapiens; identical to SEQ ID NO: 86343
  misc_feature 1..148: note = chr2:26607235-26607383
  misc_feature 1..148: note = Hypo
  source 1..148: mol_type = genomic DNA

SEQ ID NO: 117431 - DNA, 97 bp, Homo sapiens
  misc_feature 1..97: note = chr2:26624910-26625007
  misc_feature 1..97: note = Hyper
  source 1..97: mol_type = genomic DNA
gtccacccagattctcgcgccctcggtccactccgacaactctcaggagcgcatccaggcccggcgcctccgcatcgctgcgcgcttagaagcccgg

SEQ ID NO: 117432 - DNA, 30 bp, Homo sapiens; identical to SEQ ID NO: 86347
  misc_feature 1..30: note = chr2:26712122-26712152
  misc_feature 1..30: note = Hypo
  source 1..30: mol_type = genomic DNA

SEQ ID NO: 117433 - DNA, 18 bp, Homo sapiens
  misc_feature 1..18: note = chr2:26854048-26854066
  misc_feature 1..18: note = Hypo
  source 1..18: mol_type = genomic DNA
taactaagtgaagaccgg

SEQ ID NO: 117434 - DNA, 877 bp, Homo sapiens
  misc_feature 1..877: note = chr2:26915677-26916554
  misc_feature 1..877: note = Hyper
  source 1..877: mol_type = genomic DNA
agcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggtaacggctcgccgggcggggggcgggaacccagggctgggcgcggggctccgggagtcgtccggggccggctggggctgggggcgggggctcccccgagaggggctgggcgccgaaccctgcgctcgcagaaacccgagttcagcctggcgtgtgtgctccgcggggacggaactcggggaggcgtcgattcctggctccggacctgactctccggccgggccagccctaacttggccctgccatgttgcataggcccccagggactccgaagtgtgtgagaggggcagggacgaccggcggaggctcgggcaggaggggtgtggccgggccaggccctgaacagggcgctgagagtgagcggcgggagagcgccagtgctccgtatccctgaggatcggcttccacagcctagcaggtctacacctgctgggctctggggaggcatgaggatgtcggaatgcggcacttcggggcacttggggccaccctataacggcggctgtgagtgtacgtgtgtctgcgtgt

SEQ ID NO: 117435 - DNA, 69 bp, Homo sapiens; identical to SEQ ID NO: 86352
  misc_feature 1..69: note = chr2:27007856-27007925
  misc_feature 1..69: note = Hypo
  source 1..69: mol_type = genomic DNA

SEQ ID NO: 117436 - DNA, 32 bp, Homo sapiens; identical to SEQ ID NO: 86353
  misc_feature 1..32: note = chr2:27008352-27008384
  misc_feature 1..32: note = Hyper
  source 1..32: mol_type = genomic DNA

SEQ ID NO: 117437 - DNA, 42 bp, Homo sapiens; identical to SEQ ID NO: 86354
  misc_feature 1..42: note = chr2:27069889-27069931
  misc_feature 1..42: note = Hyper
  source 1..42: mol_type = genomic DNA

SEQ ID NO: 117438 - DNA, 1632 bp, Homo sapiens; identical to SEQ ID NO: 86355
  misc_feature 1..1632: note = chr2:27070287-27071919
  misc_feature 1..1632: note = Hyper
  source 1..1632: mol_type = genomic DNA

SEQ ID NO: 117439 - DNA, 879 bp, Homo sapiens; identical to SEQ ID NO: 86356
  misc_feature 1..879: note = chr2:27072152-27073031
  misc_feature 1..879: note = Hyper
  source 1..879: mol_type = genomic DNA

SEQ ID NO: 117440 - DNA, 29 bp, Homo sapiens
  misc_feature 1..29: note = chr2:27090275-27090304
  misc_feature 1..29: note = Hypo
  source 1..29: mol_type = genomic DNA
ctattgatggacattcggtttgttcccaa

SEQ ID NO: 117441 - DNA, 28 bp, Homo sapiens
  misc_feature 1..28: note = chr2:27090604-27090632
  misc_feature 1..28: note = Hypo
  source 1..28: mol_type = genomic DNA
gagccaccgcgcccggcccccaattgtt

SEQ ID NO: 117442 - DNA, 30 bp, Homo sapiens; identical to SEQ ID NO: 86359
  misc_feature 1..30: note = chr2:27165703-27165733
  misc_feature 1..30: note = Hyper
  source 1..30: mol_type = genomic DNA

SEQ ID NO: 117443 - DNA, 30 bp, Homo sapiens; identical to SEQ ID NO: 86361
  misc_feature 1..30: note = chr2:27304380-27304410
  misc_feature 1..30: note = Hyper
  source 1..30: mol_type = genomic DNA

SEQ ID NO: 117444 - DNA, 70 bp, Homo sapiens; identical to SEQ ID NO: 86363
  misc_feature 1..70: note = chr2:27319238-27319308
  misc_feature 1..70: note = Hyper
  source 1..70: mol_type = genomic DNA

SEQ ID NO: 117445 - DNA, 119 bp, Homo sapiens; identical to SEQ ID NO: 86364
  misc_feature 1..119: note = chr2:27322524-27322643
  misc_feature 1..119: note = Hypo
  source 1..119: mol_type = genomic DNA

SEQ ID NO: 117446 - DNA, 481 bp, Homo sapiens; identical to SEQ ID NO: 86365
  misc_feature 1..481: note = chr2:27341629-27342110
  misc_feature 1..481: note = Hyper
  source 1..481: mol_type = genomic DNA

SEQ ID NO: 117447 - DNA, 30 bp, Homo sapiens; identical to SEQ ID NO: 86366
  misc_feature 1..30: note = chr2:27354485-27354515
  misc_feature 1..30: note = Hypo
  source 1..30: mol_type = genomic DNA

SEQ ID NO: 117448 - DNA, 24 bp, Homo sapiens
  misc_feature 1..24: note = chr2:27433305-27433329
  misc_feature 1..24: note = Hypo
  source 1..24: mol_type = genomic DNA
ctttttttttggagacggagtctc

SEQ ID NO: 117449 - DNA, 168 bp, Homo sapiens; identical to SEQ ID NO: 27111
  misc_feature 1..168: note = chr2:27473190-27473358
  misc_feature 1..168: note = Hyper
  source 1..168: mol_type = genomic DNA

SEQ ID NO: 117450 - DNA, 834 bp, Homo sapiens; identical to SEQ ID NO: 86369
  misc_feature 1..834: note = chr2:27484899-27485733
  misc_feature 1..834: note = Hyper
  source 1..834: mol_type = genomic DNA

SEQ ID NO: 117451 - DNA, 841 bp, Homo sapiens; identical to SEQ ID NO: 86370
  misc_feature 1..841: note = chr2:27486232-27487073
  misc_feature 1..841: note = Hyper
  source 1..841: mol_type = genomic DNA

SEQ ID NO: 117452 - DNA, 89 bp, Homo sapiens; identical to SEQ ID NO: 86372
  misc_feature 1..89: note = chr2:27578409-27578498
  misc_feature 1..89: note = Hypo
  source 1..89: mol_type = genomic DNA

SEQ ID NO: 117453 - DNA, 30 bp, Homo sapiens; identical to SEQ ID NO: 86373
  misc_feature 1..30: note = chr2:27581396-27581426
  misc_feature 1..30: note = Hypo
  source 1..30: mol_type = genomic DNA

SEQ ID NO: 117454 - DNA, 33 bp, Homo sapiens; identical to SEQ ID NO: 86374
  misc_feature 1..33: note = chr2:27591961-27591994
  misc_feature 1..33: note = Hypo
  source 1..33: mol_type = genomic DNA

SEQ ID NO: 117455 - DNA, 56 bp, Homo sapiens; identical to SEQ ID NO: 86375
  misc_feature 1..56: note = chr2:27666342-27666398
  misc_feature 1..56: note = Hypo
  source 1..56: mol_type = genomic DNA

SEQ ID NO: 117456 - DNA, 30 bp, Homo sapiens; identical to SEQ ID NO: 86376
  misc_feature 1..30: note = chr2:27669403-27669433
  misc_feature 1..30: note = Hypo
  source 1..30: mol_type = genomic DNA

SEQ ID NO: 117457 - DNA, 520 bp, Homo sapiens
  misc_feature 1..520: note = chr2:27717830-27718350
  misc_feature 1..520: note = Hyper
  source 1..520: mol_type = genomic DNA
cctaccccatcccggcgcgggcccggcgacgcgggcagcgcggggccgagctgcgggcggagcgggcgcgggtctgcggagcccccagggctcgagcgggccacggagtctgtccgggagcagggggcgttgcccggacgctggcctgggtccccggtgcgggaggcagtgcggcggcctccgcccgcccctgcagcgggatgtgaccgtcccggagagccagccgccgccttctgcagcgctggccccgctcgctccgccgcagcccggccgggacgcgcgggcccgccccgcccagccggggttctcgccgccgtcattcccctcccgccccctcactcccgtcctctcggggctcctcccacgaccctcccaatggcgcctccggagcccccatcccttatcccttctctctcccagctgaagcggacgagtcggcgggggcgtggggggtgagacgcgggtgctagggtctccggcacctgggagatccccttcctccccgcgtggaagagccaag

SEQ ID NO: 117458 - DNA, 141 bp, Homo sapiens; identical to SEQ ID NO: 14400
  misc_feature 1..141: note = chr2:27887525-27887666
  misc_feature 1..141: note = Hypo
  source 1..141: mol_type = genomic DNA

SEQ ID NO: 117459 - DNA, 309 bp, Homo sapiens; identical to SEQ ID NO: 86380
  misc_feature 1..309: note = chr2:27938325-27938634
  misc_feature 1..309: note = Hyper
  source 1..309: mol_type = genomic DNA

SEQ ID NO: 117460 - DNA, 193 bp, Homo sapiens; identical to SEQ ID NO: 86385
  misc_feature 1..193: note = chr2:28500549-28500742
  misc_feature 1..193: note = Hypo
  source 1..193: mol_type = genomic DNA

SEQ ID NO: 117461 - DNA, 35 bp, Homo sapiens; identical to SEQ ID NO: 86389
  misc_feature 1..35: note = chr2:28659202-28659237
  misc_feature 1..35: note = Hypo
  source 1..35: mol_type = genomic DNA

SEQ ID NO: 117462 - DNA, 212 bp, Homo sapiens; identical to SEQ ID NO: 39489
  misc_feature 1..212: note = chr2:28676953-28677165
  misc_feature 1..212: note = Hypo
  source 1..212: mol_type = genomic DNA

SEQ ID NO: 117463 - DNA, 627 bp, Homo sapiens
  misc_feature 1..627: note = chr2:29033336-29033963
  misc_feature 1..627: note = Hyper
  source 1..627: mol_type = genomic DNA
taaccagggtaaccacgctgtgcccgcgtgtgccgggcggggaggggaggccgcagccccagccccgggggcctggttgtctaatcgaagggaagtaaacggccccaacgcaagcctgactgcgagacgtgcccaagggaggtaggtcgaatgaagagggttgtgtgagttttgcgcgggcaggcgggataacggaggagggaggcccgcggccgaggctcgggcgggcggggggcagggaggggcggggttcgccggcgcgcactcccaggcaggccccgccccctcggccggctgtgcgcgctgattggcccctgccggcctcgcgctccctcgctccgggttggcgggagaccttagagcgggtaccgctgctggctagcgaccgacgagcaaccgtctgaggccaggagcgctgcgacggagccttgaccgccgttgcccggccctctcccgcgcagccccgggcttccgcaggtacctgtgctcgcccccgggaaggggcctcgcaggcgaatctccagtttcgagtgtgcccggtccctgggttcgctcgccggcgaccccaccgcccgccttagatgagaaggcagcgctccagcctcgtcctcacgccgcctcccgtgg

SEQ ID NO: 117464 - DNA, 30 bp, Homo sapiens; identical to SEQ ID NO: 86395
  misc_feature 1..30: note = chr2:29093791-29093821
  misc_feature 1..30: note = Hyper
  source 1..30: mol_type = genomic DNA

SEQ ID NO: 117465 - DNA, 1175 bp, Homo sapiens
  misc_feature 1..1175: note = chr2:29337930-29339105
  misc_feature 1..1175: note = Hyper
  source 1..1175: mol_type = genomic DNA
gccttttacagcaagcgctgccagcagggaactggtggatgtactcttgaccacgctcggctggactctggggagcccaagacgggtaagactaggtccccggccccagcagctggtgggggcgccgcaggttagagacgtgaggccgcgaggctgagggctgtgaaggcggtgggcacgcacggcgtgccggggccgcctggcttcgcggcgggggaggtaacactgcgacaccccgcagacgctgtcagccggggtcgcggccccgcgtgcgcccgatcatctgactgctggggagtgcgggggcgcgggagccaggcgagccagcgcaggcgcgcgctgcctcctccgtccccaccgagtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtgggccgggggcgcgcggggcccccccgggccgcgggctggccggcggcggggttggggccggggtgggcggccctgggggcccgcggggaggtcagtggccccgggagggtcgcgcagaggcgctgggggctgtggaagccccgcggccgcctcccgtgggcaccggtgtcgctggccgcggggaggccttctcggggcggagcggcccacccggcggggatggggactcctcgtggcggccgctgacggacggcccaactttaggttgaggggcgcggggtgtgcgggacccggcggcggagctgggctctgggccacgaccgccagccgcggctgccccgagagtccccgcacgcgcagtggctttccaacgcggcctcttcccatttctcacttgactccccttgcgcattaaattgtcgagaaacctttggccagtgggtcttcaaagctaaaccaaatggctgtccttgcagtccttggctacctgagatcccttaattctgaaccatccgcacctgggaggggaagttgaaaggagcgctggagctgagcccgcatccttaaggat

SEQ ID NO: 117466 - DNA, 40 bp, Homo sapiens; identical to SEQ ID NO: 39490
  misc_feature 1..40: note = chr2:29462699-29462739
  misc_feature 1..40: note = Hypo
  source 1..40: mol_type = genomic DNA

SEQ ID NO: 117467 - DNA, 219 bp, Homo sapiens; identical to SEQ ID NO: 86403
  misc_feature 1..219: note = chr2:29504677-29504896
  misc_feature 1..219: note = Hypo
  source 1..219: mol_type = genomic DNA

SEQ ID NO: 117468 - DNA, 95 bp, Homo sapiens; identical to SEQ ID NO: 86404
  misc_feature 1..95: note = chr2:30142882-30142977
  misc_feature 1..95: note = Hyper
  source 1..95: mol_type = genomic DNA

SEQ ID NO: 117469 - DNA, 436 bp, Homo sapiens
  misc_feature 1..436: note = chr2:30143276-30143712
  misc_feature 1..436: note = Hyper
  source 1..436: mol_type = genomic DNA
gccagccttcagctccgaggaggatggtggcagcagtaggtcccgggcgtagacacggaagagcgagggcaccacgaagtcaactgccagactcttcctctgcaggcgcgagtagctgagtggctcccggggctgcagcggcggccccgcagctggggagcccgcgcgctggccggtccccatcccggagcccacagctgccgtggaaagcagcagcggcaggagccacaggagcccgatggctcccatcccgccggaggaggccgtttacactgctctccgggcccagcctcacccttcgctctccccgagatgggaagaggctctgaacagtccttggtacccagcggctccttccacctgatctccagaggactgtgcgtgcgcgcaagtctcttgctttcccccaactgcacggaggcgagcaggagtctaa

SEQ ID NO: 117470 - DNA, 775 bp, Homo sapiens
  misc_feature 1..775: note = chr2:30143918-30144693
  misc_feature 1..775: note = Hyper
  source 1..775: mol_type = genomic DNA
gggtctgtcccctctcggggcagcctccaatctctgcaacttttaaggctgagaacggcggctcccagctgctgcacgctgtcctggccgccttttgcgttccttttggctcctccaagctcttctgcccggtctgggcgggaaccgagggcggaggctgccgtcttgcgcaccctcaagctatctctccgctgcgggaaggcttcggactgtctgcctgctgaacttctgggcgtgaatcccagcccccgcgctgcgcaagtttgcagcgtccttgctctcaccggcgcctcggctcctcagagttcgcaggcactggagcggccccggcggcagcagctgagggcgttcagggcaggggcgcccgaaatcttgccgccccctcctcacccatcatcagcgcccgcggctttgggtggccgaccagagggcggccggaaagcacctcggtgccccgcgaccctccgaacagaggcggcgggaggtaccagctgctaccaccgctgccgcccccagagccgctggatcgcatctgcctgggcgcccgccacttgcagctggctgagccgcgcgagcgcgcgcagggagggggcggggcccggagggggcggggctcacaagccaactccgcgctgctgcccgacccacgcagtccggcctcgccccgccccacccgcaccctccaaccaatggcgtggctcgatcggctcctatgcaaatctgcagaggcctcggcattcattgagaaaaggagtgagcccgccccaccctccct

SEQ ID NO: 117471 - DNA, 32 bp, Homo sapiens; identical to SEQ ID NO: 86410
  misc_feature 1..32: note = chr2:30144922-30144954
  misc_feature 1..32: note = Hyper
  source 1..32: mol_type = genomic DNA

SEQ ID NO: 117472 - DNA, 87 bp, Homo sapiens; identical to SEQ ID NO: 39492
  misc_feature 1..87: note = chr2:30368623-30368710
  misc_feature 1..87: note = Hypo
  source 1..87: mol_type = genomic DNA

SEQ ID NO: 117473 - DNA, 27 bp, Homo sapiens
  misc_feature 1..27: note = chr2:30404502-30404529
  misc_feature 1..27: note = Hypo
  source 1..27: mol_type = genomic DNA
ctttctttttttaaacggagtcttgtt

SEQ ID NO: 117474 - DNA, 30 bp, Homo sapiens; identical to SEQ ID NO: 86413
  misc_feature 1..30: note = chr2:30407504-30407534
  misc_feature 1..30: note = Hypo
  source 1..30: mol_type = genomic DNA

SEQ ID NO: 117475 - DNA, 145 bp, Homo sapiens; identical to SEQ ID NO: 86414
  misc_feature 1..145: note = chr2:30443158-30443303
  misc_feature 1..145: note = Hypo
  source 1..145: mol_type = genomic DNA

SEQ ID NO: 117476 - DNA, 1316 bp, Homo sapiens
  misc_feature 1..1316: note = chr2:30453590-30454906
  misc_feature 1..1316: note = Hyper
  source 1..1316: mol_type = genomic DNA
gtcaaggatggggggcggcgtgcacaccgcccgcccacaccttctgcccccgctgcagaccgggcgtatgtgtgtctccaatggaaaaatcctacccaggacgacaccacatccttgctcccacaaataaaaccttccacggaactcagggctgcagaccagcccttcgcaagccaacgcgccccgtgggcactcggtcccccggctccgcgtctctgccaccttcccaccgcttcttctttaaccatgctcttgtttcccctcgctgatcgcaaggctgcgggcgaggattccagagagaggcctagtatggggaacaaacgcttcagaggggtccgaggtgggctggggacagccagtggatgggaaggagggcgctggcgccgggcggctggggtggaggagtggcgggtgccctaccccggcgcagagcagccgccgagctgtcatgtcccgagcggcccccgcgccctccttgcgcccacctccgccgcgctggagttcggggtgtgcgtggagggggctgtgagcgggaagcggcgcggacgcggagtccgggccggtgcgagtgagcgcgtgtgcgcgtgggagagcggcgggagggggccgggctcgcagccgcagcgaaccacggccccgggagcagagccgagcgcgcccccgagccgccgcccgccggagctgcgagcgctgaagccattcatgattttggtgacgttattccaggagtgggcgagggagggcggggcctctcggggccaagccccgcccccgcccctataaatacggcttcccgggctctttgtggggctgagtgctcagtggagagcggggagttgtgtccaccttgccgacgtcgctagccgtggggctgtcctgggaaggcggacggcgagcgcccggtgtccgcactcggccgcctgccgtgcccgtctgcgcccgtgtcatcctcactcgggacgcagggaccgtttttaaatcacaggggcgtgtgtcagcctgccctaggacttcatgtctatatatttccccattcactggtgagtaccctgcgcctgcggcgggcgtctgtctcgcggcggtggctgcgggcccgggcgcctgcttcgtgccggctccgggtgcgagggcagccggcggcgcgggcgctcagcgctaacccgccgcccgagcccgtgcaggagtcaacgtcaaggttgcaaaggtgggggtggggggagggggtgctgagaacatccagacaaaggacgtgaactcggagccctcacctaagtgacggccggagggtttgtattggttggcgggggagccagggg

SEQ ID NO: 117477 - DNA, 404 bp, Homo sapiens; identical to SEQ ID NO: 86417
  misc_feature 1..404: note = chr2:30455403-30455807
  misc_feature 1..404: note = Hyper
  source 1..404: mol_type = genomic DNA

SEQ ID NO: 117478 - DNA, 30 bp, Homo sapiens; identical to SEQ ID NO: 86418
  misc_feature 1..30: note = chr2:30471090-30471120
  misc_feature 1..30: note = Hypo
  source 1..30: mol_type = genomic DNA

SEQ ID NO: 117479 - DNA, 30 bp, Homo sapiens; identical to SEQ ID NO: 86419
  misc_feature 1..30: note = chr2:30486255-30486285
  misc_feature 1..30: note = Hypo
  source 1..30: mol_type = genomic DNA

SEQ ID NO: 117480 - DNA, 100 bp, Homo sapiens; identical to SEQ ID NO: 86420
  misc_feature 1..100: note = chr2:30497260-30497360
  misc_feature 1..100: note = Hypo
  source 1..100: mol_type = genomic DNA

SEQ ID NO: 117481 - DNA, 30 bp, Homo sapiens; identical to SEQ ID NO: 86422
  misc_feature 1..30: note = chr2:30512636-30512666
  misc_feature 1..30: note = Hypo
  source 1..30: mol_type = genomic DNA

SEQ ID NO: 117482 - DNA, 16 bp, Homo sapiens
  misc_feature 1..16: note = chr2:30541168-30541184
  misc_feature 1..16: note = Hypo
  source 1..16: mol_type = genomic DNA
ttggagacggagtttc

SEQ ID NO: 117483 - DNA, 826 bp, Homo sapiens
  misc_feature 1..826: note = chr2:31360195-31361021
  misc_feature 1..826: note = Hyper
  source 1..826: mol_type = genomic DNA
atttcctcaactccccgccaataccaaggcgtctgtttttacaggctctttcgtggtgttctgggcacattcaacttccaatgcagctgagagggtcgggaacagttagagaacaggggtggcagccgcccgggaggctgcaaggcgctcgcccgcaacgcacaggcgcgcgcggcgcacccggcctccggcctccccaggtcgggcctggcagctgcgggaaggaggtcagcgcagccgccacacttcgcccgggcgctggcccgacccgaccgccggcgactctctggcagcgcccggagaccgccagcccctgggccgcccgtccgcagagccccctccgccccgggaccctcgcgcgcagctcaagttgggagccccgctccgcaggcgagcgcgcgcccaccacccacacccactgccactcatgcacaccgcgggtccggagatgcccccgagcgttttaaaatccagaaacatcacatggtagccacatccggcggctgttacctgctcgcagcacccagaccctcgccctggtttcccgggagcccgcaaacccggcacgcgggctgcgcgccctcccgcaagccaccgctcagcgccagcgcgccggcaagccgcctaccttaggggtctgcacttcaggtcccgtcggcacctccaacttcctcttggttacccagaagaacagcagcaccgtgatccagagcaccccgaagactggcagaaccagccgacgagtcaggcgccgcatggtcccctttgccgcttcctctccgcggcgctacgtcccgggggcaccccccggcggtcagggttggcg

SEQ ID NO: 117484 - DNA, 394 bp, Homo sapiens; identical to SEQ ID NO: 27135
  misc_feature 1..394: note = chr2:31361296-31361690
  misc_feature 1..394: note = Hyper
  source 1..394: mol_type = genomic DNA

SEQ ID NO: 117485 - DNA, 745 bp, Homo sapiens
  misc_feature 1..745: note = chr2:31456682-31457427
  misc_feature 1..745: note = Hyper
  source 1..745: mol_type = genomic DNA
caactgaaggagaggcgattcaaagcagggagtgtgatgaataggtcaactctgtcctcgcagccgtccctgagagggcgctgttcccaaatcgaagccccagaggcggagactgagacaccggcactctcccactggactgggtcagcatccctctccccgcgcggccgcaggtctagagctgagcgcctgcccacaaacatggcggcgccctgcgcggcttcccgtcgccgcaaccgtggggccggccctgccttgccagtactaggggacttcctctgcgcgccggcttcctgcccagctggcatttaaaccaccgcctggggctgcaggatgctgctgcggatgcagagctgtccgcgggctgggcagcgtcgccgtctcccctgagccgcctcggtccggcaggagcggagccgaagcatcccttgctgcacgcagggcagagcaggcgagggctgggggccgatcggggaccccggcttgggaccccggcatctggcagtttccttgcaggttcaactttaattgccaagatttcacccctcctcctcaagcccagattatttatcctccctccggcctgggctgctggatgcagcagcggctgggcttggtcccaggagcagggagagtgcgctcccggccctcctagccgcgtgcccgggccatggtgcggctgagccccgcgcttgggtgaggcggcggcgcggctcggagcccggcggaccggtcctacgggaca

SEQ ID NO: 117486 - DNA, 89 bp, Homo sapiens; identical to SEQ ID NO: 86435
  misc_feature 1..89: note = chr2:32263995-32264084
  misc_feature 1..89: note = Hypo
  source 1..89: mol_type = genomic DNA

SEQ ID NO: 117487 - DNA, 31 bp, Homo sapiens; identical to SEQ ID NO: 86436
  misc_feature 1..31: note = chr2:32275102-32275133
  misc_feature 1..31: note = Hypo
  source 1..31: mol_type = genomic DNA

SEQ ID NO: 117488 - DNA, 17 bp, Homo sapiens
  misc_feature 1..17: note = chr2:32360509-32360526
  misc_feature 1..17: note = Hypo
  source 1..17: mol_type = genomic DNA
ttcgattattctaaatc

SEQ ID NO: 117489 - DNA, 16 bp, Homo sapiens
  misc_feature 1..16: note = chr2:32472347-32472363
  misc_feature 1..16: note = Hypo
  source 1..16: mol_type = genomic DNA
gacaagcttaacctgc

SEQ ID NO: 117490 - DNA, 30 bp, Homo sapiens; identical to SEQ ID NO: 39497
  misc_feature 1..30: note = chr2:32494200-32494230
  misc_feature 1..30: note = Hypo
  source 1..30: mol_type = genomic DNA

SEQ ID NO: 117491 - DNA, 120 bp, Homo sapiens; identical to SEQ ID NO: 86440
  misc_feature 1..120: note = chr2:32504329-32504449
  misc_feature 1..120: note = Hypo
  source 1..120: mol_type = genomic DNA

SEQ ID NO: 117492 - DNA, 42 bp, Homo sapiens; identical to SEQ ID NO: 86441
  misc_feature 1..42: note = chr2:32504749-32504791
  misc_feature 1..42: note = Hypo
  source 1..42: mol_type = genomic DNA

SEQ ID NO: 117493 - DNA, 27 bp, Homo sapiens
  misc_feature 1..27: note = chr2:32551637-32551664
  misc_feature 1..27: note = Hypo
  source 1..27: mol_type = genomic DNA
tgtgagccaccgcgcccagcctaccct

SEQ ID NO: 117494 - DNA, 29 bp, Homo sapiens
  misc_feature 1..29: note = chr2:32620220-32620249
  misc_feature 1..29: note = Hypo
  source 1..29: mol_type = genomic DNA
aaaaacagcaacaacgacaacaacagaaa

SEQ ID NO: 117495 - DNA, 150 bp, Homo sapiens; identical to SEQ ID NO: 86444
  misc_feature 1..150: note = chr2:32852511-32852661
  misc_feature 1..150: note = Hyper
  source 1..150: mol_type = genomic DNA

SEQ ID NO: 117496 - DNA, 34 bp, Homo sapiens; identical to SEQ ID NO: 86450
  misc_feature 1..34: note = chr2:33313226-33313260
  misc_feature 1..34: note = Hypo
  source 1..34: mol_type = genomic DNA

SEQ ID NO: 117497 - DNA, 30 bp, Homo sapiens; identical to SEQ ID NO: 39501
  misc_feature 1..30: note = chr2:33315571-33315601
  misc_feature 1..30: note = Hypo
  source 1..30: mol_type = genomic DNA

SEQ ID NO: 117498 - DNA, 16 bp, Homo sapiens
  misc_feature 1..16: note = chr2:33373991-33374007
  misc_feature 1..16: note = Hypo
  source 1..16: mol_type = genomic DNA
ctcccatgggctgggc

SEQ ID NO: 117499 - DNA, 21 bp, Homo sapiens
  misc_feature 1..21: note = chr2:33379839-33379860
  misc_feature 1..21: note = Hypo
  source 1..21: mol_type = genomic DNA
ttgaactaggccgggcgcggt

SEQ ID NO: 117500 - DNA, 159 bp, Homo sapiens; identical to SEQ ID NO: 86457
  misc_feature 1..159: note = chr2:33529420-33529579
  misc_feature 1..159: note = Hypo
  source 1..159: mol_type = genomic DNA

SEQ ID NO: 117501 - DNA, 44 bp, Homo sapiens; identical to SEQ ID NO: 86458
  misc_feature 1..44: note = chr2:33530065-33530109
  misc_feature 1..44: note = Hypo
  source 1..44: mol_type = genomic DNA

SEQ ID NO: 117502 - DNA, 70 bp, Homo sapiens; identical to SEQ ID NO: 39503
  misc_feature 1..70: note = chr2:33532830-33532900
  misc_feature 1..70: note = Hypo
  source 1..70: mol_type = genomic DNA

SEQ ID NO: 117503 - DNA, 42 bp, Homo sapiens; identical to SEQ ID NO: 86460
  misc_feature 1..42: note = chr2:33544683-33544725
  misc_feature 1..42: note = Hypo
  source 1..42: mol_type = genomic DNA

SEQ ID NO: 117504 - DNA, 87 bp, Homo sapiens; identical to SEQ ID NO: 86461
  misc_feature 1..87: note = chr2:33653893-33653980
  misc_feature 1..87: note = Hypo
  source 1..87: mol_type = genomic DNA

SEQ ID NO: 117505 - DNA, 60 bp, Homo sapiens; identical to SEQ ID NO: 86462
  misc_feature 1..60: note = chr2:33775696-33775756
  misc_feature 1..60: note = Hypo
  source 1..60: mol_type = genomic DNA

SEQ ID NO: 117506 - DNA, 59 bp, Homo sapiens; identical to SEQ ID NO: 86463
  misc_feature 1..59: note = chr2:33953179-33953238
  misc_feature 1..59: note = Hypo
  source 1..59: mol_type = genomic DNA

SEQ ID NO: 117507 - DNA, 38 bp, Homo sapiens; identical to SEQ ID NO: 86464
  misc_feature 1..38: note = chr2:33997908-33997946
  misc_feature 1..38: note = Hypo
  source 1..38: mol_type = genomic DNA

SEQ ID NO: 117508 - DNA, 21 bp, Homo sapiens
  misc_feature 1..21: note = chr2:34556567-34556588
  misc_feature 1..21: note = Hypo
  source 1..21: mol_type = genomic DNA
ccactgcgcccagccttggga

SEQ ID NO: 117509 - DNA, 30 bp, Homo sapiens; identical to SEQ ID NO: 86467
  misc_feature 1..30: note = chr2:36245456-36245486
  misc_feature 1..30: note = Hypo
  source 1..30: mol_type = genomic DNA

SEQ ID NO: 117510 - DNA, 236 bp, Homo sapiens; identical to SEQ ID NO: 86468
  misc_feature 1..236: note = chr2:36600958-36601194
  misc_feature 1..236: note = Hypo
  source 1..236: mol_type = genomic DNA

SEQ ID NO: 117511 - DNA, 66 bp, Homo sapiens; identical to SEQ ID NO: 39505
  misc_feature 1..66: note = chr2:36824207-36824273
  misc_feature 1..66: note = Hypo
  source 1..66: mol_type = genomic DNA

SEQ ID NO: 117512 - DNA, 30 bp, Homo sapiens; identical to SEQ ID NO: 86470
  misc_feature 1..30: note = chr2:36998369-36998399
  misc_feature 1..30: note = Hypo
  source 1..30: mol_type = genomic DNA

SEQ ID NO: 117513 - DNA, 16 bp, Homo sapiens
  misc_feature 1..16: note = chr2:37445969-37445985
  misc_feature 1..16: note = Hypo
  source 1..16: mol_type = genomic DNA
gcgccactgcattcca

SEQ ID NO: 117514 - DNA, 177 bp, Homo sapiens; identical to SEQ ID NO: 86472
  misc_feature 1..177: note = chr2:37571733-37571910
  misc_feature 1..177: note = Hyper
  source 1..177: mol_type = genomic DNA

SEQ ID NO: 117515 - DNA, 48 bp, Homo sapiens; identical to SEQ ID NO: 86473
  misc_feature 1..48: note = chr2:37899949-37899997
  misc_feature 1..48: note = Hyper
  source 1..48: mol_type = genomic DNA

SEQ ID NO: 117516 - DNA, 33 bp, Homo sapiens; identical to SEQ ID NO: 86474
  misc_feature 1..33: note = chr2:37979626-37979659
  misc_feature 1..33: note = Hypo
  source 1..33: mol_type = genomic DNA

SEQ ID NO: 117517 - DNA, 226 bp, Homo sapiens; identical to SEQ ID NO: 86475
  misc_feature 1..226: note = chr2:38007974-38008200
  misc_feature 1..226: note = Hypo
  source 1..226: mol_type = genomic DNA

SEQ ID NO: 117518 - DNA, 144 bp, Homo sapiens
  misc_feature 1..144: note = chr2:38301221-38301365
  misc_feature 1..144: note = Hyper
  source 1..144: mol_type = genomic DNA
aaatgtgttctcactcgcaagcaggggaggggacgatagagacaagataggagaccggaggggtcggggcaccgctgggtggggcgcgtgcgcgtgtcgcagccctcactgtgagtccctttaccgacgcgatcttggttttga

SEQ ID NO: 117519 - DNA, 1990 bp, Homo sapiens
  misc_feature 1..1990: note = chr2:38301719-38303709
  misc_feature 1..1990: note = Hyper
  source 1..1990: mol_type = genomic DNA
aagttgctgaagttgcggttgagctgctcgaattcgcggaaaacggtgcgcaccgggttggggaagtactgcagccagggcatcacgtccaccaggctgcccgcgcccaccgtgcgcccgaactcttcgttgtggctgagcagctcacggaactcggggtcgtcgtggctgtagcggcagccgaaacacacggcactcatgacgttggccacggccacgacggtcagcggcctcgggtcgaggaaggcgccgtccgcgctgccgcgcaccagcagcgccaccagctcgcgcgcctcgctcagcacgtggccctcgaggacttggcggctgcgcggctggcgcgtgaagaagttgcgcatcatgctgtgggctgcgcgccgctgcaccttccagtgctccgagtagtggccgaaagccatgctgcggccgccggacaccacacggaaggaggcgaaggccggccggtcggcgaaggccgagccctgctgcaccagggcctggtggatggcgcgctcgccattcagcaccactatggggcagctgcccaggcggatctggaaaacgtcgccgtagcgccgcgccaggcgagcgaacgagaggtgagccgcctggcccaccgccgccgcgtttccgatcagtggccacgcaaacgggcccgggggcgcggaccggagctgccgcctccgttgcctcagcagccgctggcccacatgcacagtggccagcaccgacaggagtagcaggagcgtggtctgctggatggacagcgggtttagcggccaagggtcgttcgggctgaggctggtgcccatgctggggacagagaggagaaggcgtgacactcaggggtgcagagacaggagcgggcgccccacgcccctaccccagcctctggggactgagtgccgttgggtggagaggtcggagctgactctctggagaaatggccgaagacgccccttcccatccccaacccactctcccttggagaagagaaggggcgtgtttccacctcgctgtaacccagcgccaaacccttcccctccccgcaaggcgcgtaacggttcctgcaatctggggacaacgctgcgggcatcgaggcggtggcgcttgatttcctttaaagtacctaccacgccacccgctacctgtaataatccatctgaagaggtcgccgggcagcgcctcggcagacagactgacctgcggggaggtgcggtttccagtggcgcgggacagccggctccgagaaggaactgggacctttgcctagggcaagacgtcaacaggaacccgcagcccggcctggacacctgctgccctcactggaagctttaactcccactcgagtctcttggcgtcgtcagtgccaggagcgcttggattgggatggggacggagaagggtgcctcgctcgccgagccccgctgcccttggggacctggcaaagtcgaggtttcctcacagcgttgagattgagactgggggtcggtgagtggcgtcaattcccatgcccttgcggctctcacaactggagtcgcagaagcgctcgctcccactcccactccagagtcaaagcgcgccatcccgctcctccgggttttaaggactgggtagaaggagggcagcgcgacctggcagggcggggcctgcggggggcggggcgcgccgcacaccaggccgctttgacccggactcccgtccaggcgcaccggccggcctcggagctctaccagcaggctttcatgggagcggaggtgcccacgtttccattgtgcggtaaccgcgcttcatcacagccacctccaatcgaggccgcacggtgtccccagaaccacgctcggtacaacctgccccggccgctgcgctcgacttgggagcgcgccccgccccgagcgcacgacctcccttccctctccgcgacttgagcttgcttcccggaaagccagtgtagtggcagcggtttgcctcacagcgcccctggttggtt

SEQ ID NO: 117520 - DNA, 21 bp, Homo sapiens
  misc_feature 1..21: note = chr2:38365727-38365748
  misc_feature 1..21: note = Hypo
  source 1..21: mol_type = genomic DNA
ctcccccgtcctgtcttaaag

SEQ ID NO: 117521 - DNA, 30 bp, Homo sapiens; identical to SEQ ID NO: 86483
  misc_feature 1..30: note = chr2:38466890-38466920
  misc_feature 1..30: note = Hypo
  source 1..30: mol_type = genomic DNA

SEQ ID NO: 117522 - DNA, 16 bp, Homo sapiens
  misc_feature 1..16: note = chr2:38669261-38669277
  misc_feature 1..16: note = Hypo
  source 1..16: mol_type = genomic DNA
tcgcgccacagcgctc

SEQ ID NO: 117523 - DNA, 19 bp, Homo sapiens
  misc_feature 1..19: note = chr2:38744252-38744271
  misc_feature 1..19: note = Hypo
  source 1..19: mol_type = genomic DNA
actccgtctcaaataataa

SEQ ID NO: 117524 - DNA, 79 bp, Homo sapiens; identical to SEQ ID NO: 27143
  misc_feature 1..79: note = chr2:38755384-38755463
  misc_feature 1..79: note = Hyper
  source 1..79: mol_type = genomic DNA

SEQ ID NO: 117525 - DNA, 30 bp, Homo sapiens; identical to SEQ ID NO: 86487
  misc_feature 1..30: note = chr2:38756521-38756551
  misc_feature 1..30: note = Hypo
  source 1..30: mol_type = genomic DNA

SEQ ID NO: 117526 - DNA, 20 bp, Homo sapiens
  misc_feature 1..20: note = chr2:38953653-38953673
  misc_feature 1..20: note = Hypo
  source 1..20: mol_type = genomic DNA
caccccgcctggccaagtct

SEQ ID NO: 117527 - DNA, 549 bp, Homo sapiens
  misc_feature 1..549: note = chr2:39187170-39187719
  misc_feature 1..549: note = Hyper
  source 1..549: mol_type = genomic DNA
cccggagatggacttcgagtcctctccggcggagccgctgggcaacgtggagcgctccctgcgcgccccggccgagctcctgcccgatgcccgcggcttcgtgcccgcggcctacgaagagttcgagtacggcggcgagatcttcgcgctgcccgcgccctacgacgaggagccgttccaggctccggccctcttcgagaactgctcgcctgcctcctccgagtccagcctggacatctgcttcctgcggcccgtcagcttcgccatggaggccgagcggccggagcacccgctgcagccgctgcccaagagcgctacgtcgccggcgggcagcagcagcgcctacaaactggaggcggcggcgcaggcgcacggcaaggccaagccgctgagccgctctctcaaagagttcccgcgtgcgccgccagccgacggcgtggccccacgcctctacagcacgcgcagcagcagcggcggccgcgcgcccatcaaggccgagcgcgccgcgcaggcgcacggcccggccgccgccgccgtcgccgcccgcgg

SEQ ID NO: 117528 - DNA, 94 bp, Homo sapiens; identical to SEQ ID NO: 86491
  misc_feature 1..94: note = chr2:39188263-39188357
  misc_feature 1..94: note = Hypo
  source 1..94: mol_type = genomic DNA

SEQ ID NO: 117529 - DNA, 75 bp, Homo sapiens
  misc_feature 1..75: note = chr2:39892733-39892808
  misc_feature 1..75: note = Hyper
  source 1..75: mol_type = genomic DNA
aaggggaaggggggtcgctggagaggagggcggactgtggatcggaggtagggagaggggcgagaggagtgcgcg

SEQ ID NO: 117530 - DNA, 1041 bp, Homo sapiens; identical to SEQ ID NO: 86494
  misc_feature 1..1041: note = chr2:39893018-39894059
  misc_feature 1..1041: note = Hyper
  source 1..1041: mol_type = genomic DNA

SEQ ID NO: 117531 - DNA, 697 bp, Homo sapiens; identical to SEQ ID NO: 86496
  misc_feature 1..697: note = chr2:40678187-40678884
  misc_feature 1..697: note = Hyper
  source 1..697: mol_type = genomic DNA

SEQ ID NO: 117532 - DNA, 696 bp, Homo sapiens
  misc_feature 1..696: note = chr2:40678944-40679640
  misc_feature 1..696: note = Hyper
  source 1..696: mol_type = genomic DNA
tgccaaagcagagggaagtgtagccttatgagcagcaaatggaaaatagttcttggtctctgactaaatgccttctgcctgtccatcataagatcctacctggtttggggagtgtgaatggattcttcctccgttcctccacgctagtagaaaatacggcgcactccctccttttaaacagctcccgatcaggaagaggtcgctcccatcttctgtgggaagcacaaagcaggcggcggcggcgggctgactaccgtgcagcgccggcgcgagcgggagccgcggcagcgggcagcggtgcgcgcgggcgggaggcaggcgcggaggccgggaggctgggagggccggggcccgggcgcgcgcgcgctccccctccctcccgcgcacactcgcccgcccgccgcccgcagcctcgcactcgctcacacgcgcgctcggccccgcggctgccgggcgccccggggccccctgcgcgccccttgggctccccaggcgatcgcgtcggggcaaagccggcgcgtttctggagcaccgagcgggtggggagcccttccagcctcccagcctctgccggcgagcagctttttcgatttcctgccggctctcggccccgcagtgcgttgtggccgcgcgctagcgctgtctctcgcacccagcccatcgatgacacgcgcacacaggcgctgcaacttttct

SEQ ID NO: 117533 - DNA, 26 bp, Homo sapiens
  misc_feature 1..26: note = chr2:41770131-41770157
  misc_feature 1..26: note = Hypo
  source 1..26: mol_type = genomic DNA
gctaaaaaatatttgcgaccaggcgc

SEQ ID NO: 117534 - DNA, 147 bp, Homo sapiens; identical to SEQ ID NO: 86502
  misc_feature 1..147: note = chr2:42274544-42274691
  misc_feature 1..147: note = Hyper
  source 1..147: mol_type = genomic DNA

SEQ ID NO: 117535 - DNA, 152 bp, Homo sapiens; identical to SEQ ID NO: 86503
  misc_feature 1..152: note = chr2:42275776-42275928
  misc_feature 1..152: note = Hyper
  source 1..152: mol_type = genomic DNA

SEQ ID NO: 117536 - DNA, 203 bp, Homo sapiens; identical to SEQ ID NO: 86504
  misc_feature 1..203: note = chr2:42281964-42282167
  misc_feature 1..203: note = Hypo
  source 1..203: mol_type = genomic DNA

SEQ ID NO: 117537 - DNA, 30 bp, Homo sapiens; identical to SEQ ID NO: 39508
  misc_feature 1..30: note = chr2:42282578-42282608
  misc_feature 1..30: note = Hypo
  source 1..30: mol_type = genomic DNA

SEQ ID NO: 117538 - DNA, 519 bp, Homo sapiens
  misc_feature 1..519: note = chr2:42329318-42329837
  misc_feature 1..519: note = Hyper
  source 1..519: mol_type = genomic DNA
gtgatcagggaaagtcgaaagtgcagatgggttcgcaaacgtggactctctagttttgggtctgcagatggggccggccaccacgtgctctctgagttctctttccaagtacagatccctccggagacggaacattgttccgcctttaattcttcccaggagctgcggaggaaggcgtgagaaccggagcccggggtgacttgcgggggaggggatcgcttccccgtcgcccacacctgcctaacccacgcccacggcggccgcaaaggcgacaccgcgtgaatctggaaagccccgagtttcaacaggcccaaccatcggcggctttgcaggcgcagcaccaagtgctgctctgcctgtgttcccccagacagcccctggttgtgatttgtcgtttccagtccagctagagtcccaaggccaagaactagacccttgcagcgagatccgcgcccccccccaccccaccccgcctcattctccacaggcgccacagccacaggccgcataaataaatcc

SEQ ID NO: 117539 - DNA, 30 bp, Homo sapiens; identical to SEQ ID NO: 86508
  misc_feature 1..30: note = chr2:42338267-42338297
  misc_feature 1..30: note = Hypo
  source 1..30: mol_type = genomic DNA

SEQ ID NO: 117540 - DNA, 45 bp, Homo sapiens
  misc_feature 1..45: note = chr2:42719904-42719949
  misc_feature 1..45: note = Hyper
  source 1..45: mol_type = genomic DNA
gacgggacgtatggacgggacggacagacgcgacaggacggacgg

SEQ ID NO: 117541 - DNA, 984 bp, Homo sapiens
  misc_feature 1..984: note = chr2:42720262-42721246
  misc_feature 1..984: note = Hyper
  source 1..984: mol_type = genomic DNA
agaaggtgtaggtgtcggacatgcggtcgtcgaggcggcgctggcagcagtactcgaggtgcgcgccctccaggccccagtagatcatctcgttgtagaaggagagctcgcacatccgcggcgcgaagcgcagcttgccgtggccgcgcacgtagagcaggatgaagccgaaggcctccgagtgccggtcgaagaagtactcgttgcgctcgcggtcgtagtcgtcgcacacctcgagcacgtcgcgctcggagcggcagccgtgcagccggctcacgcggcgcagcgggaagtccttcagcagctcccgggacagcgaataccgggcgccgcccacgttcagcaccaccgaggccgccccgctgcgcccgaaggtcatggctggccgcccgggggactttcggcccgagggccccgctgcagccccccaccccaagccgccacgcggggcctgcctgcccgtggctgacgggggagcgcgccgtcggggcccgcgctccctcggggctccgctcctgccctccgctggcccgggggtccctgggctcgagtatctccggcgctgctagtagcgcgccctccgcccggcggtacctgcgggtggccggggagtcctcgccggcgccagcgctgagccccaccggctgggaacgcggctgtgtccgcgccgccgaccctcgcgcccgagggctgcgcacaccgaggccgcggtgccctctcccaagccgcggggccgaccccctgagggctgcgggcgccgaatggagccgccggggcggaatagctccccgtctccggcgctccctgcggccgcgaatccggcggccgccccgccgccgtccagaggcgagaggcaaagtgagcgggttcggaggcggcgaagagccggctcgcggcggcgggggcggggcctctgtgcagtcctcctcctcgcccgccggctccgcgcgcgccgctcacctccctccgcgccgccctccgctt

SEQ ID NO: 117542 - DNA, 756 bp, Homo sapiens
  misc_feature 1..756: note = chr2:43019598-43020354
  misc_feature 1..756: note = Hyper
  source 1..756: mol_type = genomic DNA
gagcttgttgcagaccgggggctggaaggagccccggttctccttcacccaggccctcactcccaggcggcgctccatgactgtcccgggcgcctcctcgcagcgctgtcctcccgccgtcggaggcccgcagctccgcccagccgcctttttaaccagaatcccaagctcacgaggcggagcaaacccccgcgaccccgtggtgggggcttggggcccgcggactttgccccctggtggactttggtctgagcccgccgccctccgcgccactccaggccctggcgagcgcggcggcggcagcgctggggaacggcgtcccgcgccctctgcttctccgcggggcaggggctcggtccccgccaccgtctccggggcgccccacacactggcgcctgcggtggggcctgctcccggcggaggacaaagaatccagacccttcctggacgcttgtccccagacgttccttccctctacgccccgaggggaatcccagggaaggttcccagaaatactacagtgaggagatcgcgggttggaagtcccagcacctgagaacacggtgctggcgctgggctcaagatttggctttcccatctggaaaaggggaatgactgccccgccactcagggctgcggcgctcacccagcgggaagccgcacggcggtccccgcaggtcccgattcaaggtgagccccagacctgctgcgtgcggccggcagactccgccgcgggctcggcgaggggagcggtgc

SEQ ID NO: 117543 - DNA, 241 bp, Homo sapiens; identical to SEQ ID NO: 86513
  misc_feature 1..241: note = chr2:43037936-43038177
  misc_feature 1..241: note = Hyper
  source 1..241: mol_type = genomic DNA

SEQ ID NO: 117544 - DNA, 30 bp, Homo sapiens; identical to SEQ ID NO: 86514
  misc_feature 1..30: note = chr2:43038607-43038637
  misc_feature 1..30: note = Hyper
  source 1..30: mol_type = genomic DNA

SEQ ID NO: 117545 - DNA, 251 bp, Homo sapiens; identical to SEQ ID NO: 86515
  misc_feature 1..251: note = chr2:43227374-43227625
  misc_feature 1..251: note = Hypo
  source 1..251: mol_type = genomic DNA

SEQ ID NO: 117546 - DNA, 19 bp, Homo sapiens
  misc_feature 1..19: note = chr2:43365437-43365456
  misc_feature 1..19: note = Hypo
  source 1..19: mol_type = genomic DNA
tgggcgacaaagtgaggct

SEQ ID NO: 117547 - DNA, 189 bp, Homo sapiens; identical to SEQ ID NO: 4967
  misc_feature 1..189: note = chr2:43408168-43408357
  misc_feature 1..189: note = Hypo
  source 1..189: mol_type = genomic DNA

SEQ ID NO: 117548 - DNA, 39 bp, Homo sapiens; identical to SEQ ID NO: 14407
  misc_feature 1..39: note = chr2:43412683-43412722
  misc_feature 1..39: note = Hypo
  source 1..39: mol_type = genomic DNA

SEQ ID NO: 117549 - DNA, 30 bp, Homo sapiens; identical to SEQ ID NO: 86519
  misc_feature 1..30: note = chr2:43413669-43413699
  misc_feature 1..30: note = Hypo
  source 1..30: mol_type = genomic DNA

SEQ ID NO: 117550 - DNA, 401 bp, Homo sapiens; identical to SEQ ID NO: 86520
  misc_feature 1..401: note = chr2:43448395-43448796
  misc_feature 1..401: note = Hyper
  source 1..401: mol_type = genomic DNA

SEQ ID NO: 117551 - DNA, 1494 bp, Homo sapiens
  misc_feature 1..1494: note = chr2:43450949-43452443
  misc_feature 1..1494: note = Hyper
  source 1..1494: mol_type = genomic DNA
ctggtttgtttacaccggtctgagacacaattaggaacttcttccaagagaagggttcccacatctggacttaactaatgctgttcaagtgaagagatggaatggtggttggtagctgctggtgctgggttgatttttcctgaagtcccaaactcatcggagtcctaacaaagtttaagtgttttttttttttttttgttctattcgtatcacaactgccctgttgtgaatattttgttcaacagaaaaagttcgacttttttgctcaaaaagaatgaaacttcgtaataaaaataaaaaaaaaaagacaagaggaaaccgaaaaaggaggggtgggggcccctcccggcacagagttcgagtccaagtgctcggtcgggcttgcagtctgcctagggcccatgtcaccccccccactcccgtgcccccagcaagggcgagatggcgaggggtgtcctccaacatctctgaaccgccttcccttcctcctcactggcgccctcttgcctcagtcgtcggagatggagaggcggctgaagattggcaggcggcggccagggtcgaggctgggagactcagagccgctgaggctgccggagctcagggagccgcttaggtagctgtcgcggtccgacagcgagtccggggggctggggggcgcgtcgaacacgggcgagtcggacaggcggcgcggcagctggaagctgaagggcggcgagggaggtgcggcggccccggcggggagggtcgcgctgggcggcgccggcggctgcgcggggggcgccaggccctgctgctgctgctgctgctgactgcggtagtaggcggcggcggccacggcggcaaagttgtgggtctggatggcgagcggcgtgatgaggctgctgagctccggaccgaaggcgaaggcgttgttggcgcacgaggccgacgagcaggccgcgcacggggcccccggcgccagcaggtcctcggcgcccccggtgccgtacagcagagcggccgcagccgcggccgccgcggaggcgcagcatgtcggggcgcccgagggcgtggaggccgcggaggccgaggaacaggaggaggcggaggaggagcaggacgaggccgaagagcaggagggcggcggcggcgtgcgcgacgtggggctgtcgagcagcagcggcgactcgaggccgcccgggggctgatggtggcccgacgggaagcccgagaagctgaggctgtggtgcaacttgggccgcggctcccgcgggaagcccaggtgcaacgcatcgcgcgtgccaaaggcacgcaggtccccggaggcgccccccgacggcgcgggccgccgctcgtccgcgttgtggatgaagtggcagcgcggcccataggggcagaagccgatggtatgaaaggtgcggcacagctcggtcttgtacttcggatggcgagtcaggctgcgcagctcgtggaagccatgcgcgaactggcacttttcgccgtacttgcacg

SEQ ID NO: 117552 - DNA, 30 bp, Homo sapiens; identical to SEQ ID NO: 86523
  misc_feature 1..30: note = chr2:43654231-43654261
  misc_feature 1..30: note = Hypo
  source 1..30: mol_type = genomic DNA

SEQ ID NO: 117553 - DNA, 107 bp, Homo sapiens; identical to SEQ ID NO: 39512
  misc_feature 1..107: note = chr2:43812086-43812193
  misc_feature 1..107: note = Hypo
  source 1..107: mol_type = genomic DNA

SEQ ID NO: 117554 - DNA, 21 bp, Homo sapiens
  misc_feature 1..21: note = chr2:43824111-43824132
  misc_feature 1..21: note = Hypo
  source 1..21: mol_type = genomic DNA
ggctgtagtgctcttcgccca

SEQ ID NO: 117555 - DNA, 21 bp, Homo sapiens
  misc_feature 1..21: note = chr2:43824372-43824393
  misc_feature 1..21: note = Hypo
  source 1..21: mol_type = genomic DNA
ccatggcgcccggaccgtaat

SEQ ID NO: 117556 - DNA, 534 bp, Homo sapiens; identical to SEQ ID NO: 86527
  misc_feature 1..534: note = chr2:43864196-43864730
  misc_feature 1..534: note = Hyper
  source 1..534: mol_type = genomic DNA

SEQ ID NO: 117557 - DNA, 53 bp, Homo sapiens; identical to SEQ ID NO: 86528
  misc_feature 1..53: note = chr2:43865097-43865150
  misc_feature 1..53: note = Hyper
  source 1..53: mol_type = genomic DNA

SEQ ID NO: 117558 - DNA, 32 bp, Homo sapiens; identical to SEQ ID NO: 86529
  misc_feature 1..32: note = chr2:44104688-44104720
  misc_feature 1..32: note = Hypo
  source 1..32: mol_type = genomic DNA

SEQ ID NO: 117559 - DNA, 30 bp, Homo sapiens; identical to SEQ ID NO: 86530
  misc_feature 1..30: note = chr2:44126101-44126131
  misc_feature 1..30: note = Hypo
  source 1..30: mol_type = genomic DNA

SEQ ID NO: 117560 - DNA, 91 bp, Homo sapiens; identical to SEQ ID NO: 86531
  misc_feature 1..91: note = chr2:44224202-44224293
  misc_feature 1..91: note = Hypo
  source 1..91: mol_type = genomic DNA

SEQ ID NO: 117561 - DNA, 45 bp, Homo sapiens; identical to SEQ ID NO: 39515
  misc_feature 1..45: note = chr2:44497699-44497744
  misc_feature 1..45: note = Hypo
  source 1..45: mol_type = genomic DNA

SEQ ID NO: 117562 - DNA, 431 bp, Homo sapiens
  misc_feature 1..431: note = chr2:45028940-45029371
  misc_feature 1..431: note = Hyper
  source 1..431: mol_type = genomic DNA
tccttttaattgtgacggtgcggccgcttgggcgtgatcccttggctggggctgcagggggcccgtcctccaggggcgcagagggaaggaccagcgtttccaagccgggctctggccgccggcgcgagagcgaggccaaggtctgggggcagttcagggggaccccgaagtcgggacggcccagaaacgctttgcccacagccaccgccctttcctttgtgagtttccccaaagccgtcggtgcgacccggcgccgactctcctcctcttctccctgcgagggcccgcgccgcccgggcccagtcctgggggatagatccctcggggcccaacggctgggccaccgccggtctccggccactgctgcgaggacaggcgctgcctaactaatttctcctctaagggggctgtgcgtgcgtctccttcccaac

SEQ ID NO: 117563 - DNA, 446 bp, Homo sapiens
  misc_feature 1..446: note = chr2:45029713-45030159
  misc_feature 1..446: note = Hyper
  source 1..446: mol_type = genomic DNA
gtacacttagctactcgctcagccgcggtggcggggcccgcgcggtccctccgcagactcgcgggccgggggaggccctgctgcggcgccgcggcgtaccaagggttaagcggcgcggctcgcggccctcccggctcccctcccctgcgtgttgattttcaggcccaccgagccgcccgagaaagttttcaattcgatggggctgcagcgtctcaggggctgagctccttagaaagcttcgggggcccccgagggccgccttgcggggagggggcggctgccccgtccgggacccgctaattacagggattcggtttccccgctctgaaggaatgcattacctgcagcaaaggaggcgcggcctctcaggaaggccccgagaggaagctgaatgccccagtgcattccagccccatccctaggtttatacccgcaacctcagccca

SEQ ID NO: 117564 - DNA, 30 bp, Homo sapiens; identical to SEQ ID NO: 86537
  misc_feature 1..30: note = chr2:45034776-45034806
  misc_feature 1..30: note = Hyper
  source 1..30: mol_type = genomic DNA

SEQ ID NO: 117565 - DNA, 143 bp, Homo sapiens; identical to SEQ ID NO: 86538
  misc_feature 1..143: note = chr2:45154224-45154367
  misc_feature 1..143: note = Hyper
  source 1..143: mol_type = genomic DNA

SEQ ID NO: 117566 - DNA, 2555 bp, Homo sapiens
  misc_feature 1..2555: note = chr2:45155125-45157680
  misc_feature 1..2555: note = Hyper
  source 1..2555: mol_type = genomic DNA
ttgcttttggtgtgccggcaacttttggttgttgctgctgttgccagtgcgcttagcagagtaggaagctcgaagcgcaaagcaaccggaccgaggcagctctgccttcttgcagcccaagggtcctgcaagccgctctttctctctgcgcagcttcagcgatccaggcgcgcagggcccggctgaatgctaatttgggatacacaggagcgcaagttcaccgagttttccgcagttttgcaaatccttttccctctccccatgcctcgcggtttaagaccacgcgatttcccaaaaagaaaaactcaaaagatgccaggcgccgggctggagtcacttagagccagctctggctgctcctccgcctccccgacccccggccgccgctccgccctgcccctcgcgcctcgaccccttctcccgaaactccgtcctctccgccgaggggctgccttgcccccaacccaccccccgcgtggagaataaacacagttgacatcactcttataatctttatttaaaactgtttccaaggttacaaattgccgagcctcgtatgcaacaggttcctccaaagcggtatcattacagattaactgtaatgtgtaggattagaataaaagcataagggattaggtaaaagggcgacgctccagacataacgcccgagcgcatctcgactgagtcagcctagggagactgcgaaggcgcagggtgtcggggcgccacggggccgcaaagccggactcggttcctccgctcccggccctggccccggccccagagcggtcgggacagcggcgccggaaggccaacgcggccgaaggtttcggagccaggcttcccgggcgtcaggggctagggacgggtccccggagctggggaagatgaggggccgagaggccgtggaggcggaggacgcgggcaagccacggcccggctgggagcttcgggaagcgccgcgcccgggacgcggtctccgggcggggcgaagcgcagggaaggcggcgagggggtccccacacccgcacggggcaccgggtttgtccatgtgggtgacactgccttcaaggcccaggcccgatggggcccttcctggcgtcctcctcacccccactccgccgcgcctcccctgtccagctggggctggggacagcggcaggggctgggcagccgcgcaggccgcccgcacccttccgagcccaggcctcgggccttcgccgcccgcccaggccgtgcgccctattggaccaccttccccccggccttcgcctgcccctctcgcgccaggaaggccctggagctccctctccccctcacaccgcttcctgcggggccagggctcgccgtgctggccccatttggactcaggcctgacctgggccacggcctcaggccgctgacgcagccccgagggctgtttgcgtgttggggtggagggcgcggggctggaaaaacaaacagggcgggggcgcggaggtttggggtgggggccgcagggggctggaaggaagtgcgcagtgtggcgagagcgcgaacaaagccctctccggagccccgtcacccctcggtgaccccaggcccgccccgctgagccgcggggctcccgggcctcgcctccgagcaggccgcaccgcccggtgggcgcacgtcaggcctccgcggccgcccgggccagtgctcccctcggtccccgcaggccgagcccgcggccggccccgaaggcgcgagggacagcgcggccggcggtggagcctcactcaggcacggagcccacagagcgaggctgaggaggactccatgctgttgtccgtcgggaaaccggactactctggggcgcgctggagccaccattctgccagcagccggggaggggccgcgagggctcccaagtggacggaagtaggcgaccaacttcgccgcgactcctgcttcctagagaagggccttggctgaggaggcggcgggaggggactgttgcaaacagctgttcctcatacatatttcattacacaatcagataatgcgtcccaccaccttctcaattattcacagataaacattttcaagacgttttgacatctgtcttagtgcctgctattaatttagtaatcactgtagttaaaaatgtatgggatttttgccgtcggagcacctcgtatccggcgcgcgggcccagtgtgggactgcggctgggagcccgggccctccgggagtgaagatacctttggaggtgagacggcctctctagcgcgttgacactgttgatggaagggattaaaggggtatcaggttattttaatttattgttgaagatgatgactgccccctccccgatccgcataccgtcctcactttcccaccccaaccctagacccgacaacaccgttcagccctttgccccgggcagcggaaatggttagcttcctctaggagtttctgctgaggaaggcgcaggcaaccctagtcggcttagagagagacaaccgcacgcgatcaccgagcacgatttctcccaacaaaaaaactaacaataatagcgatccacacactca

SEQ ID NO: 117567 - DNA, 1526 bp, Homo sapiens; identical to SEQ ID NO: 86543
  misc_feature 1..1526: note = chr2:45159488-45161014
  misc_feature 1..1526: note = Hyper
  source 1..1526: mol_type = genomic DNA

SEQ ID NO: 117568 - DNA, 1934 bp, Homo sapiens
  misc_feature 1..1934: note = chr2:45161221-45163155
  misc_feature 1..1934: note = Hyper
  source 1..1934: mol_type = genomic DNA
gagaggatggggaaacgcgcgccccaagagcaaaagcaaacagctgtggaggcgctgcccgcggctcaggcttcccaacaggttagctatactgggatccacccggcatttcgcaggaaggggtggggggaagacagagcgagagggggagagaggctcacaagaggacagagggagggagggaaagagagataggagccagagagcgcaccgcgcggcttaaaaggagagacttactaatgaatatttatccgccgctgctccgtgctcccggcttcccttacctttcggcaggtaagatcctccctgtgccccagccccgggggccctcctagctccccagtcggggagcctgtggctgggcgggagggctctccgttggtgggggtgggagggcggctctactctgcgttcactttgggtgcccaggcatgcgaccctgcacgactaggaaccgcgtgcgtgggctccatgtgtggaatgagtgtgagcatgtaagagtgtgtttgtgtgtgtgcgagagagagacagagagactatgcgcccgcaagcgcgcgcgcgcgcctgtttgtggcgcgctctggaaacattttccgacttttcactcggacgccctggatttctcgcctttgcctttctctgcttcccctccctcttctctcgccctcccctcccccacccaggtctaccccaccctaccccactcctaccccggctgctgaggcgctcttctgccggctattgtacggctggcgcgggctccccctggccacatcccgggcctctcacacaagaagaatagttctgtttccgccgtaaacccccacacaaaggctgcccggccaccgggtcccctgtcccccttcccggggacttcggcttttgaggtgctgctgcgcgttctttctccctccccctctcagggcgccagggcccagaccaaggagctaagagtgatcgggacttgggggtaccgggtggaactccttgggggccgcccgccaggcttcctgggctgcaactcggagcccagagacccccaggggaagggcgcctcttcccccaccaccaccccagccgtcgcctgcgggaggagcacggggaacccggcccagccaaagggggaagagggaggggaaaaggaagaaggtcggggaggggctgaccatataaccagaattctttaaacggacttacccggccacctgttgagaatccatgtggggtcggctggctccggagttgcgcaaggtggacacacaaaaccaaaagccggagttgggaaaagaaaattctttctctgaccatgccagacgcggccggtcaggctcgcagctccgcgctaggatcgggcggctgtacaaccaagatcgactttgccctgtcccccaacgcccccctcatcccacggctccacggctgggaggctccggactcagagctcgcggactcggcgctcagggtcagcaccagcagctcggcttaagccggggcaggctctctaagccctgctcagaagtcaagagcagcagtgctgcctctcctcgccgcctttcatgccgcggccgctccttattcttgtgtctcggcctctcccggccccctcggacaaaacccccagagcccggccactctcttcccgctaaatccccttcggggtcagtgctctaccagcaccgggccgcgcgcctctcctgccagccgtgtggctcttaaagagctgcacccctcctccgccctgcgcgatcccccgacccccgcctcccctcccctctcctccggatctagccccccacgccgacgcctgaggtccctgctgccccgaccgatgcctgcggactcccagccccctcccctcgcctcctcccctgagcagccggtgggcctggcctcgaggccacagggctgagttctaccctcgcctcaggtcccct

SEQ ID NO: 117569 - DNA, 539 bp, Homo sapiens
  misc_feature 1..539: note = chr2:45164617-45165156
  misc_feature 1..539: note = Hyper
  source 1..539: mol_type = genomic DNA
aggccgcctttgagccgtcggggcggcttcattaagctgcgctaacaaggcgtacaaatgccgagcccagcagctttcttgcaatgcccggccttagcagggcgccggactaatgagggtcactcaaaggggctgatcaaatattcaaatttccccgcacgccaggaacttttatgcatggagaaagttgaggcaactgagctgtgtttactgtccggggcgacaattgcttggagcgccagtccccggaggctaaggcggggggcgggggtgcggggagggagcagttgttgttgttgtttttcaaaggaaagtaatcggggtccttgaagggcttcgcggcctccccgcctgcgtgctgcgctcccctgcgccctccctggccgcccgcgccaagcgcctcagtttgcagcttgcggggaggcccagactacgggccacccggccagcctccgcctcccgacatcctgggagccggaaggggcgttgcccccacagggcaaaccttcccccggcctcctggtcggctgtttagagct

SEQ ID NO: 117570 - DNA, 1043 bp, Homo sapiens; identical to SEQ ID NO: 86549
  misc_feature 1..1043: note = chr2:45165470-45166513
  misc_feature 1..1043: note = Hyper
  source 1..1043: mol_type = genomic DNA

SEQ ID NO: 117571 - DNA, 43 bp, Homo sapiens; identical to SEQ ID NO: 86550
  misc_feature 1..43: note = chr2:45168189-45168232
  misc_feature 1..43: note = Hyper
  source 1..43: mol_type = genomic DNA

SEQ ID NO: 117572 - DNA, 93 bp, Homo sapiens; identical to SEQ ID NO: 27186
  misc_feature 1..93: note = chr2:45168959-45169052
  misc_feature 1..93: note = Hyper
  source 1..93: mol_type = genomic DNA

SEQ ID NO: 117573 - DNA, 926 bp, Homo sapiens
  misc_feature 1..926: note = chr2:45169287-45170213
  misc_feature 1..926: note = Hyper
  source 1..926: mol_type = genomic DNA
gttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggttagtggcggggcccgcggcctggctacagcctcagaggcctgggaaggggagaggggttgagatggggctagcggagcggccgctgagagccagggaagccgtgactcctggccagtcggagaaagtttccgcttgtccgggacgcgcggaagagggggccg

SEQ ID NO: 117574 - DNA, 678 bp, Homo sapiens
  misc_feature 1..678: note = chr2:45171246-45171924
  misc_feature 1..678: note = Hyper
  source 1..678: mol_type = genomic DNA
tccccacttttccaccgccagctttcctattttctctaccctcggtcctgcgctctgcgctggcatccagagagcaaagtatgcagttctacccggagactggccgggcggtggggaacccgcagctcccggtgtgtgtttgagggagcagggacggggttactaggggaactcgaccggtcgcggggcagccggctcagtttgaagagccccagggactgcggagggaagaagcgcccggctcctctccgacttctgcttctccagggcttggcgtactttgtcgcttgcacccaggcctccccaagcggccgggctcgggttctgcctctcctccgaggccagcctctatctgagaagacttgggatgctcccgaaagcggaatggggagcggcggcgcgggggagccgggtggcgggcctctgtgtcagggcgggcgcggatctctttctcccgcaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctct

SEQ ID NO: 117575 - DNA, 271 bp, Homo sapiens; identical to SEQ ID NO: 86557
  misc_feature 1..271: note = chr2:45172153-45172424
  misc_feature 1..271: note = Hyper
  source 1..271: mol_type = genomic DNA

SEQ ID NO: 117576 - DNA, 641 bp, Homo sapiens; identical to SEQ ID NO: 86558
  misc_feature 1..641: note = chr2:45176593-45177234
  misc_feature 1..641: note = Hyper
  source 1..641: mol_type = genomic DNA

SEQ ID NO: 117577 - DNA, 760 bp, Homo sapiens; identical to SEQ ID NO: 86559
  misc_feature 1..760: note = chr2:45179296-45180056
  misc_feature 1..760: note = Hyper
  source 1..760: mol_type = genomic DNA

SEQ ID NO: 117578 - DNA, 984 bp, Homo sapiens; identical to SEQ ID NO: 86560
  misc_feature 1..984: note = chr2:45181451-45182435
  misc_feature 1..984: note = Hyper
  source 1..984: mol_type = genomic DNA

SEQ ID NO: 117579 - DNA, 487 bp, Homo sapiens
  misc_feature 1..487: note = chr2:45231112-45231599
  misc_feature 1..487: note = Hyper
  source 1..487: mol_type = genomic DNA
cttagaaagtccaagcgaaagggtattctgattttatcccggttttaccagaaaatgctgaaaggaaaagccccgagaggacacagtgctctaggaactcggggcgccacgagcgcctcatcccctcccttccgcccggccgcggtgccctggtcgctgagggacgcggtcagtacctaccgccactgcgacccgagaagggaaagcctcaacttcttcctctcggagtcctgcccactacggatctgcctggactggttcagatgcgtcgtttaaaggggggggctggcactccagagaggagggggcgctgcaggttaattgatagccacggaagcacctaggcgccccatgcgcggagccggagccgccagctcagtctgacccctgtcttttctctcctcttccctctcccacccctcactccgggaaagcgagggccgaggtaggggcagatagatcaccagacaggcggagaaggacagga

SEQ ID NO: 117580 - DNA, 341 bp, Homo sapiens; identical to SEQ ID NO: 27198
  misc_feature 1..341: note = chr2:45231852-45232193
  misc_feature 1..341: note = Hyper
  source 1..341: mol_type = genomic DNA

SEQ ID NO: 117581 - DNA, 61 bp, Homo sapiens; identical to SEQ ID NO: 86564
  misc_feature 1..61: note = chr2:45232401-45232462
  misc_feature 1..61: note = Hyper
  source 1..61: mol_type = genomic DNA

SEQ ID NO: 117582 - DNA, 413 bp, Homo sapiens; identical to SEQ ID NO: 86565
  misc_feature 1..413: note = chr2:45233374-45233787
  misc_feature 1..413: note = Hyper
  source 1..413: mol_type = genomic DNA

SEQ ID NO: 117583 - DNA, 1411 bp, Homo sapiens; identical to SEQ ID NO: 27201
  misc_feature 1..1411: note = chr2:45235475-45236886
  misc_feature 1..1411: note = Hyper
  source 1..1411: mol_type = genomic DNA

SEQ ID NO: 117584 - DNA, 765 bp, Homo sapiens
  misc_feature 1..765: note = chr2:45237178-45237943
  misc_feature 1..765: note = Hyper
  source 1..765: mol_type = genomic DNA
gggcacattctaccccggcgcaggccagtgggatgggagagtttggacgtgctcgggtgccgcccaaagacttggctttttctgctgacagcgccccacccccatcctagaaactctggactcagcggtcctcgagggaaaaggggagggagtagacgaaagaaatggggaagatttggcagtggccgcaggcggacgccggagaatcgacttcccggaggatcccgcctttcctccctctcctagccccgccggctgcctggcggcctgtaccgccccaactctgcgctctctgctcctcgccgggcggggactcagacttaaccccacgggtcccacagcccgaggagcgccaggcagttccgtgtggcctctatggaagctgactccggccggcagctgcgacgcagaaccccggacggcgcagacccgcagtctgcccaccggggcgggggagaggggcgacggcagggactctaggacggtggtggggcttccccggtgggtggtcggggaggagaacggaggcaagattcccagtcctcccgcttcgccgctggggatcggctcggctcctggccactccagcctgggaaccggctcgctgagctccgggatgaggtgctttaaaagggggtcctgttttttgcttctttgtcagggtgccaatggaaacatgtggtgctggtcctgtgggagaagggctcgcacaaaggtgggagaactgaggatgggtgtgttcttgctctacgttttgaaaagccc

SEQ ID NO: 117585 - DNA, 1500 bp, Homo sapiens
  misc_feature 1..1500: note = chr2:45240323-45241823
  misc_feature 1..1500: note = Hyper
  source 1..1500: mol_type = genomic DNA
tccagcctataaaggcggcagaaatcccctgggtagactctggccctggcgccgcccgcctcgggcgctccatgctgctccgcacctcgggctctgggatgctccggcctggatggaggctctccgccctctcccagctccgagcgccccagccgacatgggcctggcgcgttccccagacagtcccggagttctctgggcctgggcgacgtgtttcgttgaaagcgggcaggtggtgccgggcggggctgcgctgaggctccggtgcctccccacctgcccctcgtacctgccggtctgtcgggtcccggcggacgcaaccagctactcgcaaaccctgcaccagcggttttccgtgttgtcctaagaggggcaggtcagggcgaggccagtcggctcacacgaattctctgtgtcggagaacacgccccgcgacgttccgagcccgggcaaggttgagaggcgctgggctccgggcggtcgcactcttggaaccgcgcgaaccgcggcgtcgcccgcgccgcacgtggctggggcagtcacaggccccgagagctggagcaacggggtcaccgccacccctctgccctccaggccttcaccttgagacccacgcggcagcctggagggcccacaagagcaaacggtttagaggccgcgggctcacgagggatcttgttcaaacgaaaagaacgagcacaggggctcggggccagcctggaggccggcacagaggcgagtcggcccgggtggcgccgggaccaggcgggatttggggcgggtatccgggcccgggcgctggcagcctccctgcgacccccggccctgcgtccccgcccgcggtcccgccttagtcctggagtcccttcctgggccccttcgcctgggtgcggaggggcgcgggcgcggcgggcagggccacggggcgaggggacgggctcgcggctttgggttcagggagccgcggagctccaccgccgggttgttttgcaatggggctttggagaggttgcgcgtcccgggccccatggctccgccgggtctgcacgccagcgcccccacgcggcgggcccagagttcaggccggcggggctgcgcgctcggctccccgcaggcctgtagcccaggagggagaggagggagaggacgcggagagggcccgctggttcttccctcctcaccccagcactgacccgcctgtgcgctggcacggagggctcgaaaatcggggcgcgtccgcgaagagcgagacctcggagacagacacacaacccagaggtgcactaggttgccagacggtctgatcacaggattcttggggggatagacgctggcttttctccatcacacgtttcccctgcaacgtctgggtgcccaggaaatgtttgaatggatgcctgaatgaccaatcgggtttgactgacagcaacagctgggaagtgacccggccaataggagaatggccctcttcctcctctttcctcccgctcttctctccca

SEQ ID NO: 117586 - DNA, 1141 bp, Homo sapiens; identical to SEQ ID NO: 86573
  misc_feature 1..1141: note = chr2:45395854-45396995
  misc_feature 1..1141: note = Hyper
  source 1..1141: mol_type = genomic DNA

SEQ ID NO: 117587 - DNA, 54 bp, Homo sapiens; identical to SEQ ID NO: 86574
  misc_feature 1..54: note = chr2:45397223-45397277
  misc_feature 1..54: note = Hyper
  source 1..54: mol_type = genomic DNA

SEQ ID NO: 117588 - DNA, 77 bp, Homo sapiens; identical to SEQ ID NO: 86575
  misc_feature 1..77: note = chr2:45879337-45879414
  misc_feature 1..77: note = Hyper
  source 1..77: mol_type = genomic DNA

SEQ ID NO: 117589 - DNA, 45 bp, Homo sapiens; identical to SEQ ID NO: 86576
  misc_feature 1..45: note = chr2:46525712-46525757
  misc_feature 1..45: note = Hyper
  source 1..45: mol_type = genomic DNA

SEQ ID NO: 117590 - DNA, 237 bp, Homo sapiens; identical to SEQ ID NO: 86577
  misc_feature 1..237: note = chr2:46526002-46526239
  misc_feature 1..237: note = Hyper
  source 1..237: mol_type = genomic DNA

SEQ ID NO: 117591 - DNA, 132 bp, Homo sapiens; identical to SEQ ID NO: 86578
  misc_feature 1..132: note = chr2:46770699-46770831
  misc_feature 1..132: note = Hyper
  source 1..132: mol_type = genomic DNA

SEQ ID NO: 117592 - DNA, 16 bp, Homo sapiens
  misc_feature 1..16: note = chr2:47194061-47194077
  misc_feature 1..16: note = Hypo
  source 1..16: mol_type = genomic DNA
attgtgttggccgggc

SEQ ID NO: 117593 - DNA, 160 bp, Homo sapiens; identical to SEQ ID NO: 86582
  misc_feature 1..160: note = chr2:47200582-47200742
  misc_feature 1..160: note = Hypo
  source 1..160: mol_type = genomic DNA

SEQ ID NO: 117594 - DNA, 47 bp, Homo sapiens; identical to SEQ ID NO: 86583
  misc_feature 1..47: note = chr2:47235457-47235504
  misc_feature 1..47: note = Hypo
  source 1..47: mol_type = genomic DNA

SEQ ID NO: 117595 - DNA, 30 bp, Homo sapiens; identical to SEQ ID NO: 86584
  misc_feature 1..30: note = chr2:47249809-47249839
  misc_feature 1..30: note = Hypo
  source 1..30: mol_type = genomic DNA

SEQ ID NO: 117596 - DNA, 89 bp, Homo sapiens; identical to SEQ ID NO: 86585
  misc_feature 1..89: note = chr2:47335736-47335825
  misc_feature 1..89: note = Hypo
  source 1..89: mol_type = genomic DNA

SEQ ID NO: 117597 - DNA, 185 bp, Homo sapiens; identical to SEQ ID NO: 86586
  misc_feature 1..185: note = chr2:47567513-47567698
  misc_feature 1..185: note = Hypo
  source 1..185: mol_type = genomic DNA

SEQ ID NO: 117598 - DNA, 30 bp, Homo sapiens; identical to SEQ ID NO: 39518
  misc_feature 1..30: note = chr2:47574359-47574389
  misc_feature 1..30: note = Hypo
  source 1..30: mol_type = genomic DNA

SEQ ID NO: 117599 - DNA, 229 bp, Homo sapiens; identical to SEQ ID NO: 86588
  misc_feature 1..229: note = chr2:47596565-47596794
  misc_feature 1..229: note = Hyper
  source 1..229: mol_type = genomic DNA

SEQ ID NO: 117600 - DNA, 120 bp, Homo sapiens; identical to SEQ ID NO: 39519
  misc_feature 1..120: note = chr2:47597757-47597877
  misc_feature 1..120: note = Hypo
  source 1..120: mol_type = genomic DNA

SEQ ID NO: 117601 - DNA, 180 bp, Homo sapiens; identical to SEQ ID NO: 39520
  misc_feature 1..180: note = chr2:47598297-47598477
  misc_feature 1..180: note = Hypo
  source 1..180: mol_type = genomic DNA

SEQ ID NO: 117602 - DNA, 83 bp, Homo sapiens; identical to SEQ ID NO: 39521
  misc_feature 1..83: note = chr2:47598537-47598620
  misc_feature 1..83: note = Hypo
  source 1..83: mol_type = genomic DNA

SEQ ID NO: 117603 - DNA, 42 bp, Homo sapiens; identical to SEQ ID NO: 86592
  misc_feature 1..42: note = chr2:47599472-47599514
  misc_feature 1..42: note = Hypo
  source 1..42: mol_type = genomic DNA

SEQ ID NO: 117604 - DNA, 473 bp, Homo sapiens; identical to SEQ ID NO: 86593
  misc_feature 1..473: note = chr2:47748050-47748523
  misc_feature 1..473: note = Hyper
  source 1..473: mol_type = genomic DNA

SEQ ID NO: 117605 - DNA, 40 bp, Homo sapiens; identical to SEQ ID NO: 27215
  misc_feature 1..40: note = chr2:47748726-47748766
  misc_feature 1..40: note = Hyper
  source 1..40: mol_type = genomic DNA

SEQ ID NO: 117606 - DNA, 45 bp, Homo sapiens; identical to SEQ ID NO: 86595
  misc_feature 1..45: note = chr2:47753181-47753226
  misc_feature 1..45: note = Hypo
  source 1..45: mol_type = genomic DNA

SEQ ID NO: 117607 - DNA, 2488 bp, Homo sapiens
  misc_feature 1..2488: note = chr2:47796750-47799238
  misc_feature 1..2488: note = Hyper
  source 1..2488: mol_type = genomic DNA
aaaacaggaaggaaccggtagcccttggcacgtattcttagaggagaaaacggaggctcacaaaggtcagatcacagagccggccagtgttggagcacaggcggcccggggtgagcgccagaggtgggctttcttccctcactgaaagccgggagggagagagagagagagaacgggggccggcggagaagagggcgagacgaaagtaagcaaagggacattagaagggaaggcagagccgagggacgcggaccgagcggccgagcagtggaaagggcggcaggtgaaaggcacagagaggaaagatgcgcgggggacgcgccgctcacctatggttgacaccacggtgcccacgaagtagaaggcgccggggaagtcccagcgcgggcgcagcgcgtcggcgcggacgccggcggccagcgcggcctcgtagtgccggaggaaggcgcgcagctctggctcggccacgccgtgcgcagcgctgaagttgcgcagcgtggcgccccagcgcgcccgcgcctccgcctcgccggggctctcgagcgccgagaagactgtggcacccgccaccaggtagaggccgatgagcgccgccagcagcacgaagcggccggtgtcctcgttgaggtgcgaacggcggcagcagcagcagcagcaggaggggcgcggcaggcggcggcggctacggcggggcgggggccgggggctgcgggaggacatggtccggagctcagccccggggccggggcggcgctcggggcccgggccacgacatccccccggcgggagcaggagcgtgaggatggtggccaggggtccggggccgccgcggagcccctcgccgccttcgcagagcccctcgtcgccttcccagagcccggacagaggggcgcctccgcctcctccccggcgctcaggccacacgcgagtcccgtggcccagcgggtgcccgggcaggggcgctcctctgcgcgccccgacgcctcgccggctcccgcggctccttacccgccgctctcgggcgcggggctccgcagctaggcccctgccgcccggtggccggcgtccgcggggccccgggcctcatactcctctccagacaggccgcgggctgcgggcggggtgggccgtggatcccgggcgcctaggaccgggacgcggcagcaaggcgtggagagagcccccgggggcgtcccatgaggcgttcgggatcggcgcctcctaggtgcgggctgtgcgggcagtcctgctcccgcccccggggctgagctggcggcgtcggcttcagagcctcggagccgagccgagtccggggaagcgctcctttctcagctccagccgaagagccgcccggcagggagaggcggagtcactggcgcccggggcggggtgttggggaggggtgagtagggacaggagggagggggtggagagttgggctgctgcgacgcctcccggtggctctggcggcaccaatgcggggcaccggagcaggtgtccgactgcggtgcgggctaccactccgccggggaacctcgtcttgctcctccctgcgcttcgcctctggaatctctcccttatctcatgccgcggtgaaactttgctcaagttggtggtgctctgaggtctccagggctggaggccgcgcgacgcgaatcgccgacactggattctcgggcgttagtccgaagtttaagttcccttcgttcactcctttgccctggatcgaaccgcagccccaggacgcagcgggttccactggaaacggggaatcggggagaggcggtcgctgggctccgggcgacctgggaacgagggcgtttgctccccctcccgaccgagcgggcggccggcgtcagcaccgcggacagcgcatcggtgccgcagccgcgggcgggcgccgctagggctgccaggggtccgaggcgcgggcaaggctgctcaccccgctgtgctgtgcaccccaaaccttccctgttttcctttctacctcccgtgtgcacccccctacccgccacccgaggcaggtgcggtcgctgaagcaggctgctgacagggcggggacgctgcggaatagagacgggggaggagtcaagcgcgggtagggggccaaggtgccacagggagaaagagcccaggcccggcggactgccgggctcctcgcgccaccccagctcaccgacccctctagcccggggcggggaataacaccctgggtgcggtagagagtagaggaatagaggaggtgtaggggaagctcactggcagctcccctgaggccggcgcggggaacggtgtgctatggaacgcccctgggaaatggtcgcccccctacgccccaccgcggcaggaaaagacgacggatgccccgcgcggctgcgggtgctcctctgctggacacaagccggctttgccggggccacaaaagttctggcgtggaacaccctcagtacaggcggaaaatcatcctcttcgggcagccagctcc

SEQ ID NO: 117608 - DNA, 91 bp, Homo sapiens; identical to SEQ ID NO: 86600
  misc_feature 1..91: note = chr2:48209807-48209898
  misc_feature 1..91: note = Hypo
  source 1..91: mol_type = genomic DNA

SEQ ID NO: 117609 - DNA, 193 bp, Homo sapiens; identical to SEQ ID NO: 86601
  misc_feature 1..193: note = chr2:48323080-48323273
  misc_feature 1..193: note = Hypo
  source 1..193: mol_type = genomic DNA

SEQ ID NO: 117610 - DNA, 182 bp, Homo sapiens; identical to SEQ ID NO: 86603
  misc_feature 1..182: note = chr2:48625247-48625429
  misc_feature 1..182: note = Hypo
  source 1..182: mol_type = genomic DNA

SEQ ID NO: 117611 - DNA, 149 bp, Homo sapiens; identical to SEQ ID NO: 86604
  misc_feature 1..149: note = chr2:48655875-48656024
  misc_feature 1..149: note = Hypo
  source 1..149: mol_type = genomic DNA

SEQ ID NO: 117612 - DNA, 85 bp, Homo sapiens; identical to SEQ ID NO: 86605
  misc_feature 1..85: note = chr2:48757541-48757626
  misc_feature 1..85: note = Hyper
  source 1..85: mol_type = genomic DNA

SEQ ID NO: 117613 - DNA, 420 bp, Homo sapiens
  misc_feature 1..420: note = chr2:48982519-48982939
  misc_feature 1..420: note = Hyper
  source 1..420: mol_type = genomic DNA
tttgatagggcaaagcgtttttctccaagcttccagggaaagggggccaaaggagtagggagggaaggtggcatagagcgatggagggtcctgcatcaagggcgccgcgacgggagcgctgtgtactcacagtcgagtgagaccggccgtggggccggggcagcgcagggcgccgtcgggcacgcagttgcagggctcagggcagagcgcctcgcgcagcgctcgtggcagcggcggctgcagcagcagcagcagcttcagcagctgcagcgccgagaaccgctgcttcatggccggcgaactgggcttctgcggcttgccagtgtcttggacggcctctgagtgcggcccgcacccctctccccgccccttggctgcccttccacacacccttccctgccggcccgcccctgccctccc

SEQ ID NO: 117614 - DNA, 19 bp, Homo sapiens
  misc_feature 1..19: note = chr2:49004570-49004589
  misc_feature 1..19: note = Hypo
  source 1..19: mol_type = genomic DNA
tcaccggctgattgtttta

SEQ ID NO: 117615 - DNA, 149 bp, Homo sapiens; identical to SEQ ID NO: 86609
  misc_feature 1..149: note = chr2:49172411-49172560
  misc_feature 1..149: note = Hypo
  source 1..149: mol_type = genomic DNA

SEQ ID NO: 117616 - DNA, 16 bp, Homo sapiens
  misc_feature 1..16: note = chr2:49461025-49461041
  misc_feature 1..16: note = Hypo
  source 1..16: mol_type = genomic DNA
ccgtagtgagcaccat

SEQ ID NO: 117617 - DNA, 92 bp, Homo sapiens; identical to SEQ ID NO: 86614
  misc_feature 1..92: note = chr2:50497730-50497822
  misc_feature 1..92: note = Hypo
  source 1..92: mol_type = genomic DNA

SEQ ID NO: 117618 - DNA, 379 bp, Homo sapiens
  misc_feature 1..379: note = chr2:50573464-50573843
  misc_feature 1..379: note = Hyper
  source 1..379: mol_type = genomic DNA
ggtcccttagctgagcgcggcgccccatccggccactgagtgaccttctggcaactgacgcccccttcccgcggggcccagccgcgcgaccagggctggtcctttagtaggtgtccacatctctctcccagtacctcgacaaggaacgcccctcccacccctcaccaccaacacccgcgacgccttcccccatcccctttctattgtcttcaaagagataagtggctcgcaccaagcacacccaaatgcacctcccttttgtcgagctcccatttctctgagccttaggagcccaggagcgagtgcagggtagaaagaggggagcgaggggataacccgcgagaacttggcatcgcagacccaccgtgtccgcctcgca

SEQ ID NO: 117619 - DNA, 1036 bp, Homo sapiens
  misc_feature 1..1036: note = chr2:50574047-50575083
  misc_feature 1..1036: note = Hyper
  source 1..1036: mol_type = genomic DNA
agcccagctcggcgccgcaccggagcatcctctggtacatggcggggcgcccgccgaggggcagccgccgcgggaggcaaagtttggggcgcggggagaggagagggcgcaggggagcgggcggcgcggagtgggctgaggggccggccgcctcaccgcgccagggcacccatcctctccctccttcggacagtcttctcggggtcctggagtccgccgtgcctagcaccccaaacaatccgaaacatagccgaggcgaatgcagctggagaggggcttgtccggaaaggcagccccgggaacagcaagcgcggagcgggtggctgctcccagatttccagggctccaggttctcgagagatactcccaaagagtttcgggcgagagtgcgtgccggcgggtggggggccgagaaattgtttaaagctcctcctggaaggtcctcacttctacatgacagacatccaccgcgaatccactaggtaaatccatttagctttgtgtgcggggactagggaggccacttcgccggcccaacctcctttcaagacagaagcagaccccatggaatccaggcgccccttccctccattcagccccggccggctcgcccgctagcgccagcctcccccgggcagcgcgcggagcagcggcgcgcatcgcctgctcccgaggcaatctccgcgtccgccgcctcctgacacttacgcccggcgaggggttcagagggaagagtgcgcccttctgaaggaagtgggaatcgaacggcggaaaggcagctgagaagaagatgcagacgaaggagtaagggagagaaacagaaaaagaaaaagaaaaagaaaaaaagaaaagaaaaaccacacacgctggtgaagcaaggggctctatgcaaatctgcagtctccaaacagcaaatcactgaagctcggatgcaatgcagaggacgagcctatgtaacgagggaggctggtctagcttcccacgaaaatcgccctgctttgcctctcccttgcattctccacgcatcaaagggaca

SEQ ID NO: 117620 - DNA, 305 bp, Homo sapiens; identical to SEQ ID NO: 86620
  misc_feature 1..305: note = chr2:51259261-51259566
  misc_feature 1..305: note = Hyper
  source 1..305: mol_type = genomic DNA

SEQ ID NO: 117621 - DNA, 67 bp, Homo sapiens; identical to SEQ ID NO: 86622
  misc_feature 1..67: note = chr2:52798706-52798773
  misc_feature 1..67: note = Hypo
  source 1..67: mol_type = genomic DNA

SEQ ID NO: 117622 - DNA, 132 bp, Homo sapiens; identical to SEQ ID NO: 86623
  misc_feature 1..132: note = chr2:52856761-52856893
  misc_feature 1..132: note = Hypo
  source 1..132: mol_type = genomic DNA

SEQ ID NO: 117623 - DNA, 66 bp, Homo sapiens; identical to SEQ ID NO: 86624
  misc_feature 1..66: note = chr2:53241890-53241956
  misc_feature 1..66: note = Hypo
  source 1..66: mol_type = genomic DNA

SEQ ID NO: 117624 - DNA, 30 bp, Homo sapiens; identical to SEQ ID NO: 86625
  misc_feature 1..30: note = chr2:53743692-53743722
  misc_feature 1..30: note = Hypo
  source 1..30: mol_type = genomic DNA

SEQ ID NO: 117625 - DNA, 82 bp, Homo sapiens; identical to SEQ ID NO: 86626
  misc_feature 1..82: note = chr2:54951713-54951795
  misc_feature 1..82: note = Hyper
  source 1..82: mol_type = genomic DNA

SEQ ID NO: 117626 - DNA, 199 bp, Homo sapiens; identical to SEQ ID NO: 86627
  misc_feature 1..199: note = chr2:54952233-54952432
  misc_feature 1..199: note = Hyper
  source 1..199: mol_type = genomic DNA

SEQ ID NO: 117627 - DNA, 62 bp, Homo sapiens; identical to SEQ ID NO: 86629
  misc_feature 1..62: note = chr2:55289153-55289215
  misc_feature 1..62: note = Hypo
  source 1..62: mol_type = genomic DNA

SEQ ID NO: 117628 - DNA, 82 bp, Homo sapiens; identical to SEQ ID NO: 86630
  misc_feature 1..82: note = chr2:55458383-55458465
  misc_feature 1..82: note = Hypo
  source 1..82: mol_type = genomic DNA

SEQ ID NO: 117629 - DNA, 30 bp, Homo sapiens; identical to SEQ ID NO: 86631
  misc_feature 1..30: note = chr2:55554706-55554736
  misc_feature 1..30: note = Hypo
  source 1..30: mol_type = genomic DNA

SEQ ID NO: 117630 - DNA, 30 bp, Homo sapiens; identical to SEQ ID NO: 86632
  misc_feature 1..30: note = chr2:55646190-55646220
  misc_feature 1..30: note = Hyper
  source 1..30: mol_type = genomic DNA

SEQ ID NO: 117631 - DNA, 30 bp, Homo sapiens; identical to SEQ ID NO: 86633
  misc_feature 1..30: note = chr2:55646428-55646458
  misc_feature 1..30: note = Hyper
  source 1..30: mol_type = genomic DNA

SEQ ID NO: 117632 - DNA, 96 bp, Homo sapiens; identical to SEQ ID NO: 86634
  misc_feature 1..96: note = chr2:55652969-55653065
  misc_feature 1..96: note = Hypo
  source 1..96: mol_type = genomic DNA

SEQ ID NO: 117633 - DNA, 21 bp, Homo sapiens
  misc_feature 1..21: note = chr2:55669245-55669266
  misc_feature 1..21: note = Hypo
  source 1..21: mol_type = genomic DNA
tggagccaagatggccgaata

SEQ ID NO: 117634 - DNA, 28 bp, Homo sapiens
  misc_feature 1..28: note = chr2:55874935-55874963
  misc_feature 1..28: note = Hypo
  source 1..28: mol_type = genomic DNA
gcgtgagccaccgcgcccagcagacatt

SEQ ID NO: 117635 - DNA, 638 bp, Homo sapiens; identical to SEQ ID NO: 86637
  misc_feature 1..638: note = chr2:56149809-56150447
  misc_feature 1..638: note = Hyper
  source 1..638: mol_type = genomic DNA

SEQ ID NO: 117636 - DNA, 455 bp, Homo sapiens; identical to SEQ ID NO: 86638
  misc_feature 1..455: note = chr2:56150698-56151153
  misc_feature 1..455: note = Hyper
  source 1..455: mol_type = genomic DNA

SEQ ID NO: 117637 - DNA, 21 bp, Homo sapiens
  misc_feature 1..21: note = chr2:56263732-56263753
  misc_feature 1..21: note = Hypo
  source 1..21: mol_type = genomic DNA
ccacagcgcctggccagatat

SEQ ID NO: 117638 - DNA, 253 bp, Homo sapiens; identical to SEQ ID NO: 86641
  misc_feature 1..253: note = chr2:56411000-56411253
  misc_feature 1..253: note = Hyper
  source 1..253: mol_type = genomic DNA

SEQ ID NO: 117639 - DNA, 270 bp, Homo sapiens; identical to SEQ ID NO: 86642
  misc_feature 1..270: note = chr2:56411529-56411799
  misc_feature 1..270: note = Hyper
  source 1..270: mol_type = genomic DNA

SEQ ID NO: 117640 - DNA, 72 bp, Homo sapiens; identical to SEQ ID NO: 86643
  misc_feature 1..72: note = chr2:56412255-56412327
  misc_feature 1..72: note = Hyper
  source 1..72: mol_type = genomic DNA

SEQ ID NO: 117641 - DNA, 29 bp, Homo sapiens
  misc_feature 1..29: note = chr2:58269102-58269131
  misc_feature 1..29: note = Hypo
  source 1..29: mol_type = genomic DNA
acaagtatcgattgacgtcttctgtctcc

SEQ ID NO: 117642 - DNA, 30 bp, Homo sapiens; identical to SEQ ID NO: 5265
  misc_feature 1..30: note = chr2:58614664-58614694
  misc_feature 1..30: note = Hypo
  source 1..30: mol_type = genomic DNA

SEQ ID NO: 117643 - DNA, 166 bp, Homo sapiens; identical to SEQ ID NO: 39527
  misc_feature 1..166: note = chr2:58641373-58641539
  misc_feature 1..166: note = Hypo
  source 1..166: mol_type = genomic DNA

SEQ ID NO: 117644 - DNA, 168 bp, Homo sapiens; identical to SEQ ID NO: 86661
  misc_feature 1..168: note = chr2:58654927-58655095
  misc_feature 1..168: note = Hyper
  source 1..168: mol_type = genomic DNA

SEQ ID NO: 117645 - DNA, 203 bp, Homo sapiens; identical to SEQ ID NO: 86662
  misc_feature 1..203: note = chr2:58655428-58655631
  misc_feature 1..203: note = Hyper
  source 1..203: mol_type = genomic DNA

SEQ ID NO: 117646 - DNA, 254 bp, Homo sapiens; identical to SEQ ID NO: 86663
  misc_feature 1..254: note = chr2:58655979-58656233
  misc_feature 1..254: note = Hyper
  source 1..254: mol_type = genomic DNA

SEQ ID NO: 117647 - DNA, 166 bp, Homo sapiens; identical to SEQ ID NO: 86666
  misc_feature 1..166: note = chr2:58943963-58944129
  misc_feature 1..166: note = Hypo
  source 1..166: mol_type = genomic DNA

SEQ ID NO: 117648 - DNA, 30 bp, Homo sapiens; identical to SEQ ID NO: 86667
  misc_feature 1..30: note = chr2:59140038-59140068
  misc_feature 1..30: note = Hypo
  source 1..30: mol_type = genomic DNA

SEQ ID NO: 117649 - DNA, 30 bp, Homo sapiens; identical to SEQ ID NO: 86668
  misc_feature 1..30: note = chr2:59145084-59145114
  misc_feature 1..30: note = Hypo
  source 1..30: mol_type = genomic DNA

SEQ ID NO: 117650 - DNA, 18 bp, Homo sapiens
  misc_feature 1..18: note = chr2:59269708-59269726
  misc_feature 1..18: note = Hypo
  source 1..18: mol_type = genomic DNA
tgtcgcatttactaacat

SEQ ID NO: 117651 - DNA, 209 bp, Homo sapiens; identical to SEQ ID NO: 86670
  misc_feature 1..209: note = chr2:59273588-59273797
  misc_feature 1..209: note = Hypo
  source 1..209: mol_type = genomic DNA

SEQ ID NO: 117652 - DNA, 30 bp, Homo sapiens; identical to SEQ ID NO: 86671
  misc_feature 1..30: note = chr2:59393002-59393032
  misc_feature 1..30: note = Hypo
  source 1..30: mol_type = genomic DNA

SEQ ID NO: 117653 - DNA, 103 bp, Homo sapiens; identical to SEQ ID NO: 86672
  misc_feature 1..103: note = chr2:59479352-59479455
  misc_feature 1..103: note = Hypo
  source 1..103: mol_type = genomic DNA

SEQ ID NO: 117654 - DNA, 82 bp, Homo sapiens; identical to SEQ ID NO: 86675
  misc_feature 1..82: note = chr2:60411668-60411750
  misc_feature 1..82: note = Hypo
  source 1..82: mol_type = genomic DNA

SEQ ID NO: 117655 - DNA, 172 bp, Homo sapiens; identical to SEQ ID NO: 86676
  misc_feature 1..172: note = chr2:60442223-60442395
  misc_feature 1..172: note = Hypo
  source 1..172: mol_type = genomic DNA

SEQ ID NO: 117656 - DNA, 30 bp, Homo sapiens; identical to SEQ ID NO: 86677
  misc_feature 1..30: note = chr2:60687883-60687913
  misc_feature 1..30: note = Hypo
  source 1..30: mol_type = genomic DNA

SEQ ID NO: 117657 - DNA, 110 bp, Homo sapiens; identical to SEQ ID NO: 14414
  misc_feature 1..110: note = chr2:60705907-60706017
  misc_feature 1..110: note = Hypo
  source 1..110: mol_type = genomic DNA

SEQ ID NO: 117658 - DNA, 30 bp, Homo sapiens; identical to SEQ ID NO: 86679
  misc_feature 1..30: note = chr2:60706520-60706550
  misc_feature 1..30: note = Hypo
  source 1..30: mol_type = genomic DNA

SEQ ID NO: 117659 - DNA, 217 bp, Homo sapiens; identical to SEQ ID NO: 86680
  misc_feature 1..217: note = chr2:60706757-60706974
  misc_feature 1..217: note = Hypo
  source 1..217: mol_type = genomic DNA

SEQ ID NO: 117660 - DNA, 30 bp, Homo sapiens; identical to SEQ ID NO: 86681
  misc_feature 1..30: note = chr2:60732287-60732317
  misc_feature 1..30: note = Hypo
  source 1..30: mol_type = genomic DNA

SEQ ID NO: 117661 - DNA, 30 bp, Homo sapiens; identical to SEQ ID NO: 39533
  misc_feature 1..30: note = chr2:60733708-60733738
  misc_feature 1..30: note = Hypo
  source 1..30: mol_type = genomic DNA

SEQ ID NO: 117662 - DNA, 98 bp, Homo sapiens; identical to SEQ ID NO: 86683
  misc_feature 1..98: note = chr2:60780399-60780497
  misc_feature 1..98: note = Hyper
  source 1..98: mol_type = genomic DNA

SEQ ID NO: 117663 - DNA, 153 bp, Homo sapiens; identical to SEQ ID NO: 86684
  misc_feature 1..153: note = chr2:60784352-60784505
  misc_feature 1..153: note = Hyper
  source 1..153: mol_type = genomic DNA

SEQ ID NO: 117664 - DNA, 453 bp, Homo sapiens; identical to SEQ ID NO: 86685
  misc_feature 1..453: note = chr2:60796196-60796649
  misc_feature 1..453: note = Hyper
  source 1..453: mol_type = genomic DNA

SEQ ID NO: 117665 - DNA, 633 bp, Homo sapiens; identical to SEQ ID NO: 86686
  misc_feature 1..633: note = chr2:60796709-60797342
  misc_feature 1..633: note = Hyper
  source 1..633: mol_type = genomic DNA

SEQ ID NO: 117666 - DNA, 30 bp, Homo sapiens; identical to SEQ ID NO: 14415
  misc_feature 1..30: note = chr2:60887794-60887824
  misc_feature 1..30: note = Hypo
  source 1..30: mol_type = genomic DNA

SEQ ID NO: 117667 - DNA, 299 bp, Homo sapiens; identical to SEQ ID NO: 86688
  misc_feature 1..299: note = chr2:60962750-60963049
  misc_feature 1..299: note = Hyper
  source 1..299: mol_type = genomic DNA

SEQ ID NO: 117668 - DNA, 22 bp, Homo sapiens
  misc_feature 1..22: note = chr2:61135115-61135137
  misc_feature 1..22: note = Hypo
  source 1..22: mol_type = genomic DNA
cacgccccgccttatttgtact

SEQ ID NO: 117669 - DNA, 76 bp, Homo sapiens; identical to SEQ ID NO: 86691
  misc_feature 1..76: note = chr2:61231438-61231514
  misc_feature 1..76: note = Hypo
  source 1..76: mol_type = genomic DNA

SEQ ID NO: 117670 - DNA, 15 bp, Homo sapiens
  misc_feature 1..15: note = chr2:61231814-61231829
  misc_feature 1..15: note = Hypo
  source 1..15: mol_type = genomic DNA
cgaagtgaaccataa

SEQ ID NO: 117671 - DNA, 204 bp, Homo sapiens; identical to SEQ ID NO: 86693
  misc_feature 1..204: note = chr2:61406160-61406364
  misc_feature 1..204: note = Hypo
  source 1..204: mol_type = genomic DNA

SEQ ID NO: 117672 - DNA, 80 bp, Homo sapiens; identical to SEQ ID NO: 86694
  misc_feature 1..80: note = chr2:61992300-61992380
  misc_feature 1..80: note = Hypo
  source 1..80: mol_type = genomic DNA

SEQ ID NO: 117673 - DNA, 30 bp, Homo sapiens; identical to SEQ ID NO: 86695
  misc_feature 1..30: note = chr2:62116817-62116847
  misc_feature 1..30: note = Hypo
  source 1..30: mol_type = genomic DNA

SEQ ID NO: 117674 - DNA, 56 bp, Homo sapiens; identical to SEQ ID NO: 39538
  misc_feature 1..56: note = chr2:62409597-62409653
  misc_feature 1..56: note = Hypo
  source 1..56: mol_type = genomic DNA

SEQ ID NO: 117675 - DNA, 82 bp, Homo sapiens; identical to SEQ ID NO: 86697
  misc_feature 1..82: note = chr2:62497735-62497817
  misc_feature 1..82: note = Hypo
  source 1..82: mol_type = genomic DNA

SEQ ID NO: 117676 - DNA, 150 bp, Homo sapiens; identical to SEQ ID NO: 86698
  misc_feature 1..150: note = chr2:62589735-62589885
  misc_feature 1..150: note = Hypo
  source 1..150: mol_type = genomic DNA

SEQ ID NO: 117677 - DNA, 147 bp, Homo sapiens; identical to SEQ ID NO: 86699
  misc_feature 1..147: note = chr2:62652367-62652514
  misc_feature 1..147: note = Hypo
  source 1..147: mol_type = genomic DNA

SEQ ID NO: 117678 - DNA, 32 bp, Homo sapiens; identical to SEQ ID NO: 86700
  misc_feature 1..32: note = chr2:62732906-62732938
  misc_feature 1..32: note = Hyper
  source 1..32: mol_type = genomic DNA

SEQ ID NO: 117679 - DNA, 30 bp, Homo sapiens; identical to SEQ ID NO: 86701
  misc_feature 1..30: note = chr2:62764362-62764392
  misc_feature 1..30: note = Hypo
  source 1..30: mol_type = genomic DNA

SEQ ID NO: 117680 - DNA, 199 bp, Homo sapiens
  misc_feature 1..199: note = chr2:62798327-62798526
  misc_feature 1..199: note = Hyper
  source 1..199: mol_type = genomic DNA
agacgccgcccgtgccgtgtcaggttgtccccgagtgcgcttgccgtgagtttctgccgcgtgactcacccgtgtccctcgctctcagccatcggaacagcagaagcgggtcggggagagcgcgctgccctgacacctgcaccccatccccacctccaactccatctccagaatttagccttcgcggagcccagcggct

SEQ ID NO: 117681 - DNA, 30 bp, Homo sapiens
  misc_feature 1..30: note = chr2:63275056-63275086
  misc_feature 1..30: note = Hyper
  source 1..30: mol_type = genomic DNA
cctggtcagatccctcggcctcagatccaa

SEQ ID NO: 117682 - DNA, 1188 bp, Homo sapiens
  misc_feature 1..1188: note = chr2:63275304-63276492
  misc_feature 1..1188: note = Hyper
  source 1..1188: mol_type = genomic DNA
tggacatttgcctagcgacggccgcctcaatcctctgcgctgctttcaagaaactttcatcccagtctctctccctctccactctcctccctctccccctctcctctttcttttcttaatcctggggttttatgggctgagcgttaagaaaattcgcctgcaatttgggattagataaatactctaattaggaaaaaaaaaatccgtgctacttgatacctcccaacttccccgagaatggtggcagcatctggaaccgagagcgccggcctcccgcgaggcgtaccccggggaccgcgctggcacattccagagcgcactgccgtcccacctcgctgcgccggacccaggtcaggtgctgaggctgcaggcgaaacagggcctggtggagggaggaatgagttaaggtggaggaatggggcaaggtcacgcgccccggcactggagggccaaccccggcacacagcggactggccgggactagggcagcgccgggctatggacgcggacgccggcgaagcgcaccccgggacgtccgcatattctttcccccaaaactagtgcgctccagccggcgcctttcctcggaacctaaggaaggggtatatttcgttgctttctttaaacctcagcacgatcacagtggctccgagccgcgggcggctgaccgcgggcctcgcgggctactcctggtaggggcctgcgcgagcctaaggtgtgtccccgcctgggttagcgctgcgctctgcactgtttcttttcctcttaaagcttctttctcactcactctctccctccttctctctctcattttttccccatttctctcgttcttttattcagctttctctctttctctcccttttgtgaatgggccgcggtgtctttgttctgtagagaagcgcccgtgtcgctgacttttgtgaaccagagaaggatcttgtaaaacctccttttctccttcgtacgcccccactcccacccctcctcccctgcctctttgattagatgttccctcatcgtcaaaaaaaaaatgtaatttcgttggtctggcggccactttctttgaacattagctcgctttcagctccaacttcaattagaaggagttgattttgagagatcaacaaaagaaccgaccaaagccttattaaaggtcctaagaagatctcccgggtcctttgagaa

SEQ ID NO: 117683 - DNA, 442 bp, Homo sapiens
  misc_feature 1..442: note = chr2:63278633-63279075
  misc_feature 1..442: note = Hyper
  source 1..442: mol_type = genomic DNA
ctcccccgcctcctccgaagtaaccaagctgaagtgctaagtttggagaaagtctttgaaaactcacgctgcagcttcgcaaagccgtcgcagctttgagtcccattttccttcggccctagagccctggctgcttcccttccggtccccttcctacaagctggactccctcagcccaggtcttgggtcccagaagacgggggcgggaacggggctggggggagcttctttagctctaacttctctccttgaacgtcctagcccgagtccctggcttgcttcacagcgatcccgctaagcggggtgtagcgatggccccccagggccccaggcccagtttccagcgcccctccctgacccctgagagtggcaccccgggttcccggcagcggcgggggcgaggcttcgacctcccagctcgggtctgcgtgggctacgccgc

SEQ ID NO: 117684 - DNA, 49 bp, Homo sapiens; identical to SEQ ID NO: 86707
  misc_feature 1..49: note = chr2:63280496-63280545
  misc_feature 1..49: note = Hyper
  source 1..49: mol_type = genomic DNA

SEQ ID NO: 117685 - DNA, 699 bp, Homo sapiens; identical to SEQ ID NO: 166
  misc_feature 1..699: note = chr2:63280952-63281651
  misc_feature 1..699: note = Hyper
  source 1..699: mol_type = genomic DNA

SEQ ID NO: 117686 - DNA, 325 bp, Homo sapiens
  misc_feature 1..325: note = chr2:63282650-63282975
  misc_feature 1..325: note = Hyper
  source 1..325: mol_type = genomic DNA
cgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccat

SEQ ID NO: 117687 - DNA, 30 bp, Homo sapiens; identical to SEQ ID NO: 86710
  misc_feature 1..30: note = chr2:63283512-63283542
  misc_feature 1..30: note = Hyper
  source 1..30: mol_type = genomic DNA

SEQ ID NO: 117688 - DNA, 461 bp, Homo sapiens; identical to SEQ ID NO: 86711
  misc_feature 1..461: note = chr2:63283790-63284251
  misc_feature 1..461: note = Hyper
  source 1..461: mol_type = genomic DNA

SEQ ID NO: 117689 - DNA, 41 bp, Homo sapiens; identical to SEQ ID NO: 86712
  misc_feature 1..41: note = chr2:63284311-63284352
  misc_feature 1..41: note = Hyper
  source 1..41: mol_type = genomic DNA

SEQ ID NO: 117690 - DNA, 2768 bp, Homo sapiens
  misc_feature 1..2768: note = chr2:63284558-63287326
  misc_feature 1..2768: note = Hyper
  source 1..2768: mol_type = genomic DNA
gtctaagcacagggtcgcagttccagtttacaaacctaaaacaagaaaaccaaaaccagggaacaaaacaacaaaacaaaacaaaatccgtaaaagtacagcattagggaaaaacaaacaaacccaggccccaaacccagttccaactcctctgtcggcttctctctttcaacacccttgttttgtctagtgagtttttagtgcaccttcgttctccgaaatctgcggagagcccgcgcgcctgtgtatcaattttggctttggccgcttcgtccagtaggtgggaaagtaatttgtaaatttgatttgtctgatgtgaagatcacaaattacttgttgaaatgtaaggcagtccccctcctcctctttatctacattacttcccgaaaataaatgcaaattaatgaacggcttgtcagtgttgctcttctgattccagcccgaggtcctggtctcggggggctaaaagcgagggaaactccgtgttaataacccgcgtgttaatgacctgcgtgaagctggaggccaaaggatgaggcgggaggacttggcaagagaagtccccagaaactttcgcttagggagtgtctccccccacccccaccacgcccctccgcgtcagcctggcctcttcccccaggcgttttgaccccgcatcccccctcgccatccaggacagagacaggtgtcaggactcaattcccgaagcaattcctttctcttcagaggcaggagcctggcactgatttcttcaccctaattgcctgcaccagaaagaagagggggaggggaagagggtcgggaggcgggaaaggatagctctgtaatgctctcagagctgagccaaaaaggaaaagaaagcaaaacgacaaaaaactgatccgtgtcctgcatgttggcagcagacaaccttccttgctgctgagctgtcccgggtggcttcaccgcggctggggaatccgagccattccttccacgtgctaagatgtccctctaagccctcagctcctgccagaagtagccaaattacctttcttcgtactgtaaacttcctttaaaacatacaaactcataacctggaaaagtcgacaaggacgcctttcactttggcaggggaagaagacgactggcttgcatctgggggtcaggaaggacagttccatctccctctgagggaagacggggttgaggggtaatcctcccccagaaaatgcagagcctggaactgtccagactctggcctgaaacctcctgggtgtaaggccatgaatctgctcgacttgctcacgggcgggaaggaaacaaggaaacaacgaaaagtttcctgcgaagtgaccaacatcccctattttttaaaaattccgtgtgagacctgagaacacactgtgaagcggggttcggagaacgacccctcccgcgttccgcgcccagcggggtcgcagggctgcgagcccggctgtagcaaagctttctcggccgcgtcctccctccggattcggtaggccaggctcgggcgcgcccttcccacaccaacaaaccatctttcccgactcagcagaggcccacaggggcgcagccgctgtccctccgcccttggcccagcggcgccgccctggtacgccaggcctgaaggcagggccggcccgcgccacgcagggtctcccttaggcggcgccttagggtgaaatgcggggccaagcctgacctgccggggtgccccgtggcatctctggtgcggaccccgcacgtgccggggagaactggcaggcggccagggcgaggaggcttccagcttgcgccgcactggcctgggcacccgggctgcagggccttttgggccctcccctcagtgaccctgcctgtagcggccccagggccgctttggctcaggcagcagctgccaatgccgctcgaggcccgcggctccctgaggcgagctctgcggggcccagcagtcctcttggctgctaaatggaacgaaaccaggagacccggctttgcactcgtttggacaactgtgtggcctccggagcaaggtacccaaacccttgggcctcagtttcgtcgcagttgttatttgaacccactcggcctgggacgtgccagagcttcacactttaggtcgcggctgcgggcgggaggggcagatgcgacccctgggccggcccctcgggggcgtctagaagcttcggcacctgcatactaaggccggagggggctggcagccaggcacaccgaggcccggccggagttcccgcccggggaacgaggcttcgaaaagaggcacgtgcttctcccagggcctcccgccaggtgctgaaaccccacggcactgagtggaaaccggaagagggaaggcgcccagggcctgccgggccgcggcgccacctgaggctgccgggacgctggagcgtgggggagtggggtgagtgcgctgccgggccgggggcggcgggggacggcgggaggtggccaggcccggcagggtgagggcgctggcgttggccgagagtccctgggcagcggcggcgggaacgcggaaggttccctccacccccaccccaacccccacccccacccccgggccggccacctgttgacaggcaggttctctgagaaccgacttcagctcgcccttctgtccaggaagtttgttcggtttgggtttgggtgttcgtgacacaatcggagcaattagaattgaagcaacttcaggagatttagcaacccgcgaaaatttagcaacgttcagacgtcaacagttttct

SEQ ID NO: 117691 - DNA, 164 bp, Homo sapiens; identical to SEQ ID NO: 86718
  misc_feature 1..164: note = chr2:64348216-64348380
  misc_feature 1..164: note = Hypo
  source 1..164: mol_type = genomic DNA

SEQ ID NO: 117692 - DNA, 30 bp, Homo sapiens; identical to SEQ ID NO: 86719
  misc_feature 1..30: note = chr2:64372072-64372102
  misc_feature 1..30: note = Hypo
  source 1..30: mol_type = genomic DNA

SEQ ID NO: 117693 - DNA, 196 bp, Homo sapiens; identical to SEQ ID NO: 86720
  misc_feature 1..196: note = chr2:64455465-64455661
  misc_feature 1..196: note = Hyper
  source 1..196: mol_type = genomic DNA

SEQ ID NO: 117694 - DNA, 146 bp, Homo sapiens; identical to SEQ ID NO: 86722
  misc_feature 1..146: note = chr2:64835504-64835650
  misc_feature 1..146: note = Hypo
  source 1..146: mol_type = genomic DNA

SEQ ID NO: 117695 - DNA, 710 bp, Homo sapiens
  misc_feature 1..710: note = chr2:64836207-64836917
  misc_feature 1..710: note = Hyper
  source 1..710: mol_type = genomic DNA
gtccgcctggacactcgggagtgaaggcgtgacaggcctcagccggccgtccctcctcgcgcctctgccccgggggacgcacgaggaccagaaagccgagggggcgcagggcctgctctggccgccgggcccgggatgccaggatgcggggggccggggctgccggtgctcttgggggcagggggaagctccgctccctctacagaggacaaccgccccgccgccccggcagcctccgaggcgccctctccgcgcttcactctcggccgctcccccggagccacgcgagccggtcgtggcggctggacccgagcctgggagcctgcaggcggccgcgccgcgctgcgctgccgaaccgcccggagccgcaggtccgccgcccgcccgctcgggggcgccccagcttccggcctccggcggcttccgcgtcgcgctcccaaggcccggcggccgcgccaggtcccctcggcgccccccgtcccctctgccgggcgctcgcccccgcctccaccctgggatctgagcccgggccgtctccccgcggcgccgcgcctgacggtcactctctctgacctcctgggcccagtcctggggccaagagccgcatccccggggaccttggtagaaaaatatgcggctcctgtagccacccaagatcttctggatgagaacccctgcaccagcagactgggtgtcgtggacctccaagc

SEQ ID NO: 117696 - DNA, 30 bp, Homo sapiens; identical to SEQ ID NO: 86726
  misc_feature 1..30: note = chr2:64854140-64854170
  misc_feature 1..30: note = Hypo
  source 1..30: mol_type = genomic DNA

SEQ ID NO: 117697 - DNA, 103 bp, Homo sapiens; identical to SEQ ID NO: 86728
  misc_feature 1..103: note = chr2:65413481-65413584
  misc_feature 1..103: note = Hypo
  source 1..103: mol_type = genomic DNA

SEQ ID NO: 117698 - DNA, 45 bp, Homo sapiens; identical to SEQ ID NO: 86729
  misc_feature 1..45: note = chr2:65794624-65794669
  misc_feature 1..45: note = Hypo
  source 1..45: mol_type = genomic DNA

SEQ ID NO: 117699 - DNA, 30 bp, Homo sapiens; identical to SEQ ID NO: 39543
  misc_feature 1..30: note = chr2:65868490-65868520
  misc_feature 1..30: note = Hypo
  source 1..30: mol_type = genomic DNA

SEQ ID NO: 117700 - DNA, 30 bp, Homo sapiens; identical to SEQ ID NO: 39544
  misc_feature 1..30: note = chr2:66561514-66561544
  misc_feature 1..30: note = Hypo
  source 1..30: mol_type = genomic DNA

SEQ ID NO: 117701 - DNA, 86 bp, Homo sapiens; identical to SEQ ID NO: 86733
  misc_feature 1..86: note = chr2:66652616-66652702
  misc_feature 1..86: note = Hyper
  source 1..86: mol_type = genomic DNA

SEQ ID NO: 117702 - DNA, 1028 bp, Homo sapiens
  misc_feature 1..1028: note = chr2:66653022-66654050
  misc_feature 1..1028: note = Hyper
  source 1..1028: mol_type = genomic DNA
tctcagtagtgtccccggctgtctcctttcctccgtctcccggtcctctcccagcgtcacccctcactacctatacccccgcgccctacccccacctggggcgctgggttccacgcctcctcaagaggtgtgagcgcccgcgctgggcgcccgtagcgcggccctcctgtgtccccacttccacccggcggccgctggaagccgggagaaggaacggcaccaatcccctcacgcttctcccaggacgtctgatcccattagcgcacctgaaatcacaaccttggccacaaatgcgcgcttgttgcgacccctccgagtgggccgccgtgccgcaggagccactctggggccggggtccccaacctctcccccctgcaagtcctaaaaggaatcgtagagcaattgatctcggaggagatgagcgcaccccggggctcattgctgcccctgaggaagagccgtccaggaacggaggcgagaagcttccagaattaggccaagaggcaggtggcggggtgatccggcgtccccgagtccagctggggagaaaggcgccctcggatgctcagccccaaagcagcagaagacagaagccggtgcgccatcgtcgctgcgccccagtccgcgggtcctcgcgctcctgctccggctcccgggctgccacccaccgctgcccaagcctgaccaactcccaactccctccggcacaggctgaggcgacccccaaagagaaaaataggatcgcagtcaaaactggcggggatggggcacactggtgggagaggggaccttttcaccttttgctcttcccaggggacacagtcccccaaacctacgtccctgcgccaaaccaggtgcgagcaaactccgcggaccccgcagctggaagtgcatcctgccgggacccccacccgacccagggagtcagcgcgccccagggtgcaggcaggcccagggctctgggtggctcagggcacggggaccggatcgcgctgcagaacaccgccgggacccggcacccggacgcg

SEQ ID NO: 117703 - DNA, 351 bp, Homo sapiens; identical to SEQ ID NO: 86736
  misc_feature 1..351: note = chr2:66659963-66660314
  misc_feature 1..351: note = Hyper
  source 1..351: mol_type = genomic DNA

SEQ ID NO: 117704 - DNA, 126 bp, Homo sapiens; identical to SEQ ID NO: 86737
  misc_feature 1..126: note = chr2:66660578-66660704
  misc_feature 1..126: note = Hyper
  source 1..126: mol_type = genomic DNA

SEQ ID NO: 117705 - DNA, 72 bp, Homo sapiens; identical to SEQ ID NO: 86738
  misc_feature 1..72: note = chr2:66801890-66801962
  misc_feature 1..72: note = Hyper
  source 1..72: mol_type = genomic DNA

SEQ ID NO: 117706 - DNA, 353 bp, Homo sapiens; identical to SEQ ID NO: 86739
  misc_feature 1..353: note = chr2:66802594-66802947
  misc_feature 1..353: note = Hyper
  source 1..353: mol_type = genomic DNA

SEQ ID NO: 117707 - DNA, 457 bp, Homo sapiens; identical to SEQ ID NO: 86740
  misc_feature 1..457: note = chr2:66803297-66803754
  misc_feature 1..457: note = Hyper
  source 1..457: mol_type = genomic DNA

SEQ ID NO: 117708 - DNA, 1042 bp, Homo sapiens
  misc_feature 1..1042: note = chr2:66808525-66809567
  misc_feature 1..1042: note = Hyper
  source 1..1042: mol_type = genomic DNA
agacaaaagggggagcgatgcaggtctgtttgttttctttccccgccgccccactgtcccttttctcgtctccccgcgcacctccccagacgccctgccggggtggctccgcggatgaggcggtcatttgctgtccgctttgcggggacgggtcactttccgcgctggcgtgaaagcaaatgtggagctgcttttggaaggcgccggccggacgtcggctaggctccttctccccgcgggctgggggccctggggctctgcaaggctctggctccgaacagattgcgcctcccgcctggctgccagtaggaactggggtgggagccgcgtaactaacagttgcgcgcaggaggcgagccccaggtgtgagcgcagaggctctctccccagcccgcgggtctgggaacctttcaggacgcctccctccccaactcctacccatgcgtctgctccctaggccgagcccccctcgtgaggttttaatgaccgcggacgcaggggagcccgcacttgagcgaggaccgacttctctggcgggtccacgctgctcgcgcttgcgtccgcgggtagcgcgctgtgcccgggtcagggggcgagctgcgagaagtaggaggggtcaagacccccagaaatccctccatgggcacacacacaatcaagaatagggttgagggtcttgagaggtagaactaccctaggcagggcttctccaactcggcctttggaccccgcgcgcgcccaagggcgtgcccaccgcggaagcacagatcatcttcccgggactgggtctcctggaccctgcgttgctccctttttcctagcggccccgtagctggctgccgcatgtagggcgatcttcattaacttggacgcccaacgtgattgaaatagagaggaggaaaaaacacatttgatctgggccgaccctttgtcttgaagcagattaggcagcctagaaataggaggaaaaacagaaagtctaggcaggaaaacttattgtgttcacaacatataaaaatgatccgagcggtctggtacctca

SEQ ID NO: 117709 - DNA, 39 bp, Homo sapiens; identical to SEQ ID NO: 39545
  misc_feature 1..39: note = chr2:67625453-67625492
  misc_feature 1..39: note = Hypo
  source 1..39: mol_type = genomic DNA

SEQ ID NO: 117710 - DNA, 38 bp, Homo sapiens; identical to SEQ ID NO: 39546
  misc_feature 1..38: note = chr2:67625732-67625770
  misc_feature 1..38: note = Hypo
  source 1..38: mol_type = genomic DNA

SEQ ID NO: 117711 - DNA, 30 bp, Homo sapiens; identical to SEQ ID NO: 86745
  misc_feature 1..30: note = chr2:67626227-67626257
  misc_feature 1..30: note = Hypo
  source 1..30: mol_type = genomic DNA

SEQ ID NO: 117712 - DNA, 39 bp, Homo sapiens; identical to SEQ ID NO: 39547
  misc_feature 1..39: note = chr2:68530252-68530291
  misc_feature 1..39: note = Hypo
  source 1..39: mol_type = genomic DNA

SEQ ID NO: 117713 - DNA, 39 bp, Homo sapiens; identical to SEQ ID NO: 39548
  misc_feature 1..39: note = chr2:68537171-68537210
  misc_feature 1..39: note = Hypo
  source 1..39: mol_type = genomic DNA

SEQ ID NO: 117714 - DNA, 1048 bp, Homo sapiens
  misc_feature 1..1048: note = chr2:68546222-68547270
  misc_feature 1..1048: note = Hyper
  source 1..1048: mol_type = genomic DNA
tccaacccccgggcccgctgggagcggcgcgaggccagaggcccttgagaggctcgggctgtcctgggggcctcagtcctctgcctgtaccccatgggggaccctgctgccaccaggcgccccgcactcactcgacctgcagcgtgctgggtttaatcttcacctcaaccttgtaggaggagccggtgagcagcttgatggtgcggttctggccgaagcgctgcccgtccaccttgtaaaagaccgggccgtcattaggctggatgcgcagcgcgatggagaggcgcacgaggcccggcaggtcccccatgtctgggcgagggtctggcgcggcggctccggggggcggaggacagcgccggctgcggccgagtggctggagcgcgaggggcggagaggaagcgcggggagggtgagggaggtggtggagctgaggctgccgctaggaacccgcgccgtcgccgccgtccgcccgggcttttgaggagcagctccttaggctgtggcccccctccccactcggcgaggaagcgggcccaagagacggctccaaggccgcgcgcttccccatcccccgctccagtgctgcgccctccacgcacccgaaggctcgctctggcccgcaggccgccgcgcagatccgcgcagctgggggcgagggagttaatcctgtttacgcaccacaatccccttcagctggggaagcggacatttaggctcctcctagaacagccccgggcaggaggaggagaggtttgggaggcactgggaaggcgctggagttaagcgaccactatgccaaggagcgagacccccggaatctggataccgcctcggccagctacgtgaggtggacactgctgctcgcggatccggcgccagccaggcgggaggaggctgagggggggtaaagggaggcgggaaggggggacaggaaaccgctagccggtgatttaaatttcaggaaatatgagtctttccaaagcttaggggaaatggccgaggaaaggcgcaattccacgtgatggagccacgctggatgaggaat

SEQ ID NO: 117715 - DNA, 138 bp, Homo sapiens; identical to SEQ ID NO: 86753
  misc_feature 1..138: note = chr2:68559325-68559463
  misc_feature 1..138: note = Hypo
  source 1..138: mol_type = genomic DNA

SEQ ID NO: 117716 - DNA, 17 bp, Homo sapiens
  misc_feature 1..17: note = chr2:68561789-68561806
  misc_feature 1..17: note = Hypo
  source 1..17: mol_type = genomic DNA
gggcatggtggctctcg

SEQ ID NO: 117717 - DNA, 249 bp, Homo sapiens; identical to SEQ ID NO: 39549
  misc_feature 1..249: note = chr2:68672689-68672938
  misc_feature 1..249: note = Hypo
  source 1..249: mol_type = genomic DNA

SEQ ID NO: 117718 - DNA, 51 bp, Homo sapiens; identical to SEQ ID NO: 86757
  misc_feature 1..51: note = chr2:68674579-68674630
  misc_feature 1..51: note = Hypo
  source 1..51: mol_type = genomic DNA

SEQ ID NO: 117719 - DNA, 276 bp, Homo sapiens; identical to SEQ ID NO: 86758
  misc_feature 1..276: note = chr2:68675493-68675769
  misc_feature 1..276: note = Hypo
  source 1..276: mol_type = genomic DNA

SEQ ID NO: 117720 - DNA, 732 bp, Homo sapiens; identical to SEQ ID NO: 86759
  misc_feature 1..732: note = chr2:68870336-68871068
  misc_feature 1..732: note = Hyper
  source 1..732: mol_type = genomic DNA

SEQ ID NO: 117721 - DNA, 87 bp, Homo sapiens; identical to SEQ ID NO: 86760
  misc_feature 1..87: note = chr2:68882389-68882476
  misc_feature 1..87: note = Hypo
  source 1..87: mol_type = genomic DNA

SEQ ID NO: 117722 - DNA, 30 bp, Homo sapiens; identical to SEQ ID NO: 86761
  misc_feature 1..30: note = chr2:68979044-68979074
  misc_feature 1..30: note = Hyper
  source 1..30: mol_type = genomic DNA

SEQ ID NO: 117723 - DNA, 30 bp, Homo sapiens; identical to SEQ ID NO: 86762
  misc_feature 1..30: note = chr2:69171628-69171658
  misc_feature 1..30: note = Hypo
  source 1..30: mol_type = genomic DNA

SEQ ID NO: 117724 - DNA, 139 bp, Homo sapiens; identical to SEQ ID NO: 39551
  misc_feature 1..139: note = chr2:69182056-69182195
  misc_feature 1..139: note = Hypo
  source 1..139: mol_type = genomic DNA

SEQ ID NO: 117725 - DNA, 652 bp, Homo sapiens; identical to SEQ ID NO: 86764
  misc_feature 1..652: note = chr2:69240068-69240720
  misc_feature 1..652: note = Hyper
  source 1..652: mol_type = genomic DNA

SEQ ID NO: 117726 - DNA, 40 bp, Homo sapiens; identical to SEQ ID NO: 27267
  misc_feature 1..40: note = chr2:69241225-69241265
  misc_feature 1..40: note = Hyper
  source 1..40: mol_type = genomic DNA

SEQ ID NO: 117727 - DNA, 469 bp, Homo sapiens; identical to SEQ ID NO: 86767
  misc_feature 1..469: note = chr2:69533515-69533984
  misc_feature 1..469: note = Hyper
  source 1..469: mol_type = genomic DNA

SEQ ID NO: 117728 - DNA, 125 bp, Homo sapiens; identical to SEQ ID NO: 86768
  misc_feature 1..125: note = chr2:69534538-69534663
  misc_feature 1..125: note = Hyper
  source 1..125: mol_type = genomic DNA

SEQ ID NO: 117729 - DNA, 141 bp, Homo sapiens; identical to SEQ ID NO: 39552
  misc_feature 1..141: note = chr2:69720070-69720211
  misc_feature 1..141: note = Hypo
  source 1..141: mol_type = genomic DNA

SEQ ID NO: 117730 - DNA, 95 bp, Homo sapiens; identical to SEQ ID NO: 39553
  misc_feature 1..95: note = chr2:69914132-69914227
  misc_feature 1..95: note = Hypo
  source 1..95: mol_type = genomic DNA

SEQ ID NO: 117731 - DNA, 37 bp, Homo sapiens; identical to SEQ ID NO: 86772
  misc_feature 1..37: note = chr2:69990379-69990416
  misc_feature 1..37: note = Hypo
  source 1..37: mol_type = genomic DNA

SEQ ID NO: 117732 - DNA, 30 bp, Homo sapiens
  misc_feature 1..30: note = chr2:70055440-70055470
  misc_feature 1..30: note = Hypo
  source 1..30: mol_type = genomic DNA
tcagacattagtccacggggaccctcaaac

SEQ ID NO: 117733 - DNA, 20 bp, Homo sapiens
  misc_feature 1..20: note = chr2:70140798-70140818
  misc_feature 1..20: note = Hypo
  source 1..20: mol_type = genomic DNA
attcttggccgggtgcggtg

SEQ ID NO: 117734 - DNA, 38 bp, Homo sapiens; identical to SEQ ID NO: 86776
  misc_feature 1..38: note = chr2:70203999-70204037
  misc_feature 1..38: note = Hypo
  source 1..38: mol_type = genomic DNA

SEQ ID NO: 117735 - DNA, 127 bp, Homo sapiens; identical to SEQ ID NO: 86778
  misc_feature 1..127: note = chr2:70313348-70313475
  misc_feature 1..127: note = Hyper
  source 1..127: mol_type = genomic DNA

SEQ ID NO: 117736 - DNA, 67 bp, Homo sapiens; identical to SEQ ID NO: 86779
  misc_feature 1..67: note = chr2:70351496-70351563
  misc_feature 1..67: note = Hyper
  source 1..67: mol_type = genomic DNA

SEQ ID NO: 117737 - DNA, 48 bp, Homo sapiens; identical to SEQ ID NO: 14421
  misc_feature 1..48: note = chr2:70364215-70364263
  misc_feature 1..48: note = Hypo
  source 1..48: mol_type = genomic DNA

SEQ ID NO: 117738 - DNA, 94 bp, Homo sapiens; identical to SEQ ID NO: 86783
  misc_feature 1..94: note = chr2:70367805-70367899
  misc_feature 1..94: note = Hypo
  source 1..94: mol_type = genomic DNA

SEQ ID NO: 117739 - DNA, 25 bp, Homo sapiens
  misc_feature 1..25: note = chr2:70418602-70418627
  misc_feature 1..25: note = Hypo
  source 1..25: mol_type = genomic DNA
aaaaatcgcccgagattttctacat

SEQ ID NO: 117740 - DNA, 25 bp, Homo sapiens
  misc_feature 1..25: note = chr2:70418457-70418482
  misc_feature 1..25: note = Hypo
  source 1..25: mol_type = genomic DNA
acttgagttgctggacgtggtggct

SEQ ID NO: 117741 - DNA, 28 bp, Homo sapiens
  misc_feature 1..28: note = chr2:70430867-70430895
  misc_feature 1..28: note = Hypo
  source 1..28: mol_type = genomic DNA
ccgatgggttacctccgcttgtcaatac

SEQ ID NO: 117742 - DNA, 23 bp, Homo sapiens
  misc_feature 1..23: note = chr2:70466510-70466533
  misc_feature 1..23: note = Hypo
  source 1..23: mol_type = genomic DNA
actgcgcccggccaataaagggt

SEQ ID NO: 117743 - DNA, 25 bp, Homo sapiens
  misc_feature 1..25: note = chr2:70477736-70477761
  misc_feature 1..25: note = Hypo
  source 1..25: mol_type = genomic DNA
gtgatgtcggctgagcggggcggct

SEQ ID NO: 117744 - DNA, 30 bp, Homo sapiens; identical to SEQ ID NO: 39557
  misc_feature 1..30: note = chr2:71270959-71270989
  misc_feature 1..30: note = Hypo
  source 1..30: mol_type = genomic DNA

SEQ ID NO: 117745 - DNA, 30 bp, Homo sapiens; identical to SEQ ID NO: 86792
  misc_feature 1..30: note = chr2:71272757-71272787
  misc_feature 1..30: note = Hypo
  source 1..30: mol_type = genomic DNA

SEQ ID NO: 117746 - DNA, 79 bp, Homo sapiens; identical to SEQ ID NO: 86793
  misc_feature 1..79: note = chr2:71355038-71355117
  misc_feature 1..79: note = Hypo
  source 1..79: mol_type = genomic DNA

SEQ ID NO: 117747 - DNA, 439 bp, Homo sapiens; identical to SEQ ID NO: 86794
  misc_feature 1..439: note = chr2:71453947-71454386
  misc_feature 1..439: note = Hyper
  source 1..439: mol_type = genomic DNA

SEQ ID NO: 117748 - DNA, 85 bp, Homo sapiens; identical to SEQ ID NO: 86795
  misc_feature 1..85: note = chr2:71455203-71455288
  misc_feature 1..85: note = Hypo
  source 1..85: mol_type = genomic DNA

SEQ ID NO: 117749 - DNA, 41 bp, Homo sapiens; identical to SEQ ID NO: 86796
  misc_feature 1..41: note = chr2:71502899-71502940
  misc_feature 1..41: note = Hypo
  source 1..41: mol_type = genomic DNA

SEQ ID NO: 117750 - DNA, 918 bp, Homo sapiens; identical to SEQ ID NO: 86797
  misc_feature 1..918: note = chr2:71503413-71504331
  misc_feature 1..918: note = Hyper
  source 1..918: mol_type = genomic DNA

SEQ ID NO: 117751 - DNA, 88 bp, Homo sapiens; identical to SEQ ID NO: 86798
  misc_feature 1..88: note = chr2:71504730-71504818
  misc_feature 1..88: note = Hyper
  source 1..88: mol_type = genomic DNA

SEQ ID NO: 117752 - DNA, 51 bp, Homo sapiens; identical to SEQ ID NO: 86799
  misc_feature 1..51: note = chr2:71622692-71622743
  misc_feature 1..51: note = Hypo
  source 1..51: mol_type = genomic DNA

SEQ ID NO: 117753 - DNA, 558 bp, Homo sapiens; identical to SEQ ID NO: 27271
  misc_feature 1..558: note = chr2:71680684-71681242
  misc_feature 1..558: note = Hyper
  source 1..558: mol_type = genomic DNA

SEQ ID NO: 117754 - DNA, 404 bp, Homo sapiens; identical to SEQ ID NO: 86802
  misc_feature 1..404: note = chr2:71693520-71693924
  misc_feature 1..404: note = Hyper
  source 1..404: mol_type = genomic DNA

SEQ ID NO: 117755 - DNA, 171 bp, Homo sapiens; identical to SEQ ID NO: 27274
  misc_feature 1..171: note = chr2:71694277-71694448
  misc_feature 1..171: note = Hyper
  source 1..171: mol_type = genomic DNA

SEQ ID NO: 117756 - DNA, 34 bp, Homo sapiens; identical to SEQ ID NO: 86807
  misc_feature 1..34: note = chr2:72017134-72017168
  misc_feature 1..34: note = Hypo
  source 1..34: mol_type = genomic DNA

SEQ ID NO: 117757 - DNA, 170 bp, Homo sapiens; identical to SEQ ID NO: 86809
  misc_feature 1..170: note = chr2:72125970-72126140
  misc_feature 1..170: note = Hypo
  source 1..170: mol_type = genomic DNA

SEQ ID NO: 117758 - DNA, 207 bp, Homo sapiens; identical to SEQ ID NO: 86810
  misc_feature 1..207: note = chr2:72372030-72372237
  misc_feature 1..207: note = Hyper
  source 1..207: mol_type = genomic DNA

SEQ ID NO: 117759 - DNA, 167 bp, Homo sapiens; identical to SEQ ID NO: 27276
  misc_feature 1..167: note = chr2:72372591-72372758
  misc_feature 1..167: note = Hyper
  source 1..167: mol_type = genomic DNA

SEQ ID NO: 117760 - DNA, 315 bp, Homo sapiens; identical to SEQ ID NO: 86813
  misc_feature 1..315: note = chr2:72373470-72373785
  misc_feature 1..315: note = Hyper
  source 1..315: mol_type = genomic DNA

SEQ ID NO: 117761 - DNA, 557 bp, Homo sapiens
  misc_feature 1..557: note = chr2:72374375-72374932
  misc_feature 1..557: note = Hyper
  source 1..557: mol_type = genomic DNA
gggggcttgcagcaccgaggggaggcgaaagcggctcaggaccggaccctcccccgggaccgcgcctcgctaggcgcccccggggcgctccacgccccctgccaggccagccgcgacccaggcaagtccatcttgggagccccctcaggtccgggaacccctcttaccagccccctgaacctgcgccgcgggcgccagtggtcccggaaccgcgctgccggcgggctggggaagcccgggctgctgcggcagagaggagggaaggggcggggcggggaccagtgccttcaggctcccggcgccccctggccggcccgccgctccgtctgccccgcgctcgcagctagcggaccccggagtgcagcggagcgagcgcgcccttacctgcagcagccagtggccggtctctccgatgagcgggaagcccatggatcccttggggatgggcagcttgcagctcttgtcgcgagtggcggcccagcgcagctgccacagctgctgcgacacggccagcagcagcgtcacggacaccaggcacgcggcgagggtggccagcg

SEQ ID NO: 117762 - DNA, 232 bp, Homo sapiens; identical to SEQ ID NO: 86817
  misc_feature 1..232: note = chr2:72375350-72375582
  misc_feature 1..232: note = Hyper
  source 1..232: mol_type = genomic DNA

SEQ ID NO: 117763 - DNA, 270 bp, Homo sapiens; identical to SEQ ID NO: 86818
  misc_feature 1..270: note = chr2:72375898-72376168
  misc_feature 1..270: note = Hyper
  source 1..270: mol_type = genomic DNA

SEQ ID NO: 117764 - DNA, 30 bp, Homo sapiens; identical to SEQ ID NO: 86819
  misc_feature 1..30: note = chr2:72376558-72376588
  misc_feature 1..30: note = Hyper
  source 1..30: mol_type = genomic DNA

SEQ ID NO: 117765 - DNA, 358 bp, Homo sapiens; identical to SEQ ID NO: 86820
  misc_feature 1..358: note = chr2:72377029-72377387
  misc_feature 1..358: note = Hyper
  source 1..358: mol_type = genomic DNA

SEQ ID NO: 117766 - DNA, 102 bp, Homo sapiens; identical to SEQ ID NO: 86821
  misc_feature 1..102: note = chr2:72778893-72778995
  misc_feature 1..102: note = Hypo
  source 1..102: mol_type = genomic DNA

SEQ ID NO: 117767 - DNA, 159 bp, Homo sapiens; identical to SEQ ID NO: 86822
  misc_feature 1..159: note = chr2:73121674-73121833
  misc_feature 1..159: note = Hypo
  source 1..159: mol_type = genomic DNA

SEQ ID NO: 117768 - DNA, 88 bp, Homo sapiens; identical to SEQ ID NO: 86823
  misc_feature 1..88: note = chr2:73142014-73142102
  misc_feature 1..88: note = Hyper
  source 1..88: mol_type = genomic DNA

SEQ ID NO: 117769 - DNA, 62 bp, Homo sapiens; identical to SEQ ID NO: 86824
  misc_feature 1..62: note = chr2:73142786-73142848
  misc_feature 1..62: note = Hyper
  source 1..62: mol_type = genomic DNA

SEQ ID NO: 117770 - DNA, 1008 bp, Homo sapiens; identical to SEQ ID NO: 86825
  misc_feature 1..1008: note = chr2:73143487-73144495
  misc_feature 1..1008: note = Hyper
  source 1..1008: mol_type = genomic DNA

SEQ ID NO: 117771 - DNA, 1554 bp, Homo sapiens; identical to SEQ ID NO: 86826
  misc_feature 1..1554: note = chr2:73144718-73146272
  misc_feature 1..1554: note = Hyper
  source 1..1554: mol_type = genomic DNA

SEQ ID NO: 117772 - DNA, 1068 bp, Homo sapiens
  misc_feature 1..1068: note = chr2:73147149-73148217
  misc_feature 1..1068: note = Hyper
  source 1..1068: mol_type = genomic DNA
ggagggataggggctcggaggagagggcggggtcgttcctaagtcctgtggcctccagccgttcagcttgtccggagtcggcatcctgggccgcaccctcggcttcgaatccagcccctgacgccctccgcaccgcggttcctgcctccgggcgccgagggccgggggcgcctggagagaaatccagctccggctctgagcgtctccagtcaggcgaggcggataaatccttcgcaaaaccctcttggaaattgccgccgcttcctgagccatcagtcccagcgggtacgttatcgagtagcacaaacagttggatttttccctcaagaaccgagtctggacgcggagatggagccaagtgtggctgcattttcggacccggaaatccgttgggcactgaaggacttttcgaaccctgtagcgctgttgcttcgcggtccatcgtcgccgctgcagacggatgcgctccccggcggctctacgccctccagtcccggccaggcctctgggctgggagccgagccgtctcgggccctccggcgccgcgttttctagagaaccgggtctcagcgatgctcatttcagccccgtcttaatgcaacaaacgaaaccccacacgaacgaaaaggaacatgtctgcgctctctgcgcagcgcttgggcggcgcggtcccggcgcgcggggaagcggcgtctccgctaaccgaggcgctggaaggggaaaagcgaatgcggaatcgtccaggactccgaaggtcggggccgctcgcgagcaccgaaggggaggagccgacgaagaccaggagtgggccgcatttcggtactgtttccccgagatcaggaactttccgggtctaggagcaacgcctggagggggctgtagagacccagccccccgggacccgcaactacaatgggccggagcttctaaggtcgcctttgttctggcaggaggacggggaatgaggttatctccgccgcctgtcctgcctctccctctcctagccctagggccctccgcccagccgtccggccctgagcccctggccggcggcggcctctccagcga

SEQ ID NO: 117773 - DNA, 47 bp, Homo sapiens; identical to SEQ ID NO: 27290
  misc_feature 1..47: note = chr2:73150907-73150954
  misc_feature 1..47: note = Hyper
  source 1..47: mol_type = genomic DNA

SEQ ID NO: 117774 - DNA, 664 bp, Homo sapiens; identical to SEQ ID NO: 86831
  misc_feature 1..664: note = chr2:73151185-73151849
  misc_feature 1..664: note = Hyper
  source 1..664: mol_type = genomic DNA

SEQ ID NO: 117775 - DNA, 53 bp, Homo sapiens; identical to SEQ ID NO: 6222
  misc_feature 1..53: note = chr2:73152398-73152451
  misc_feature 1..53: note = Hyper
  source 1..53: mol_type = genomic DNA

SEQ ID NO: 117776 - DNA, 344 bp, Homo sapiens
  misc_feature 1..344: note = chr2:73152656-73153000
  misc_feature 1..344: note = Hyper
  source 1..344: mol_type = genomic DNA
agagttgcgagaggccggctccgcggtctcccagctacctcccggctgacttttcaccttccgctcccctttcctcctagtctcgaccctactacaccaccgtcccctcccaagtcccgggcagtgagaagatgcccggcatggggggcagccggagcctccctttagcagccagagtaggaagggggcttagtgagggagcccagacccaaacttcatccgcagctttcttcggcggaccttaccctctcctccttcagtggcattttggcatctattgtcgtcatatctgtctgctgccccacttaatctacaaatcgctcacgggtcggaggcaggacccg

SEQ ID NO: 117777 - DNA, 89 bp, Homo sapiens; identical to SEQ ID NO: 86835
  misc_feature 1..89: note = chr2:73339571-73339660
  misc_feature 1..89: note = Hyper
  source 1..89: mol_type = genomic DNA

SEQ ID NO: 117778 - DNA, 1526 bp, Homo sapiens
  misc_feature 1..1526: note = chr2:73429292-73430818
  misc_feature 1..1526: note = Hyper
  source 1..1526: mol_type = genomic DNA
ctaggtgaatctggccgaggcttctgcgtcaaggacggcgcgggtcagctgaggccaagaccgcaggcactgccctaccgctctccagatcacagctccgcctctgcaaggccccggggaaacgggcatcccttcttcagtgagcaaaggagaaagacggagcccggtggctgggtgtttcgcccaggatcaccagcgagctcagagtcctccccacgaccgccccagggtgggcatttttaaaagcggaggaagggagggaacacactctttggtgctgtgcccaccttgcctcgcacagagcgggcgctcacaggctttgggggccccgcccggaccgcagtggggagaggccgccccatgccccgccccgccaaatttaagagccttcgccgagcgccaggaggttcccagacaaccggtcttgctcgctgccttttgcagaatcttctcacttctcccgagctcccttccttgcgtccgtccgggcaacggccgcgtcatgcctagccccaggccgcgaggcagcccgccacccgctccctcgggctctcgggtccgacctccgcgctctggccgctctccggcgcccaggtcccctactggcccgaacacgccccgcgctcccggacgcttcgagtcccctttctcggtcgaggccatcctggcgaggcccgacccctgcgcgccggcggcctcccagccgtcgggctccgcctgcgtccacccggccttctggaccgctgcttccctgtgcgccaccgggggtctgccctgggcttgcccgacatcgtggctgcccgcctacctgagcgtaggtttttaccctgtgccagggccgcgcgtggctcccgtctgcggcctgctgggcttcggcgtcacaggtactgcggtcccggcgcccgcacgcgggggactgggcgggggctggagagcctaggtcgccactgccggcgccccagtgcaggagagggcactgagtgtgagaatcacacacggctggagtgggaaggggctctgccaccgtttaccttgcagttgaagccgaggaccgcgacagtcttgctgaaaaagaccccggcgcgaggcttcccccgcacgctgctgaggtgggagagggtgggtgtgagggcggcgcagcgcctgaatgcggtgggcaggaggccagcgctggggctgcaaggggacccagccctgctcccggtctccgcgtcccttgactccctcgcacaccccggggtagcgcttagtgacagagacgcttcccaaagcggctctcgacccgaaccaatggccctgttttttttttttacggggtagggggaagtggacgctccgggcggtgctgttgagcgaggagctgttaggagctggtcaaggctcacaccccactaccgcctccactgctcacgtctgtgaacttgagctacacacttcgctctgagcctgcgtgcatgcaatgctcttaagtagtgcttaagggccaggcacttaaatctcatgagaaagtaattgtaaggttgggc

SEQ ID NO: 117779 - DNA, 23 bp, Homo sapiens
  misc_feature 1..23: note = chr2:73440127-73440150
  misc_feature 1..23: note = Hypo
  source 1..23: mol_type = genomic DNA
caggtgatcctcccacgcatcac

SEQ ID NO: 117780 - DNA, 23 bp, Homo sapiens
  misc_feature 1..23: note = chr2:73440270-73440293
  misc_feature 1..23: note = Hypo
  source 1..23: mol_type = genomic DNA
cgacaaagcgagaccctgtctca

SEQ ID NO: 117781 - DNA, 30 bp, Homo sapiens; identical to SEQ ID NO: 86842
  misc_feature 1..30: note = chr2:73493641-73493671
  misc_feature 1..30: note = Hypo
  source 1..30: mol_type = genomic DNA

SEQ ID NO: 117782 - DNA, 139 bp, Homo sapiens; identical to SEQ ID NO: 86843
  misc_feature 1..139: note = chr2:73512023-73512162
  misc_feature 1..139: note = Hyper
  source 1..139: mol_type = genomic DNA

SEQ ID NO: 117783 - DNA, 1662 bp, Homo sapiens; identical to SEQ ID NO: 86844
  misc_feature 1..1662: note = chr2:73518205-73519867
  misc_feature 1..1662: note = Hyper
  source 1..1662: mol_type = genomic DNA

SEQ ID NO: 117784 - DNA, 861 bp, Homo sapiens; identical to SEQ ID NO: 86845
  misc_feature 1..861: note = chr2:73520242-73521103
  misc_feature 1..861: note = Hyper
  source 1..861: mol_type = genomic DNA

SEQ ID NO: 117785 - DNA, 30 bp, Homo sapiens; identical to SEQ ID NO: 39565
  misc_feature 1..30: note = chr2:73723848-73723878
  misc_feature 1..30: note = Hypo
  source 1..30: mol_type = genomic DNA

SEQ ID NO: 117786 - DNA, 93 bp, Homo sapiens; identical to SEQ ID NO: 39566
  misc_feature 1..93: note = chr2:74010528-74010621
  misc_feature 1..93: note = Hypo
  source 1..93: mol_type = genomic DNA

SEQ ID NO: 117787 - DNA, 30 bp, Homo sapiens; identical to SEQ ID NO: 86849
  misc_feature 1..30: note = chr2:74152651-74152681
  misc_feature 1..30: note = Hypo
  source 1..30: mol_type = genomic DNA

SEQ ID NO: 117788 - DNA, 707 bp, Homo sapiens; identical to SEQ ID NO: 86850
  misc_feature 1..707: note = chr2:74229462-74230169
  misc_feature 1..707: note = Hyper
  source 1..707: mol_type = genomic DNA

SEQ ID NO: 117789 - DNA, 22 bp, Homo sapiens
  misc_feature 1..22: note = chr2:74315939-74315961
  misc_feature 1..22: note = Hypo
  source 1..22: mol_type = genomic DNA
gctcatgcctgtggtcgcagca

SEQ ID NO: 117790 - DNA, 31 bp, Homo sapiens; identical to SEQ ID NO: 86852
  misc_feature 1..31: note = chr2:74350360-74350391
  misc_feature 1..31: note = Hypo
  source 1..31: mol_type = genomic DNA

SEQ ID NO: 117791 - DNA, 17 bp, Homo sapiens
  misc_feature 1..17: note = chr2:74425137-74425154
  misc_feature 1..17: note = Hypo
  source 1..17: mol_type = genomic DNA
atatggtctcactctcg

SEQ ID NO: 117792 - DNA, 71 bp, Homo sapiens; identical to SEQ ID NO: 86854
  misc_feature 1..71: note = chr2:74425719-74425790
  misc_feature 1..71: note = Hyper
  source 1..71: mol_type = genomic DNA

SEQ ID NO: 117793 - DNA, 317 bp, Homo sapiens; identical to SEQ ID NO: 39568
  misc_feature 1..317: note = chr2:74454002-74454319
  misc_feature 1..317: note = Hypo
  source 1..317: mol_type = genomic DNA

SEQ ID NO: 117794 - DNA, 96 bp, Homo sapiens; identical to SEQ ID NO: 86856
  misc_feature 1..96: note = chr2:74454965-74455061
  misc_feature 1..96: note = Hypo
  source 1..96: mol_type = genomic DNA

SEQ ID NO: 117795 - DNA, 22 bp, Homo sapiens
  misc_feature 1..22: note = chr2:74669781-74669803
  misc_feature 1..22: note = Hypo
  source 1..22: mol_type = genomic DNA
cataaagagcagctgcgcgcgg

SEQ ID NO: 117796 - DNA, 22 bp, Homo sapiens
  misc_feature 1..22: note = chr2:74691369-74691391
  misc_feature 1..22: note = Hypo
  source 1..22: mol_type = genomic DNA
gccaccgcgcccagcctctttt

SEQ ID NO: 117797 - DNA, 92 bp, Homo sapiens; identical to SEQ ID NO: 39570
  misc_feature 1..92: note = chr2:74700397-74700489
  misc_feature 1..92: note = Hypo
  source 1..92: mol_type = genomic DNA

SEQ ID NO: 117798 - DNA, 44 bp, Homo sapiens; identical to SEQ ID NO: 6233
  misc_feature 1..44: note = chr2:74726199-74726243
  misc_feature 1..44: note = Hyper
  source 1..44: mol_type = genomic DNA

SEQ ID NO: 117799 - DNA, 56 bp, Homo sapiens; identical to SEQ ID NO: 86861
  misc_feature 1..56: note = chr2:74726718-74726774
  misc_feature 1..56: note = Hyper
  source 1..56: mol_type = genomic DNA

SEQ ID NO: 117800 - DNA, 33 bp, Homo sapiens; identical to SEQ ID NO: 86862
  misc_feature 1..33: note = chr2:74729900-74729933
  misc_feature 1..33: note = Hyper
  source 1..33: mol_type = genomic DNA

SEQ ID NO: 117801 - DNA, 473 bp, Homo sapiens; identical to SEQ ID NO: 86863
  misc_feature 1..473: note = chr2:74730171-74730644
  misc_feature 1..473: note = Hyper
  source 1..473: mol_type = genomic DNA

SEQ ID NO: 117802 - DNA, 66 bp, Homo sapiens; identical to SEQ ID NO: 86864
  misc_feature 1..66: note = chr2:74733315-74733381
  misc_feature 1..66: note = Hypo
  source 1..66: mol_type = genomic DNA

SEQ ID NO: 117803 - DNA, 3266 bp, Homo sapiens
  misc_feature 1..3266: note = chr2:74740515-74743781
  misc_feature 1..3266: note = Hyper
  source 1..3266: mol_type = genomic DNA
taaggctcaggggcccgcccgcgggggtcccatccccgggaaggacgcagagttcacgcactcccggctcctggattcatggccagaggtcacaaggtcaccaagcggcttaggtctttccccacctcccttctctgacagctccaggccattttttgagtttgggtggggtaaaatgtttatgggaaacaaggcggccaggatccaaccaaggcctcagtgaggtcccacgtgtcccccgtggcgagatttcgccctcccgccgttgaggaggaagagtgtgagaacagacttcctaggcacagaatggaggggcagagtcctgcattgaggactccctgcacttggggtccgggggtaagtgccagccccaagaacccgccggcctgatttggcccgggttgagccatggtccgttttacacggattttggaaaatcgaaattctaggaaacacaggacaccaattaccggtgcgcatgaacagggctggggggacctacaggagaggccagaaggcgcaccacgatcgccagcccaaagcggccgttccccgcccttagcccctgccgtccccttcccacacctgttctcttcctgggcctgcagctcaccgggcgccgttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcggtgagcatctccgctgactcagcggcccatgctcgggcccctcccgcgctgagcctggctcctaacaccctggccccctgtccccctccccgcacatctccgccagccagccttccccctgcgcttggcgcaaacaggcgtcccttcccctttaactgctgggccccgcccctgccctacccccagcccccactacccacccgggccgatccgtcagtcactgccccagccggagctggccaaccctctccacccgggacttgggcagcggcgccggcagcccagcgtctatttgcgcttaagagccagcaaggaagctccaggggccccagctggccgtgctcccccgggatgcaagtccctgcgctgacgcccggcagcggctggcacgggcgcggctgctccgggtgcacagggatgctgctgtttcggggaccccggcgccctgccttggccagccccgcgggcccctgaggccactctccggagcgcgccgccgctgggcttctggcgctgcctgaggcatcctccccaaccaccgaacctccggcggttctcctcggcccagaccgatggagccggggatgctgggtccacacaacctcccacaccacgagccaatcagcttcggcatcgatcagatcctgagcggccccgaaaccccagggggcggtctaggcctgggtcgcgggggccagggtcatggggagaatggggcgttctcgggtggataccacggagcctcgggctacggtcccgccggctcacttgccccgctgcccggcagctccggagtgggcccaggcggcgtgatccgcgtccctgcgcaccgcccgctgcctgtgccgccgcccgctgggggggcgcctgcagtgcctgggccctcgggtttgggcggcgccggaggcctagcgggactcaccttcccctggatggacagcggccgccgctttgccaaggaccggctcacgggtgaggttgtctgacccctccagcgtcacgcccgactctgaccccgtctcctcatttcttagctttctgctccaactcaaggacccctttcacacctcccactagatcctcccaggggatcctcccccaactcaaatctctgggtcctgcctccgagaggtgatggggagggagctgccgtcggtgcccgcgccctcctctgtagtcccactgtccacgcgtggggaggggagggtgaagttacaggggacgtctccctcgcatcccaggggaagggcctttcttggctatagggctcggctgatgcttagggcccgggtaaggacagggcgcgggagttctgcggcctggacagccgcgcggccttctcagtggcacctcgggccaccctgcaaatcctgccctggtctttcttcctcccggtagctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggtgaggcgcggcgcgggcgagggcggactggggttcccgagcagggcctggtgagaagcgacgcggcgggcgccccgctgaccccgcgtctccctcccttaggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagaggg

SEQ ID NO: 117804 - DNA, 30 bp, Homo sapiens; identical to SEQ ID NO: 86872
  misc_feature 1..30: note = chr2:74764874-74764904
  misc_feature 1..30: note = Hypo
  source 1..30: mol_type = genomic DNA

SEQ ID NO: 117805 - DNA, 414 bp, Homo sapiens
  misc_feature 1..414: note = chr2:74781935-74782349
  misc_feature 1..414: note = Hyper
  source 1..414: mol_type = genomic DNA
accaaggtagtctggcgcatggatgccgaaccttatccgggctagtagtgggtgagagagcccagaaacagggagaggtgggcagcgggctggagagcggcgccgggagttggagagcctgtgactttcccgtgaagttgctttgcacactcccgggaagcgtctgtagtctaggggttctggtcctggggagacggagtggcatcgtccttgggaaacttcgcccccaaccccgtttggaagccccagatcccaaatcgacttgcgccgcaacctccttccccgtcgggacccgggccgcctgcgcacgccactccctctcgagcactctctctctctccctagaggtggaggaagacctgggccgtgctctacccggccagtccccacggcgtagcgcggctcgagttcttt

SEQ ID NO: 117806 - DNA, 24 bp, Homo sapiens
  misc_feature 1..24: note = chr2:74874703-74874727
  misc_feature 1..24: note = Hypo
  source 1..24: mol_type = genomic DNA
tgggttcactttaaacgaaatgaa

SEQ ID NO: 117807 - DNA, 32 bp, Homo sapiens; identical to SEQ ID NO: 86876
  misc_feature 1..32: note = chr2:74875128-74875160
  misc_feature 1..32: note = Hyper
  source 1..32: mol_type = genomic DNA

SEQ ID NO: 117808 - DNA, 103 bp, Homo sapiens
  misc_feature 1..103: note = chr2:74875415-74875518
  misc_feature 1..103: note = Hyper
  source 1..103: mol_type = genomic DNA
ctcacctggtcctcccggctctcagcgtgcgcccgcgcgttcggaggcgcccccctcaggccggcgcggctgggcgggaggctcactgcgggcaaggcggggc

SEQ ID NO: 117809 - DNA, 30 bp, Homo sapiens; identical to SEQ ID NO: 86879
  misc_feature 1..30: note = chr2:75031726-75031756
  misc_feature 1..30: note = Hypo
  source 1..30: mol_type = genomic DNA

SEQ ID NO: 117810 - DNA, 30 bp, Homo sapiens; identical to SEQ ID NO: 86880
  misc_feature 1..30: note = chr2:75090539-75090569
  misc_feature 1..30: note = Hypo
  source 1..30: mol_type = genomic DNA

SEQ ID NO: 117811 - DNA, 104 bp, Homo sapiens; identical to SEQ ID NO: 86881
  misc_feature 1..104: note = chr2:75146952-75147056
  misc_feature 1..104: note = Hyper
  source 1..104: mol_type = genomic DNA

SEQ ID NO: 117812 - DNA, 54 bp, Homo sapiens; identical to SEQ ID NO: 86882
  misc_feature 1..54: note = chr2:75179952-75180006
  misc_feature 1..54: note = Hypo
  source 1..54: mol_type = genomic DNA

SEQ ID NO: 117813 - DNA, 140 bp, Homo sapiens; identical to SEQ ID NO: 86883
  misc_feature 1..140: note = chr2:75426430-75426570
  misc_feature 1..140: note = Hyper
  source 1..140: mol_type = genomic DNA

SEQ ID NO: 117814 - DNA, 91 bp, Homo sapiens; identical to SEQ ID NO: 86884
  misc_feature 1..91: note = chr2:75426784-75426875
  misc_feature 1..91: note = Hyper
  source 1..91: mol_type = genomic DNA

SEQ ID NO: 117815 - DNA, 892 bp, Homo sapiens; identical to SEQ ID NO: 86885
  misc_feature 1..892: note = chr2:75427383-75428275
  misc_feature 1..892: note = Hyper
  source 1..892: mol_type = genomic DNA

SEQ ID NO: 117816 - DNA, 170 bp, Homo sapiens; identical to SEQ ID NO: 86886
  misc_feature 1..170: note = chr2:75608174-75608344
  misc_feature 1..170: note = Hypo
  source 1..170: mol_type = genomic DNA

SEQ ID NO: 117817 - DNA, 157 bp, Homo sapiens; identical to SEQ ID NO: 27319
  misc_feature 1..157: note = chr2:75787200-75787357
  misc_feature 1..157: note = Hyper
  source 1..157: mol_type = genomic DNA

SEQ ID NO: 117818 - DNA, 541 bp, Homo sapiens
  misc_feature 1..541: note = chr2:75787804-75788345
  misc_feature 1..541: note = Hyper
  source 1..541: mol_type = genomic DNA
cctttgctggggccccggcgcgcacttccggggactgcgcttggggcgcgcggggccgagcagggggacccggagctgatcactgaggggcggacacgacaaagcgctgcccgggtcttgggccggcaccagtacctcggaaaggaatcccggcggaggggccgccggggtcagggctggcctggggatgtggggtcccggcctgggtgctcacggacggcggcgccaagccccgcagaagctgcaggagcccgagtcagtgggaggaaaaggttgtctcatttccttcgatctcccccctcctccacccgcttggctccggacctgccctccctctcccccgcccccttctgcaagccagcggcccatgtgggcgcccgcaagacgcgaaacctgaacggctgcggcgtgcggcacctccctccgcgccaagttagttcacgctcccaactcctgcctgcctccccgcgctgccgactgtccgcaggaccggggaggttccccatcggcagtccccaacctatcccggtcctccaggctt

SEQ ID NO: 117819 - DNA, 29 bp, Homo sapiens
  misc_feature 1..29: note = chr2:75851938-75851967
  misc_feature 1..29: note = Hypo
  source 1..29: mol_type = genomic DNA
caggtgggagccaccgcctccagtcgtta

SEQ ID NO: 117820 - DNA, 145 bp, Homo sapiens; identical to SEQ ID NO: 86894
  misc_feature 1..145: note = chr2:76036826-76036971
  misc_feature 1..145: note = Hypo
  source 1..145: mol_type = genomic DNA

SEQ ID NO: 117821 - DNA, 30 bp, Homo sapiens; identical to SEQ ID NO: 86896
  misc_feature 1..30: note = chr2:76975878-76975908
  misc_feature 1..30: note = Hypo
  source 1..30: mol_type = genomic DNA

SEQ ID NO: 117822 - DNA, 159 bp, Homo sapiens; identical to SEQ ID NO: 86898
  misc_feature 1..159: note = chr2:79159337-79159496
  misc_feature 1..159: note = Hypo
  source 1..159: mol_type = genomic DNA

SEQ ID NO: 117823 - DNA, 486 bp, Homo sapiens
  misc_feature 1..486: note = chr2:79739850-79740336
  misc_feature 1..486: note = Hyper
  source 1..486: mol_type = genomic DNA
ccccacctgcggcgccgagcctgccgcgcctccagagctccgccctaccccgccccgccctttcgggcgctccccaggccgcgcgcgcccgcggccccccacccagccacccctcgatgcccggtgcctttccaggcgccgcggagccacggggaccgcgggggcgcgcgagcgagcaagcggccgcgcatgcgcactggctgcctcccctagcggcgatccgggccgctgccgctcgcgcttgggcaggacgcggggcgggcggggggaggggggagcggcttcgcttccagccccgagtgaggcggagacccaggcgggcgggcagagcaggcggcaccgcacctcggccagaggcggctgcagcagctgctgcccttgtccctgccgccgcctctccagtcccttctgtgattaccactccagctgctgggaacgggcgagaaagaggaggaggcgagaaactcccaccgacccacagaggtg

SEQ ID NO: 117824 - DNA, 147 bp, Homo sapiens; identical to SEQ ID NO: 86902
  misc_feature 1..147: note = chr2:80529296-80529443
  misc_feature 1..147: note = Hyper
  source 1..147: mol_type = genomic DNA

SEQ ID NO: 117825 - DNA, 1177 bp, Homo sapiens
  misc_feature 1..1177: note = chr2:80529662-80530839
  misc_feature 1..1177: note = Hyper
  source 1..1177: mol_type = genomic DNA
ccttgtggatctgcacggcgttctcggcgtgctcgccgcctggaagagccacggtggcaggctcgaatgtgccgtcgtgctgcccctccccgccgtccgcgagcgtggtggccgagctggcagggggccccagatcactgcggttggtgacggccgagagcaggtggccgctggtgggctcggccccatcctcgcacaggtggaaggcgtacacggcgtccaggacgtcctcgccctgtgcgtactccgggctggcgcactgcaagttgccatcgtagcgcccctggaagttgttgagccacgaggctagggcacacacgttgcgcccgcaatcccacaggttcccggccagggtgatgcttgtcagggacttccaagagttgaggatccggggctcgatgtaggtgaggcggttggagtccagctgcagggactgcaggtgcggcacggtctcgaacacatggggctccatgtactcgatctcgttgcccgacaagtccattttctccaggttccaaacccagtccagcgagctgaccacaatggccaccttgttcctccgcaggcagagcgagtgcagggagatgaggcgcgggaagtgggcgaagttcaccttgaccaagtcgttgtgctcgaggtgcagctcggtgagcttaaacaagccggcgaaagagttgcgcgccagactcttgagctgattgtatccgatgtcgagaaacttgaggctgcggcagtcctggaagatgcgcacgggcacaaactggatggcgttggcccgcatatgcagcgtggtgagcttccgcagcccgtggaagaggtcgggcgcgagcgcctgcagcttgttgtacgagaggtccacgctgcgcaggttgggcatgggccggaaggtggtgttgggcagttgggtgatctggttggaactcagcgtgagttccttaactcggcgcagtttctgaaaggcgtccccctgcacggagcagatgtgattgtgatccagatagagccacgtgagctgcattaaccccgtgaactggccggcgcgcagctccgagaggctgttgtagcgcagggacaagcccagcaggccggacaggttgtggggcgcctcggtgaggttgagcgcctcgcagtacagcagccgcccctcgcaccggcacagctgcgggcacccgctggg

SEQ ID NO: 117826 - DNA, 685 bp, Homo sapiens; identical to SEQ ID NO: 27329
  misc_feature 1..685: note = chr2:80531328-80532013
  misc_feature 1..685: note = Hyper
  source 1..685: mol_type = genomic DNA

SEQ ID NO: 117827 - DNA, 240 bp, Homo sapiens; identical to SEQ ID NO: 86909
  misc_feature 1..240: note = chr2:80549571-80549811
  misc_feature 1..240: note = Hyper
  source 1..240: mol_type = genomic DNA

SEQ ID NO: 117828 - DNA, 30 bp, Homo sapiens; identical to SEQ ID NO: 86910
  misc_feature 1..30: note = chr2:80591074-80591104
  misc_feature 1..30: note = Hyper
  source 1..30: mol_type = genomic DNA

SEQ ID NO: 117829 - DNA, 75 bp, Homo sapiens; identical to SEQ ID NO: 86911
  misc_feature 1..75: note = chr2:81421356-81421431
  misc_feature 1..75: note = Hypo
  source 1..75: mol_type = genomic DNA

SEQ ID NO: 117830 - DNA, 30 bp, Homo sapiens; identical to SEQ ID NO: 86912
  misc_feature 1..30: note = chr2:81421864-81421894
  misc_feature 1..30: note = Hypo
  source 1..30: mol_type = genomic DNA

SEQ ID NO: 117831 - DNA, 54 bp, Homo sapiens; identical to SEQ ID NO: 39574
  misc_feature 1..54: note = chr2:81424249-81424303
  misc_feature 1..54: note = Hypo
  source 1..54: mol_type = genomic DNA

SEQ ID NO: 117832 - DNA, 82 bp, Homo sapiens; identical to SEQ ID NO: 86914
  misc_feature 1..82: note = chr2:81694612-81694694
  misc_feature 1..82: note = Hypo
  source 1..82: mol_type = genomic DNA

SEQ ID NO: 117833 - DNA, 32 bp, Homo sapiens; identical to SEQ ID NO: 86916
  misc_feature 1..32: note = chr2:82462336-82462368
  misc_feature 1..32: note = Hypo
  source 1..32: mol_type = genomic DNA

SEQ ID NO: 117834 - DNA, 18 bp, Homo sapiens
  misc_feature 1..18: note = chr2:83283948-83283966
  misc_feature 1..18: note = Hypo
  source 1..18: mol_type = genomic DNA
ctccgcctcaaaaaaaaa

SEQ ID NO: 117835 - DNA, 49 bp, Homo sapiens; identical to SEQ ID NO: 86918
  misc_feature 1..49: note = chr2:84101246-84101295
  misc_feature 1..49: note = Hypo
  source 1..49: mol_type = genomic DNA

SEQ ID NO: 117836 - DNA, 36 bp, Homo sapiens; identical to SEQ ID NO: 86919
  misc_feature 1..36: note = chr2:84104568-84104604
  misc_feature 1..36: note = Hypo
  source 1..36: mol_type = genomic DNA

SEQ ID NO: 117837 - DNA, 479 bp, Homo sapiens; identical to SEQ ID NO: 86921
  misc_feature 1..479: note = chr2:85107340-85107819
  misc_feature 1..479: note = Hyper
  source 1..479: mol_type = genomic DNA

SEQ ID NO: 117838 - DNA, 65 bp, Homo sapiens; identical to SEQ ID NO: 86922
  misc_feature 1..65: note = chr2:85280281-85280346
  misc_feature 1..65: note = Hypo
  source 1..65: mol_type = genomic DNA

SEQ ID NO: 117839 - DNA, 29 bp, Homo sapiens
  misc_feature 1..29: note = chr2:85287855-85287884
  misc_feature 1..29: note = Hypo
  source 1..29: mol_type = genomic DNA
tgaacgaccgtgcccggccaagccaatgg

SEQ ID NO: 117840 - DNA, 427 bp, Homo sapiens; identical to SEQ ID NO: 86924
  misc_feature 1..427: note = chr2:85360043-85360470
  misc_feature 1..427: note = Hyper
  source 1..427: mol_type = genomic DNA

SEQ ID NO: 117841 - DNA, 756 bp, Homo sapiens
  misc_feature 1..756: note = chr2:85360872-85361628
  misc_feature 1..756: note = Hyper
  source 1..756: mol_type = genomic DNA
cgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgtccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgc

SEQ ID NO: 117842 - DNA, 30 bp, Homo sapiens; identical to SEQ ID NO: 39575
  misc_feature 1..30: note = chr2:85533655-85533685
  misc_feature 1..30: note = Hypo
  source 1..30: mol_type = genomic DNA

SEQ ID NO: 117843 - DNA, 18 bp, Homo sapiens
  misc_feature 1..18: note = chr2:85534085-85534103
  misc_feature 1..18: note = Hypo
  source 1..18: mol_type = genomic DNA
cagcgactgcatttatag

SEQ ID NO: 117844 - DNA, 64 bp, Homo sapiens; identical to SEQ ID NO: 86929
  misc_feature 1..64: note = chr2:85542210-85542274
  misc_feature 1..64: note = Hypo
  source 1..64: mol_type = genomic DNA

SEQ ID NO: 117845 - DNA, 49 bp, Homo sapiens; identical to SEQ ID NO: 86930
  misc_feature 1..49: note = chr2:85641060-85641109
  misc_feature 1..49: note = Hyper
  source 1..49: mol_type = genomic DNA

SEQ ID NO: 117846 - DNA, 275 bp, Homo sapiens; identical to SEQ ID NO: 86931
  misc_feature 1..275: note = chr2:85645262-85645537
  misc_feature 1..275: note = Hypo
  source 1..275: mol_type = genomic DNA

SEQ ID NO: 117847 - DNA, 43 bp, Homo sapiens; identical to SEQ ID NO: 86932
  misc_feature 1..43: note = chr2:85698940-85698983
  misc_feature 1..43: note = Hypo
  source 1..43: mol_type = genomic DNA

SEQ ID NO: 117848 - DNA, 34 bp, Homo sapiens; identical to SEQ ID NO: 39577
  misc_feature 1..34: note = chr2:85769773-85769807
  misc_feature 1..34: note = Hypo
  source 1..34: mol_type = genomic DNA

SEQ ID NO: 117849 - DNA, 95 bp, Homo sapiens; identical to SEQ ID NO: 86934
  misc_feature 1..95: note = chr2:85837713-85837808
  misc_feature 1..95: note = Hypo
  source 1..95: mol_type = genomic DNA

SEQ ID NO: 117850 - DNA, 35 bp, Homo sapiens; identical to SEQ ID NO: 86935
  misc_feature 1..35: note = chr2:85838288-85838323
  misc_feature 1..35: note = Hypo
  source 1..35: mol_type = genomic DNA

SEQ ID NO: 117851 - DNA, 30 bp, Homo sapiens; identical to SEQ ID NO: 86936
  misc_feature 1..30: note = chr2:85890872-85890902
  misc_feature 1..30: note = Hypo
  source 1..30: mol_type = genomic DNA

SEQ ID NO: 117852 - DNA, 22 bp, Homo sapiens
  misc_feature 1..22: note = chr2:86346762-86346784
  misc_feature 1..22: note = Hypo
  source 1..22: mol_type = genomic DNA
gccaccgcgcccagctttccta

SEQ ID NO: 117853 - DNA, 39 bp, Homo sapiens; identical to SEQ ID NO: 86939
  misc_feature 1..39: note = chr2:86423730-86423769
  misc_feature 1..39: note = Hypo
  source 1..39: mol_type = genomic DNA

SEQ ID NO: 117854 - DNA, 24 bp, Homo sapiens
  misc_feature 1..24: note = chr2:86425865-86425889
  misc_feature 1..24: note = Hypo
  source 1..24: mol_type = genomic DNA
ccccaggctggagtgcggtggctc

SEQ ID NO: 117855 - DNA, 16 bp, Homo sapiens
  misc_feature 1..16: note = chr2:86455870-86455886
  misc_feature 1..16: note = Hypo
  source 1..16: mol_type = genomic DNA
gcgcctggcaaccctt

SEQ ID NO: 117856 - DNA, 22 bp, Homo sapiens
  misc_feature 1..22: note = chr2:86562959-86562981
  misc_feature 1..22: note = Hypo
  source 1..22: mol_type = genomic DNA
cgagactcggtctcaaaaaaaa

SEQ ID NO: 117857 - DNA, 30 bp, Homo sapiens; identical to SEQ ID NO: 86943
  misc_feature 1..30: note = chr2:86564715-86564745
  misc_feature 1..30: note = Hyper
  source 1..30: mol_type = genomic DNA

SEQ ID NO: 117858 - DNA, 23 bp, Homo sapiens
  misc_feature 1..23: note = chr2:86783937-86783960
  misc_feature 1..23: note = Hypo
  source 1..23: mol_type = genomic DNA
ccctagcccgctttttcactgga

SEQ ID NO: 117859 - DNA, 44 bp, Homo sapiens; identical to SEQ ID NO: 86946
  misc_feature 1..44: note = chr2:86815266-86815310
  misc_feature 1..44: note = Hypo
  source 1..44: mol_type = genomic DNA

SEQ ID NO: 117860 - DNA, 30 bp, Homo sapiens; identical to SEQ ID NO: 86947
  misc_feature 1..30: note = chr2:87016267-87016297
  misc_feature 1..30: note = Hyper
  source 1..30: mol_type = genomic DNA

SEQ ID NO: 117861 - DNA, 420 bp, Homo sapiens
  misc_feature 1..420: note = chr2:87016517-87016937
  misc_feature 1..420: note = Hyper
  source 1..420: mol_type = genomic DNA
tgtagatatcacaggcgaagtccagccccctcgtgtgcactgacgacaccaaagacgccgacatttaggagagggcccgggacctcccaaccgccccaccgtcccgggaacgtctctccgcctcagatctcggtttcccaccacttggacagcccttgactctacctacagtatcagggctgtccctggcatgggctctccccgcggtgcgtgccgcccccgccccgggcccccgcacgcctcacctgcgccccccgccgctggccggcacgcctctgggcgcagggacaggggctgcgacgcgatggtgggcgccggtgttggtggtcgcggcgctggcgtcgtggtgggcttcgctgcaagagcaacagagcgtggttgggggccaggctggggttatggaggcgccccagccccggc

SEQ ID NO: 117862 - DNA, 746 bp, Homo sapiens
  misc_feature 1..746: note = chr2:87017490-87018236
  misc_feature 1..746: note = Hyper
  source 1..746: mol_type = genomic DNA
ggagttgctcagggccgagcagaaatagtagccctcgttctctcggcggaagtcgctcagggtgaggacgaaggtgtcccccaacctcttgcccgagaaccgctgggtgtccagcccctcggccgccttgggcttgttttgggagaggtataggaggaaggtgggactggcggcggcgccgcgcggctggaagagccacgagcagcccgacgtcgggttggacagcagcacctggcacttcagctccactgtctcgcccaggttccaggtccgatccagcggcgacacccggaactggctcggcctggcggcgtctgcaggcggcaagcagcgaggctgagcccgcagtcccgcgccccccgccccccgcccgccccatcccctgccttcccgggcgtctcaaactcacggagcagcaaggccagcggcaggagcaaggcggtcactggtaaggccatgacgcgctccccaggacgctgcttggctcgaagctcgggcgcgaggggaggcgcgcgggagccggtggggcgccgaggggggaaagttgcgcccttcggccggcccggagcctgatttcgcatttggaggatgtgatgtcacccgaagcccccgccgaggagagtcaccctccttttcgcggttgtcgccttccagcccggcgaggaggctggggcccgtgaatagggccgtcgaggcagcctggccaggcaactgggggcagctgaaaactgcgggtttggggatga

SEQ ID NO: 117863 - DNA, 33 bp, Homo sapiens; identical to SEQ ID NO: 86951
  misc_feature 1..33: note = chr2:87034656-87034689
  misc_feature 1..33: note = Hyper
  source 1..33: mol_type = genomic DNA

SEQ ID NO: 117864 - DNA, 90 bp, Homo sapiens; identical to SEQ ID NO: 86952
  misc_feature 1..90: note = chr2:87056531-87056621
  misc_feature 1..90: note = Hypo
  source 1..90: mol_type = genomic DNA

SEQ ID NO: 117865 - DNA, 493 bp, Homo sapiens; identical to SEQ ID NO: 86953
  misc_feature 1..493: note = chr2:87088683-87089176
  misc_feature 1..493: note = Hyper
  source 1..493: mol_type = genomic DNA

SEQ ID NO: 117866 - DNA, 80 bp, Homo sapiens; identical to SEQ ID NO: 39581
  misc_feature 1..80: note = chr2:87961966-87962046
  misc_feature 1..80: note = Hypo
  source 1..80: mol_type = genomic DNA

SEQ ID NO: 117867 - DNA, 30 bp, Homo sapiens; identical to SEQ ID NO: 39582
  misc_feature 1..30: note = chr2:88306721-88306751
  misc_feature 1..30: note = Hypo
  source 1..30: mol_type = genomic DNA

SEQ ID NO: 117868 - DNA, 196 bp, Homo sapiens; identical to SEQ ID NO: 86964
  misc_feature 1..196: note = chr2:88469231-88469427
  misc_feature 1..196: note = Hypo
  source 1..196: mol_type = genomic DNA

SEQ ID NO: 117869 - DNA, 30 bp, Homo sapiens; identical to SEQ ID NO: 27339
  misc_feature 1..30: note = chr2:88469803-88469833
  misc_feature 1..30: note = Hyper
  source 1..30: mol_type = genomic DNA

SEQ ID NO: 117870 - DNA, 60 bp, Homo sapiens; identical to SEQ ID NO: 86966
  misc_feature 1..60: note = chr2:88470136-88470196
  misc_feature 1..60: note = Hyper
  source 1..60: mol_type = genomic DNA

SEQ ID NO: 117871 - DNA, 87 bp, Homo sapiens; identical to SEQ ID NO: 39584
  misc_feature 1..87: note = chr2:88573562-88573649
  misc_feature 1..87: note = Hypo
  source 1..87: mol_type = genomic DNA

SEQ ID NO: 117872 - DNA, 229 bp, Homo sapiens; identical to SEQ ID NO: 86969
  misc_feature 1..229: note = chr2:88650232-88650461
  misc_feature 1..229: note = Hyper
  source 1..229: mol_type = genomic DNA

SEQ ID NO: 117873 - DNA, 30 bp, Homo sapiens; identical to SEQ ID NO: 86970
  misc_feature 1..30: note = chr2:88650807-88650837
  misc_feature 1..30: note = Hyper
  source 1..30: mol_type = genomic DNA

SEQ ID NO: 117874 - DNA, 103 bp, Homo sapiens; identical to SEQ ID NO: 86972
  misc_feature 1..103: note = chr2:88750914-88751017
  misc_feature 1..103: note = Hyper
  source 1..103: mol_type = genomic DNA

SEQ ID NO: 117875 - DNA, 1607 bp, Homo sapiens
  misc_feature 1..1607: note = chr2:88751271-88752878
  misc_feature 1..1607: note = Hyper
  source 1..1607: mol_type = genomic DNA
ggttattcctccatccgctcccacccgcagcctggacaagaagactcctggcagatcttccagccgcacaccgacccctgcgccggcccttgcgacccgcgtccgccctccccggctgggaagcacctgccagcggccctcacctgggtcgtcctcgtcgcggggcaccttcttgaagcagtcgttgagcgacaggttgtggcggatggagttctgccagccggccttgctgcgctggtagaaggggaagctatcggcgacgaactggtagatgtggctgagagtgagtttgcgctcgggcgcgctctgaatggccatggcgatgagcgccgaatacgagtagggcggccgcaccatcttcatcaggtcctcgcggctggccatggacagccagcccagctccccgggccccgcgggcgcggcgggcgaggcgggcgcggcgggcgcgggctgcgcgaagggccgctgagagcagccgaagtgccggcggcaggcggtggctgcagaaagggcccggccgcggccccggggggcggcggcggcggcggagcgcccaggtacgcggcggcggctgcggcggcggcggagggcgggcctcccacgccgggcccgttgagccacaggtaggggttggcggcggcggccggcggcgcggcgtagtcggccagcccgtaaggcgccctggctgccgggggggcgcccggggcggcggcggtggcggcgggcgggggcaggccgggctgcgaatacactccgaagttgtcgccgcagtagagggccatgtcggcggccgtgggcggctgcggcgcggccgcggcgaggggcgagcggggctggtctcgccgctcgggcgagagcatccctttgggggccaaccctgcggctccgccttcacccgcgctgggcgcccggtgctccgggccggggtcgggcgggtgctagcggagcgcctgctagccggcctcttataaccgagcccggcgcggctcctcctgggccggcccggagcggggcggtggccgcgggcctgggctctccacgcccccgccacgccccacctgcccgcgcgcccaaacccggagcccgcccgccccgcccctaccgcccctctgcccgggcccgggagcgtctgggaggccggcgcctccaggtttcgggcaaaaagcagcaccccattcctagcccacgtttcttaacatcataataagtaaagccacgaatattaaagagaagataacccgaacagtacgaatgatttctaaaaagttaacttggggtggccgctcgggccacctgcctagtcatccttttggcttttctacctctttcctcctaaccttttgtgatcgagtcgcggaattcacgtccagtctcaaccgatcggcttccagtcgaaaataatcgatgtgatttacaacgctttggggtatacggtagaggttattaacaggcccgcttggcgtgtccccttctcctcggggattctgtgattggaggaacggaaatcagtgttgagtttttctaaccaaactgtaggttcgctcacattcgggaagcatttattcgttttctgtgcggtttgtacgggctttcgttgtgatttgtta

SEQ ID NO: 117876 - DNA, 45 bp, Homo sapiens; identical to SEQ ID NO: 86976
  misc_feature 1..45: note = chr2:88753098-88753143
  misc_feature 1..45: note = Hyper
  source 1..45: mol_type = genomic DNA

SEQ ID NO: 117877 - DNA, 30 bp, Homo sapiens; identical to SEQ ID NO: 86977
  misc_feature 1..30: note = chr2:88755765-88755795
  misc_feature 1..30: note = Hypo
  source 1..30: mol_type = genomic DNA

SEQ ID NO: 117878 - DNA, 232 bp, Homo sapiens; identical to SEQ ID NO: 39585
  misc_feature 1..232: note = chr2:88990189-88990421
  misc_feature 1..232: note = Hypo
  source 1..232: mol_type = genomic DNA

SEQ ID NO: 117879 - DNA, 224 bp, Homo sapiens; identical to SEQ ID NO: 86979
  misc_feature 1..224: note = chr2:89006626-89006850
  misc_feature 1..224: note = Hypo
  source 1..224: mol_type = genomic DNA

SEQ ID NO: 117880 - DNA, 976 bp, Homo sapiens
  misc_feature 1..976: note = chr2:89064550-89065526
  misc_feature 1..976: note = Hyper
  source 1..976: mol_type = genomic DNA
aagccccaggtcctgcgctcagggcaggggtcaagagcagctggcaagggcggcgcagcctgtggggcccttgggcgcggcgggccgcagctccgggaagccacgtcagcccaccggcgctgcagctgcagccgccaccagcacacggaccaggggtcgccgaggattgggaatccccgaccaggactgcgcctccagccgtgcggaccccggggccagcggggcagcggcaagtcaggcagtctgcagcaggagcgctgggcatgggcttcggcccgggttgcaggaggcgtgcaccctccggccggataggcggcgcactcagggaccaggaggccatcccaggtgagccccgccagccccagccggagcccgagctgcagctgccacctgcaagtggtgctctggctgcagcggtggcaaccccggatccagtccttccgcctcgcgcccatcagcgcggacccgggggcgacgcagtggcgaagtcgggctgtgggcccggcggcggcaccaggcggagaagcgccactcaaccccatccctgggctgcagagggcccagcgcggagggctccgcgcgtcgggagccggtggaagaggagaagagcgcgcgggcgacagtcatacaggccttggggcagggcgcgcctcgcgctccagggagccacgccagcccgctgcgcctccgcagcaaccgccgcctgcacgtggcggggcgagagagctgctagggcggtttctccgcctcgggcctgttgggcggggccggctaaggtgcgcgtgctcgctggtcctaacggttctgttgggcgtttctgctgagaggcgggaggggctgagagtctgtgcgaaggtaggtggacagactgcattgcttgttgttgcgcttcggaggcggcgatccccgaaggcgagctgaaatacggctggagcgttcccaggctacagtttgtagccgacgattgtggaagact

SEQ ID NO: 117881 - DNA, 44 bp, Homo sapiens; identical to SEQ ID NO: 86982
  misc_feature 1..44: note = chr2:89071937-89071981
  misc_feature 1..44: note = Hypo
  source 1..44: mol_type = genomic DNA

SEQ ID NO: 117882 - DNA, 30 bp, Homo sapiens; identical to SEQ ID NO: 86983
  misc_feature 1..30: note = chr2:89121162-89121192
  misc_feature 1..30: note = Hypo
  source 1..30: mol_type = genomic DNA

SEQ ID NO: 117883 - DNA, 30 bp, Homo sapiens; identical to SEQ ID NO: 39587
  misc_feature 1..30: note = chr2:89371674-89371704
  misc_feature 1..30: note = Hypo
  source 1..30: mol_type = genomic DNA

SEQ ID NO: 117884 - DNA, 30 bp, Homo sapiens; identical to SEQ ID NO: 86986
  misc_feature 1..30: note = chr2:89866048-89866078
  misc_feature 1..30: note = Hypo
  source 1..30: mol_type = genomic DNA

SEQ ID NO: 117885 - DNA, 32 bp, Homo sapiens; identical to SEQ ID NO: 86987
  misc_feature 1..32: note = chr2:90003862-90003894
  misc_feature 1..32: note = Hypo
  source 1..32: mol_type = genomic DNA

SEQ ID NO: 117886 - DNA, 20 bp, Homo sapiens
  misc_feature 1..20: note = chr2:90209634-90209654
  misc_feature 1..20: note = Hypo
  source 1..20: mol_type = genomic DNA
ttcaccgtgttagccaggat

SEQ ID NO: 117887 - DNA, 75 bp, Homo sapiens; identical to SEQ ID NO: 86989
  misc_feature 1..75: note = chr2:90413666-90413741
  misc_feature 1..75: note = Hyper
  source 1..75: mol_type = genomic DNA

SEQ ID NO: 117888 - DNA, 281 bp, Homo sapiens
  misc_feature 1..281: note = chr2:91635122-91635403
  misc_feature 1..281: note = Hyper
  source 1..281: mol_type = genomic DNA
atttgcacctgccaccgcggagttttgccccgtatgcggcttccggcccccgccgccacggctttttatcacccccgccgctttttgcccccgccgccgcgggtttttgcccccgcccccgttgctttttacccccgccgccgcggctttctgcccctgccgacgagggtttttgcggctttatatccccgctgtcatggctttttgcggccgtggctttttgccccctcagccgtggtttttttgcggcttttggcacccgtcgccgcagctttttcagg

SEQ ID NO: 117889 - DNA, 30 bp, Homo sapiens
  misc_feature 1..30: note = chr2:91874180-91874210
  misc_feature 1..30: note = Hyper
  source 1..30: mol_type = genomic DNA
gttctcgggagtctgcggcgcgccagatgg

SEQ ID NO: 117890 - DNA, 39 bp, Homo sapiens; identical to SEQ ID NO: 86994
  misc_feature 1..39: note = chr2:92261800-92261839
  misc_feature 1..39: note = Hypo
  source 1..39: mol_type = genomic DNA

SEQ ID NO: 117891 - DNA, 189 bp, Homo sapiens; identical to SEQ ID NO: 87008
  misc_feature 1..189: note = chr2:95663943-95664132
  misc_feature 1..189: note = Hyper
  source 1..189: mol_type = genomic DNA

SEQ ID NO: 117892 - DNA, 1791 bp, Homo sapiens
  misc_feature 1..1791: note = chr2:95690747-95692538
  misc_feature 1..1791: note = Hyper
  source 1..1791: mol_type = genomic DNA
aacgtcccttcctgtcgcatggattcaaggccgacctgccccagcaccaccaccagcagccttctgctggggccggcacagctgggagcaacctcctactctcaggcagacgcgcagcaccaagcagagaggcccggtgcaggatcccagcgccgaaccagcgccggctcagtggacgcggaaggggccggcggccgcggccggtcccatcccccactgcagacccccagcctgtggcggtggtccagttccgccaggaaaccgccgcctggagctgtgggtcgcgcacattaacgcatccagcggaaaaatgaaggagacccaaattcaaagttaaagtaatggtgacccgagaggtgccttgatgagaaggtttggggtcccggttactgatggttatcattcttacgagatgctggtcacctacgaagggagaaaggcacgaggagcgcctgaccaaagtggttttgccctgcttcccgcaagaggtggcacccacggctggaacgcaggagtcagacccacagtccccagctctggacgcccgcagcggggcctcgaagaggttcagggcggtgcccgcggcgctcgggccgggtctcccggggcgtggggcggggggcggggttgggcggcggccggggctcctccctcttctgccccgggctcccctgctcttaacccgcgcgcgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggccggggaagggacggggtgggctgagccgtgcgctctctcgggcgcccagcacagctgtcggacgggatccgctagctgcgcaggttctgggagcatcggggcagcaggcgcagggcggggactaagccagggaagtcccctcccacctccggtcctttgtgcccttctagaccaacagaatgaggggaacagtctacaggactatggaggaaaaactgggttcccaactggggtcagatgtaggcagcggggcagggggggacggctcttggttcgctggtcccaaagctgcgcgcggggcccacttgacgcgcgcagcgccaccgaagctcccgccgcgctttgcgcggttgggtagaagtgcgcagcttttacaagggagaaggtttcgttaaaaaagaaaaaaaaatcagcaagagaaacattagtattaccaaccgagatttggagatgagagggagctgaatccggtttattttcttctggccttttaaagtttctggcgagggaacgtatttgcgaccaattcgatctggaaatgaggccatcgtttgcttggccgcagtccttctgccccgtgtgcggggtgggggtggaggagatggggggtggggggtggggggtggcggcgagagcgatccgcgcgcctcgactgaccttgggcaggcccggggcctctgcacctgcggtcggtcccgccttgcacgcacggtctctgcctgaggctgcaggaaagcgcttcctactgagaactcctgataagcgctcacggtgtcgcgaagccgaagtgacctccctcagcctcaactccccgggggccgctggccttcacctgggaggggtgtgccctgtatgtcctgtgggtgcggtccgtcaccgcctgagggacacc

SEQ ID NO: 117893 - DNA, 30 bp, Homo sapiens; identical to SEQ ID NO: 87011
  misc_feature 1..30: note = chr2:95726475-95726505
  misc_feature 1..30: note = Hypo
  source 1..30: mol_type = genomic DNA

SEQ ID NO: 117894 - DNA, 39 bp, Homo sapiens; identical to SEQ ID NO: 87012
  misc_feature 1..39: note = chr2:95736152-95736191
  misc_feature 1..39: note = Hypo
  source 1..39: mol_type = genomic DNA

SEQ ID NO: 117895 - DNA, 40 bp, Homo sapiens; identical to SEQ ID NO: 87013
  misc_feature 1..40: note = chr2:95742095-95742135
  misc_feature 1..40: note = Hypo
  source 1..40: mol_type = genomic DNA

SEQ ID NO: 117896 - DNA, 20 bp, Homo sapiens
  misc_feature 1..20: note = chr2:95745778-95745798
  misc_feature 1..20: note = Hypo
  source 1..20: mol_type = genomic DNA
tggcccggacacaagcattt

SEQ ID NO: 117897 - DNA, 187 bp, Homo sapiens; identical to SEQ ID NO: 87016
  misc_feature 1..187: note = chr2:95873374-95873561
  misc_feature 1..187: note = Hyper
  source 1..187: mol_type = genomic DNA

SEQ ID NO: 117898 - DNA, 223 bp, Homo sapiens; identical to SEQ ID NO: 39591
  misc_feature 1..223: note = chr2:95941629-95941852
  misc_feature 1..223: note = Hypo
  source 1..223: mol_type = genomic DNA

SEQ ID NO: 117899 - DNA, 30 bp, Homo sapiens; identical to SEQ ID NO: 87018
  misc_feature 1..30: note = chr2:95958861-95958891
  misc_feature 1..30: note = Hypo
  source 1..30: mol_type = genomic DNA

SEQ ID NO: 117900 - DNA, 99 bp, Homo sapiens; identical to SEQ ID NO: 87019
  misc_feature 1..99: note = chr2:95988527-95988626
  misc_feature 1..99: note = Hypo
  source 1..99: mol_type = genomic DNA

SEQ ID NO: 117901 - DNA, 30 bp, Homo sapiens; identical to SEQ ID NO: 87020
  misc_feature 1..30: note = chr2:95989378-95989408
  misc_feature 1..30: note = Hypo
  source 1..30: mol_type = genomic DNA

SEQ ID NO: 117902 - DNA, 32 bp, Homo sapiens; identical to SEQ ID NO: 87021
  misc_feature 1..32: note = chr2:95989755-95989787
  misc_feature 1..32: note = Hypo
  source 1..32: mol_type = genomic DNA

SEQ ID NO: 117903 - DNA, 170 bp, Homo sapiens; identical to SEQ ID NO: 87022
  misc_feature 1..170: note = chr2:96011693-96011863
  misc_feature 1..170: note = Hyper
  source 1..170: mol_type = genomic DNA

SEQ ID NO: 117904 - DNA, 242 bp, Homo sapiens; identical to SEQ ID NO: 87023
  misc_feature 1..242: note = chr2:96012441-96012683
  misc_feature 1..242: note = Hyper
  source 1..242: mol_type = genomic DNA

SEQ ID NO: 117905 - DNA, 120 bp, Homo sapiens; identical to SEQ ID NO: 87025
  misc_feature 1..120: note = chr2:96192504-96192624
  misc_feature 1..120: note = Hyper
  source 1..120: mol_type = genomic DNA

SEQ ID NO: 117906 - DNA, 202 bp, Homo sapiens; identical to SEQ ID NO: 87026
  misc_feature 1..202: note = chr2:96428959-96429161
  misc_feature 1..202: note = Hypo
  source 1..202: mol_type = genomic DNA

SEQ ID NO: 117907 - DNA, 339 bp, Homo sapiens
  misc_feature 1..339: note = chr2:96781907-96782246
  misc_feature 1..339: note = Hyper
  source 1..339: mol_type = genomic DNA
agagggagcgctgcccgcccagtgcgcaccgtggacgacagcgctgcccggctcggctagacaagagcgtcgcccctcgggcggcgccgagggcgctggagccccatggcctggacgagcggggcctaggaggtcgggaacacccaggaccagcagccgccctcctacatcctcctccaccggtgcccggggtccctgccgtccgccccagagaagtttcccaagttgtcccgccgccgtccccgtcccgcccgggaccggagaaagtcgcgccctcccgccacgcggatgccgtacgctctgggggcgcgggccgggctgggccggttcttaaaggag

SEQ ID NO: 117908 - DNA, 184 bp, Homo sapiens; identical to SEQ ID NO: 87029
  misc_feature 1..184: note = chr2:96784561-96784745
  misc_feature 1..184: note = Hypo
  source 1..184: mol_type = genomic DNA

SEQ ID NO: 117909 - DNA, 34 bp, Homo sapiens; identical to SEQ ID NO: 87030
  misc_feature 1..34: note = chr2:96872240-96872274
  misc_feature 1..34: note = Hypo
  source 1..34: mol_type = genomic DNA

SEQ ID NO: 117910 - DNA, 30 bp, Homo sapiens; identical to SEQ ID NO: 87031
  misc_feature 1..30: note = chr2:96970484-96970514
  misc_feature 1..30: note = Hypo
  source 1..30: mol_type = genomic DNA

SEQ ID NO: 117911 - DNA, 300 bp, Homo sapiens; identical to SEQ ID NO: 87032
  misc_feature 1..300: note = chr2:96987012-96987312
  misc_feature 1..300: note = Hyper
  source 1..300: mol_type = genomic DNA

SEQ ID NO: 117912 - DNA, 435 bp, Homo sapiens; identical to SEQ ID NO: 27356
  misc_feature 1..435: note = chr2:96990881-96991316
  misc_feature 1..435: note = Hyper
  source 1..435: mol_type = genomic DNA

SEQ ID NO: 117913 - DNA, 30 bp, Homo sapiens; identical to SEQ ID NO: 87034
  misc_feature 1..30: note = chr2:96993641-96993671
  misc_feature 1..30: note = Hypo
  source 1..30: mol_type = genomic DNA

SEQ ID NO: 117914 - DNA, 102 bp, Homo sapiens; identical to SEQ ID NO: 87035
  misc_feature 1..102: note = chr2:96996017-96996119
  misc_feature 1..102: note = Hypo
  source 1..102: mol_type = genomic DNA

SEQ ID NO: 117915 - DNA, 39 bp, Homo sapiens; identical to SEQ ID NO: 87036
  misc_feature 1..39: note = chr2:97101384-97101423
  misc_feature 1..39: note = Hypo
  source 1..39: mol_type = genomic DNA

SEQ ID NO: 117916 - DNA, 36 bp, Homo sapiens; identical to SEQ ID NO: 87037
  misc_feature 1..36: note = chr2:97135614-97135650
  misc_feature 1..36: note = Hypo
  source 1..36: mol_type = genomic DNA

SEQ ID NO: 117917 - DNA, 30 bp, Homo sapiens; identical to SEQ ID NO: 87038
  misc_feature 1..30: note = chr2:97159065-97159095
  misc_feature 1..30: note = Hypo
  source 1..30: mol_type = genomic DNA

SEQ ID NO: 117918 - DNA, 172 bp, Homo sapiens; identical to SEQ ID NO: 87039
  misc_feature 1..172: note = chr2:97174612-97174784
  misc_feature 1..172: note = Hypo
  source 1..172: mol_type = genomic DNA

SEQ ID NO: 117919 - DNA, 637 bp, Homo sapiens
  misc_feature 1..637: note = chr2:97193015-97193652
  misc_feature 1..637: note = Hyper
  source 1..637: mol_type = genomic DNA
ggcaggggaaggcctcgggagggacacgacggtccggcagcagagcctgcggggctggaggaggcgccctcctctcagctgctcttcctgcccctttcggtggcgaagatggatggggcccggggctttcggcggggcccgaggggccggcgaggctgcggccctggagccccctgcctggcagccatttgggccccagggaaatatcggcgctttggctaaccgaattattctttcggtttgagccagctcccctttttgagtcagatccggcggcagggccagaaaagcgctttctgaaaccccagcgcggtcctcggtgggggtggaatggggtggggtggggggcgcggccgcgccgctgggcgccctccccgccctcccccctccccacccccagtcctccctccgctgcccgccccccaagcccggtgtcgccccctccgccccctgccgcatccccggagccagtgcccacaggggccaggcagcccgcaggggtcgctcacggctggtgtaggggcttggtccaccacgctagtacttcgggcaccaaaatagaaaaagaataacgcttggaaagaatctgatgtttccgaaggagcatcgaaaatcgccgttacgggaaaagtaaaac

SEQ ID NO: 117920 - DNA, 169 bp, Homo sapiens; identical to SEQ ID NO: 87042
  misc_feature 1..169: note = chr2:97203376-97203545
  misc_feature 1..169: note = Hyper
  source 1..169: mol_type = genomic DNA

SEQ ID NO: 117921 - DNA, 30 bp, Homo sapiens; identical to SEQ ID NO: 87043
  misc_feature 1..30: note = chr2:97275430-97275460
  misc_feature 1..30: note = Hypo
  source 1..30: mol_type = genomic DNA

SEQ ID NO: 117922 - DNA, 639 bp, Homo sapiens; identical to SEQ ID NO: 87045
  misc_feature 1..639: note = chr2:97427454-97428093
  misc_feature 1..639: note = Hypo
  source 1..639: mol_type = genomic DNA

SEQ ID NO: 117923 - DNA, 30 bp, Homo sapiens; identical to SEQ ID NO: 87046
  misc_feature 1..30: note = chr2:97435640-97435670
  misc_feature 1..30: note = Hypo
  source 1..30: mol_type = genomic DNA

SEQ ID NO: 117924 - DNA, 30 bp, Homo sapiens; identical to SEQ ID NO: 39596
  misc_feature 1..30: note = chr2:97437788-97437818
  misc_feature 1..30: note = Hypo
  source 1..30: mol_type = genomic DNA

SEQ ID NO: 117925 - DNA, 30 bp, Homo sapiens; identical to SEQ ID NO: 87048
  misc_feature 1..30: note = chr2:97553301-97553331
  misc_feature 1..30: note = Hypo
  source 1..30: mol_type = genomic DNA

SEQ ID NO: 117926 - DNA, 30 bp, Homo sapiens; identical to SEQ ID NO: 39597
  misc_feature 1..30: note = chr2:97603228-97603258
  misc_feature 1..30: note = Hypo
  source 1..30: mol_type = genomic DNA

SEQ ID NO: 117927 - DNA, 139 bp, Homo sapiens; identical to SEQ ID NO: 87050
  misc_feature 1..139: note = chr2:97605950-97606089
  misc_feature 1..139: note = Hypo
  source 1..139: mol_type = genomic DNA

SEQ ID NO: 117928 - DNA, 97 bp, Homo sapiens; identical to SEQ ID NO: 87051
  misc_feature 1..97: note = chr2:97651788-97651885
  misc_feature 1..97: note = Hypo
  source 1..97: mol_type = genomic DNA

SEQ ID NO: 117929 - DNA, 209 bp, Homo sapiens; identical to SEQ ID NO: 87052
  misc_feature 1..209: note = chr2:97652196-97652405
  misc_feature 1..209: note = Hypo
  source 1..209: mol_type = genomic DNA

SEQ ID NO: 117930 - DNA, 62 bp, Homo sapiens; identical to SEQ ID NO: 87054
  misc_feature 1..62: note = chr2:98025655-98025717
  misc_feature 1..62: note = Hypo
  source 1..62: mol_type = genomic DNA

SEQ ID NO: 117931 - DNA, 30 bp, Homo sapiens; identical to SEQ ID NO: 39601
  misc_feature 1..30: note = chr2:98263541-98263571
  misc_feature 1..30: note = Hypo
  source 1..30: mol_type = genomic DNA

SEQ ID NO: 117932 - DNA, 89 bp, Homo sapiens; identical to SEQ ID NO: 87058
  misc_feature 1..89: note = chr2:98351134-98351223
  misc_feature 1..89: note = Hypo
  source 1..89: mol_type = genomic DNA

SEQ ID NO: 117933 - DNA, 30 bp, Homo sapiens; identical to SEQ ID NO: 39603
  misc_feature 1..30: note = chr2:98354137-98354167
  misc_feature 1..30: note = Hypo
  source 1..30: mol_type = genomic DNA

SEQ ID NO: 117934 - DNA, 145 bp, Homo sapiens; identical to SEQ ID NO: 39604
  misc_feature 1..145: note = chr2:98357736-98357881
  misc_feature 1..145: note = Hypo
  source 1..145: mol_type = genomic DNA

SEQ ID NO: 117935 - DNA, 30 bp, Homo sapiens; identical to SEQ ID NO: 87061
  misc_feature 1..30: note = chr2:98614089-98614119
  misc_feature 1..30: note = Hypo
  source 1..30: mol_type = genomic DNA

SEQ ID NO: 117936 - DNA, 215 bp, Homo sapiens; identical to SEQ ID NO: 87062
  misc_feature 1..215: note = chr2:98633480-98633695
  misc_feature 1..215: note = Hypo
  source 1..215: mol_type = genomic DNA

SEQ ID NO: 117937 - DNA, 189 bp, Homo sapiens; identical to SEQ ID NO: 39605
  misc_feature 1..189: note = chr2:98702143-98702332
  misc_feature 1..189: note = Hypo
  source 1..189: mol_type = genomic DNA

SEQ ID NO: 117938 - DNA, 154 bp, Homo sapiens; identical to SEQ ID NO: 87064
  misc_feature 1..154: note = chr2:98703234-98703388
  misc_feature 1..154: note = Hyper
  source 1..154: mol_type = genomic DNA

SEQ ID NO: 117939 - DNA, 150 bp, Homo sapiens; identical to SEQ ID NO: 87065
  misc_feature 1..150: note = chr2:98957243-98957393
  misc_feature 1..150: note = Hypo
  source 1..150: mol_type = genomic DNA

SEQ ID NO: 117940 - DNA, 2026 bp, Homo sapiens
  misc_feature 1..2026: note = chr2:98962692-98964718
  misc_feature 1..2026: note = Hyper
  source 1..2026: mol_type = genomic DNA
ggagagaacccagaacggaacgacggacttgtttgctttcttgcccctgactctccccgtcctccctgggagggttggggatgtgaactaatgacttctgcctctttcggaccgcctttgaggctccagagcctcaccttactttcccacggagagggaggccacaggctccttcagcagtcgccgagcagagtcctgggccgggagcgcgggggagggagcgagcggaactgcgcctaggaggccgagggaggaggcgctccgcagaccctggcgcgccgcggagaagctcaaactttggcagggtaaggatttttaggggctcttgagctggaattttttggggggcgccgggaggtgtgctggggccgcagaccccatacaggaggtaagttagagaaccacacgcaggggagggatgctgctgcttccaggggcgggcgcggcgctgtccgcagcccccggtgctgaaacgggccgcgggctggagagaaagtgaaaaaggatcggctacggcctcggctcccactccccggctcccatacccctccagtccagttcaaaggacaggaagccctccccgtgctccccaagccgatcgcacccccttttactcacgtcccacagccgcgctgggccgagcccgctgagccgtcggggcgggaggcagaaggagcagggctggctcccgctggggacgggtagggcttgcagccgcgaccccaccccatacatttcctcctgtcacgctgtccccggaccgccagtccgggaaggacccacttccccggctccaagtcgggagcgggcgccgcgtcttctcgagtccgcgccgcgccgggggaggttgagtcagtggcctggagggagcagggccgggggaaggcagcggcgaaggactgccccccaacccaggggactattttcccttggggattcaaagagaaaggtaggctgaggaggaggcgagaattaaaattcttttaggagtgcgcggttactttttttaatgataaaatcacacccgggatctcggacgcccggggcttagtgctcggtgatggaggagaaggggcggcgggctctctgatcctctgcaatcccctaaccggataaaggcgccgggctcccagccgtcaggcttttctctttagctcagcccgcggcccctcccgacgcccctgggggccttggcgcgcaggccctcgcagtcccgcaaccccgggccgggtgattcatttttctccctgtgtaatctccctactgagcggcgcagctgggactttaacttcggccctctgcagcgggggtctccggttggcgcggcgcgtgagggaggatgaatggcgctggaacctagaggacctggagccggcgccccggcctctttggcctgaaccaggtgcctctgacacgcagtccgccggctcaggcctcgccggaagctggcgggagcagtcccttgcagcgaagcccggcaccccgacggcagacgctccccatcacatcttccaaaggggcgaggctgggatcagcaggaatggcacccacccgggttcagactccatcccggagtggacagctcggtgcccctaacattatgcactgtccgccaccccctccccccaacacatacacactttcattcatgaaaaccagcaagaatagtgctgtctgggcacggagtccaatgtacagcgtgcgttcacgctgagaattcatgggggacgcgggtggttgggccgggagaggagagatggtcacttgtgtgtggtatccaccaactgggtcttctacgccagagtcccagttgtagaaaagtcggccaggtcagaggacccagatgggatttcactaagctggtgggagcttctttgcgttctttggggtagggggaaggacaggaactccccctgcttcgcaccaatgcccaaacaccgcacttcctcttcagcctcggttcagccacagagaggggcctcctcctgtgtagatgcccggaggggaggagcggtggttcttgggg

SEQ ID NO: 117941 - DNA, 87 bp, Homo sapiens; identical to SEQ ID NO: 87071
  misc_feature 1..87: note = chr2:99004128-99004215
  misc_feature 1..87: note = Hypo
  source 1..87: mol_type = genomic DNA

SEQ ID NO: 117942 - DNA, 30 bp, Homo sapiens; identical to SEQ ID NO: 87075
  misc_feature 1..30: note = chr2:99264200-99264230
  misc_feature 1..30: note = Hypo
  source 1..30: mol_type = genomic DNA

SEQ ID NO: 117943 - DNA, 512 bp, Homo sapiens
  misc_feature 1..512: note = chr2:99438995-99439507
  misc_feature 1..512: note = Hyper
  source 1..512: mol_type = genomic DNA
tcggcacgaggacaccgagaacttcttcgcgcctcgcagctcggcaccgcccctctccgccttccgctctggcgccgccctctcggcgcccgccggtggcgcctcggctcgctcggccttggggcgctccggggcggcggcctctgcgtcgagggaaccggggccgggctccaccgggggagactccgcagcggcaagcggcggggacgcggcggggccctcgctggcggccgcgggccggtgtttcaggcagctcttgggcgccggcgggctcggggcgggcgccgtggagggctcggtcccaattctctcgggctcggtccccgctcctctctcgggctccgtctccgcttctctctcgggctcaggcgccggccctgggggccccttctcctcatccgggagcacgggcggcgtcggctccgcttccttcgggacactgcgttctggcccgtcgcgagcagagggcgcctctgaggtggcggcggggtcagtctcggggggagtcgtgt

SEQ ID NO: 117944 - DNA, 985 bp, Homo sapiens; identical to SEQ ID NO: 87079
  misc_feature 1..985: note = chr2:99552170-99553155
  misc_feature 1..985: note = Hyper
  source 1..985: mol_type = genomic DNA

SEQ ID NO: 117945 - DNA, 125 bp, Homo sapiens; identical to SEQ ID NO: 87080
  misc_feature 1..125: note = chr2:99553419-99553544
  misc_feature 1..125: note = Hyper
  source 1..125: mol_type = genomic DNA

SEQ ID NO: 117946 - DNA, 30 bp, Homo sapiens
  misc_feature 1..30: note = chr2:99553797-99553827
  misc_feature 1..30: note = Hyper
  source 1..30: mol_type = genomic DNA
tcggctgtcggaggccgagagggcctggac

SEQ ID NO: 117947 - DNA, 38 bp, Homo sapiens; identical to SEQ ID NO: 87083
  misc_feature 1..38: note = chr2:99694705-99694743
  misc_feature 1..38: note = Hypo
  source 1..38: mol_type = genomic DNA

SEQ ID NO: 117948 - DNA, 93 bp, Homo sapiens; identical to SEQ ID NO: 87084
  misc_feature 1..93: note = chr2:99795933-99796026
  misc_feature 1..93: note = Hypo
  source 1..93: mol_type = genomic DNA

SEQ ID NO: 117949 - DNA, 152 bp, Homo sapiens; identical to SEQ ID NO: 87085
  misc_feature 1..152: note = chr2:99796326-99796478
  misc_feature 1..152: note = Hypo
  source 1..152: mol_type = genomic DNA

SEQ ID NO: 117950 - DNA, 100 bp, Homo sapiens; identical to SEQ ID NO: 1551
  misc_feature 1..100: note = chr2:99798646-99798746
  misc_feature 1..100: note = Hypo
  source 1..100: mol_type = genomic DNA

SEQ ID NO: 117951 - DNA, 101 bp, Homo sapiens; identical to SEQ ID NO: 87087
  misc_feature 1..101: note = chr2:99799327-99799428
  misc_feature 1..101: note = Hypo
  source 1..101: mol_type = genomic DNA

SEQ ID NO: 117952 - DNA, 31 bp, Homo sapiens; identical to SEQ ID NO: 87088
  misc_feature 1..31: note = chr2:99951500-99951531
  misc_feature 1..31: note = Hypo
  source 1..31: mol_type = genomic DNA

SEQ ID NO: 117953 - DNA, 72 bp, Homo sapiens; identical to SEQ ID NO: 84768
  misc_feature 1..72: note = chr2:100107653-100107725
  misc_feature 1..72: note = Hypo
  source 1..72: mol_type = genomic DNA

SEQ ID NO: 117954 - DNA, 162 bp, Homo sapiens; identical to SEQ ID NO: 39613
  misc_feature 1..162: note = chr2:100108060-100108222
  misc_feature 1..162: note = Hypo
  source 1..162: mol_type = genomic DNA

SEQ ID NO: 117955 - DNA, 88 bp, Homo sapiens; identical to SEQ ID NO: 84770
  misc_feature 1..88: note = chr2:100196908-100196996
  misc_feature 1..88: note = Hypo
  source 1..88: mol_type = genomic DNA

SEQ ID NO: 117956 - DNA, 178 bp, Homo sapiens; identical to SEQ ID NO: 84771
  misc_feature 1..178: note = chr2:100339611-100339789
  misc_feature 1..178: note = Hypo
  source 1..178: mol_type = genomic DNA

SEQ ID NO: 117957 - DNA, 104 bp, Homo sapiens; identical to SEQ ID NO: 84772
  misc_feature 1..104: note = chr2:100381776-100381880
  misc_feature 1..104: note = Hypo
  source 1..104: mol_type = genomic DNA

SEQ ID NO: 117958 - DNA, 63 bp, Homo sapiens; identical to SEQ ID NO: 84773
  misc_feature 1..63: note = chr2:100403903-100403966
  misc_feature 1..63: note = Hypo
  source 1..63: mol_type = genomic DNA

SEQ ID NO: 117959 - DNA, 186 bp, Homo sapiens; identical to SEQ ID NO: 84774
  misc_feature 1..186: note = chr2:100422787-100422973
  misc_feature 1..186: note = Hypo
  source 1..186: mol_type = genomic DNA

SEQ ID NO: 117960 - DNA, 210 bp, Homo sapiens; identical to SEQ ID NO: 84775
  misc_feature 1..210: note = chr2:100616138-100616348
  misc_feature 1..210: note = Hypo
  source 1..210: mol_type = genomic DNA

SEQ ID NO: 117961 - DNA, 73 bp, Homo sapiens; identical to SEQ ID NO: 84776
  misc_feature 1..73: note = chr2:100623015-100623088
  misc_feature 1..73: note = Hypo
  source 1..73: mol_type = genomic DNA

SEQ ID NO: 117962 - DNA, 541 bp, Homo sapiens; identical to SEQ ID NO: 84777
  misc_feature 1..541: note = chr2:100720888-100721429
  misc_feature 1..541: note = Hyper
  source 1..541: mol_type = genomic DNA

SEQ ID NO: 117963 - DNA, 30 bp, Homo sapiens; identical to SEQ ID NO: 84778
  misc_feature 1..30: note = chr2:100820254-100820284
  misc_feature 1..30: note = Hypo
  source 1..30: mol_type = genomic DNA

SEQ ID NO: 117964 - DNA, 1387 bp, Homo sapiens
  misc_feature 1..1387: note = chr2:100937789-100939176
  misc_feature 1..1387: note = Hyper
  source 1..1387: mol_type = genomic DNA
aagcctcgggcccaccggccagctccccaccccgctgctgggccggacaggtgtaggggaggcggacccgccccgcagccgactcacccagctccagggcctggtcgcacctgagcagcgcggcctccggctgctgctggcgctgcaggctccgcgcctggcctgccagcctgcgcagccggcactcggccgggaagcacttctccagcaggccgctcagcaccacgttcacgcgccgcacctgcggccgcgcgggccctggctccacgcagcgcttgcagactgtgagcccgcagggcagcgtcaccggcttatgcagcagccgccggcagcgcgggcagccgagcaggtcgcggggcgcgcggggctccggggccggccctccctcgccgggcgcctcgggctcgccgcccgggttctccgcggacagcggccggtcgcgcaggcccacggcgcgcaccaggccgcccgccagctcttccagctcctccggccgcagcgccccgagccgcgcggcgccgcggaacgcgcccagggcttcggggaggcggccggcgcgggccagcgcgtcccccagcctcaggcacaggccgcggtccggctgcgccagcccggctagcatggagcgaaagagctcggctgccatctcgtagtcgcccgcgcggaaggcctcgtcgccctcctctaagcgctgggcgatcggctccgcgcggtcgcagccaggacactggggcggcggcggcggcgggaccggctcggggctcatcaccgcggggctgcgacgacgcgggtccggagcgaaggcgcggagcagggaggatgcgctgctgctgggaactggccggcgggagcgcggtctcagccctcgccagcagccacgcgcgtctgggggcggcgcgctgcgagcggctgagaccgcgggcgggggcgggcgcctggcttgggcagcgtcctcagcgcggtgtgggcggcgagccccgcagggctgcaatcgttccggggtgggggccgggacaggcaccgcgggcgcaatctgagcccctgcccacgcgcagcggcctctcagtcccgccggcttaggtaacccaggtcgctgcggtaacgcagtgaccgcgctccaggtccgcgtctcttgcgatgcttcccccactcgcctgagggctcctgcgcgactgcgcgcgcgtcctctgcctgccgcctccccgcagaggtgccggggccctgggagcaggtggccttggccgcgggctgctggcgcgccggcaccgcggcacctgctcttccccagaggcctggccgcccccacaacctgtggctccgcttaagcaagaacccaggaaaagtcaccaaacgcatcacgcatctctagcttcgacttaggaaattg

SEQ ID NO: 117965 - DNA, 30 bp, Homo sapiens; identical to SEQ ID NO: 84784
  misc_feature 1..30: note = chr2:100993554-100993584
  misc_feature 1..30: note = Hypo
  source 1..30: mol_type = genomic DNA

SEQ ID NO: 117966 - DNA, 30 bp, Homo sapiens; identical to SEQ ID NO: 84785
  misc_feature 1..30: note = chr2:100995355-100995385
  misc_feature 1..30: note = Hypo
  source 1..30: mol_type = genomic DNA

SEQ ID NO: 117967 - DNA, 30 bp, Homo sapiens; identical to SEQ ID NO: 84786
  misc_feature 1..30: note = chr2:101007539-101007569
  misc_feature 1..30: note = Hypo
  source 1..30: mol_type = genomic DNA

SEQ ID NO: 117968 - DNA, 175 bp, Homo sapiens; identical to SEQ ID NO: 84787
  misc_feature 1..175: note = chr2:101009822-101009997
  misc_feature 1..175: note = Hypo
  source 1..175: mol_type = genomic DNA

SEQ ID NO: 117969 - DNA, 718 bp, Homo sapiens
  misc_feature 1..718: note = chr2:101033591-101034309
  misc_feature 1..718: note = Hyper
  source 1..718: mol_type = genomic DNA
caatatcaataattccgcgggtcacagcatcccgcacaaggacgccttcttattgcataattaacgcgaggaaggctcttcccgctactcccgcgaactagggaggtcttcaagtcgccaaaacacaccgggatgtggctcgccaggacaaaacccgcgggttccccggtttttccgtgcgccccgcggcggggagaggggcccaggcgctgaaacccacccgcctgcgcgtccccgagctcaccctactggagcggcgctcgtccgggtccttaggctcctcccctggccctgggggcgccgcgcgggtcgggcttcgccgggcctgtgggcgaagcgcgcggggtcctgggagctcgggaggcccgccccaccttgccccgaggcctccgcgccgcggcccgtcgggtcccgggatgtggcggcggcggcagcggaagtaaggaagacgcccggcgcgctagaccggctttgggggccagaacgccggcaccgcctcacgcggccccctcgcgcctatccggccgtgcgcgccgcctgcccgcgcgcgtccccgccgccgtccccggccgtgcgcgttccagcgggtcgcggggagtggggaggggcgcggccgcgggaccccaggcccggatcccgagtctccctttctgccgctgcaaaagcgttctttctgaccgagacctgcggccggaacaagtcccgctgggcctccatc

SEQ ID NO: 117970 - DNA, 125 bp, Homo sapiens; identical to SEQ ID NO: 84790
  misc_feature 1..125: note = chr2:101056687-101056812
  misc_feature 1..125: note = Hypo
  source 1..125: mol_type = genomic DNA

SEQ ID NO: 117971 - DNA, 30 bp, Homo sapiens; identical to SEQ ID NO: 84792
  misc_feature 1..30: note = chr2:101228276-101228306
  misc_feature 1..30: note = Hypo
  source 1..30: mol_type = genomic DNA

SEQ ID NO: 117972 - DNA, 429 bp, Homo sapiens; identical to SEQ ID NO: 84793
  misc_feature 1..429: note = chr2:101435684-101436113
  misc_feature 1..429: note = Hyper
  source 1..429: mol_type = genomic DNA

SEQ ID NO: 117973 - DNA, 30 bp, Homo sapiens; identical to SEQ ID NO: 84794
  misc_feature 1..30: note = chr2:101436712-101436742
  misc_feature 1..30: note = Hyper
  source 1..30: mol_type = genomic DNA

SEQ ID NO: 117974 - DNA, 183 bp, Homo sapiens; identical to SEQ ID NO: 84797
  misc_feature 1..183: note = chr2:101520526-101520709
  misc_feature 1..183: note = Hypo
  source 1..183: mol_type = genomic DNA

SEQ ID NO: 117975 - DNA, 41 bp, Homo sapiens; identical to SEQ ID NO: 39616
  misc_feature 1..41: note = chr2:101835056-101835097
  misc_feature 1..41: note = Hypo
  source 1..41: mol_type = genomic DNA

SEQ ID NO: 117976 - DNA, 30 bp, Homo sapiens; identical to SEQ ID NO: 39617
  misc_feature 1..30: note = chr2:101893777-101893807
  misc_feature 1..30: note = Hypo
  source 1..30: mol_type = genomic DNA

SEQ ID NO: 117977 - DNA, 35 bp, Homo sapiens; identical to SEQ ID NO: 84809
  misc_feature 1..35: note = chr2:101959293-101959328
  misc_feature 1..35: note = Hypo
  source 1..35: mol_type = genomic DNA

SEQ ID NO: 117978 - DNA, 48 bp, Homo sapiens; identical to SEQ ID NO: 84810
  misc_feature 1..48: note = chr2:101997524-101997572
  misc_feature 1..48: note = Hypo
  source 1..48: mol_type = genomic DNA

SEQ ID NO: 117979 - DNA, 108 bp, Homo sapiens; identical to SEQ ID NO: 84811
  misc_feature 1..108: note = chr2:102003501-102003609
  misc_feature 1..108: note = Hyper
  source 1..108: mol_type = genomic DNA

SEQ ID NO: 117980 - DNA, 320 bp, Homo sapiens; identical to SEQ ID NO: 84812
  misc_feature 1..320: note = chr2:102003834-102004154
  misc_feature 1..320: note = Hyper
  source 1..320: mol_type = genomic DNA

SEQ ID NO: 117981 - DNA, 879 bp, Homo sapiens; identical to SEQ ID NO: 84813
  misc_feature 1..879: note = chr2:102090355-102091234
  misc_feature 1..879: note = Hyper
  source 1..879: mol_type = genomic DNA

SEQ ID NO: 117982 - DNA, 212 bp, Homo sapiens; identical to SEQ ID NO: 84817
  misc_feature 1..212: note = chr2:102246999-102247211
  misc_feature 1..212: note = Hypo
  source 1..212: mol_type = genomic DNA

SEQ ID NO: 117983 - DNA, 262 bp, Homo sapiens; identical to SEQ ID NO: 84824
  misc_feature 1..262: note = chr2:103235936-103236198
  misc_feature 1..262: note = Hyper
  source 1..262: mol_type = genomic DNA

SEQ ID NO: 117984 - DNA, 30 bp, Homo sapiens; identical to SEQ ID NO: 84827
  misc_feature 1..30: note = chr2:103510419-103510449
  misc_feature 1..30: note = Hypo
  source 1..30: mol_type = genomic DNA

SEQ ID NO: 117985 - DNA, 91 bp, Homo sapiens; identical to SEQ ID NO: 39619
  misc_feature 1..91: note = chr2:104014594-104014685
  misc_feature 1..91: note = Hypo
  source 1..91: mol_type = genomic DNA

SEQ ID NO: 117986 - DNA, 40 bp, Homo sapiens; identical to SEQ ID NO: 84831
  misc_feature 1..40: note = chr2:104275911-104275951
  misc_feature 1..40: note = Hypo
  source 1..40: mol_type = genomic DNA

SEQ ID NO: 117987 - DNA, 225 bp, Homo sapiens; identical to SEQ ID NO: 84833
  misc_feature 1..225: note = chr2:104726683-104726908
  misc_feature 1..225: note = Hypo
  source 1..225: mol_type = genomic DNA

SEQ ID NO: 117988 - DNA, 28 bp, Homo sapiens
  misc_feature 1..28: note = chr2:104963628-104963656
  misc_feature 1..28: note = Hypo
  source 1..28: mol_type = genomic DNA
cacggtggctcacgccgactgtaatccc

SEQ ID NO: 117989 - DNA, 165 bp, Homo sapiens; identical to SEQ ID NO: 84835
  misc_feature 1..165: note = chr2:104984754-104984919
  misc_feature 1..165: note = Hypo
  source 1..165: mol_type = genomic DNA

SEQ ID NO: 117990 - DNA, 30 bp, Homo sapiens; identical to SEQ ID NO: 84837
  misc_feature 1..30: note = chr2:105147581-105147611
  misc_feature 1..30: note = Hypo
  source 1..30: mol_type = genomic DNA

SEQ ID NO: 117991 - DNA, 1554 bp, Homo sapiens
  misc_feature 1..1554: note = chr2:105458957-105460511
  misc_feature 1..1554: note = Hyper
  source 1..1554: mol_type = genomic DNA
ttgggaagactcaggcgaaagagggagatgcccgtgtagagaaccgaggaggggggctggggtagaataatcagctctaaggttgcagatttagatctcaaggctgaaaaggataagcttccaccagagcatcctgtagcgcctcctgtcctgccctgccctgccctgcgcgcgcaccgcactcacacgtacacccggtcctcgcacgcgcacacacgcacactgttccccgccgctctaccctctagactgcaagggaaacggctcctctggggcgcgctcaccggaggtgaggcgacccagcccggcccaggccagcctggtacccagcgctggtcgctgcccctgtggggaggcagcgcggccttcggggctccagagcgcgcgggcccggaacgaggcgcgcggccgctggcacatgcggggactgcccagcgcggactggagaaggggagcgaaggggtggggagggggtgacgccggctgcccaccccgctccgcgcctccctctgtggccctctctcccttcttcccctcccaccctgccgctcccagccgcgtatggaactcgcgtttggaaaaggcacggagcaggcgggcagctgtgcgtgtgcgcgccggtggcctcggacgcagccagcgcgaggacctcggcgcggcggtagcgccccggcgggccctccaagtgccggcctgcagggggcgccggcgcgctcgcgccccgcgggttctccaccgccccgccttcgcccaccgaggaagggtcggagggaggacccggacgggagcaggttcccttcgcgcctctctggagggtcggcggggccctcaggctggtgctcacccgtaggaccgggacggtgttgtcacacttgtcaccaacgacggccggcgtggcgtcgcaagtccgctttccagtctcagcggctggaggaggcctcggggcggcagggggagtttgcctcccggctggctagcttcgctagactcagtcattactaaggggttgggagggggagcttgtctcttctctcctggcagagccgcgggaggcgtcggaaagtttcctaccacttgagggacgaaggtggatggatcgagagccttgtttccctgctgggatggccgaatgtaccagaagtctcgctggcgagcagcgccctcggcttccccggcaatcatcccaaacgcacacccttcccctggccgaaggaaccccaggttgcctaggaaacggccccgcggacctggcgggccctagggtggagacccgggcggggttggggggtactcgcgaatctgctgcgggcgcagcgttggggtgtctggtccctgcccagccggtaggccgcgtccgccgtcccactcagtggggctttgcgcccccacccatgggagttgcccgttccgcagcagagttcgaaggggaaagtgggggccacgttcccagaggaacagagttccagacctctcagggcactgatggggactccgtcggacccacgggttccgcaaacactccagaggggttcccagggccgaagatgcctcctg

SEQ ID NO: 117992 - DNA, 1431 bp, Homo sapiens
  misc_feature 1..1431: note = chr2:105460921-105462352
  misc_feature 1..1431: note = Hyper
  source 1..1431: mol_type = genomic DNA
ggagagggtgatacacgttcacacaccgcttgctaaatgcagtggcgagaggagggagcagcgtctacatgaagcgaacttttcaagcgcagagccctgactcccaggcgcgggggctcaccgggaggggcccgggcgagagagcgcgtgggtgcgtgagtgcctgtgtgcgcccgccctttgcttgctcggggtgtccgcctttgtcccccgccgcgggcctccacggtgggatctgcgcgcggccggtgggcagccctcgacccggggcgcgtccacagcgcccacccgcggcccccaaacacctcgagagcagatcttaggggttaaccaggcaccgacctgaggcgccctgcagctgccaaaagctcgaccggaaacctagaacatgggacccaattcatcggttttcctcgtccatacatgcatccatccatccctgcatgcgtacatgcatgcaatacaaatcccgggacgccggcacggagagctgcgcctcgcccttgctgcgggctgagagcgggtacccccccttccagctcttcctcctcccgcgcagccgcggccccctccccgaaggaagaacagctcaattacgaagaggagccaaggaacgaaatcccaggctcagaggcgcccgccgttgctcctctgttcccggtccctgtagtgcagtccccacccccaccgtccccagctcggggagggcggggacgcggcggtgcgaggggtcctgccctgctccgccggaacaaagcccgccgcaggagcccgcggccgcgcaccgaatcagtgacaaaggcaagcgggcggcgccgagctccaagccggcgctcctacggcttggcgggaaggaggcccagaagatggggtgcgatttgcacccggattttcctgggctgcagcatctcgctcctgtgtacccaatgacctgttagggtgactcagcgtttatctcttcgcctccctgctgccccatctcctctcttgtcctcttctgtccccagtctccttcaccgctccctgcatgttttaatccacctcactccttgtaccttacccgcttctcactttgccctatttacctctttccctttttctttcccatagaaaagcaatgctaattcgacttctgaaggccgctctagatgttcaaataacagtctgaaagaccttgctgggcagtgctcagagagaaaaggggagtaatgggatccttttaattttattatgcaaactgtgccctaaataaaataaaacgccgttagaatgcgatctaaggaagccgagcttagccctggggcccccaaaatggccggagattcgggagaagtcgcttctcgtgcccacaaatcacaggaatgttgggggtgggggtgagaggaggacctcgccgctgtggaatggggacctcagcgctggagactccaa

SEQ ID NO: 117993 - DNA, 2506 bp, Homo sapiens
  misc_feature 1..2506: note = chr2:105468563-105471069
  misc_feature 1..2506: note = Hyper
  source 1..2506: mol_type = genomic DNA
ttatatatacatatacgcatacgtaaatataaaaagcaacctttgggggccgcagaggaaaaaaatccgttctgtttggggtttggttaccaccgcctttggtatctataccttggcaataatggctttgctaaaacctacctacgatggtatctcacccggcaagcaggagctggacaagagcctacataaattctacgcgtctagtgttaatcttgagatcacgcgggggctgcctggctgcggctgggcaggagaactcctgctttcactgagttcacttaactgcgctcggcagaggcacgatacagcgggagagaagggcaggcccgttcacattttaatcggagcgcaccggcggccgctcctcggctgcgtcctgggctgccgctcgggctcgggactgccagatgcaggctctggctgggggcggcgggcgcaagcgggcgcacccgcagctaggggtgcggggtgcacgcacacgcacgctcattaagagccatgtatttattgaatgtccgagttgggttagttcattggaaatccccgaggagggctcaatttgcccttgttttcgttgccactttctcttttttcttggttcgctgaggttcctctgtgcagcgtttccgcttggccgcgtccccccaccccaccccaccccacccccgcttctctcgcctaccgggtgcactccccctcccatcccccttaactctttcagctgggttagagctgagaaagcatttgtcgccgccagccccatccaccacgcaaatccatctgagacagaaaggaaagaaaaaaaagcaccaccatgcctaagaatagagagcgagcaaacccccccaccgctaatcacacacacacacacacacacacacacacacacacacgaggaagcggtggagcagagaagggcgcggctagccgatcccggttctttcgcccggctcctgctgccacagggaattcctaaagccattggggtcgaatacacttacgatgaatctatgggggaaggtcggactgattgcttttcaaatacatcgcacggctccgctgaccggcaccctccaaactcacaagggcacgcacgctacttgcacgaatcccagaggagggaggagggaggaagggagggagagcgaaggagggagagagggggtggaggagccagggagcggcggcagcgagcggtccgtctcgcacgcgcgggcaccgcgctggtcctgggctgcaggtttcccagatgatggcatccgagaacttaaacaaagggggctgccgccggcgcgcaacggctgcggaaagttgcggtggcggatttccaaggagcgtggccacgaccagagctcttggcgatgcgagcccccgcttcccacccccgccgatcagagaagggggccggctggtgaagggaagaggaaactttgaaaccactggggacacatctgtctataggtattagcttgaatggtacatccgtgccgcgcgctttacaaatctctggcggggcgggggtaagggggtgagcaacccgacgcgtactaggtggggtgggcaggttgctatttttcatgtttcccccttcgttttccttctgattctcttcccccctctcgtccctccctcccttttatctcccctttcttccccccgcccagacctattgcgaacgcccagagccgccgagggaacgccaacgtctgggccggacactaagagttaagatgtggcggagggggcggcgggggaggggcggggaggggaaagtggtgagggggagggaggctggaggacgacagatttccagcttctacgacgctctgcctaaattaaaaagcaaccaatcggaacggccggaaggggggcctcgcgtcctgagccagtcattccgagcctgccaatcacccagcgggtagccaatcagcgggggccctggtgctcgacttccttgtatttgggaaagtgtggtggtgggtgcgcgctcgcggcggagggtaaacattcgacagtccccgctctgagagggagggacagagagcgaactgtcagatcggagcgagagcgggcgcccgagagagggagagagagagagggagggagaggaaaagtgagagagggaaagagagcgcgaacgagggcgcagagcgagctcctgctgcaactctgctccagcacggccagcgccagcgcccgccgtcggtgcactctacgagccgtgcagcgtgcccactggagttgttgtgtatcaaggatcgatcccctatatgcacacacacacctccacctccaccaatgcactcttcttcctcctccttctccagacaactgctgggaaaaaaataaaacaccaaccccaaccgtcagcaacaaggtaacagagcgattcgacatcattttttttcctgttcaattttttccttgttatatttgtttcctaatttctgcccaaaaggaaagatgtcgcatcagactgtgactgttgcgaggagaatgaaaa

SEQ ID NO: 117994 - DNA, 326 bp, Homo sapiens; identical to SEQ ID NO: 84849
  misc_feature 1..326: note = chr2:105471422-105471748
  misc_feature 1..326: note = Hyper
  source 1..326: mol_type = genomic DNA

SEQ ID NO: 117995 - DNA, 240 bp, Homo sapiens; identical to SEQ ID NO: 84850
  misc_feature 1..240: note = chr2:105471808-105472048
  misc_feature 1..240: note = Hyper
  source 1..240: mol_type = genomic DNA

SEQ ID NO: 117996 - DNA, 1706 bp, Homo sapiens
  misc_feature 1..1706: note = chr2:105472108-105473814
  misc_feature 1..1706: note = Hyper
  source 1..1706: mol_type = genomic DNA
gggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtgaagccagggcgcagagcgaagagggccgccgccgccgccgcctccgcagccgccgtcagcaccgccgccgcccctgccgccgccgccgccgccgccgccgccgctgccgccgccgcgccgaccctgcacctgggccgctccgggctccagcccaggcccatccgccgccctcccctccacccagagacaggcatgcccgcccttggaggagaaaacgcgggagaaacggaccaaggaggcatttttgcagtccaaggaaggaggggccaaaaaataaaaagcataataaacacccagactgttttgtatacatatataacaaacaaaaccggaagagaaaaagg

SEQ ID NO: 117997 - DNA, 347 bp, Homo sapiens
  misc_feature 1..347: note = chr2:105474399-105474746
  misc_feature 1..347: note = Hyper
  source 1..347: mol_type = genomic DNA
gaactgggagcagagcgggggcccagccagcgaggccgccgagccaggcccggccgcgtacccaggctttgacggctgccattcagggtggacgatgcctaaagattccaccgctaatattttttttattaatattttttattttttatttctggactgactcagataaaggaatttagaaagactgagcaccagccgctgcacttctctggacttctctcctcaatccgttgccaactttgattgaatgggtgctgtggatgtgattatataatactgccatttccaagcagtgtttttggtaggttttaataaacagacttttcaaaagacggcaatatagaatt

SEQ ID NO: 117998 - DNA, 30 bp, Homo sapiens; identical to SEQ ID NO: 84854
  misc_feature 1..30: note = chr2:105477283-105477313
  misc_feature 1..30: note = Hyper
  source 1..30: mol_type = genomic DNA

SEQ ID NO: 117999 - DNA, 685 bp, Homo sapiens
  misc_feature 1..685: note = chr2:105478626-105479311
  misc_feature 1..685: note = Hyper
  source 1..685: mol_type = genomic DNA
ctatgatgtcactgccggccagaggcggccgcctggccttctggcgggctgtgcgctgcgttcttgatgagtccggtcttcctcaaggaagagttggctctggaagtgacctcagaggggtctgggaagagggcaacagtcattctcttggcggcacgatgtgtgcgctagtgtgtgcgcgcgcgtgccgtgtgcatgtgggtgcgcgtgaggggagggggaagcggaaattcgcagtctggaccccgaagccctaggggtacaggcgacggggtcaggtgtaaggcctgcctccggtgaaaaccccggatcagaagaggcggagggggagggggacccgaggcagccgggcgtccaaagctcgcttctctccgggagggagggcagggctgggcgcggaggtggggcggtggcggtcgcggtggggcggccgggtccctgctcggcccggcacggccgggcggccagactgtggcagctgctgtgggtcccacaagttgttttcctcgtggcgaccattcagcaaaacgcacgaacctttctcaaagatttaaatttcgcggatgaattaccatacacccgttgcttagcaactaaattcaagcagggctaagaatatgcaagctttttgtattctcattaataaaaatgccactctgacacagcaacccgactttggatcact

SEQ ID NO: 118000 - DNA, 321 bp, Homo sapiens; identical to SEQ ID NO: 84857
  misc_feature 1..321: note = chr2:105479678-105479999
  misc_feature 1..321: note = Hyper
  source 1..321: mol_type = genomic DNA

SEQ ID NO: 118001 - DNA, 107 bp, Homo sapiens
  misc_feature 1..107: note = chr2:105480530-105480637
  misc_feature 1..107: note = Hyper
  source 1..107: mol_type = genomic DNA
tgcctgtgcctggcccggtgagggtcgctcccccaggccccgtctccgcccgaggactgcaggcctaggcctgcggggagatcctgagaccgcggtgtgcgggcgcc

SEQ ID NO: 118002 - DNA, 216 bp, Homo sapiens; identical to SEQ ID NO: 84859
  misc_feature 1..216: note = chr2:105483624-105483840
  misc_feature 1..216: note = Hyper
  source 1..216: mol_type = genomic DNA

SEQ ID NO: 118003 - DNA, 337 bp, Homo sapiens; identical to SEQ ID NO: 84860
  misc_feature 1..337: note = chr2:105484041-105484378
  misc_feature 1..337: note = Hyper
  source 1..337: mol_type = genomic DNA

SEQ ID NO: 118004 - DNA, 997 bp, Homo sapiens; identical to SEQ ID NO: 84861
  misc_feature 1..997: note = chr2:105488281-105489278
  misc_feature 1..997: note = Hyper
  source 1..997: mol_type = genomic DNA

SEQ ID NO: 118005 - DNA, 420 bp, Homo sapiens
  misc_feature 1..420: note = chr2:105489615-105490035
  misc_feature 1..420: note = Hyper
  source 1..420: mol_type = genomic DNA
ttaaaaacagggcagcggctgtgagcgctgggccggtaagtaagggcagagaaaggggctgtcgtgtgcgtcccagctctccgacccgcacgtccgggacccctttccgcccgcgcaccgcggtcacttgcagccggcgctggctgcttgagcccgcggccgggtcgcccggcttctctccgggagagtggccagggcctaggcgctcgctcaagagggagagcgaagggaaaagaagaaagttctccgccggccgcgcgcagctcctcccgtgagcgcgccccagccctgggccggcccgacccgacccgcgacggggccacgcgtagtgccaggcaactcctgtgccctgtggccagccccgcgcgcgcactcgcactcacacacactcatactcacaccccacggttctttttgttc

SEQ ID NO: 118006 - DNA, 30 bp, Homo sapiens; identical to SEQ ID NO: 84863
  misc_feature 1..30: note = chr2:105515638-105515668
  misc_feature 1..30: note = Hypo
  source 1..30: mol_type = genomic DNA

SEQ ID NO: 118007 - DNA, 35 bp, Homo sapiens; identical to SEQ ID NO: 84864
  misc_feature 1..35: note = chr2:105719619-105719654
  misc_feature 1..35: note = Hypo
  source 1..35: mol_type = genomic DNA

SEQ ID NO: 118008 - DNA, 441 bp, Homo sapiens; identical to SEQ ID NO: 84865
  misc_feature 1..441: note = chr2:105760563-105761004
  misc_feature 1..441: note = Hyper
  source 1..441: mol_type = genomic DNA

SEQ ID NO: 118009 - DNA, 20 bp, Homo sapiens
  misc_feature 1..20: note = chr2:105761064-105761084
  misc_feature 1..20: note = Hyper
  source 1..20: mol_type = genomic DNA
actgtcgcccatcccagctc

SEQ ID NO: 118010 - DNA, 30 bp, Homo sapiens; identical to SEQ ID NO: 84868
  misc_feature 1..30: note = chr2:105840269-105840299
  misc_feature 1..30: note = Hypo
  source 1..30: mol_type = genomic DNA

SEQ ID NO: 118011 - DNA, 30 bp, Homo sapiens; identical to SEQ ID NO: 84869
  misc_feature 1..30: note = chr2:105840502-105840532
  misc_feature 1..30: note = Hypo
  source 1..30: mol_type = genomic DNA

SEQ ID NO: 118012 - DNA, 84 bp, Homo sapiens; identical to SEQ ID NO: 84870
  misc_feature 1..84: note = chr2:105858316-105858400
  misc_feature 1..84: note = Hypo
  source 1..84: mol_type = genomic DNA

SEQ ID NO: 118013 - DNA, 162 bp, Homo sapiens; identical to SEQ ID NO: 84872
  misc_feature 1..162: note = chr2:105972350-105972512
  misc_feature 1..162: note = Hypo
  source 1..162: mol_type = genomic DNA

SEQ ID NO: 118014 - DNA, 171 bp, Homo sapiens; identical to SEQ ID NO: 27406
  misc_feature 1..171: note = chr2:106014945-106015116
  misc_feature 1..171: note = Hyper
  source 1..171: mol_type = genomic DNA

SEQ ID NO: 118015 - DNA, 131 bp, Homo sapiens; identical to SEQ ID NO: 84875
  misc_feature 1..131: note = chr2:106015416-106015547
  misc_feature 1..131: note = Hyper
  source 1..131: mol_type = genomic DNA

SEQ ID NO: 118016 - DNA, 279 bp, Homo sapiens; identical to SEQ ID NO: 84876
  misc_feature 1..279: note = chr2:106016119-106016398
  misc_feature 1..279: note = Hypo
  source 1..279: mol_type = genomic DNA

SEQ ID NO: 118017 - DNA, 177 bp, Homo sapiens; identical to SEQ ID NO: 14440
  misc_feature 1..177: note = chr2:106060615-106060792
  misc_feature 1..177: note = Hypo
  source 1..177: mol_type = genomic DNA

SEQ ID NO: 118018 - DNA, 156 bp, Homo sapiens; identical to SEQ ID NO: 84878
  misc_feature 1..156: note = chr2:106111050-106111206
  misc_feature 1..156: note = Hypo
  source 1..156: mol_type = genomic DNA

SEQ ID NO: 118019 - DNA, 68 bp, Homo sapiens; identical to SEQ ID NO: 84879
  misc_feature 1..68: note = chr2:106143101-106143169
  misc_feature 1..68: note = Hypo
  source 1..68: mol_type = genomic DNA

SEQ ID NO: 118020 - DNA, 41 bp, Homo sapiens; identical to SEQ ID NO: 84880
  misc_feature 1..41: note = chr2:106231824-106231865
  misc_feature 1..41: note = Hypo
  source 1..41: mol_type = genomic DNA

SEQ ID NO: 118021 - DNA, 48 bp, Homo sapiens; identical to SEQ ID NO: 84881
  misc_feature 1..48: note = chr2:106305501-106305549
  misc_feature 1..48: note = Hypo
  source 1..48: mol_type = genomic DNA

SEQ ID NO: 118022 - DNA, 147 bp, Homo sapiens; identical to SEQ ID NO: 84883
  misc_feature 1..147: note = chr2:106560596-106560743
  misc_feature 1..147: note = Hypo
  source 1..147: mol_type = genomic DNA

SEQ ID NO: 118023 - DNA, 30 bp, Homo sapiens; identical to SEQ ID NO: 84884
  misc_feature 1..30: note = chr2:106571234-106571264
  misc_feature 1..30: note = Hypo
  source 1..30: mol_type = genomic DNA

SEQ ID NO: 118024 - DNA, 30 bp, Homo sapiens; identical to SEQ ID NO: 84885
  misc_feature 1..30: note = chr2:106578646-106578676
  misc_feature 1..30: note = Hypo
  source 1..30: mol_type = genomic DNA

SEQ ID NO: 118025 - DNA, 30 bp, Homo sapiens; identical to SEQ ID NO: 14441
  misc_feature 1..30: note = chr2:106672847-106672877
  misc_feature 1..30: note = Hypo
  source 1..30: mol_type = genomic DNA

SEQ ID NO: 118026 - DNA, 562 bp, Homo sapiens
  misc_feature 1..562: note = chr2:106681722-106682284
  misc_feature 1..562: note = Hyper
  source 1..562: mol_type = genomic DNA
taaggggaacagtggcgcggctggggcgggcggaggaagtgggggagccaaggagacaccccagcgctgggatccggcaagtcctccctctgagtggccagggggcctcgtcccttctcccgatgccttctgcccttccttgggtctccggaacccagcttgtcctaaccgctttcgctgcgggcagcgctggccacgcggcccccgccgccggcggttctccgtggccaagcatccttggccttggagcccaggggctgcgttccccttggggccggggcgggagagaggacctcggtggtactcgcccgtgcgctgggcgcagccgcttggccctcagccctctggcgcggcgcccacccgctgggtcccgccccggcagcgacgcagggataacccgcggccgcgcctgcccgctcgcacccctctcccgcgcccggttctccctcgcagcacctcgaagtgcgcccctcgccctcctgctcgcgccccgccgccatggctgcctcccccgcgcggcctgctgtcctggccctgaccgggctggcgctgctcctgctcc

SEQ ID NO: 118027 - DNA, 30 bp, Homo sapiens; identical to SEQ ID NO: 84889
  misc_feature 1..30: note = chr2:106730211-106730241
  misc_feature 1..30: note = Hypo
  source 1..30: mol_type = genomic DNA

SEQ ID NO: 118028 - DNA, 30 bp, Homo sapiens; identical to SEQ ID NO: 84890
  misc_feature 1..30: note = chr2:106778483-106778513
  misc_feature 1..30: note = Hypo
  source 1..30: mol_type = genomic DNA

SEQ ID NO: 118029 - DNA, 456 bp, Homo sapiens; identical to SEQ ID NO: 84893
  misc_feature 1..456: note = chr2:106959159-106959615
  misc_feature 1..456: note = Hypo
  source 1..456: mol_type = genomic DNA

SEQ ID NO: 118030 - DNA, 143 bp, Homo sapiens; identical to SEQ ID NO: 84894
  misc_feature 1..143: note = chr2:106959900-106960043
  misc_feature 1..143: note = Hypo
  source 1..143: mol_type = genomic DNA

SEQ ID NO: 118031 - DNA, 324 bp, Homo sapiens; identical to SEQ ID NO: 84895
  misc_feature 1..324: note = chr2:107103816-107104140
  misc_feature 1..324: note = Hyper
  source 1..324: mol_type = genomic DNA

SEQ ID NO: 118032 - DNA, 21 bp, Homo sapiens
  misc_feature 1..21: note = chr2:107278930-107278951
  misc_feature 1..21: note = Hypo
  source 1..21: mol_type = genomic DNA
ccaccgcgcctggcctatttt

SEQ ID NO: 118033 - DNA, 30 bp, Homo sapiens; identical to SEQ ID NO: 84897
  misc_feature 1..30: note = chr2:107459415-107459445
  misc_feature 1..30: note = Hypo
  source 1..30: mol_type = genomic DNA

SEQ ID NO: 118034 - DNA, 386 bp, Homo sapiens; identical to SEQ ID NO: 84898
  misc_feature 1..386: note = chr2:107460030-107460416
  misc_feature 1..386: note = Hypo
  source 1..386: mol_type = genomic DNA

SEQ ID NO: 118035 - DNA, 1705 bp, Homo sapiens
  misc_feature 1..1705: note = chr2:107502427-107504132
  misc_feature 1..1705: note = Hyper
  source 1..1705: mol_type = genomic DNA
aacattccccacacacgggtctcgctcctaaacacggagtgtaactccgcgcacagcagcgcggaggctgcagcgccaccaagaaaggcgtcgccaacccttacccagtgccctcccttaccagccttcttcccacgccgcgcctcgaagcgcacgacaccgtggtgctcggtgctccccctggcagcgcggcactggagtccaaggcgtgcgtgtcacattttattccccggcagccgctcgggtgcgcgcgctacgcgctcccacactcacgctggcgcccgctagagctgggaccctggccggggtccccgactcacgccgcggaacttgggggctgcagaaggcgagtgcgcggcgggagtcgtcctgccgcaggctcgagtcctcctcctgccaccgtggggtctcggagctgccccgcgctcccgtcccaggcggcctgcgggatcacctctccggggccagcgctgctccgcgccggcggcagctgcaagcgcgggcggcggggcacagcgggtggctcggcctcaaagccggcgggaggctacgctcagccccgcgctgcacgcctcattgtttcgggcagcgcggcggcggctcccgcggccagaggaaccgcggccccgagccccggggagaggcggcggttcccggcccacgcaccgaggctgcgccgcgccccgcccccgagctccgctcgccccagagccccctccctctccgcgatccctttcatccttcccgctccaggctcacctagctggcgggagccgggcactgggaagttgggctgccccctccccgcgcccccggcccggcagctcggcccgccggcgagcgcaggcggggcgctccctggctgcgcgcggatttctgcttgtcgcggagagtgactgcagacttgggctgcgtggggcggtgcggggcagcacggctgcctaaaaaggcgtgtttctccccggccgccgcctccatccagccctagttcttccgaaggttacctgcacagtacccgcctggcaccgcgcctggacacctccggggcactcgggtcccgggcggcggcaggaatgcaggaatgcgcacaggctgtgggcggccaggagggagtcccggcgcctgccccggcggaagtgagtctttgtgtaccctgtccaacacctccccccgccagcgcggaaggccgggctacctgcgcgcctggcagcgcctggcagccggctgggtggggcgcaggggagcgcagcatcctccccggctcgctagctccctttgttcatctcgctcaaccaggctccgcactgccgcctggccctcgctcccagagcttctctaaggatatgggatggacttgggagcgggccacctttcatttgggaagggtagctcgccaagtccggtgacggtgctccctggagacccccacctgcccgcccctccacactgccggtccccaaccccaagagggacggaaagttcttggggtagaagccggcgggacaagtggttgaagcagcctccggagccagtgggcggctgcgagctgggcagctggagcctgcgggcggggccgcggggaggtgcccatcgagtgtcggtctggtcgcgtgcggaatgtccacttgtcaccgcggcccttgcgttttctcgagacggcggcagctggtcctaggaccccaaaccgcgccgccctttgtttgct

SEQ ID NO: 118036 - DNA, 30 bp, Homo sapiens; identical to SEQ ID NO: 84905
  misc_feature 1..30: note = chr2:107872048-107872078
  misc_feature 1..30: note = Hypo
  source 1..30: mol_type = genomic DNA

SEQ ID NO: 118037 - DNA, 24 bp, Homo sapiens
  misc_feature 1..24: note = chr2:108104796-108104820
  misc_feature 1..24: note = Hypo
  source 1..24: mol_type = genomic DNA
tttttttttttgagacggagtccc

SEQ ID NO: 118038 - DNA, 47 bp, Homo sapiens; identical to SEQ ID NO: 39632
  misc_feature 1..47: note = chr2:108160878-108160925
  misc_feature 1..47: note = Hypo
  source 1..47: mol_type = genomic DNA

SEQ ID NO: 118039 - DNA, 39 bp, Homo sapiens; identical to SEQ ID NO: 84908
  misc_feature 1..39: note = chr2:108310877-108310916
  misc_feature 1..39: note = Hypo
  source 1..39: mol_type = genomic DNA

SEQ ID NO: 118040 - DNA, 573 bp, Homo sapiens
  misc_feature 1..573: note = chr2:108602842-108603415
  misc_feature 1..573: note = Hyper
  source 1..573: mol_type = genomic DNA
cacacccaccctcctcgcgagggcagcgtccctagcacacgccctagcaccactctcctctgacgtccgcctccggatgtctgacgatcgcccccgcctgccgcccttataaaggggacttttcccaatactcgatcgattcccacctcgccctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccaggtaggagcggagcgggcattcctgcgcctacgggcccgcaccctcggaaacgccttgggcaccgagcccgggcggttttagaggggagggacgcggcgtttttccctctcggtgggatgcgagggcgggtttgctgtctggcaccgttgctgtcagggtgcaagaggctacaaagtctgggcgcaggaaatgggta

SEQ ID NO: 118041 - DNA, 82 bp, Homo sapiens; identical to SEQ ID NO: 84916
  misc_feature 1..82: note = chr2:109335084-109335166
  misc_feature 1..82: note = Hypo
  source 1..82: mol_type = genomic DNA

SEQ ID NO: 118042 - DNA, 30 bp, Homo sapiens; identical to SEQ ID NO: 84917
  misc_feature 1..30: note = chr2:109524351-109524381
  misc_feature 1..30: note = Hypo
  source 1..30: mol_type = genomic DNA

SEQ ID NO: 118043 - DNA, 425 bp, Homo sapiens; identical to SEQ ID NO: 84918
  misc_feature 1..425: note = chr2:109648039-109648464
  misc_feature 1..425: note = Hyper
  source 1..425: mol_type = genomic DNA

SEQ ID NO: 118044 - DNA, 1753 bp, Homo sapiens
  misc_feature 1..1753: note = chr2:109744748-109746501
  misc_feature 1..1753: note = Hyper
  source 1..1753: mol_type = genomic DNA
attcaccctcctctgcgcctccgtaggaaaaaattggagcgggggttcacgagactgcgccgcggcgggcgctagagcccctcgcacagcgtcgccaagggtgcggcgtggagccgggcgcctggcgccagggtgctggtcggcgggcagcggcgccagcctccgacccgcgactccggcgagccaaggctgcgccgggaggagtcggcgcgggccccggggtgcccccttcaactggagcgccttcccctcctgccttgcggcgcatccccacacctacaccggaacgaagctccggggctgtcacttctgcgcgcttctcggaaaggagtctgaactgggagcgctccggggggtcgtcggggaggatgcccgggcgtcggctgtgtccccaagctgctcgccggcgctggcgaggaaggcagtcgggataacgccgcccaaactttccttcgcagcagcgttggcaggaaacgtccctctctgaggctcacgaaaagccgaaaaagactcggacgcttggaggaggcagggccaagcctgcgcaggagaggttccccggagccctggagatgtcctaggggaccaggctaatcgccggcttgcgcccaagcgaagggaagtcctgcaggcacggcgcctccttccctgagccccgcagtgaccgtgacctccgcgcgcacccccgcgcacgtgctcgcggccgaggaagaggaacggtcctgctgaatcctctggaggacagcgactagcgagcaggccaggggcgcatggaggtgccgcgggggcggtgcggctcgccagctgcgcggaggagcgtgcacgccgcgccccggcctccccggggacctggccggccgctgcccgcacttcctgccgctggtctcccaggcgcgagccgccgcttgcagcacagaacccgttgagcttcgtgcccggcagcacccccggtcccccgcgcggggcggacttgcggcgggacaggtgtagcccgcagccgcaggcgctgcgctcaggactgggcgggctcggctggccggtccccgccacgcaggccggtccccgccacgcaggccggtcggtgagccacttcgcaccgccacagccctagcatcgggccaccagccggggtgaagaaagtcacggcggagcccggctccccagtcctgatgctggctgccggtggcgggctccacgccggccccgggacctaggcagccgcgcgagaccgctgcgggcgcctcccccatgctgctcggagcgtcctggctgtgcgcatccaaggcggccgccgctgctgcgcagagcgagggcgacgaggacaggccaggcgagcgacggcggcgtcgggcggcggccaccgccgcgggggcgggcgaggacatggacgagtcgtcgctgctggacctgctggagtgctccgtgtgtctggagcgcctggacaccacggccaaggtgctgccatgccaacacactttctgccgccgctgcctggagagcatcgtgtgctcgcgccacgagctgcgctgccccgagtgccgcatcctggtgggctgcggcgtggacgaactgcccgccaacatcttgctggtgcgactgctggacggcatccgtcagcggccccgcgcgggcaccagccccggcggcagcccgcccgcgcgtcccatcccaggccagagtgcggcccccacgctcgcgggcggcgggggcggcgcggcaggcagcaccccgggttccccggttttcctctccg

SEQ ID NO: 118045 - DNA, 44 bp, Homo sapiens; identical to SEQ ID NO: 84921
  misc_feature 1..44: note = chr2:110015320-110015364
  misc_feature 1..44: note = Hypo
  source 1..44: mol_type = genomic DNA

SEQ ID NO: 118046 - DNA, 114 bp, Homo sapiens; identical to SEQ ID NO: 84923
  misc_feature 1..114: note = chr2:110371704-110371818
  misc_feature 1..114: note = Hyper
  source 1..114: mol_type = genomic DNA

SEQ ID NO: 118047 - DNA, 30 bp, Homo sapiens; identical to SEQ ID NO: 84924
  misc_feature 1..30: note = chr2:110433828-110433858
  misc_feature 1..30: note = Hypo
  source 1..30: mol_type = genomic DNA

SEQ ID NO: 118048 - DNA, 67 bp, Homo sapiens; identical to SEQ ID NO: 84925
  misc_feature 1..67: note = chr2:110518226-110518293
  misc_feature 1..67: note = Hyper
  source 1..67: mol_type = genomic DNA

SEQ ID NO: 118049 - DNA, 54 bp, Homo sapiens; identical to SEQ ID NO: 84928
  misc_feature 1..54: note = chr2:111438469-111438523
  misc_feature 1..54: note = Hypo
  source 1..54: mol_type = genomic DNA

SEQ ID NO: 118050 - DNA, 193 bp, Homo sapiens; identical to SEQ ID NO: 84929
  misc_feature 1..193: note = chr2:111462929-111463122
  misc_feature 1..193: note = Hypo
  source 1..193: mol_type = genomic DNA

SEQ ID NO: 118051 - DNA, 30 bp, Homo sapiens; identical to SEQ ID NO: 84930
  misc_feature 1..30: note = chr2:111483271-111483301
  misc_feature 1..30: note = Hypo
  source 1..30: mol_type = genomic DNA

SEQ ID NO: 118052 - DNA, 373 bp, Homo sapiens; identical to SEQ ID NO: 84931
  misc_feature 1..373: note = chr2:111490316-111490689
  misc_feature 1..373: note = Hyper
  source 1..373: mol_type = genomic DNA

SEQ ID NO: 118053 - DNA, 101 bp, Homo sapiens; identical to SEQ ID NO: 84932
  misc_feature 1..101: note = chr2:111874886-111874987
  misc_feature 1..101: note = Hyper
  source 1..101: mol_type = genomic DNA

SEQ ID NO: 118054 - DNA, 39 bp, Homo sapiens; identical to SEQ ID NO: 84933
  misc_feature 1..39: note = chr2:111875378-111875417
  misc_feature 1..39: note = Hyper
  source 1..39: mol_type = genomic DNA

SEQ ID NO: 118055 - DNA, 263 bp, Homo sapiens
  misc_feature 1..263: note = chr2:111876698-111876961
  misc_feature 1..263: note = Hyper
  source 1..263: mol_type = genomic DNA
ggtccctgtctgagtcgcccgaccccgcggggagcgcggagcattgcggcgtgcggcgggcttcgggctctcagcccgcgcagcaagttgtgttgcttttccccgggtgcgacgcgggacggccgcgaagagcaaagttcgtccgcggtaggaacttcgaggcccggttaggaccgatctccggcctccgagtctacttagccgtgtccacgctcgtgccttttccctcttgcagcgaaataactgggcggggcccgacgcgc

SEQ ID NO: 118056 - DNA, 66 bp, Homo sapiens; identical to SEQ ID NO: 84934
  misc_feature 1..66: note = chr2:111898079-111898145
  misc_feature 1..66: note = Hypo
  source 1..66: mol_type = genomic DNA

SEQ ID NO: 118057 - DNA, 75 bp, Homo sapiens; identical to SEQ ID NO: 84935
  misc_feature 1..75: note = chr2:111912943-111913018
  misc_feature 1..75: note = Hypo
  source 1..75: mol_type = genomic DNA

SEQ ID NO: 118058 - DNA, 18 bp, Homo sapiens
  misc_feature 1..18: note = chr2:111928152-111928170
  misc_feature 1..18: note = Hypo
  source 1..18: mol_type = genomic DNA
atagtcccagctactcgg

SEQ ID NO: 118059 - DNA, 515 bp, Homo sapiens; identical to SEQ ID NO: 84937
  misc_feature 1..515: note = chr2:112656577-112657092
  misc_feature 1..515: note = Hyper
  source 1..515: mol_type = genomic DNA

SEQ ID NO: 118060 - DNA, 49 bp, Homo sapiens; identical to SEQ ID NO: 84939
  misc_feature 1..49: note = chr2:112779046-112779095
  misc_feature 1..49: note = Hypo
  source 1..49: mol_type = genomic DNA

SEQ ID NO: 118061 - DNA, 98 bp, Homo sapiens; identical to SEQ ID NO: 84940
  misc_feature 1..98: note = chr2:112896008-112896106
  misc_feature 1..98: note = Hyper
  source 1..98: mol_type = genomic DNA

SEQ ID NO: 118062 - DNA, 158 bp, Homo sapiens; identical to SEQ ID NO: 84941
  misc_feature 1..158: note = chr2:113013159-113013317
  misc_feature 1..158: note = Hypo
  source 1..158: mol_type = genomic DNA

SEQ ID NO: 118063 - DNA, 185 bp, Homo sapiens; identical to SEQ ID NO: 84942
  misc_feature 1..185: note = chr2:113103246-113103431
  misc_feature 1..185: note = Hypo
  source 1..185: mol_type = genomic DNA

SEQ ID NO: 118064 - DNA, 126 bp, Homo sapiens; identical to SEQ ID NO: 84944
  misc_feature 1..126: note = chr2:113190911-113191037
  misc_feature 1..126: note = Hyper
  source 1..126: mol_type = genomic DNA

SEQ ID NO: 118065 - DNA, 61 bp, Homo sapiens; identical to SEQ ID NO: 84945
  misc_feature 1..61: note = chr2:113195104-113195165
  misc_feature 1..61: note = Hypo
  source 1..61: mol_type = genomic DNA

SEQ ID NO: 118066 - DNA, 42 bp, Homo sapiens; identical to SEQ ID NO: 84946
  misc_feature 1..42: note = chr2:113341856-113341898
  misc_feature 1..42: note = Hyper
  source 1..42: mol_type = genomic DNA

SEQ ID NO: 118067 - DNA, 36 bp, Homo sapiens; identical to SEQ ID NO: 84947
  misc_feature 1..36: note = chr2:113494765-113494801
  misc_feature 1..36: note = Hypo
  source 1..36: mol_type = genomic DNA

SEQ ID NO: 118068 - DNA, 30 bp, Homo sapiens; identical to SEQ ID NO: 84948
  misc_feature 1..30: note = chr2:113555815-113555845
  misc_feature 1..30: note = Hypo
  source 1..30: mol_type = genomic DNA

SEQ ID NO: 118069 - DNA, 79 bp, Homo sapiens
  misc_feature 1..79: note = chr2:114034462-114034541
  misc_feature 1..79: note = Hyper
  source 1..79: mol_type = genomic DNA
gcttggcatgggcaccgggcactgcacattaggcctcagggatggtcctggcgatgtctggtatcgtaccacggtttgg

SEQ ID NO: 118070 - DNA, 611 bp, Homo sapiens
  misc_feature 1..611: note = chr2:114034802-114035413
  misc_feature 1..611: note = Hyper
  source 1..611: mol_type = genomic DNA
gctctagagagaacccgagtgagaaatcttccggcgccccagggggttcccgctcccctcctagttgggccatggccctgggactggagactgcgccgcagagcccgggcccccgcagtgcgcttggctaaatagagatctcagcctcgctgcgcgcccgatccgaccctccttattataacaaatgtcccgtttgcagagcgggacatcatattcgcggagaattcattctgaaatattgatttcctctcacttcgccggcccaaatcgatagcgatgcgccctggccccataaatcgccttctctgcggccggccgggctccatccatcactgcgggccgcgctgcgcctccaccgctgtccgcactcgctgcgcgccgggacggctgcgcccaccagccctgaccctggagctccttcccagcaaagaccctgcccagccctggccgggaagggggaaaacaggcatcgcggcctgggagctcgagtgtgtttgaaggccctgcttccgggcgcaggtggggagggggttttgactccgcgagcggcttagtcctcaccagccggacgccccgcgcgcggcgcccggcctgcccggtgctgggccagg

SEQ ID NO: 118071 - DNA, 260 bp, Homo sapiens; identical to SEQ ID NO: 84950
  misc_feature 1..260: note = chr2:114256928-114257188
  misc_feature 1..260: note = Hyper
  source 1..260: mol_type = genomic DNA

SEQ ID NO: 118072 - DNA, 36 bp, Homo sapiens; identical to SEQ ID NO: 84951
  misc_feature 1..36: note = chr2:114260005-114260041
  misc_feature 1..36: note = Hyper
  source 1..36: mol_type = genomic DNA

SEQ ID NO: 118073 - DNA, 745 bp, Homo sapiens; identical to SEQ ID NO: 84952
  misc_feature 1..745: note = chr2:114260750-114261495
  misc_feature 1..745: note = Hyper
  source 1..745: mol_type = genomic DNA

SEQ ID NO: 118074 - DNA, 81 bp, Homo sapiens; identical to SEQ ID NO: 84953
  misc_feature 1..81: note = chr2:114394608-114394689
  misc_feature 1..81: note = Hypo
  source 1..81: mol_type = genomic DNA

SEQ ID NO: 118075 - DNA, 17 bp, Homo sapiens
  misc_feature 1..17: note = chr2:114469902-114469919
  misc_feature 1..17: note = Hypo
  source 1..17: mol_type = genomic DNA
tttttttttttgagacg

SEQ ID NO: 118076 - DNA, 265 bp, Homo sapiens; identical to SEQ ID NO: 39640
  misc_feature 1..265: note = chr2:114515303-114515568
  misc_feature 1..265: note = Hypo
  source 1..265: mol_type = genomic DNA

SEQ ID NO: 118077 - DNA, 24 bp, Homo sapiens
  misc_feature 1..24: note = chr2:114515808-114515832
  misc_feature 1..24: note = Hypo
  source 1..24: mol_type = genomic DNA
gcgagactccgtctcaaaataaat

SEQ ID NO: 118078 - DNA, 26 bp, Homo sapiens
  misc_feature 1..26: note = chr2:114634729-114634755
  misc_feature 1..26: note = Hypo
  source 1..26: mol_type = genomic DNA
tttttttttttgagacggagtctcgc

SEQ ID NO: 118079 - DNA, 85 bp, Homo sapiens; identical to SEQ ID NO: 84958
  misc_feature 1..85: note = chr2:114634995-114635080
  misc_feature 1..85: note = Hypo
  source 1..85: mol_type = genomic DNA

SEQ ID NO: 118080 - DNA, 30 bp, Homo sapiens; identical to SEQ ID NO: 84959
  misc_feature 1..30: note = chr2:114737714-114737744
  misc_feature 1..30: note = Hypo
  source 1..30: mol_type = genomic DNA

SEQ ID NO: 118081 - DNA, 176 bp, Homo sapiens; identical to SEQ ID NO: 84961
  misc_feature 1..176: note = chr2:114869802-114869978
  misc_feature 1..176: note = Hypo
  source 1..176: mol_type = genomic DNA

SEQ ID NO: 118082 - DNA, 30 bp, Homo sapiens; identical to SEQ ID NO: 84963
  misc_feature 1..30: note = chr2:115099730-115099760
  misc_feature 1..30: note = Hypo
  source 1..30: mol_type = genomic DNA

SEQ ID NO: 118083 - DNA, 150 bp, Homo sapiens; identical to SEQ ID NO: 84964
  misc_feature 1..150: note = chr2:115141250-115141400
  misc_feature 1..150: note = Hypo
  source 1..150: mol_type = genomic DNA

SEQ ID NO: 118084 - DNA, 30 bp, Homo sapiens; identical to SEQ ID NO: 84965
  misc_feature 1..30: note = chr2:115159137-115159167
  misc_feature 1..30: note = Hypo
  source 1..30: mol_type = genomic DNA

SEQ ID NO: 118085 - DNA, 2037 bp, Homo sapiens
  misc_feature 1..2037: note = chr2:115918661-115920698
  misc_feature 1..2037: note = Hyper
  source 1..2037: mol_type = genomic DNA
cttatggtttttaaccgacctttaggagttccaccgacgtgacccaagcagctggtaggagaatctgggctggattcggaaggcgcagctacaggacgcccgctgccccggatcggaaggcgcagcacctcaggccacaatctcagacacgccctcgggtcccgacaggtgttgcccgcctcccacggggctccgggaccccggtccccgggctgccccctgccttctggggcgctggagcgcgcgcagtggcggagctggagccacccagtgcttcgcacgggcgcgctccgcttctccgggttttagcggaagcctgcggggggcggggtaaccgcggaagccggcggccgtgggcgcgcgggttgggggctctcgcgccgctccgggctctccccccccccggctgcggttgccgaagagaggccggagcgcggcgcccggctgctccacctggcgcgctgagcaccgcgcggggagcccccgggggcgggcggtggggggcgcggactgcgggaagaaggcacgaggcgtcgccgcagctcggtcaggggccggggccccgccgctcgccgctgcactaacttgccgcttggtctcgcctcgccgccgcggctcgctgcgctttgggtggcggggggcggggagagcggggagtcagagggtctgcggtggccgagggagggaccctacgacggggagcccgcccggtgccgctcttcttcccctccccgcccctccgctccccccaccccgtcccttccgccgattccgggagcgacgggcgcccgtgacctgcgaacgctgccaagtgacggtccccgagtctgaagcgcccgcgaggaagcgagcgccagcgcgggccgccggcgatgacggccgcgaagcaggagccgcagcccaccccgggggccagggcgagccaggcgcagccggcggaccaggtgagagtcggcagccgcggccaggccctcccgggaggggtggctccagtgcgcgctccgcccgcctcccgcttcccaggctgggctcccgcgcctccctcttctcaccctcccccgccccgccccagttccaggctctcctgcttctccacggactctgcgggaagttagagcctctgcgtgcgctccggggcccggcgagaggatgcgcaaggtggagagccgcggggaagggggcagagaggtaaaggctgaaggtgccccggggaaccccggcgggcggcccaccgagggagggagaggcggccgggaccaaggaatggggcctcttggttccccattaacgcacgctgaagaaatctgctgcgctcctgacggccgctcaccgggttcgagccccgtcctcctatagccggggcgctcgctggccaaagcgacccgagcaggcgaatgacctttaggcggacggggttttccctctgctttcttgtttcttttgaggagacgggtgtgtgtttgtgaggtggggatgggggaagagtgtcccagacatccgtagtctgctgagcggaacggagcttggggagcggcgaggcattaacgattaagtggagccgggaaggcgctggctttggtgatgtgttgggtttggatgtgtcgcgtctgcacagatgaggtgccctgcgtgggctgagggttattcctgtctctttcccgtccgtctacacccgccaacccctttttgttttggtctttagaaatctgtagcataaccgtaccgtcgtggatccccatctcgtctctgtccctgatctggggtgattgggacttcggtgtcgctctttttccaaagttggagggtcgggagcgccgagacaccctggcgaggaggaggaggaggaggagggaggctgcgctgagccgggtgcaggtgcgctcacgtttgcatcaattaggaactccgggcagagagagctgcacttaggtcagggattaactgtggacccgcgggacccaagcgctggggtaggaggactggggatctttgttcggagtgcgctgcgaaggctgctggaggcggacaccctcccag

SEQ ID NO: 118086 - DNA, 36 bp, Homo sapiens; identical to SEQ ID NO: 84975
  misc_feature 1..36: note = chr2:116723692-116723728
  misc_feature 1..36: note = Hypo
  source 1..36: mol_type = genomic DNA

SEQ ID NO: 118087 - DNA, 17 bp, Homo sapiens
  misc_feature 1..17: note = chr2:117052188-117052205
  misc_feature 1..17: note = Hypo
  source 1..17: mol_type = genomic DNA
aacgcactgccatttct

SEQ ID NO: 118088 - DNA, 37 bp, Homo sapiens; identical to SEQ ID NO: 39642
  misc_feature 1..37: note = chr2:118628528-118628565
  misc_feature 1..37: note = Hypo
  source 1..37: mol_type = genomic DNA

SEQ ID NO: 118089 - DNA, 1430 bp, Homo sapiens
  misc_feature 1..1430: note = chr2:118981092-118982522
  misc_feature 1..1430: note = Hyper
  source 1..1430: mol_type = genomic DNA
aacccagggcagcagcgaatcccacgccccacgctccctcttcccaaacctcaatatcgttgcttaaaatcttccgggcttattgtgaagccaagggcgcttggcatgggaagagagccgctcgtgatttatttgggagagggatggggttttggaaaggaaattggggggtttacaaggaggacgggtgggttttactcaacaacttattcttgggcgttttcgtggactggagaggagtttcgatcccgtctcgggctcacctgggaagccccctcctggcgcccgctttgtttggcgttcctttaaagcccggtgttggcagagcgacccacaatgaaacaaattctcattttatgacgtctttccccccgtaggagtccgaacaatgtctgggggcttggcacgcatgaagataaaagaattttattttaaatgcgatacatgtcaggattagacagcgtttcctttcagctaaactacagagcgaatcttcatttcctgtttcactgcttcccccgaaagaaacttttctttttctttttctttttctttttttttcttttctttctctcccccagcagagagtccgagagaaaagtgctgggcacagagctccccacgaggtccccggaaagcagacttagctcctgatcgttgtcaatctttgggcaacccggggcctcgcaacggctcgggtttagtgtgatctggggaggctgcagcccagttccggctaccgtgggcgcctgagcagagccggggcgagttgtaaacctcagagaaaggcacttgtccccagcaaaacgcttggagaggaccgtgcacgctgtgctgcccccgccccgagacgcgccgggccgccgggtcaccggttttccgaaagggacccggcagagacaaagtgccttcgccgctgcgataggttggttttactttgcaataaacagcccctaatgggaccgggcgccgggcggagagctcggcccggggcgcggcctttgccgcctggctctgcgggccgccccgccgggcgccaggttttggggggtggcccggccccgcgtccgccactgcaggccgctctcctccttcccgcgcacacagcggagaaaaaaggacgcaaacagcattttacacttttcccactttagcgggaatcggaggagccgggcgagaaagcccgaaaagggaggcggttatttacgaccggcgggttggagtctggcaccagatggtgggggtctgtcaggcccggccgccccgcccagcgccccgcaaacagcgcccggttggcagcgtcgcctgagcagcccccatcttcgcttccagcccctcccgtatattttctcccgtccaagtcgatcaaagacggactttaaaaattactcgcaattagacccaaaaaagtcattcgtgatctttgggta

SEQ ID NO: 118090 - DNA, 505 bp, Homo sapiens; identical to SEQ ID NO: 84986
  misc_feature 1..505: note = chr2:119067621-119068126
  misc_feature 1..505: note = Hyper
  source 1..505: mol_type = genomic DNA

SEQ ID NO: 118091 - DNA, 331 bp, Homo sapiens; identical to SEQ ID NO: 84987
  misc_feature 1..331: note = chr2:119531997-119532328
  misc_feature 1..331: note = Hyper
  source 1..331: mol_type = genomic DNA

SEQ ID NO: 118092 - DNA, 242 bp, Homo sapiens; identical to SEQ ID NO: 84988
  misc_feature 1..242: note = chr2:119566157-119566399
  misc_feature 1..242: note = Hyper
  source 1..242: mol_type = genomic DNA

SEQ ID NO: 118093 - DNA, 1075 bp, Homo sapiens
  misc_feature 1..1075: note = chr2:119590605-119591680
  misc_feature 1..1075: note = Hyper
  source 1..1075: mol_type = genomic DNA
caccctttctaggggcgtgttgcctgctcttaggggctgtatttggcagacatgcaaatataaaacagcctcaccaaagtgcttactatggacacagcctcttggccaagcacggaaaaggttacaggggctggtgtaaggttggatgggaacgtgaatgagatccaggatatggtacatggggctcctggctctccctgtgtaatgtgccccaagttcccctggattccactgaaaatagggagtggaagggtgggtttggagtgaggataaccaggatcgtcacactcacataagcacagaacctcagggatcttcagggctgacaccctgaacgcccaccactttccctagcccccagtgtctcagctctccaggcggggcctctgaggctagaccgctgtctcgcccagggatgctcgcggactgcggcactagcgaacgcgcaattcccttccccagggaagccacgcaggggctttccccgacggcgtctcacagccaagtgagcttgtgaacacggagacggccgaggatccgagacaaggagctcgctcgctcggtttttcccgggctgtgtttgccattcgcgggaataaatgaagcatcggtaatctccataaaagagctttcacgcttcattctctgaaactaagttgaggcttagacggaaaggagaaaagagacttttaatttaaagtaatgatcatcaacactcaggtgctagagggtctctggggaaagggggtccctaccccacccggggtagcgggagggaggccgcctctctgcgcctagccgggcgggccttgacttgctaggattggtgggccaaatcccatctccggggagccttcaaataactctcccatggggaactgaggaggcgcgggagcctagggcggaaaaagctgaagagccgtggtcccggagaaaaggaagtgagcagtctcaatggaggcccgagcctctccaaggccaccctgcaggcagcagcgacttcttcctggggcaaaagtcgcgcactacctgcgggaacgtccgctgccagggcgccgcccgggaccccagagca

SEQ ID NO: 118094 - DNA, 98 bp, Homo sapiens
  misc_feature 1..98: note = chr2:119592208-119592306
  misc_feature 1..98: note = Hyper
  source 1..98: mol_type = genomic DNA
cagtccctgccaggccgcggcctcctcgcccccgcctgcccggcctcacccttctggaagttcctccaggcctgggtgggggccgccagggaaggcgc

SEQ ID NO: 118095 - DNA, 1216 bp, Homo sapiens
  misc_feature 1..1216: note = chr2:119592747-119593963
  misc_feature 1..1216: note = Hyper
  source 1..1216: mol_type = genomic DNA
caagagcgcgcgcctcgtgtaaccattcaggaccagttgaagcaacacaaataaagtcaggtctcttcagccttgctgtccacccctccccctcttcctggtttgaccctggcctggccgctctgaggcccagtttgcgcagccgacattgcgtggctactctcattaccaggggaagggcgctccccttttccctggtaatactccgggagcccctactcggaagcccaagagtcaaagggatacaggggtgactggagagcagcgggggacagcgtggcctcacccaaggtcagcgctggtccccacgtgtcggccgggggaggggaggggagcggacagtcggagcgttcggatgtccagttgagccgcggcgcggggcagccgggggcgcaaagttggaggcagggctgggcgacgaggagagagggagggccgggagccgaagggacgcccgggtgcaccccgctgcagaggccgagtccgagcggccggagaaggctggtcgcagaagggcggcctccggtgcaaaaaacggaaaccttggagcagaggatgaggaggaatacggaggcggggagcccacagaaaaagatgttgaggaaagaagaggagaccccggcctaaacaaatcgaaactgtgcaatgaacgtggcccgggagaaccgggggtgaggggcgatggctggagctgcggcccaagcacagctttcagacgcttgcccggaccctggcgcggggaggcggccgggactgcctttctgcgcgcgtccctggagagcgggtgggcaggacctgcgccccgcggtgggcaagaagatttggggtttcgcagttcctggggtcgggggcgggggtgaagtgccctcagagacctcggcggagccccagttgcgctcccatctccagcccccactggagagagggggtccagggccgtaccctcctgcggcctgggctgcgctgaccggaagtgcctgtaagaagcgccctccgcggaccgtgccgggcgcgggcagctccagccgggttggagcaaggccaagacgcccggatggggcgggccgtttcggcggacccagtctggacgcaggtgcgggaggaaagtgtgaggggggaaactgctgattgtgcggggataggggcatcttaatctgggaaaagatcggaatctcttgggacgctaatctgagacccgggtcggaggtgtagagta

SEQ ID NO: 118096 - DNA, 30 bp, Homo sapiens; identical to SEQ ID NO: 27443
  misc_feature 1..30: note = chr2:119594194-119594224
  misc_feature 1..30: note = Hyper
  source 1..30: mol_type = genomic DNA

SEQ ID NO: 118097 - DNA, 30 bp, Homo sapiens; identical to SEQ ID NO: 27444
  misc_feature 1..30: note = chr2:119594750-119594780
  misc_feature 1..30: note = Hyper
  source 1..30: mol_type = genomic DNA

SEQ ID NO: 118098 - DNA, 1015 bp, Homo sapiens; identical to SEQ ID NO: 84995
  misc_feature 1..1015: note = chr2:119599849-119600864
  misc_feature 1..1015: note = Hyper
  source 1..1015: mol_type = genomic DNA

SEQ ID NO: 118099 - DNA, 954 bp, Homo sapiens
  misc_feature 1..954: note = chr2:119602464-119603418
  misc_feature 1..954: note = Hyper
  source 1..954: mol_type = genomic DNA
actggggttttgattcgtaattagctgagcggggagaaatagcccaagaaatgcacacagccccaaaaaggccccactgcccgttctgcatccgggacatgttgaagtgttgttgtatgtgtgtgcagaggcacggactcttgtaataaaatcgttcctagtctcccggccagcccgagccgtgcagcctgacagctcaatcactctatccatcaggcgagtcaatcaaagcagcttttcggaggttcagggagcccgacgtgtcaataacggggctcgagatggcgggagctgatagtgcgcatcgatccgcgcccggccggcagctgtggggcggcgagagaccagccagaggaaagcggcgcgtggctacgttgttcccggccccctgccggaccgggtgtctggagtgctgatcttgggccaaagcttctgccgctctcccagacactgcgggccggggcgtcaggcaggccttggccttctctcccggagcccagctcaggtctcctcctcgggttcgccaagcgcgaggggcacacggaaaagtggtggaaggaaagccgagaaaaacaggcctacggatgccagaagtctgctggatgtgcgggtgaaaaaaggaaagcgccgcgcggggaggatgcgggaaccgttccgcggagaagctacggaggaaactggctctcatgcccttggacacgcttcctggcctgagcctgacctgttttctctcctctcccactgtttttcagctccagaaaaccaggggctgccagcacccacctttttggcaactgcctttccctggtttctacccacccgggtcagactcttttcgctacccagccgggggagagggacggctttcagacgctttcctccctgtcttcctgtgtttcccatgtttatcaatgtaaacggtctctccgcagaaaatatcgagatggtgtttgt

SEQ ID NO: 118100 - DNA, 459 bp, Homo sapiens; identical to SEQ ID NO: 84998
  misc_feature 1..459: note = chr2:119603634-119604093
  misc_feature 1..459: note = Hyper
  source 1..459: mol_type = genomic DNA

SEQ ID NO: 118101 - DNA, 698 bp, Homo sapiens
  misc_feature 1..698: note = chr2:119604153-119604851
  misc_feature 1..698: note = Hyper
  source 1..698: mol_type = genomic DNA
ttcccagctttagacgcgcccgcgccggcggcggctggctgggagccgtcgggtgggccacagttcgcgtccggggcgcacaggagcgaggcagcgcctggcgcccgggtgcccaacgggtggacagggtctctacctgcggcagtctggcctctgtcacgctcgacccggcctcctcctcctgcgcctcctctggccgccgcagccaccagaagctgcggtggcggctgctcctttttgcagccgaagtccggcctcaggatgttgtcgatgaaaaagttggtggtgcggtgcagctgggccgctggctgcggctggtgagcaggcgccgcgagatgctgaggcggcgggggcggggggtgtggggggaggtgcgggtggtgggccaggggcggcaggcaaggcgccgcgggcggcgaggggggcgcaggctgcggggacaccggcacgctgtctccatcgctgccgctgccgctgctgccgctggcgcccggactgaggctcaggctgaggccgcccggagtcgccgccgccgccgcgccgagggccgagtcgcgctgacttttaggttccggctgctgttcttccatgctcggccgccccgccgccccggccgccgcgccggcccccgcccccaccgcctcgctccccaccccactttgccagcggcccgtgggggtgcgcggaggaaggaggca

SEQ ID NO: 118102 - DNA, 28 bp, Homo sapiens
  misc_feature 1..28: note = chr2:119605271-119605299
  misc_feature 1..28: note = Hyper
  source 1..28: mol_type = genomic DNA
gggagagcgcgtctccgccagcgccggg

SEQ ID NO: 118103 - DNA, 27 bp, Homo sapiens
  misc_feature 1..27: note = chr2:119605359-119605386
  misc_feature 1..27: note = Hyper
  source 1..27: mol_type = genomic DNA
cacaaactctctcgcttaaaaaaaaaa

SEQ ID NO: 118104 - DNA, 30 bp, Homo sapiens; identical to SEQ ID NO: 27453
  misc_feature 1..30: note = chr2:119605745-119605775
  misc_feature 1..30: note = Hyper
  source 1..30: mol_type = genomic DNA

SEQ ID NO: 118105 - DNA, 55 bp, Homo sapiens; identical to SEQ ID NO: 85004
  misc_feature 1..55: note = chr2:119606135-119606190
  misc_feature 1..55: note = Hyper
  source 1..55: mol_type = genomic DNA

SEQ ID NO: 118106 - DNA, 1157 bp, Homo sapiens
  misc_feature 1..1157: note = chr2:119606705-119607862
  misc_feature 1..1157: note = Hyper
  source 1..1157: mol_type = genomic DNA
tggaggaccagtatccgactatgctgaagcctgcggtggccgagaaaggcgtcagcaaacgaggccttcgggggtgtcatcttagagctccagcggacctcctcgccctgaacgccctccgcaactgggacagtagagaaaggatccctttggaaatattgtctatttgtgacatgcgaaagaatccccctacctccagttttccagaaaagtcacagagggttaggctaggaggaacatgcaactaaacccacaacaagccgaaccaccaccacagtagctgaagtttctcaaaagggctggtggagagcaggaatttatattgctcaccgcatcttgggagcaggcgagggtcccccgatttccggggctgagttcccggctagacttgcgctgcagcctaggggagaaaacctctctccctaacgctgcgctgcagtcttctctaccttcccaagccgcctccaaccccaccttggagtctcccgagtcctcttcagtagcacacccaagggctccccgaaatctccaggcgcccccaccccttctccccgaaatgggggtgggattttatttatatttaagttcgcaaaattgaaatctttatcccgcaagcaagcgtgggtacttaattaaattctaattaggacactatcaatatcctatttagctgcgtagcttttgtgcgccgcggtccctttcagcgcggtaaatagggtctcgacgccttatctcgcctgcaggagacgcctcgagaagggctgcggaagataatttataggttttaattactcttcattccgcctgatcagcttggcgttcatcacaggcctgtgaataaaaccctggtcaaaagctctgtcacatcgcgctggcaagacgcttaatcaaagtgagcggccccgcgcgccgcgcggcccggctcctccacgtaatttccagccagctgataaagccagctgaataatacggcggccctttggagacaccatttacagaaatgactttattgacggcttaacgtcggtaattcattttacctttcatgtagtggagcccggatttgttacagtaatgggatgataaatgcacccgcggcccacgagctcgagctggattaggcggcactctgcgcgctggctcgtccccccacctcc

SEQ ID NO: 118107 - DNA, 30 bp, Homo sapiens; identical to SEQ ID NO: 85008
  misc_feature 1..30: note = chr2:119608197-119608227
  misc_feature 1..30: note = Hyper
  source 1..30: mol_type = genomic DNA

SEQ ID NO: 118108 - DNA, 383 bp, Homo sapiens
  misc_feature 1..383: note = chr2:119610236-119610619
  misc_feature 1..383: note = Hyper
  source 1..383: mol_type = genomic DNA
ctcctcttgactccccgcgggaaacggtggaaagatatcaatgatttctgtacattgcacccggtggccaggattcagaaagcgctcctggggccctggtttcctctctgagccccgccggctgtccacaggcccgcgccgggcgcagagggcgccagggtgcaaacacccgaactgtcgccgctcgcgggtttgcaggcggccttcgggctgcgcggggatgtccgggagcccgacgcagggccccttggctcggattacgggaagaggagccttcactggcccccctcggaatttcaaacctcgctgggactgtatcacacagccagacaggcctctggagctgagaattttagacttcgctgctccgggaagcaagagga

SEQ ID NO: 118109 - DNA, 125 bp, Homo sapiens
  misc_feature 1..125: note = chr2:119610844-119610969
  misc_feature 1..125: note = Hyper
  source 1..125: mol_type = genomic DNA
ccccaaaaaattccccgaggtcggtgttctcaggcctaggggaccctctcccacccctggtccccacctgtccgagtggccgctctcgcctggatccggcttggcgcgttcggtgtccacacaga

SEQ ID NO: 118110 - DNA, 543 bp, Homo sapiens
  misc_feature 1..543: note = chr2:119611281-119611824
  misc_feature 1..543: note = Hyper
  source 1..543: mol_type = genomic DNA
aaggagacaaaagttcgcgcacctggctctcggcgcctaggttttctgcctctgccggccccggagcccgatccaggccgcgcctccctgttgcccaaggggcgtgcatctttgggaccctcttcccggggaggtgcaagaaaagctccgggttccagcagaggtcggcgctgcagggcccaggcgggaagatgtggaaggaaaaagtttagtacagaaggtggggcggtaagggaacggaaagtctcaagagcctgggagcgggggagaggggcgagaacccgtctgtctcccccaccccgcccacctccttcctcgtattgaatcggatgcggggggcgggagggggtcactgcaatgccaaggccttctcgggccatcttccctgttcccctgctccagcagaaagctgggaggggaacgagtgtgtagccccgcgcgtgcgtgtttgttcgtgactcagaggctctgggtgggtgcgtgagtgagtccaagtgtgtgcccgagtgtgcacgcaaaaattgcgttcgttttgtctctcta

SEQ ID NO: 118111 - DNA, 30 bp, Homo sapiens; identical to SEQ ID NO: 85013
  misc_feature 1..30: note = chr2:119612029-119612059
  misc_feature 1..30: note = Hyper
  source 1..30: mol_type = genomic DNA

SEQ ID NO: 118112 - DNA, 30 bp, Homo sapiens; identical to SEQ ID NO: 85014
  misc_feature 1..30: note = chr2:119612324-119612354
  misc_feature 1..30: note = Hyper
  source 1..30: mol_type = genomic DNA

SEQ ID NO: 118113 - DNA, 122 bp, Homo sapiens; identical to SEQ ID NO: 85015
  misc_feature 1..122: note = chr2:119612692-119612814
  misc_feature 1..122: note = Hyper
  source 1..122: mol_type = genomic DNA

SEQ ID NO: 118114 - DNA, 875 bp, Homo sapiens; identical to SEQ ID NO: 85016
  misc_feature 1..875: note = chr2:119613016-119613891
  misc_feature 1..875: note = Hyper
  source 1..875: mol_type = genomic DNA

SEQ ID NO: 118115 - DNA, 71 bp, Homo sapiens; identical to SEQ ID NO: 85017
  misc_feature 1..71: note = chr2:119614130-119614201
  misc_feature 1..71: note = Hyper
  source 1..71: mol_type = genomic DNA

SEQ ID NO: 118116 - DNA, 1076 bp, Homo sapiens
  misc_feature 1..1076: note = chr2:119614551-119615627
  misc_feature 1..1076: note = Hyper
  source 1..1076: mol_type = genomic DNA
gctctgggctccaagcgtggggacggcagcccccaagcttggcgcacccctcgggaagccccggaacggtcctcgccagacatagccggctgtcctggtccttagcttcaggctggcggcgcaaggccagagcggctgccttctaggcacctgggtggaggtctcgcatagcattccctgagaagcgaaactgcccttggggccgcagcgagcctgccacatcgaactggagaccctctgctttcgggatagatgggacgtttctgctctgtccttcttggagtcccggaatcgttctggggccgcgtgctgcctggaggcggtgaatttcagggtcttgagaagccgcgcacacacgggattctgggcgagcgtcccgtctcttaattcctattaagagacgggaaaatcgagggactggaggtcccatcattgtcgcgtgagcagcctcctgaacaccaagcgagacctgagggttccgctggggcctcgccctgacacccgggccctccgtgtggtcgagagtttgcgcccgctcccgctagggcagcgaggtcccacttgcggccggctggggcatggtggcaccggttgtctactccccacttgtgacaccgacagcttccaactcctcagacccaccccgtggaattctggactttgtgagggccgccggggtcctggccctggggtcagctgccatctgactaagccaggacggcggagctccaggccttgctccagcactgccggtgcgtcggggcccgcggagagcccagggcgggagctgtgggctgagccgggtggccgcgtggacacagatgcccggccggactgagcggcagccaagactctccgtccatcccgccgctggactcgactctcccagacccgccacggaacccagatttgagcacgcaagataaagacgccagaggcgagtgcgcggcggagaactggccgcgacacgggaagcttctggggcgcagaacgctggctccgactcgcgcggcgcagaccagcttctgtggttgcactcaattgaacaacaggcggatttacgttaaactttgttt

SEQ ID NO: 118117 - DNA, 1318 bp, Homo sapiens
  misc_feature 1..1318: note = chr2:119615975-119617293
  misc_feature 1..1318: note = Hyper
  source 1..1318: mol_type = genomic DNA
catgcccataccaagcgggaaacgaagcaccgaatatttccccagctcgtaggaagccagatgggggccagttccctcaggagacgctccaagtcgccctgcgggctccaggtggggacaggagttataaccttccctgcccttccccctgcaacacacgcgaggtctcagcgctcccaggcgctccagtggggccgcgttccccgccagggtgggtcaggggaatactctgcctgcgccctctccgagggtccgcgcagagcgagcgcctctttaggtggggcctctggctccgacccctgctcccaacagggatcttcgtttgcatcacccagaggagctggccagagagccgcgccggaggccgcatctccccttgttggtattgttgtcggcttgctttcttctggcttcccagctcagtgaccccggaaagggtcgagcatccgactccggcatgctggttggctgcccccggaggcggaggtagggggccagaaatgctgacctgggcaggcccccagccctgagctcctggggtggacatctcagggtcccgggcctccaagctcatggccggtctccgcggcggcggggtgacccaccaagggcaagactttttcagacttgcctatggtcaccaggcaatgactccgactggtacgtgagggagctcgggtcccaccttgaggacaaggcccagccttccccggagccgcacctcaactgtcagggtgcaagtggtggtgatccgggagcagtcgaggcccgtgacaaaaccaggatgacccagcgttttctaaccgcgctgaggcagtcgcctctccgggtcgctccactcccggactccggcagcctgttggccttcctgtcaccacctcgcatggagcaccctgccctaagccctggaactgggcccctggctcgcaaggaagagggtgggggtggggtagggaggaaaggccgggaagcctgctagagagaaggaggtgactgagggccagcatcgccaggaggcatagttccactagtccccagtcccatggttccaccttgaccccagttcacctgcagggcggcagggaactcctctgattcccgaacctgcagctggtgctgcactggaggggtttccgttggtccaacgcaccccggtgaagggaattccctggagaagagagaggaggtgccagaacctggctgtaaggggggtgcaggtgtgcagagagaagcgggttgtcccgggctgtgggtcctgcagcgcagcacctgagacttcagtttccttccttttccttactcccgtagtcttccggga

SEQ ID NO: 118118 - DNA, 308 bp, Homo sapiens; identical to SEQ ID NO: 85021
  misc_feature 1..308: note = chr2:119769161-119769469
  misc_feature 1..308: note = Hyper
  source 1..308: mol_type = genomic DNA

SEQ ID NO: 118119 - DNA, 40 bp, Homo sapiens; identical to SEQ ID NO: 27467
  misc_feature 1..40: note = chr2:119914013-119914053
  misc_feature 1..40: note = Hyper
  source 1..40: mol_type = genomic DNA

SEQ ID NO: 118120 - DNA, 2541 bp, Homo sapiens
  misc_feature 1..2541: note = chr2:119914280-119916821
  misc_feature 1..2541: note = Hyper
  source 1..2541: mol_type = genomic DNA
ggaagtgttatgaatcgagagtggcctttgccaaggagccgcgcccgggcggagaccgggcggcctgcagccaccccgcctcgcaccccccgcgcccctaatccgggtacagaagaaagcccgagaacgtgctgtacttgttattattgcctccgtgagccttcccgccatccagcttcacatacacttcgtcccctgaatccaagtgcagcaccacgctgttactggcgtagtcgtagttctggtcggcgtcctgtgcaatggcgctggcccggacctggggacaagcggtgggagcaggtgagccggggcacctcttcccgcgcctttgctcagcccacaccaggcgcgccactcacgggcctcccgcctgctgcttcagggtccacactcccaccccagctccatgttctctctccaacttagtcaactccttccaggtcccccctcctcctcgcgccgacgagtctgggaaatagggagaggggaagcttcatgaacactgacccagagtggaagggtgggagccaggggccagggccaagaggaaaggaggctgcagggcaagggggcgacctggagagaactaaagaactgaggtttccgagaagcccacggagaggcaggcagggacgcaagtggccaaggagtgtagtttaggtatgggggtctctgggctctcaaggcccaacatttggctctacgtcccggtgagcgcggcctcggcgcatcgggaagcggagatactgtggcaccgaggcgcgttcattcccggggctcgcagggtagcccgcgggtggagagaaaggaggctggttccctgggaggttcagggcgcgggcgagggtttacgggggccggtgagtgtaggggtcactgacctgcccgttcttgcagaggtccgcccacatgctggtgccgtcgccgccgcgcatgaggatgtggtaggtgaagaagtagatgccgcgtacctggcagctgaacttgcccgtggtggggtcatagtgattgccgaggttggtgaccacgtcatcgaacttcagcacctcatagccttcgtgggggctcttgagacccacatagaaggcgatcttggggccgctgaaggtggcgctcagcgcactggtcacttcaccctcggaatcgccacctaccccggccccgccgcccaccaccccgacgccgctggccgtgcccgccgtcagttgcagccctggcagcccgggccgccccgagtcgcccttctctcccggagggcccctgggtccaggcgggcccggctctccagggggcccccgcggccctggcttgcccggtcgccccgggtcgcccttgggtccctggatgaaaggaggaggagggttggcgctgaggtcctgcatgacttccagggcggcggtgctgggtccgggtggctgcgcctttgcacccgggggctccccgccgggcgcggcagtgtaagggtcgcagatcatgcggcaggtgcccatcatctcatagtgcgcggcgcctcggggcgccgcctgcagcagcagcggcacggcgatgagcagcccgagcgccatggccaagagtacgccgacggccgccaggcaggcacgccgccgccgctgccacagccgggaggcgaccgccaccagctcctccttgccgcccggggaggtaatggtggggcggcgcgggcggccccgctccccgcgctcggggaccggctccgcgggtcctggccgcgcccccgacgtggcgacccccagccccggctacccaactacttcagcgagaggcgccgggacctctgagcctgggcccaccgcgctggggctggtcgggagagccgcggacgcccgcgcgcatgacgtggggcacacaagacgaatccggcgccccgagggtccggcgccggccagggagtgcttgcgctggccggggagtctgcttgcggcgtccggcgctggctccgcggcgctgcctcccgccaggctccgctccgctgggtttagtggggctcctagcgcagtgagggcgccccggctccgcggcgcgctctgctgtgctctctcgctgttcgctggctcccgcgcggaggggggaccccgctaccctgacgtaaggagtccggggctgagcggcggaggcggcgaagcagcgcgcgctgccatcactcgggagacggagccctcatgtcatcagcctcctatctggcggcgtcctcggcagaggcggtgaaggcgcggttccccctggcggctcccaggagccacaagtgggcgcagcgggcgcggtcccaagccggggcacatcggacacacccacccgcggccacactcacgcgccccccaccgataacacacacagacacccacgcacgcagtggcggggcacgcacagccacccccacatggccacgaaagcagctggaatccaggtgtcagcagggctcctctggggtcacctaatccatcccctggcctgcaaagaggatcaaacctcaacccaccgagtccaggagagtcccgtgaggtccagcgggaaggagtttct

SEQ ID NO: 118121 - DNA, 50 bp, Homo sapiens; identical to SEQ ID NO: 85027
  misc_feature 1..50: note = chr2:119997993-119998043
  misc_feature 1..50: note = Hypo
  source 1..50: mol_type = genomic DNA

SEQ ID NO: 118122 - DNA, 30 bp, Homo sapiens; identical to SEQ ID NO: 85028
  misc_feature 1..30: note = chr2:120000595-120000625
  misc_feature 1..30: note = Hypo
  source 1..30: mol_type = genomic DNA

SEQ ID NO: 118123 - DNA, 404 bp, Homo sapiens; identical to SEQ ID NO: 85029
  misc_feature 1..404: note = chr2:120005365-120005769
  misc_feature 1..404: note = Hypo
  source 1..404: mol_type = genomic DNA

SEQ ID NO: 118124 - DNA, 30 bp, Homo sapiens; identical to SEQ ID NO: 85030
  misc_feature 1..30: note = chr2:120160587-120160617
  misc_feature 1..30: note = Hypo
  source 1..30: mol_type = genomic DNA

SEQ ID NO: 118125 - DNA, 337 bp, Homo sapiens; identical to SEQ ID NO: 27471
  misc_feature 1..337: note = chr2:120190015-120190352
  misc_feature 1..337: note = Hyper
  source 1..337: mol_type = genomic DNA

SEQ ID NO: 118126 - DNA, 478 bp, Homo sapiens
  misc_feature 1..478: note = chr2:120281646-120282124
  misc_feature 1..478: note = Hyper
  source 1..478: mol_type = genomic DNA
cacctgcatcctgcccgaggccggagaaagggcgagactgtcgctccctcgggtccccagcctgcagaagggcgcagtactcaccgagtgcgcggcgcaggcgagcagcaccggcagtagtagctgctgcagcggcggcgacaggtggggacgcatggtgcccgcacgttccccgagggcgccccgacgtccgcctgcccgtgccctctgcccgctcgggagctcagcgccccgcgcagggtcccgggctccggccggccgctgcgccccgaggagccatggctgagccacccgacctgcggcgggccccgggactgctcctcctcggaccaggtggccgcgcgcgctaagccgcccgccccattgatcaggacgcggctttgccggcgcgcctcctccacccggcagggactggcgcggggtcggcgcggaggctggcaggggaggaggcagagggagggcgcggggacccggagtc

SEQ ID NO: 118127 - DNA, 30 bp, Homo sapiens; identical to SEQ ID NO: 39644
  misc_feature 1..30: note = chr2:120441329-120441359
  misc_feature 1..30: note = Hypo
  source 1..30: mol_type = genomic DNA

SEQ ID NO: 118128 - DNA, 30 bp, Homo sapiens; identical to SEQ ID NO: 85038
  misc_feature 1..30: note = chr2:120748913-120748943
  misc_feature 1..30: note = Hypo
  source 1..30: mol_type = genomic DNA

SEQ ID NO: 118129 - DNA, 20 bp, Homo sapiens
  misc_feature 1..20: note = chr2:120769511-120769531
  misc_feature 1..20: note = Hypo
  source 1..20: mol_type = genomic DNA
tgagtctggctttgtcgcca

SEQ ID NO: 118130 - DNA, 20 bp, Homo sapiens
  misc_feature 1..20: note = chr2:120769771-120769791
  misc_feature 1..20: note = Hypo
  source 1..20: mol_type = genomic DNA
caccgcgcccagccaaatgc

SEQ ID NO: 118131 - DNA, 97 bp, Homo sapiens; identical to SEQ ID NO: 85042
  misc_feature 1..97: note = chr2:120973458-120973555
  misc_feature 1..97: note = Hypo
  source 1..97: mol_type = genomic DNA

SEQ ID NO: 118132 - DNA, 335 bp, Homo sapiens; identical to SEQ ID NO: 85043
  misc_feature 1..335: note = chr2:120973770-120974105
  misc_feature 1..335: note = Hypo
  source 1..335: mol_type = genomic DNA

SEQ ID NO: 118133 - DNA, 612 bp, Homo sapiens; identical to SEQ ID NO: 85044
  misc_feature 1..612: note = chr2:120979880-120980492
  misc_feature 1..612: note = Hypo
  source 1..612: mol_type = genomic DNA

SEQ ID NO: 118134 - DNA, 36 bp, Homo sapiens; identical to SEQ ID NO: 85045
  misc_feature 1..36: note = chr2:120994230-120994266
  misc_feature 1..36: note = Hypo
  source 1..36: mol_type = genomic DNA

SEQ ID NO: 118135 - DNA, 93 bp, Homo sapiens; identical to SEQ ID NO: 85046
  misc_feature 1..93: note = chr2:120995387-120995480
  misc_feature 1..93: note = Hypo
  source 1..93: mol_type = genomic DNA

SEQ ID NO: 118136 - DNA, 156 bp, Homo sapiens; identical to SEQ ID NO: 85047
  misc_feature 1..156: note = chr2:121003489-121003645
  misc_feature 1..156: note = Hypo
  source 1..156: mol_type = genomic DNA

SEQ ID NO: 118137 - DNA, 121 bp, Homo sapiens; identical to SEQ ID NO: 85049
  misc_feature 1..121: note = chr2:121101236-121101357
  misc_feature 1..121: note = Hyper
  source 1..121: mol_type = genomic DNA

SEQ ID NO: 118138 - DNA, 102 bp, Homo sapiens; identical to SEQ ID NO: 85050
  misc_feature 1..102: note = chr2:121102132-121102234
  misc_feature 1..102: note = Hyper
  source 1..102: mol_type = genomic DNA

SEQ ID NO: 118139 - DNA, 83 bp, Homo sapiens; identical to SEQ ID NO: 85051
  misc_feature 1..83: note = chr2:121102536-121102619
  misc_feature 1..83: note = Hyper
  source 1..83: mol_type = genomic DNA

SEQ ID NO: 118140 - DNA, 390 bp, Homo sapiens; identical to SEQ ID NO: 85052
  misc_feature 1..390: note = chr2:121102965-121103355
  misc_feature 1..390: note = Hyper
  source 1..390: mol_type = genomic DNA

SEQ ID NO: 118141 - DNA, 1564 bp, Homo sapiens
  misc_feature 1..1564: note = chr2:121103677-121105241
  misc_feature 1..1564: note = Hyper
  source 1..1564: mol_type = genomic DNA
ggcgcgcccggagcccggagcccggccctgcgctcggctcgactcggctcgcctcgcggcgggcgccctcgtcgccagcggcgcaccatggacgggctgcccggtcgggcgctgggggccgcctgccttctgctgctggcggccggctggctggggcctgaggcctggggctcacccacgcccccgccgacgcctgccgcgccgccgccacccccgccacccggatccccgggtggctcgcaggacacctgtacgtcgtgcggcggcttccggcggccagaggagctcggccgagtggacggcgacttcctggaggcggtgaagcggcacatcttgagccgcctgcagatgcggggccggcccaacatcacgcacgccgtgcctaaggccgccatggtcacggccctgcgcaagctgcacgcgggcaaggtgcgcgaggacggccgcgtggagatcccgcacctcgacggccacgccagcccgggcgccgacggccaggagcgcgtttccgaaatcatcagcttcgccgagacaggtgggtccggccctccggctgtctgccgcggtccccgctcgctcccgctctccctctccttgctagctccggctgccaccgccgccaccgcagcccgcgcgccctggggcagcctggactcccggcagagctccttcggccgtggccctgcgcgctccgcccgggttgcagtcctcttcccccaggccgcagacccttgcctgctgcctcaaccccccgccgccgatcgcctggccctccacccctgctctccggaatcgggccccagcgcctctgggcgcgcgtccccctcccggcagatgcgcgcggccctggctctgcgggcacttgcttggtgattgcttaatgtttttgtttcccacgatcggagtgtaggcttagcagtgtggatggagatgtgtgtgcttgttgatatacgtgggccggaggagagagagagtgtgtgtgtatctgtgtgtgtgtctgtgtgtgtgtgtgcctgcgtgagaggcccctggggccgcttccatcaccggcggcgtgggcttgccaggattgctgaagcctcgctggggagagctaggcaacctctcttccgattgtgtgggcaccggaatcgggcggaaggcaggcttctcaacaggtccatcatttacacagagaaagccgcggttcggggacagccccgtgcctctcggcttgcctggcagctgcagcagacccctcgcccgagaggcagagtcgtagttaacaaagggtatggctcctttctggaatccgcccccccccccggccccagattgcaaatctctaacactgtctaaatataaaaatcagggagagaaaaatctttcggaactttaaaagaaggagaaaaatgtgcccgcgccaaaatgctgcaagtgctttcgactccgctgtccttttcaggacttgaatgagccaggctggcttttgtgcctggagctcggccccatttgtgccgaggggactgcggagaaggtcgcagagggggaagccccggtgcagttagggcgggggcaagcgggg

SEQ ID NO: 118142 - DNA, 181 bp, Homo sapiens; identical to SEQ ID NO: 85055
  misc_feature 1..181: note = chr2:121199949-121200130
  misc_feature 1..181: note = Hyper
  source 1..181: mol_type = genomic DNA

SEQ ID NO: 118143 - DNA, 64 bp, Homo sapiens; identical to SEQ ID NO: 85056
  misc_feature 1..64: note = chr2:121200390-121200454
  misc_feature 1..64: note = Hyper
  source 1..64: mol_type = genomic DNA

SEQ ID NO: 118144 - DNA, 36 bp, Homo sapiens; identical to SEQ ID NO: 85057
  misc_feature 1..36: note = chr2:121200695-121200731
  misc_feature 1..36: note = Hyper
  source 1..36: mol_type = genomic DNA

SEQ ID NO: 118145 - DNA, 30 bp, Homo sapiens; identical to SEQ ID NO: 85058
  misc_feature 1..30: note = chr2:121242474-121242504
  misc_feature 1..30: note = Hypo
  source 1..30: mol_type = genomic DNA

SEQ ID NO: 118146 - DNA, 244 bp, Homo sapiens; identical to SEQ ID NO: 85059
  misc_feature 1..244: note = chr2:121344837-121345081
  misc_feature 1..244: note = Hyper
  source 1..244: mol_type = genomic DNA

SEQ ID NO: 118147 - DNA, 248 bp, Homo sapiens; identical to SEQ ID NO: 85060
  misc_feature 1..248: note = chr2:121412072-121412320
  misc_feature 1..248: note = Hyper
  source 1..248: mol_type = genomic DNA

SEQ ID NO: 118148 - DNA, 142 bp, Homo sapiens; identical to SEQ ID NO: 85061
  misc_feature 1..142: note = chr2:121492883-121493025
  misc_feature 1..142: note = Hyper
  source 1..142: mol_type = genomic DNA

SEQ ID NO: 118149 - DNA, 861 bp, Homo sapiens; identical to SEQ ID NO: 85062
  misc_feature 1..861: note = chr2:121493409-121494270
  misc_feature 1..861: note = Hyper
  source 1..861: mol_type = genomic DNA

SEQ ID NO: 118150 - DNA, 40 bp, Homo sapiens; identical to SEQ ID NO: 85063
  misc_feature 1..40: note = chr2:121494968-121495008
  misc_feature 1..40: note = Hyper
  source 1..40: mol_type = genomic DNA

SEQ ID NO: 118151 - DNA, 30 bp, Homo sapiens; identical to SEQ ID NO: 39649
  misc_feature 1..30: note = chr2:121639825-121639855
  misc_feature 1..30: note = Hypo
  source 1..30: mol_type = genomic DNA

SEQ ID NO: 118152 - DNA, 30 bp, Homo sapiens; identical to SEQ ID NO: 85065
  misc_feature 1..30: note = chr2:121731009-121731039
  misc_feature 1..30: note = Hypo
  source 1..30: mol_type = genomic DNA

SEQ ID NO: 118153 - DNA, 20 bp, Homo sapiens
  misc_feature 1..20: note = chr2:121852396-121852416
  misc_feature 1..20: note = Hypo
  source 1..20: mol_type = genomic DNA
cagaacgtccatcagccagg

SEQ ID NO: 118154 - DNA, 24 bp, Homo sapiens
  misc_feature 1..24: note = chr2:122013325-122013349
  misc_feature 1..24: note = Hypo
  source 1..24: mol_type = genomic DNA
tttttttttttgagacggaatctc

SEQ ID NO: 118155 - DNA, 243 bp, Homo sapiens; identical to SEQ ID NO: 85069
  misc_feature 1..243: note = chr2:122042116-122042359
  misc_feature 1..243: note = Hyper
  source 1..243: mol_type = genomic DNA

SEQ ID NO: 118156 - DNA, 337 bp, Homo sapiens; identical to SEQ ID NO: 85070
  misc_feature 1..337: note = chr2:122042645-122042982
  misc_feature 1..337: note = Hyper
  source 1..337: mol_type = genomic DNA

SEQ ID NO: 118157 - DNA, 47 bp, Homo sapiens; identical to SEQ ID NO: 39651
  misc_feature 1..47: note = chr2:122088821-122088868
  misc_feature 1..47: note = Hypo
  source 1..47: mol_type = genomic DNA

SEQ ID NO: 118158 - DNA, 315 bp, Homo sapiens; identical to SEQ ID NO: 85072
  misc_feature 1..315: note = chr2:122104569-122104884
  misc_feature 1..315: note = Hypo
  source 1..315: mol_type = genomic DNA

SEQ ID NO: 118159 - DNA, 272 bp, Homo sapiens; identical to SEQ ID NO: 39653
  misc_feature 1..272: note = chr2:122495322-122495594
  misc_feature 1..272: note = Hypo
  source 1..272: mol_type = genomic DNA

SEQ ID NO: 118160 - DNA, 36 bp, Homo sapiens; identical to SEQ ID NO: 85076
  misc_feature 1..36: note = chr2:122511837-122511873
  misc_feature 1..36: note = Hypo
  source 1..36: mol_type = genomic DNA

SEQ ID NO: 118161 - DNA, 24 bp, Homo sapiens
  misc_feature 1..24: note = chr2:123285320-123285344
  misc_feature 1..24: note = Hypo
  source 1..24: mol_type = genomic DNA
gggcgtggcggctcacgcctgtaa

SEQ ID NO: 118162 - DNA, 35 bp, Homo sapiens; identical to SEQ ID NO: 85082
  misc_feature 1..35: note = chr2:124439807-124439842
  misc_feature 1..35: note = Hypo
  source 1..35: mol_type = genomic DNA

SEQ ID NO: 118163 - DNA, 1240 bp, Homo sapiens
  misc_feature 1..1240: note = chr2:124782165-124783405
  misc_feature 1..1240: note = Hyper
  source 1..1240: mol_type = genomic DNA
tgtctttcctctctccgtctccctgagacgccagtgaaccacctgggcttggaatccagagccccggaacaccttgcagtacttgcccgaagcaacgcgccaacagcgggagggagacgcagacgcgaagaccggcgagaggatgtgcggtgggagtagctgcggggtctgcaagcaggggagcgcgcacaacgttaaaccttgaaaccagaaatcccgatcctatcgagacccatcagcttttcccatttgggaacgagcgcaggggaaattaaatgcgtaattcaagctctgttttcccctcccctccaaaggtgaggtgggggaacgcgtctcgttagctcattacaaagctttccgtgggaaattccctcttcctaatgcgtctgtcttgcaactcctattagcatccttcgacagcggcctttgaaaatctcctttaaatttcaatacctctactcgtttcccaaatggggggaagggaagagaaagccggggggtagagagaatttccttcccctttccctcccaggtagccaaagcgcaccgcagcggcttggcttcctggaggaaaagcgcccgagcggggcaaagacccgcccaggctgctcttataggcgagcgcggggcgggcctggctgggggcggtgccgcgcggccccgctcgcctataaggagctgtccgccacccgggtgctgattccagctctcgcgcccgacgaggtggatttggctgtccaccgagctccggcgcctgtcgttctaattgggtttggatttgcaccgttaaggaggggggaagagaaggaagaggcgggcgaggaaggcgagtccagctagcggctgttgcggggaccgtagccccagctgcagctccgaagaatcccccgccacggtttcggtggagcgtctgggcacgggatggagtgaaagagcgagtgcctctccaagcgggggtgggagggggtcaggctgtgcagaggagagagacagcgagaagaagccgcggctggctactgcgaatttgggattcgattgggagggaccgctcactcgggggaaatggattctttaccacggctgaccagcgttttgactttgctgttctctggcttgtggcatttaggattaacagcgacaaactgtgagtacgaggagctgggggcgggaaggtgaggtggaaaacgatcgcattcagaaagacaatcaactatctaagcgtactcgattgtgtctgctt

SEQ ID NO: 118164 - DNA, 90 bp, Homo sapiens; identical to SEQ ID NO: 85086
  misc_feature 1..90: note = chr2:125742056-125742146
  misc_feature 1..90: note = Hypo
  source 1..90: mol_type = genomic DNA

SEQ ID NO: 118165 - DNA, 40 bp, Homo sapiens; identical to SEQ ID NO: 85088
  misc_feature 1..40: note = chr2:126236905-126236945
  misc_feature 1..40: note = Hypo
  source 1..40: mol_type = genomic DNA

SEQ ID NO: 118166 - DNA, 39 bp, Homo sapiens; identical to SEQ ID NO: 85089
  misc_feature 1..39: note = chr2:126237005-126237044
  misc_feature 1..39: note = Hypo
  source 1..39: mol_type = genomic DNA

SEQ ID NO: 118167 - DNA, 31 bp, Homo sapiens; identical to SEQ ID NO: 85090
  misc_feature 1..31: note = chr2:126347693-126347724
  misc_feature 1..31: note = Hypo
  source 1..31: mol_type = genomic DNA

SEQ ID NO: 118168 - DNA, 24 bp, Homo sapiens
  misc_feature 1..24: note = chr2:126413299-126413323
  misc_feature 1..24: note = Hypo
  source 1..24: mol_type = genomic DNA
aaatatagcaatggccgggtgcgg

SEQ ID NO: 118169 - DNA, 30 bp, Homo sapiens; identical to SEQ ID NO: 85092
  misc_feature 1..30: note = chr2:126700543-126700573
  misc_feature 1..30: note = Hypo
  source 1..30: mol_type = genomic DNA

SEQ ID NO: 118170 - DNA, 30 bp, Homo sapiens; identical to SEQ ID NO: 85094
  misc_feature 1..30: note = chr2:127227218-127227248
  misc_feature 1..30: note = Hypo
  source 1..30: mol_type = genomic DNA

SEQ ID NO: 118171 - DNA, 172 bp, Homo sapiens; identical to SEQ ID NO: 85095
  misc_feature 1..172: note = chr2:127374881-127375053
  misc_feature 1..172: note = Hypo
  source 1..172: mol_type = genomic DNA

SEQ ID NO: 118172 - DNA, 265 bp, Homo sapiens; identical to SEQ ID NO: 85096
  misc_feature 1..265: note = chr2:127395350-127395615
  misc_feature 1..265: note = Hypo
  source 1..265: mol_type = genomic DNA

SEQ ID NO: 118173 - DNA, 30 bp, Homo sapiens; identical to SEQ ID NO: 39659
  misc_feature 1..30: note = chr2:127397957-127397987
  misc_feature 1..30: note = Hypo
  source 1..30: mol_type = genomic DNA

SEQ ID NO: 118174 - DNA, 102 bp, Homo sapiens; identical to SEQ ID NO: 85098
  misc_feature 1..102: note = chr2:127412026-127412128
  misc_feature 1..102: note = Hypo
  source 1..102: mol_type = genomic DNA

SEQ ID NO: 118175 - DNA, 76 bp, Homo sapiens
  misc_feature 1..76: note = chr2:127413750-127413826
  misc_feature 1..76: note = Hyper
  source 1..76: mol_type = genomic DNA
tcaggagcccgggagcgcgaccctcccccggcccggcctggcccggcctggccagtccccgcggtctctgcccggg

SEQ ID NO: 118176 - DNA, 207 bp, Homo sapiens; identical to SEQ ID NO: 85099
  misc_feature 1..207: note = chr2:127417883-127418090
  misc_feature 1..207: note = Hypo
  source 1..207: mol_type = genomic DNA

SEQ ID NO: 118177 - DNA, 37 bp, Homo sapiens; identical to SEQ ID NO: 85100
  misc_feature 1..37: note = chr2:127422857-127422894
  misc_feature 1..37: note = Hypo
  source 1..37: mol_type = genomic DNA

SEQ ID NO: 118178 - DNA, 336 bp, Homo sapiens; identical to SEQ ID NO: 85101
  misc_feature 1..336: note = chr2:127423014-127423350
  misc_feature 1..336: note = Hypo
  source 1..336: mol_type = genomic DNA

SEQ ID NO: 118179 - DNA, 279 bp, Homo sapiens; identical to SEQ ID NO: 85102
  misc_feature 1..279: note = chr2:127427725-127428004
  misc_feature 1..279: note = Hypo
  source 1..279: mol_type = genomic DNA

SEQ ID NO: 118180 - DNA, 208 bp, Homo sapiens; identical to SEQ ID NO: 85103
  misc_feature 1..208: note = chr2:127428985-127429193
  misc_feature 1..208: note = Hypo
  source 1..208: mol_type = genomic DNA

SEQ ID NO: 118181 - DNA, 30 bp, Homo sapiens; identical to SEQ ID NO: 85104
  misc_feature 1..30: note = chr2:127430819-127430849
  misc_feature 1..30: note = Hypo
  source 1..30: mol_type = genomic DNA

SEQ ID NO: 118182 - DNA, 127 bp, Homo sapiens; identical to SEQ ID NO: 39665
  misc_feature 1..127: note = chr2:127433244-127433371
  misc_feature 1..127: note = Hypo
  source 1..127: mol_type = genomic DNA

SEQ ID NO: 118183 - DNA, 92 bp, Homo sapiens; identical to SEQ ID NO: 85106
  misc_feature 1..92: note = chr2:127435199-127435291
  misc_feature 1..92: note = Hypo
  source 1..92: mol_type = genomic DNA

SEQ ID NO: 118184 - DNA, 202 bp, Homo sapiens; identical to SEQ ID NO: 85107
  misc_feature 1..202: note = chr2:127437938-127438140
  misc_feature 1..202: note = Hypo
  source 1..202: mol_type = genomic DNA

SEQ ID NO: 118185 - DNA, 262 bp, Homo sapiens; identical to SEQ ID NO: 39668
  misc_feature 1..262: note = chr2:127438633-127438895
  misc_feature 1..262: note = Hypo
  source 1..262: mol_type = genomic DNA

SEQ ID NO: 118186 - DNA, 30 bp, Homo sapiens; identical to SEQ ID NO: 85109
  misc_feature 1..30: note = chr2:127439943-127439973
  misc_feature 1..30: note = Hypo
  source 1..30: mol_type = genomic DNA

SEQ ID NO: 118187 - DNA, 417 bp, Homo sapiens; identical to SEQ ID NO: 85110
  misc_feature 1..417: note = chr2:127453528-127453945
  misc_feature 1..417: note = Hypo
  source 1..417: mol_type = genomic DNA

SEQ ID NO: 118188 - DNA, 21 bp, Homo sapiens
  misc_feature 1..21: note = chr2:127459661-127459682
  misc_feature 1..21: note = Hypo
  source 1..21: mol_type = genomic DNA
ccaccgcgctcagcccaggaa

SEQ ID NO: 118189 - DNA, 30 bp, Homo sapiens; identical to SEQ ID NO: 85112
  misc_feature 1..30: note = chr2:127461007-127461037
  misc_feature 1..30: note = Hypo
  source 1..30: mol_type = genomic DNA

SEQ ID NO: 118190 - DNA, 30 bp, Homo sapiens; identical to SEQ ID NO: 85114
  misc_feature 1..30: note = chr2:127529764-127529794
  misc_feature 1..30: note = Hypo
  source 1..30: mol_type = genomic DNA

SEQ ID NO: 118191 - DNA, 775 bp, Homo sapiens; identical to SEQ ID NO: 85115
  misc_feature 1..775: note = chr2:127534404-127535179
  misc_feature 1..775: note = Hyper
  source 1..775: mol_type = genomic DNA

SEQ ID NO: 118192 - DNA, 183 bp, Homo sapiens; identical to SEQ ID NO: 85116
  misc_feature 1..183: note = chr2:127638054-127638237
  misc_feature 1..183: note = Hypo
  source 1..183: mol_type = genomic DNA

SEQ ID NO: 118193 - DNA, 137 bp, Homo sapiens; identical to SEQ ID NO: 85117
  misc_feature 1..137: note = chr2:127643980-127644117
  misc_feature 1..137: note = Hyper
  source 1..137: mol_type = genomic DNA

SEQ ID NO: 118194 - DNA, 538 bp, Homo sapiens
  misc_feature 1..538: note = chr2:127783043-127783581
  misc_feature 1..538: note = Hyper
  source 1..538: mol_type = genomic DNA
actcccccagcaggacgtttactgaatctggagggagtcgccctgcagatatcccgcggaagccggaggagacccaggtgcgccccaccggctagctgcgcctgcgggtgcccaaattggtgtccgggccatcctcaccgcagtgactcctccgcagcgccaacgcactccattttccttccaccctgccggtggggggcgtttgcttgttctcactctgcagccgcagccagtggcgccgctaccaaggtccccgcctcgccatccgggtcctgcctgagcatccttattggtgctcagggctaggcgtgcattgctgctaggggcgcggaaaggtttatcgtgggtggatgctgcccggggcttgagtggtttttagaggtcttgagtggctcactctccaatcagcgctttctagagacagcgtggtcagcgtacttgcttactttcaggattgcgagacgtctttaacccttgctgatcggctgacgctgcagcttcctgtggcttcctgctcatttcccgcaagatagcactg

SEQ ID NO: 118195 - DNA, 81 bp, Homo sapiens; identical to SEQ ID NO: 39671
  misc_feature 1..81: note = chr2:127801154-127801235
  misc_feature 1..81: note = Hypo
  source 1..81: mol_type = genomic DNA

SEQ ID NO: 118196 - DNA, 55 bp, Homo sapiens; identical to SEQ ID NO: 85121
  misc_feature 1..55: note = chr2:127809256-127809311
  misc_feature 1..55: note = Hypo
  source 1..55: mol_type = genomic DNA

SEQ ID NO: 118197 - DNA, 390 bp, Homo sapiens; identical to SEQ ID NO: 27493
  misc_feature 1..390: note = chr2:127863488-127863878
  misc_feature 1..390: note = Hyper
  source 1..390: mol_type = genomic DNA

SEQ ID NO: 118198 - DNA, 452 bp, Homo sapiens; identical to SEQ ID NO: 27494
  misc_feature 1..452: note = chr2:127976374-127976826
  misc_feature 1..452: note = Hyper
  source 1..452: mol_type = genomic DNA

SEQ ID NO: 118199 - DNA, 234 bp, Homo sapiens; identical to SEQ ID NO: 85124
  misc_feature 1..234: note = chr2:127977701-127977935
  misc_feature 1..234: note = Hyper
  source 1..234: mol_type = genomic DNA

SEQ ID NO: 118200 - DNA, 251 bp, Homo sapiens; identical to SEQ ID NO: 85125
  misc_feature 1..251: note = chr2:128050739-128050990
  misc_feature 1..251: note = Hypo
  source 1..251: mol_type = genomic DNA

SEQ ID NO: 118201 - DNA, 37 bp, Homo sapiens; identical to SEQ ID NO: 85126
  misc_feature 1..37: note = chr2:128158434-128158471
  misc_feature 1..37: note = Hypo
  source 1..37: mol_type = genomic DNA

SEQ ID NO: 118202 - DNA, 30 bp, Homo sapiens; identical to SEQ ID NO: 85127
  misc_feature 1..30: note = chr2:128166372-128166402
  misc_feature 1..30: note = Hypo
  source 1..30: mol_type = genomic DNA

SEQ ID NO: 118203 - DNA, 78 bp, Homo sapiens; identical to SEQ ID NO: 85128
  misc_feature 1..78: note = chr2:128292507-128292585
  misc_feature 1..78: note = Hypo
  source 1..78: mol_type = genomic DNA

SEQ ID NO: 118204 - DNA, 53 bp, Homo sapiens; identical to SEQ ID NO: 85129
  misc_feature 1..53: note = chr2:128293399-128293452
  misc_feature 1..53: note = Hypo
  source 1..53: mol_type = genomic DNA

SEQ ID NO: 118205 - DNA, 30 bp, Homo sapiens; identical to SEQ ID NO: 85130
  misc_feature 1..30: note = chr2:128351156-128351186
  misc_feature 1..30: note = Hypo
  source 1..30: mol_type = genomic DNA

SEQ ID NO: 118206 - DNA, 71 bp, Homo sapiens; identical to SEQ ID NO: 85131
  misc_feature 1..71: note = chr2:128380851-128380922
  misc_feature 1..71: note = Hypo
  source 1..71: mol_type = genomic DNA

SEQ ID NO: 118207 - DNA, 273 bp, Homo sapiens
  misc_feature 1..273: note = chr2:128421809-128422082
  misc_feature 1..273: note = Hyper
  source 1..273: mol_type = genomic DNA
gaaggcctgccctgccgccgcagctttccggccattgtccccgccacccgccccgcccctggccacctaccccgtggctggcggcgggctctgccggtgctggcgccgccggtacagccccgacgcggccagcgcacccagccgggccgccatggcgcggggcagccgccttgaggtcgcgggcgcgggccgcctggtgcaggggctatgggaccacctcggaggggaggcgcggccgcctggggccagacaccaagacgggacgggcgtgtg

SEQ ID NO: 118208 - DNA, 375 bp, Homo sapiens; identical to SEQ ID NO: 85134
  misc_feature 1..375: note = chr2:128432249-128432624
  misc_feature 1..375: note = Hyper
  source 1..375: mol_type = genomic DNA

SEQ ID NO: 118209 - DNA, 496 bp, Homo sapiens; identical to SEQ ID NO: 85135
  misc_feature 1..496: note = chr2:128433025-128433521
  misc_feature 1..496: note = Hyper
  source 1..496: mol_type = genomic DNA

SEQ ID NO: 118210 - DNA, 30 bp, Homo sapiens; identical to SEQ ID NO: 85136
  misc_feature 1..30: note = chr2:128436077-128436107
  misc_feature 1..30: note = Hypo
  source 1..30: mol_type = genomic DNA

SEQ ID NO: 118211 - DNA, 22 bp, Homo sapiens
  misc_feature 1..22: note = chr2:128601383-128601405
  misc_feature 1..22: note = Hypo
  source 1..22: mol_type = genomic DNA
ttataaaagaggctgcgggctg

SEQ ID NO: 118212 - DNA, 151 bp, Homo sapiens; identical to SEQ ID NO: 39676
  misc_feature 1..151: note = chr2:128616477-128616628
  misc_feature 1..151: note = Hypo
  source 1..151: mol_type = genomic DNA

SEQ ID NO: 118213 - DNA, 120 bp, Homo sapiens; identical to SEQ ID NO: 85141
  misc_feature 1..120: note = chr2:128847679-128847799
  misc_feature 1..120: note = Hypo
  source 1..120: mol_type = genomic DNA

SEQ ID NO: 118214 - DNA, 30 bp, Homo sapiens; identical to SEQ ID NO: 85142
  misc_feature 1..30: note = chr2:128897581-128897611
  misc_feature 1..30: note = Hypo
  source 1..30: mol_type = genomic DNA

SEQ ID NO: 118215 - DNA, 59 bp, Homo sapiens; identical to SEQ ID NO: 85143
  misc_feature 1..59: note = chr2:129128223-129128282
  misc_feature 1..59: note = Hypo
  source 1..59: mol_type = genomic DNA

SEQ ID NO: 118216 - DNA, 47 bp, Homo sapiens; identical to SEQ ID NO: 85144
  misc_feature 1..47: note = chr2:129179600-129179647
  misc_feature 1..47: note = Hypo
  source 1..47: mol_type = genomic DNA

SEQ ID NO: 118217 - DNA, 30 bp, Homo sapiens; identical to SEQ ID NO: 85145
  misc_feature 1..30: note = chr2:129384355-129384385
  misc_feature 1..30: note = Hypo
  source 1..30: mol_type = genomic DNA

SEQ ID NO: 118218 - DNA, 30 bp, Homo sapiens; identical to SEQ ID NO: 85146
  misc_feature 1..30: note = chr2:129493732-129493762
  misc_feature 1..30: note = Hypo
  source 1..30: mol_type = genomic DNA

SEQ ID NO: 118219 - DNA, 185 bp, Homo sapiens; identical to SEQ ID NO: 85147
  misc_feature 1..185: note = chr2:130482642-130482827
  misc_feature 1..185: note = Hypo
  source 1..185: mol_type = genomic DNA

SEQ ID NO: 118220 - DNA, 171 bp, Homo sapiens; identical to SEQ ID NO: 39679
  misc_feature 1..171: note = chr2:130497037-130497208
  misc_feature 1..171: note = Hypo
  source 1..171: mol_type = genomic DNA

SEQ ID NO: 118221 - DNA, 169 bp, Homo sapiens; identical to SEQ ID NO: 85149
  misc_feature 1..169: note = chr2:130542307-130542476
  misc_feature 1..169: note = Hypo
  source 1..169: mol_type = genomic DNA

SEQ ID NO: 118222 - DNA, 178 bp, Homo sapiens; identical to SEQ ID NO: 39680
  misc_feature 1..178: note = chr2:130666498-130666676
  misc_feature 1..178: note = Hypo
  source 1..178: mol_type = genomic DNA

SEQ ID NO: 118223 - DNA, 47 bp, Homo sapiens; identical to SEQ ID NO: 85151
  misc_feature 1..47: note = chr2:130680907-130680954
  misc_feature 1..47: note = Hyper
  source 1..47: mol_type = genomic DNA

SEQ ID NO: 118224 - DNA, 521 bp, Homo sapiens
  misc_feature 1..521: note = chr2:130737136-130737657
  misc_feature 1..521: note = Hyper
  source 1..521: mol_type = genomic DNA
ttattttgttttcaccgcaccattgtttttagtacatatgttttgtgtatttaaaaaactgtgttgaggcgccctggctcgccctgcgccagaggctcgcgcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcctgccgacaccgccctccttcccttcccagccgcgggcctcgctccgtgctcggctactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctggg

SEQ ID NO: 118225 - DNA, 365 bp, Homo sapiens
  misc_feature 1..365: note = chr2:130763468-130763833
  misc_feature 1..365: note = Hyper
  source 1..365: mol_type = genomic DNA
atcaacaatgttgctcgcagtcccagcgctccgaacgacggtgcctccggttgacagcaacctgagcggacccgcgcctaggccctccgccaggcctgcgctgcctcgccccgggagaggaagactgagcccggctcaggcggctggagcgcgcgggcccgtttcctttcagcgatcagtcccctggcgtcccagcagcgccttccccgcgatcgcgcgtccccagcgcacgtcgcggctgccagctgctgccctgaccgccggcccagacgtgcccgcggacgccgctgacagcgcctgtgccatggggctgcctactctggagttcagcgattcctacttggacagcccggatttcagggagc

SEQ ID NO: 118226 - DNA, 87 bp, Homo sapiens; identical to SEQ ID NO: 85156
  misc_feature 1..87: note = chr2:130886777-130886864
  misc_feature 1..87: note = Hypo
  source 1..87: mol_type = genomic DNA

SEQ ID NO: 118227 - DNA, 49 bp, Homo sapiens; identical to SEQ ID NO: 85157
  misc_feature 1..49: note = chr2:130897204-130897253
  misc_feature 1..49: note = Hypo
  source 1..49: mol_type = genomic DNA

SEQ ID NO: 118228 - DNA, 195 bp, Homo sapiens; identical to SEQ ID NO: 85158
  misc_feature 1..195: note = chr2:130947958-130948153
  misc_feature 1..195: note = Hypo
  source 1..195: mol_type = genomic DNA

SEQ ID NO: 118229 - DNA, 325 bp, Homo sapiens
  misc_feature 1..325: note = chr2:130970979-130971304
  misc_feature 1..325: note = Hyper
  source 1..325: mol_type = genomic DNA
gctcatgagtgggcacgtcttgcccaccgccccgtcgccgaccaccacgcacttgagcatcagcgcgccaggcccgtgagccacgctgctgcccgccggcctccgggcatggtccccccggagcccccgccccggtccccgggctcagccccagcccgcctggggagtccgccgccgtcgccgccgctctgcgccgcaggccgccccccgaccggccccatccagcggctcccctcgccggaggggagggggcggcgggcccggggcgctgccgccgcggcggtcgccgccaggatccccgccccggccccggtcgctgcgcctg

SEQ ID NO: 118230 - DNA, 30 bp, Homo sapiens; identical to SEQ ID NO: 85161
  misc_feature 1..30: note = chr2:131018739-131018769
  misc_feature 1..30: note = Hypo
  source 1..30: mol_type = genomic DNA

SEQ ID NO: 118231 - DNA, 81 bp, Homo sapiens; identical to SEQ ID NO: 85163
  misc_feature 1..81: note = chr2:131085026-131085107
  misc_feature 1..81: note = Hypo
  source 1..81: mol_type = genomic DNA

SEQ ID NO: 118232 - DNA, 102 bp, Homo sapiens; identical to SEQ ID NO: 85164
  misc_feature 1..102: note = chr2:131089765-131089867
  misc_feature 1..102: note = Hypo
  source 1..102: mol_type = genomic DNA

SEQ ID NO: 118233 - DNA, 84 bp, Homo sapiens; identical to SEQ ID NO: 85165
  misc_feature 1..84: note = chr2:131114416-131114500
  misc_feature 1..84: note = Hypo
  source 1..84: mol_type = genomic DNA

SEQ ID NO: 118234 - DNA, 186 bp, Homo sapiens; identical to SEQ ID NO: 85166
  misc_feature 1..186: note = chr2:131477750-131477936
  misc_feature 1..186: note = Hypo
  source 1..186: mol_type = genomic DNA

SEQ ID NO: 118235 - DNA, 759 bp, Homo sapiens; identical to SEQ ID NO: 27505
  misc_feature 1..759: note = chr2:131484847-131485606
  misc_feature 1..759: note = Hyper
  source 1..759: mol_type = genomic DNA

SEQ ID NO: 118236 - DNA, 70 bp, Homo sapiens; identical to SEQ ID NO: 85168
  misc_feature 1..70: note = chr2:131486934-131487004
  misc_feature 1..70: note = Hypo
  source 1..70: mol_type = genomic DNA

SEQ ID NO: 118237 - DNA, 929 bp, Homo sapiens; identical to SEQ ID NO: 85169
  misc_feature 1..929: note = chr2:131513348-131514277
  misc_feature 1..929: note = Hyper
  source 1..929: mol_type = genomic DNA

SEQ ID NO: 118238 - DNA, 30 bp, Homo sapiens; identical to SEQ ID NO: 85170
  misc_feature 1..30: note = chr2:131525696-131525726
  misc_feature 1..30: note = Hypo
  source 1..30: mol_type = genomic DNA

SEQ ID NO: 118239 - DNA, 30 bp, Homo sapiens; identical to SEQ ID NO: 85171
  misc_feature 1..30: note = chr2:131586487-131586517
  misc_feature 1..30: note = Hypo
  source 1..30: mol_type = genomic DNA

SEQ ID NO: 118240 - DNA, 994 bp, Homo sapiens
  misc_feature 1..994: note = chr2:131594263-131595257
  misc_feature 1..994: note = Hyper
  source 1..994: mol_type = genomic DNA
cggcggcccctgggccgggtctgtggacggctctgctgtgtgcctgtgcgtgcccagtcccgcgggtgaccaaagcccaggggcgggcagggcaggagcctggacctcacgtgcctccagtggccaggtttgcgggggcggagcgtccgggcgagggcgcgggggcggaccctagggcggggcgcggggtggcgtcggtggagccggctcggcggcgcggctcgtagtgctgcggccgggctccgggcgtcccggcggccaccatgctcagcgtcgtgcacttcctccggagcttcttcaaggtgagagccggcgtccgggacttgcggtcgggctcccggcgccctgcgcgggtggggaggagcacagcccgcgctggctgctgcgccccgggccgtcccctgggcacccggtgggtggggacaccctcgtggctccccgccgctcccaactttccgacgtgcagaccggaggcggcgtcctgcaaagtggggccgtctcgagcgcggggaaggacggggctccgttgggggcggtagggacggcggcccggggcgagcccctgagagggcaagggcgagcgcctgagccggcctccccgcacctggaccgtcctgggcgcgcggggcactcggagccgctgcctggaccggcctgggcgcgcagggcactcggagcctctgccgcttggcgcagtaccagctgttttgggaaggagggctggtgccggcccggtgggtacgggagaagtggttgctgttgttattccccaggctgagagtacgcgagggcgcagcagcggcaaggggctggaactggggtcggggctgttgggctcctgctcggggtgccccctctctggcccgatttccgggcccgctcaccatccgggacccactcagttgggacgcctccacctcgctgcccccacaggaaccccaagatgggccgggggctccggggcactgtcaggggtggccggccacaggttgcc

SEQ ID NO: 118241 - DNA, 30 bp, Homo sapiens; identical to SEQ ID NO: 85174
  misc_feature 1..30: note = chr2:131639301-131639331
  misc_feature 1..30: note = Hypo
  source 1..30: mol_type = genomic DNA

SEQ ID NO: 118242 - DNA, 1603 bp, Homo sapiens
  misc_feature 1..1603: note = chr2:131720738-131722341
  misc_feature 1..1603: note = Hyper
  source 1..1603: mol_type = genomic DNA
ctgaactcttccacacgctttctaaaatcgtttggcatggactttcctcggccccttaatcaccacagggtgtgtcctgcccgggctgtcaggagggtcgcaggcgcccggtggtccacgctcaccgtgcgcctggctgagcgcagatgagggtcgtgtcccgtctgagcgcgctccccccgccggcgcgcacgcctgcccgccgggtctctgccctgggccgagcggggccacctgcttgcgtcctcgccctggatggcgtgggaggcgccgccaaccgtctgagctggaatccttgcggtgaaaaagtgggcgcccaccagccctcctcaccaccgcggctgcgacgagcctgggcgtcgcctcctaaggatggccctgtcctaacacacgcgtgcggacacaggtggcggcggcgcggccctgcggcaccgaggacgacccggagccccgcgcccgcgcccgccgccgcagccgctccaggcctgcgtgcgcgcgtgcgtgagcgcgtgccgaccgggcccgcgacccgcactggggtcgccgttgaggctcagcgcccgccgggcggccggtagtgggcagcgagctgacgcgctgcgctctgccgggagggcgcctggcctcgctccgagccgcgcgcgccccgcgcctgccaagggtcccagctgccgcggccacagagcccgagcggggggtcggctgagagcctccttaacggagccccatgatgtcagccggcccgcacgcccctcgccctccgactgcgaccccggcccgggctcgcgcgccccgtcccccggcagccccgcggccgccgcaccgccgcccccggcccagccttccccgagcctgtggctggagctcgggcccgcctgcgtgcgggcgcagcaatgccccagcgagtcaagcgggcagacgagtggcgatctcggcactagcagcagcagcagcgccgggctgtccccgggctccgactcggacagcagcggcgtggtgtgtggcggccgcggaggcaacgggggcatgcgcggcgccgtgtcccgctcctggagcctggagagcctgcgctcggccaccgccggtaaggacgccgccatccccgcgccgcacgcgccctccgcgcccgggtctgtgctcttgggaccccccgcccccctcctgcctttccttctcctccctcactttctgcctgtcgtttccatctcctggtcccttccttcccattgcttcgccctgctattccttttctttttctggtttccttctgattcccactgcctgtctctctgatccacgtctaccggtgggccacctgttacagccgggaccttgttggcccccataccagagcgcgctgtcaactgggaaactgattaaggtgagactagaatttggtgcccgatgcgctgtgttcctttccccaaactgttcttgaccagttgcacctgtctggctttacctaccgcagctgcttagcctctgtaaagccaggaggatggaagggggccgctggccgagggtggaacggattgcgccacctggctgtgagtgcgcttggtcctgaccgcaggactgcagctcccagcggaggcagctggtc

SEQ ID NO: 118243 - DNA, 1030 bp, Homo sapiens
  misc_feature 1..1030: note = chr2:131792172-131793202
  misc_feature 1..1030: note = Hyper
  source 1..1030: mol_type = genomic DNA
tgaagtgggggcctgcggccagtccttgtaaggaatcagagtccctggcccatccctccccaaagcgccggtgccaggcgttttggcctctgtatctctgaaacgaggaggtcccggggcatccccgagcgcccccgtggccatctgtgccactggccagcccagggccaggactgctgtgccggcgtggagattcccgaccctttccaaggaggtgccaagggcgcagcgcagcgcacgcccgagccgccgcggtccctctgagcctctccagcccgccgccgccgccgcccccgcccgcacagccggcttggttgccagggttgccagggcttggggcctgggaggcgccgcgcgcacggcgccggcttcgcgggaggagccccaggcccgcgagcgcaggcgccccgcctctccccgggcgctgcgggccaccggctcggccctgtgcggcgggatctcggggccgcacggagcgggaggccgggcgccatggcgagggccccgcagccccggcgcggccccgcggcgcccgggaacgccctgcgcgccctgctgcgctgcaacctgccccccggcgcccagcgcgtggtggtctccgccgtgctggcgctcctggttctcatcaacgtcgtactgatcttcctgctggccttccgctgagcggccgcgcagggcgccgcgccggggtgagtggcgcgggcgacggcactccagccgttgccacccgcggcctccgcactggtcgcggagggaaggcctccttccaccccatgtgctcactaccagggcctggtccgggggtgtcgccgagcgggtgcctgaggggcgtggtggcacgtgtgtcacagggtccttctgtcctctgtgccctgtggggagtgggggctgcgggggcgaggggggaggccaaaatggcgcgtctctgcgagtaaccgaggatgcggattcagctggggctccccggctgcttgtctggaaacggagtgcatgtgaccgctgggtgagcgacccgcgcttgcatctgtgt

SEQ ID NO: 118244 - DNA, 180 bp, Homo sapiens; identical to SEQ ID NO: 85182
  misc_feature 1..180: note = chr2:131813291-131813471
  misc_feature 1..180: note = Hypo
  source 1..180: mol_type = genomic DNA

SEQ ID NO: 118245 - DNA, 261 bp, Homo sapiens; identical to SEQ ID NO: 14463
  misc_feature 1..261: note = chr2:131967115-131967376
  misc_feature 1..261: note = Hypo
  source 1..261: mol_type = genomic DNA

SEQ ID NO: 118246 - DNA, 266 bp, Homo sapiens
  misc_feature 1..266: note = chr2:132088590-132088856
  misc_feature 1..266: note = Hyper
  source 1..266: mol_type = genomic DNA
tcctgacactgcaagcgctccctgaaatccgggctgtccaagtaggaatcgctgaactccagagtaggcagccccatggcacaggcgctgtcagcggcgtccgcgggcacgtctgggccggcggtcagggcagcagctggcggcggcggcggcgggcgctggggacgcgcgatagcggggaaggcgctgctgggacgccaggggactgatcgctgaaaggaaacgggcccgcgcgctgcagccacctgagccgggctcagtcttcc

SEQ ID NO: 118247 - DNA, 402 bp, Homo sapiens
  misc_feature 1..402: note = chr2:132121322-132121724
  misc_feature 1..402: note = Hyper
  source 1..402: mol_type = genomic DNA
agcccagagacctcccggaccgatgctgctccagccggctgacgaaaaaggcgagcggaagggcgggcgccgagctctctgcgcccctgcaagggccggtggaggagcccggctggagggcagcaggactctccacagactggcagccgccgccgcctcccggcagagtagccgagcaccgagcgaggcccgcggctgggaagggaaggagggcggtgtcggcaggagccaggggtgtgctttggcttcccaaggctagggccgttcccttcttcctcacccggctccaagacctgcgggagaaaggcggagggtggcggagccggaaccgcagacgtatctgggatctctcacgcgcggcgcttcggcttccccagccgccgccgccgcagcccaacctgc

SEQ ID NO: 118248 - DNA, 303 bp, Homo sapiens; identical to SEQ ID NO: 85189
  misc_feature 1..303: note = chr2:132152221-132152524
  misc_feature 1..303: note = Hyper
  source 1..303: mol_type = genomic DNA

SEQ ID NO: 118249 - DNA, 635 bp, Homo sapiens; identical to SEQ ID NO: 85190
  misc_feature 1..635: note = chr2:132182618-132183253
  misc_feature 1..635: note = Hyper
  source 1..635: mol_type = genomic DNA

SEQ ID NO: 118250 - DNA, 207 bp, Homo sapiens; identical to SEQ ID NO: 85191
  misc_feature 1..207: note = chr2:132218311-132218518
  misc_feature 1..207: note = Hyper
  source 1..207: mol_type = genomic DNA

SEQ ID NO: 118251 - DNA, 49 bp, Homo sapiens; identical to SEQ ID NO: 85192
  misc_feature 1..49: note = chr2:132300662-132300711
  misc_feature 1..49: note = Hypo
  source 1..49: mol_type = genomic DNA

SEQ ID NO: 118252 - DNA, 30 bp, Homo sapiens; identical to SEQ ID NO: 85193
  misc_feature 1..30: note = chr2:132301604-132301634
  misc_feature 1..30: note = Hypo
  source 1..30: mol_type = genomic DNA

SEQ ID NO: 118253 - DNA, 99 bp, Homo sapiens; identical to SEQ ID NO: 85194
  misc_feature 1..99: note = chr2:132415272-132415371
  misc_feature 1..99: note = Hypo
  source 1..99: mol_type = genomic DNA

SEQ ID NO: 118254 - DNA, 46 bp, Homo sapiens; identical to SEQ ID NO: 85195
  misc_feature 1..46: note = chr2:132416768-132416814
  misc_feature 1..46: note = Hypo
  source 1..46: mol_type = genomic DNA

SEQ ID NO: 118255 - DNA, 201 bp, Homo sapiens; identical to SEQ ID NO: 85196
  misc_feature 1..201: note = chr2:132767329-132767530
  misc_feature 1..201: note = Hyper
  source 1..201: mol_type = genomic DNA

SEQ ID NO: 118256 - DNA, 240 bp, Homo sapiens; identical to SEQ ID NO: 85197
  misc_feature 1..240: note = chr2:132767710-132767950
  misc_feature 1..240: note = Hyper
  source 1..240: mol_type = genomic DNA

SEQ ID NO: 118257 - DNA, 120 bp, Homo sapiens; identical to SEQ ID NO: 85198
  misc_feature 1..120: note = chr2:132795881-132796001
  misc_feature 1..120: note = Hyper
  source 1..120: mol_type = genomic DNA

SEQ ID NO: 118258 - DNA, 120 bp, Homo sapiens; identical to SEQ ID NO: 85199
  misc_feature 1..120: note = chr2:132796061-132796181
  misc_feature 1..120: note = Hyper
  source 1..120: mol_type = genomic DNA

SEQ ID NO: 118259 - DNA, 453 bp, Homo sapiens
  misc_feature 1..453: note = chr2:133014570-133015023
  misc_feature 1..453: note = Hyper
  source 1..453: mol_type = genomic DNA
acacggccacgggatcccaccgccacagacaggagggaggtaccgcagcgacccgcctaggatgccggacggccctcggcaccaccgagacccgcctcatgagccccaggtcccgccatcaggaccccgaggtgacctcagccacaaacctaacgccagggccacgttgctcgtttctcatccatcctccaacccggtcaagctccaggagaccggcatgccccccacttgggacgcttcccagggccaggcggcccaaccccgtgccacgcaaacacggtcgtcggcaccggtcgctgctctgcaggggagcgggcagagagccggctcacagcggaacgggtcacaagccggactgaacgccaggcacagccaccgctcacgcagcctcccaaccgctaggacgccggcccggcccggcgggattctcccctgactcggaaggggaaggcg

SEQ ID NO: 118260 - DNA, 180 bp, Homo sapiens; identical to SEQ ID NO: 85202
  misc_feature 1..180: note = chr2:133015296-133015476
  misc_feature 1..180: note = Hyper
  source 1..180: mol_type = genomic DNA

SEQ ID NO: 118261 - DNA, 163 bp, Homo sapiens; identical to SEQ ID NO: 85203
  misc_feature 1..163: note = chr2:133015536-133015699
  misc_feature 1..163: note = Hyper
  source 1..163: mol_type = genomic DNA

SEQ ID NO: 118262 - DNA, 30 bp, Homo sapiens; identical to SEQ ID NO: 85204
  misc_feature 1..30: note = chr2:133036010-133036040
  misc_feature 1..30: note = Hypo
  source 1..30: mol_type = genomic DNA

SEQ ID NO: 118263 - DNA, 560 bp, Homo sapiens
  misc_feature 1..560: note = chr2:133062139-133062699
  misc_feature 1..560: note = Hyper
  source 1..560: mol_type = genomic DNA
actttttcttttcatcgttgatagtgatttaacatttcattactttatcgttattatgattgtcattattttagacgaatgcacgaagtcaaaggacttccaaatgcacggacgtcaaaggctaccttcacccgggtagccttgcgaatggccactgctgcgagtggggctttctggggattgtagtccataggcctccttgcgcaagcgcgtggtaccagacgcaagctaggggcgacattgtttggaatgctgggttgagtcccggctggaccgcgcccctctcggaagtgtagccaggagtaggggtgtaggatgtgcagctgtgacccgtccctgtggactgaagtaggaggagtggaggaggggactggtgaccaatgaaaaggcctcgtgggtggggtaggctggggaagttcagcagcccctatctacccgggatggaatgggaagcgcttgggctcagtttggggagcagccctgggtttgacaaaacgtgcatcttcacgtttcgtgacagcgacttgcgctgtgccaccttgggtcgaggcttagggtca

SEQ ID NO: 118264 - DNA, 92 bp, Homo sapiens; identical to SEQ ID NO: 85207
  misc_feature 1..92: note = chr2:133174078-133174170
  misc_feature 1..92: note = Hyper
  source 1..92: mol_type = genomic DNA

SEQ ID NO: 118265 - DNA, 144 bp, Homo sapiens; identical to SEQ ID NO: 27528
  misc_feature 1..144: note = chr2:133426223-133426367
  misc_feature 1..144: note = Hyper
  source 1..144: mol_type = genomic DNA

SEQ ID NO: 118266 - DNA, 625 bp, Homo sapiens; identical to SEQ ID NO: 85209
  misc_feature 1..625: note = chr2:133426637-133427262
  misc_feature 1..625: note = Hyper
  source 1..625: mol_type = genomic DNA

SEQ ID NO: 118267 - DNA, 181 bp, Homo sapiens; identical to SEQ ID NO: 85210
  misc_feature 1..181: note = chr2:133427471-133427652
  misc_feature 1..181: note = Hyper
  source 1..181: mol_type = genomic DNA

SEQ ID NO: 118268 - DNA, 221 bp, Homo sapiens; identical to SEQ ID NO: 27531
  misc_feature 1..221: note = chr2:133427885-133428106
  misc_feature 1..221: note = Hyper
  source 1..221: mol_type = genomic DNA

SEQ ID NO: 118269 - DNA, 47 bp, Homo sapiens; identical to SEQ ID NO: 85212
  misc_feature 1..47: note = chr2:134024354-134024401
  misc_feature 1..47: note = Hyper
  source 1..47: mol_type = genomic DNA

SEQ ID NO: 118270 - DNA, 34 bp, Homo sapiens; identical to SEQ ID NO: 85213
  misc_feature 1..34: note = chr2:134024695-134024729
  misc_feature 1..34: note = Hyper
  source 1..34: mol_type = genomic DNA

SEQ ID NO: 118271 - DNA, 30 bp, Homo sapiens; identical to SEQ ID NO: 85214
  misc_feature 1..30: note = chr2:134326018-134326048
  misc_feature 1..30: note = Hyper
  source 1..30: mol_type = genomic DNA

SEQ ID NO: 118272 - DNA, 808 bp, Homo sapiens; identical to SEQ ID NO: 85215
  misc_feature 1..808: note = chr2:135475588-135476396
  misc_feature 1..808: note = Hyper
  source 1..808: mol_type = genomic DNA

SEQ ID NO: 118273 - DNA, 321 bp, Homo sapiens; identical to SEQ ID NO: 85216
  misc_feature 1..321: note = chr2:135476749-135477070
  misc_feature 1..321: note = Hyper
  source 1..321: mol_type = genomic DNA

SEQ ID NO: 118274 - DNA, 30 bp, Homo sapiens; identical to SEQ ID NO: 39689
  misc_feature 1..30: note = chr2:135832320-135832350
  misc_feature 1..30: note = Hypo
  source 1..30: mol_type = genomic DNA

SEQ ID NO: 118275 - DNA, 30 bp, Homo sapiens; identical to SEQ ID NO: 85218
  misc_feature 1..30: note = chr2:136873990-136874020
  misc_feature 1..30: note = Hyper
  source 1..30: mol_type = genomic DNA

SEQ ID NO: 118276 - DNA, 467 bp, Homo sapiens; identical to SEQ ID NO: 85219
  misc_feature 1..467: note = chr2:136874932-136875399
  misc_feature 1..467: note = Hyper
  source 1..467: mol_type = genomic DNA

SEQ ID NO: 118277 - DNA, 264 bp, Homo sapiens; identical to SEQ ID NO: 85220
  misc_feature 1..264: note = chr2:136875881-136876145
  misc_feature 1..264: note = Hyper
  source 1..264: mol_type = genomic DNA

SEQ ID NO: 118278 - DNA, 702 bp, Homo sapiens
  misc_feature 1..702: note = chr2:136876362-136877064
  misc_feature 1..702: note = Hyper
  source 1..702: mol_type = genomic DNA
gtaatttcataatagcggtaaccaattcgcgaatagtgctttattatcctaaaagtatgctttattataagagtaatttagcgaccagtactttttgtaacagatcactaggaacttgcacagaatcactcattcattctcacaacaccgtgtgggtattaccatcacagagatgcatttagtccgatatttatagaaggacgaactgcgtgccacgcactgttctaggcgttggggatccagcgtgaaccagacaaggcccgcattcggagaaaccagcaaataagcccggagagatgaaatgccagggatgggcagggattccaagccgggcttgaacccaggtcttcggtccccatactcggcgtcttccacgattttgagcagaggacaagctttggcacgaatcagaaattaggttgaagaactgggcggggcggagtgggggtgggggtcagacgtttaaagcgatctcagactggctgaggtttgcagtgggcgcgcagacagtgctttccccctcgcgccacttccctccggcgcggagactgggtggggcgggggagcgagtgtggggcggggccgagaaactgcgtccgcaggcggggtggccgctgcggagatagctgggaccgaggcgcgtgcgtcgcgacacggaccccagaggcccccaccccgaaatggtcccgaggagagggattg

SEQ ID NO: 118279 - DNA, 92 bp, Homo sapiens; identical to SEQ ID NO: 85222
  misc_feature 1..92: note = chr2:137181222-137181314
  misc_feature 1..92: note = Hyper
  source 1..92: mol_type = genomic DNA

SEQ ID NO: 118280 - DNA, 698 bp, Homo sapiens
  misc_feature 1..698: note = chr2:137522341-137523039
  misc_feature 1..698: note = Hyper
  source 1..698: mol_type = genomic DNA
gcacccagctcccggcgtttcccggagtcaccacaatgtttccctttctctctcccccacgtatgctgctaggggtactccccagataggattttctttgtcttttctcctagtaacaccgaagccctctcgtgcccggggactgcagaggaacgccagaccatccggaccttgcgggatggctcggtgtgtgtgttttactgtgtgtcggagtgtcgcgcatgtgtgcgtgttggggcgcgttatcaacaggggcctagggcacccccactctttcttgctctcttcccccatcacttcatggacctccgaggcgcaaagcgctcgaccctctcctgggctcagtggcttgggtactccgggctgagctcagctggggagtccccttacccagcccgcaccggcaccccgaagcttcaaagttgcggcaaacagttgcggggagcagaggaactgaggtccaggccagcgcgcccgcggtcgctcgccttggggagcaggctgagccgagggtcgtgcgggtgcgcggcagaggcggtaggaggcggaggagaggggggagaaagagggggcggtggggaacagctgccggggtaggcgaggcgcaaggtggctccccgcggccccgcgccccgcggctctcggacgcaccaggcagccaatggctgcgcagaggtgtacagcagatggcgtctgac

SEQ ID NO: 118281 - DNA, 577 bp, Homo sapiens
  misc_feature 1..577: note = chr2:137523099-137523676
  misc_feature 1..577: note = Hyper
  source 1..577: mol_type = genomic DNA
tcctcctcctccttcagtgctgaggagccagagtcgccgccgggttgccagacgctggaatgggtggtcttccgacacacaccaccatctttcttgcgctcgggaagctcggggctcagcggctcccagaggttacggcggcggctctggcgagacgggtgagtgcaagcacgcggagccccgagtcggggatgccgggccccctggccggccgactggggcgcggggtggcagcgccggggaagggggcgcgctgccggcgcagactttgctctttcctcgccggacagccatcgtcgccccttctcccagccagacgcgggaacttggaagcggatcttctcggacgcctctggcttggggctgcgggaagcgtgggctgcccggggcgcagtgtgcggagaccctctaggcgggcggggacgccccacgcggcgacctgagcaccgacctcatgcaacgggaccgaaccttgggacccgggcagcaggagctctgttcccttcacctccagcttggtttgagggatactgatgaaggaaaccgggggtttcccgtcctgcgcggagagcctcgg

SEQ ID NO: 118282 - DNA, 1229 bp, Homo sapiens
  misc_feature 1..1229: note = chr2:139536937-139538166
  misc_feature 1..1229: note = Hyper
  source 1..1229: mol_type = genomic DNA
catatagaacataggcgtatatcaggaggaggagagcgtggcgcctcgcgggaagagagaagagagtgacaacgcgaaccccaaaccacattttaatacgtttcttattcctcagcgcctccgagccacccagaccaggcgggcggtctccctgaaaagacagcttcgagatgcccgagagggggctcctgcgcggagctgggcatgaaagttatatcttgtgtccccagctggcagaaagccccatcccagtccctagcgccagacggaaaacgaagagaaatccaagctgtcccccaaatccgtattttgcctaagttttctcccagcaaggcgccactacctggctctgagaacgaggatgcatgcactatgctgtgctttgggagaagtgtctgtgtgcatctgggcaaaacaccacgtgaaaaataaacaccaccaagcctctcaaactgtgaacaggaggaaggtctttctgccccttctcatcctatcaatttactttccttcctctccttgaccgcttatcaataaaccgcttccttctcccggacctacttcccggccaccttctgcctactttaccccagcgctcaagtcccaacccgtgctaagcccctgagtcgcctgtagatcccgtctattccgttcttcaattcttccctttcgacctctaaggcaacccaaaactccttgccctccgcgcgcccccaaccccacttcccaagcaggcccaggctgggctccaagtcagccgcctgcgcggttttcccgccgaaacgcgtccccggcgtgtgggacggcgcgcgggccgggcactcaccagctgcagcaagccagggaccaccacgaggggcagcggccgcaggcgcatggtgccggctggcgcggcttttcacgagctgcgcgccctcgcctgcctctcgcgcatctccacttcgcggggcaggactgaggacgccagggacacagcgcggcgcttccctcccggaatccgagcgctgcgccgtgccgcgcagctctggccgggtgggcgggcagggaagggggagggtgggcggaccggaggtgcctctcccggccccccgcgcgcccctcctcggagggggccggcaaagagcctgcggggcagctcgagctccggcacgcggcggggggcttcagtcgcgccttggactctcccgcttggccgggcttggggtgagcgcgtggggcgcctgcgggaggga

SEQ ID NO: 118283 - DNA, 82 bp, Homo sapiens; identical to SEQ ID NO: 85231
  misc_feature 1..82: note = chr2:140650882-140650964
  misc_feature 1..82: note = Hypo
  source 1..82: mol_type = genomic DNA

SEQ ID NO: 118284 - DNA, 39 bp, Homo sapiens; identical to SEQ ID NO: 85232
  misc_feature 1..39: note = chr2:141842488-141842527
  misc_feature 1..39: note = Hypo
  source 1..39: mol_type = genomic DNA

SEQ ID NO: 118285 - DNA, 117 bp, Homo sapiens; identical to SEQ ID NO: 85233
  misc_feature 1..117: note = chr2:142022840-142022957
  misc_feature 1..117: note = Hypo
  source 1..117: mol_type = genomic DNA

SEQ ID NO: 118286 - DNA, 663 bp, Homo sapiens; identical to SEQ ID NO: 85236
  misc_feature 1..663: note = chr2:142887903-142888566
  misc_feature 1..663: note = Hyper
  source 1..663: mol_type = genomic DNA

SEQ ID NO: 118287 - DNA, 98 bp, Homo sapiens; identical to SEQ ID NO: 85237
  misc_feature 1..98: note = chr2:142889151-142889249
  misc_feature 1..98: note = Hyper
  source 1..98: mol_type = genomic DNA

SEQ ID NO: 118288 - DNA, 45 bp, Homo sapiens; identical to SEQ ID NO: 85238
  misc_feature 1..45: note = chr2:143931476-143931521
  misc_feature 1..45: note = Hypo
  source 1..45: mol_type = genomic DNA

SEQ ID NO: 118289 - DNA, 30 bp, Homo sapiens; identical to SEQ ID NO: 85239
  misc_feature 1..30: note = chr2:143948617-143948647
  misc_feature 1..30: note = Hypo
  source 1..30: mol_type = genomic DNA

SEQ ID NO: 118290 - DNA, 39 bp, Homo sapiens; identical to SEQ ID NO: 85240
  misc_feature 1..39: note = chr2:144022361-144022400
  misc_feature 1..39: note = Hypo
  source 1..39: mol_type = genomic DNA

SEQ ID NO: 118291 - DNA, 18 bp, Homo sapiens
  misc_feature 1..18: note = chr2:144081508-144081526
  misc_feature 1..18: note = Hypo
  source 1..18: mol_type = genomic DNA
caacgggccatgtatcag

SEQ ID NO: 118292 - DNA, 30 bp, Homo sapiens; identical to SEQ ID NO: 85242
  misc_feature 1..30: note = chr2:144093577-144093607
  misc_feature 1..30: note = Hypo
  source 1..30: mol_type = genomic DNA

SEQ ID NO: 118293 - DNA, 96 bp, Homo sapiens; identical to SEQ ID NO: 85243
  misc_feature 1..96: note = chr2:144108415-144108511
  misc_feature 1..96: note = Hypo
  source 1..96: mol_type = genomic DNA

SEQ ID NO: 118294 - DNA, 81 bp, Homo sapiens; identical to SEQ ID NO: 85244
  misc_feature 1..81: note = chr2:144247835-144247916
  misc_feature 1..81: note = Hypo
  source 1..81: mol_type = genomic DNA

SEQ ID NO: 118295 - DNA, 36 bp, Homo sapiens; identical to SEQ ID NO: 85245
  misc_feature 1..36: note = chr2:144667175-144667211
  misc_feature 1..36: note = Hypo
  source 1..36: mol_type = genomic DNA

SEQ ID NO: 118296 - DNA, 1034 bp, Homo sapiens
  misc_feature 1..1034: note = chr2:144694291-144695325
  misc_feature 1..1034: note = Hyper
  source 1..1034: mol_type = genomic DNA
aaaggtagtaggcatcggtgtttctggttttgcttagtgcgtcttcatcgtattccctcgctgaggactgagcctggccgactcagggaaccgagttcaatgaaatcctcagacgcataaagcacagggtgccggcccaccgagctgcgctcccttcccgggggtgcccgagagagagcacgcgagcccggcgcagccaaacccgggcaggggtgggtccccaccgcgtgtgcgtgtgccagcctgggagtgtcggcgcgagcgtggcgggtgcgtgccggtgtgtgtgcgtgacagcgcgcgcgtggcagggagttcgcgcgccagggtgcgcgtgccagcgcgggtgtgcgagggagtgcgcgcgggtgggagcgccaggggctggcggggcccgcgccctgggacgagcccctcgtgctccggctctgcgctcccgcagcgcccacgcagccgagaggagtgggtgatgacttcgtgacctcaacgtcctcccccgtccctcgacatgttcccgcgcctgaaaggtgcagaaaactccccccaccgctctggacgagactgagctaggcgtcgagggcgggcgccgccgcagaccggagctcgggctcgctggccgctcaggcgcagcggtgtggagggaacggacgcgcggcaaggcgacccgctctgggcaacgcgggcgcagctgccccgacgcaaggcactagctggtcgggggctcgggcgagccggggccggcgtgccggggcgtgcgctctctcggcaggcgagcgccgggctccgcggaggtccctgcgcccactgcctgcttctccgcccggcgacccggagtccccaggctgcggtgcgccaggccagacctgaccgagggcggaagacccgagcggcagggaggcagaaagaaaagaggtagcaagccccagacaagggatccttaattacagataaaaggcaaacaaaaccgtacaccacattttccacgtgtcagctgacggccgcgacaaaaggaaacagaacgctggggggtgggg

SEQ ID NO: 118297 - DNA, 94 bp, Homo sapiens; identical to SEQ ID NO: 85250
  misc_feature 1..94: note = chr2:145174483-145174577
  misc_feature 1..94: note = Hypo
  source 1..94: mol_type = genomic DNA

SEQ ID NO: 118298 - DNA, 35 bp, Homo sapiens; identical to SEQ ID NO: 85251
  misc_feature 1..35: note = chr2:145204264-145204299
  misc_feature 1..35: note = Hypo
  source 1..35: mol_type = genomic DNA

SEQ ID NO: 118299 - DNA, 2564 bp, Homo sapiens
  misc_feature 1..2564: note = chr2:145273327-145275891
  misc_feature 1..2564: note = Hyper
  source 1..2564: mol_type = genomic DNA
acacacgcacacacacgcgtacacacacacaaaacctagagagagagagagagagagagaaaagcatcatttgtctctaatcaaaattctctcgtctttgtgttttgctccttccagcacctcacactgcgcccccagccgccccctccccgcgccgcgcagctctggggcaggccgggggcgcgcacaattgtcttctctagaggaaagttgctccaagtgggcccgggcggtccccgcgaggcgcgggctggggctgcggaggccgggaggccgggtgggcgctgcgtcccagcgcctgcctcgggagcgtctacgcggccccgcgccgggtgatcgggctgagagcgaggggagcgagaagtttcctttccgagtctgggctggcgctcgttcgcttgtttgttttcgggggttggtttctttctttttaaactcagttatcctccgtcagctcccccacccccccccggcaccctcgctagtccccagccctctcccctcccccaggcgccttccgcgctcttgccaatcacttttctcttttattcccacgattttgtttggggtaatacctagggggtctctctctcactctcttcctctctctctgtttctctctgtccccccgcgtcccttctctggctgtctccaaaacggacctaccaaactctcacccccccctttaatatcccacctctgatctgcgtgtgcccctcgaacccccatctcctttctccttcctccttcctgactcagcctggataacgggctcctccagaccatgtagaaactgccgggaaaagtctcgctgcgccctgcgactccttcagtccccggcctgggggcagagcctgctggagaggagtcatccgtccccgagccatcatcgaccccaccggaccccgcgcggggccggccgactccctcccaccccggggtctgggcgcgatgggccgggccccgctgcccgcggaccgttacttggcgcaccgagaagcggccgggcgactccggcaagaaactttaagcctcgctgaggcgcagacccggttcccctctcctgccttcgcagtctctctgccacccccgcccccgccccgggatcctgcgcgatccagcgcctgggcccccgccctgccccaggcggacgctcccgaagcccggccggagacccggcgggccgggcgcgagcggagcgggaggcggaggcggagggagggcggaggcaggggctcgaggggggcagcggggctgggggcgcggggccccggccggacccccgcgctcggacccccgggtgcctgacgctcactttgcccggcacttccccaacaccccccggtccagccgccgcgcgcgccgggctccggcgccggccgcggagggaggctcgccctagagccctgggcgccgccgccgccgccgcctcggttccttttccctttccccctccttctccctgggtctcgagccgcgtagtggcccggaaaagtttggttcgggctgcttcttaccgtttttcctcctgggattggcttgtttgcgcctcttgcaccgggggccatccgccatgatcggctgcttcattgataagagcggatcagatggcagttcgcatggactcggcgccctgcttcggcagcacgcaggctcgatctagcaaccaaacacagcgacaatgtgggcatcgcccgcgcccattgaaacgcgcgcgggccgcccaggggagccgggccagggccccggcgagcacccatccgcgccccccaacgccaaagcgaaacttcggcggccccctccccgccccccacccccagccttggccccgaggcgctttgtgtttgttactgtttggtgtgttgcacccgcgaggggatcagagagacaagaattacatcttcaaaatgagtcataactcctgaccgtatgagggaatgcacacggcggtacagtaagaccgcttgactcagggctaggcggaccctttccttcgaaaagtcctcagcccccggctcgggaacttggggtgaggcgaggttttcttttcgttctcatcttttctcatccccccaccccccaattcccagaggaaacaaacaaacaaacaacgcgaaacagcccctggatgaagcacactcgggcaaattgataatagtaattataggaagcccactcgcccagcgccccctcccctccccttttggagtttatcgaggcactgtctcttcctccccccaccctcgcccccaaattaagatttcccgttttacgccgcaatgataaatataattataagcctctttggacactgtcctttaccccaccccccctcgccactttgacaatatttacttaagtatttccccccacctcactcacacacatgctcccccacactggttcccttaaatagttccagtagaattttttttttcccttaagaaaggaaagagaaagtccaaccactacggcaatacttttaagctctactaaatgatcgtatcctttctggcttcgaaacttttgtacctaaaaatcgagagaggcgctgcattttttca

SEQ ID NO: 118300 - DNA, 457 bp, Homo sapiens; identical to SEQ ID NO: 27553
  misc_feature 1..457: note = chr2:145277493-145277950
  misc_feature 1..457: note = Hyper
  source 1..457: mol_type = genomic DNA

SEQ ID NO: 118301 - DNA, 1065 bp, Homo sapiens
  misc_feature 1..1065: note = chr2:145281202-145282267
  misc_feature 1..1065: note = Hyper
  source 1..1065: mol_type = genomic DNA
tctagaggaattattcgaccttgtgttgtgactcaggaggtgggcaacttcttttggagttgcaagcaaagggtgataaaggggacccctggactgggtgtgtgtggaggaggtggggggcggcaggggtccaagccaagccaaacggttttctcacgtgcagactcgcaatccaatccattcggagttgagcctaggataggaggggaaagtctattaaaaaaaaaaaaaatcaggagcatctctctgagaagccctttcaaacaaaaccaaaacaggaccagagaagctcagaccgtccctaacatccctgctgcgagacccgcaggctgtggaatctcgcacgtcacctggccccagcagggcggccagctgaggggttgattttattttatttttttgaagtaaaggctgaatctcggcttcagggcttttgccaacgtctccactgacaggaaccagcaaacttcaggacccaaatgagcatcttaatttattgatgctaaacaggtctggttgttgtccccaattttccgcgcgctctgccactcccccccccacacaccccgccccaacccccgccgccagcttcggtccctgcatttgatctccaggaagggccccgctgcacaggcggaggagcgcgtcgcgggggggggcggtgttcggccccctcccaccagaccgccctcccccagacctgtccccgcccgggatcctgcgacccccgcccgccgcccggtcagctgacctggctcgctcgcctgctccccgcccgccgccctgtttccggtccccggggtccgcgagccgcgctccgagcgggcgcagccgcggccgggaggtgatgccgggggctgattaccatgagaaaggctgtgcctggaaaagcctcctccacgcgactgtcaatctcactaaggcttggggggcggggagcggggggggggacggaaaggggccctgtaggagtcaccagaaaacttggagtaagttggatgcgacgcaggcccgaggaggtggctttcgcctcaacttggaaggctggggcgttgagggcgcgga

SEQ ID NO: 118302 - DNA, 26 bp, Homo sapiens
  misc_feature 1..26: note = chr2:145286967-145286993
  misc_feature 1..26: note = Hypo
  source 1..26: mol_type = genomic DNA
gccactgcacccggccagaaattatt

SEQ ID NO: 118303 - DNA, 188 bp, Homo sapiens; identical to SEQ ID NO: 85260
  misc_feature 1..188: note = chr2:145569755-145569943
  misc_feature 1..188: note = Hypo
  source 1..188: mol_type = genomic DNA

SEQ ID NO: 118304 - DNA, 36 bp, Homo sapiens; identical to SEQ ID NO: 85261
  misc_feature 1..36: note = chr2:146299343-146299379
  misc_feature 1..36: note = Hypo
  source 1..36: mol_type = genomic DNA

SEQ ID NO: 118305 - DNA, 84 bp, Homo sapiens; identical to SEQ ID NO: 85269
  misc_feature 1..84: note = chr2:148600063-148600147
  misc_feature 1..84: note = Hypo
  source 1..84: mol_type = genomic DNA

SEQ ID NO: 118306 - DNA, 62 bp, Homo sapiens; identical to SEQ ID NO: 85270
  misc_feature 1..62: note = chr2:148601287-148601349
  misc_feature 1..62: note = Hyper
  source 1..62: mol_type = genomic DNA

SEQ ID NO: 118307 - DNA, 160 bp, Homo sapiens; identical to SEQ ID NO: 85271
  misc_feature 1..160: note = chr2:148776716-148776876
  misc_feature 1..160: note = Hypo
  source 1..160: mol_type = genomic DNA

SEQ ID NO: 118308 - DNA, 113 bp, Homo sapiens; identical to SEQ ID NO: 85272
  misc_feature 1..113: note = chr2:148958934-148959047
  misc_feature 1..113: note = Hypo
  source 1..113: mol_type = genomic DNA

SEQ ID NO: 118309 - DNA, 267 bp, Homo sapiens; identical to SEQ ID NO: 85273
  misc_feature 1..267: note = chr2:149255724-149255991
  misc_feature 1..267: note = Hypo
  source 1..267: mol_type = genomic DNA

SEQ ID NO: 118310 - DNA, 86 bp, Homo sapiens; identical to SEQ ID NO: 85274
  misc_feature 1..86: note = chr2:149256171-149256257
  misc_feature 1..86: note = Hypo
  source 1..86: mol_type = genomic DNA

SEQ ID NO: 118311 - DNA, 30 bp, Homo sapiens; identical to SEQ ID NO: 85275
  misc_feature 1..30: note = chr2:149309923-149309953
  misc_feature 1..30: note = Hypo
  source 1..30: mol_type = genomic DNA

SEQ ID NO: 118312 - DNA, 103 bp, Homo sapiens; identical to SEQ ID NO: 85276
  misc_feature 1..103: note = chr2:149514585-149514688
  misc_feature 1..103: note = Hypo
  source 1..103: mol_type = genomic DNA

SEQ ID NO: 118313 - DNA, 1504 bp, Homo sapiens
  misc_feature 1..1504: note = chr2:149632642-149634146
  misc_feature 1..1504: note = Hyper
  source 1..1504: mol_type = genomic DNA
atcctgtccttcccccggcaggtagagtgactacaagtcccgggatgcgcagcgctcggagtcgggcgggggccgggcggacctctacggtgacgtcaccgtcccggggcgggccaggggagggcggggcggaggggcgggtctcaaggcggcagagcgcgctggtgctgatgcaggatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcggggtaagtggctggggcgtctgccttccctgctgctccgcgccgcagctgggcgccccgacgccccagacgcagcggaggtgtttaggccgccccctcggacattcccgcggggctggcctctcgggtggacctgaccagagacccctcgccccgcgcactatggttccctcccgggcgggtggagaggcggccgggagcggcgggccgggcgggggtggcgggggtggggatggggggcgaagacgggctcggcgccgccattgttcgccgggtgggggcccgggtgggcccattgttccccacgctcgcctcgccgcgtgggtagtgtgttcgggtgaccctcaagccgggtgcccaggccccctttaaagtgtgagctctgcaacccgcaaatgcttctgggcatcaatcaattcgatttaccaaacgccttgcctcttcttctcacgaccctagcaaaaaagaaagaaaaaggggtacaggaaaatttctagtcgcgtctcggagctcccgcggcagtgtagacgcggctccccgcggtgttacacctggctccgcgcgcggaaggcggagggttgggggagtactggtggcctcggtgtcccctggaggcctggtgtgtctcccgcttcctctcacgcctggctgccctggatgtggagtcccggcttgatccctcccctctgggatgacctccctcccatgtctgcagaccctctgatgcgcctcacgctgggtggagaggaggctgtgtccacatctgtggggcgagggggctcagagcgcagtagccccctgtgccaagagcagaagttacttcgtgcggctcggacc

SEQ ID NO: 118314 - DNA, 491 bp, Homo sapiens
  misc_feature 1..491: note = chr2:149645496-149645987
  misc_feature 1..491: note = Hyper
  source 1..491: mol_type = genomic DNA
aggctggaccctccccgcccctatcactaccccttacccccgcagcaagggctgcgaccccgcgggtccccgctgagcaccgcagcaattaagtacgtgcaagccatttgcggcagcgggtttgagatgcgttcgtagtgggtgacattgagaacccccagaggcgacacgggcgcctggtctctgagaggtggcatgctgcctgccgccctggtgcctggctgccccggaaggggcccccagtcgccggccccgggaaggtgctccaggctcgcggctcctcgggggtcgcctctgcaggcggcctgtttccaatttccaggcgaggagcgacgccgtgatgcaaatctgccacttaccttctgtcaccattctgtcgctaacgctaggaatgatgaaacctcctgttctggaaatgcatttccctttagcaccagcgccttctaatgaggtccctctgccccgcaggacaaaagcgcccattagggggc

SEQ ID NO: 118315 - DNA, 137 bp, Homo sapiens; identical to SEQ ID NO: 85282
  misc_feature 1..137: note = chr2:150186851-150186988
  misc_feature 1..137: note = Hyper
  source 1..137: mol_type = genomic DNA

SEQ ID NO: 118316 - DNA, 30 bp, Homo sapiens; identical to SEQ ID NO: 85283
  misc_feature 1..30: note = chr2:150394715-150394745
  misc_feature 1..30: note = Hypo
  source 1..30: mol_type = genomic DNA

SEQ ID NO: 118317 - DNA, 39 bp, Homo sapiens; identical to SEQ ID NO: 85284
  misc_feature 1..39: note = chr2:150422336-150422375
  misc_feature 1..39: note = Hypo
  source 1..39: mol_type = genomic DNA

SEQ ID NO: 118318 - DNA, 41 bp, Homo sapiens; identical to SEQ ID NO: 85285
  misc_feature 1..41: note = chr2:150706992-150707033
  misc_feature 1..41: note = Hypo
  source 1..41: mol_type = genomic DNA

SEQ ID NO: 118319 - DNA, 30 bp, Homo sapiens; identical to SEQ ID NO: 85286
  misc_feature 1..30: note = chr2:151342707-151342737
  misc_feature 1..30: note = Hyper
  source 1..30: mol_type = genomic DNA

SEQ ID NO: 118320 - DNA, 52 bp, Homo sapiens; identical to SEQ ID NO: 85287
  misc_feature 1..52: note = chr2:151343072-151343124
  misc_feature 1..52: note = Hyper
  source 1..52: mol_type = genomic DNA

SEQ ID NO: 118321 - DNA, 47 bp, Homo sapiens; identical to SEQ ID NO: 85288
  misc_feature 1..47: note = chr2:151343590-151343637
  misc_feature 1..47: note = Hyper
  source 1..47: mol_type = genomic DNA

SEQ ID NO: 118322 - DNA, 172 bp, Homo sapiens; identical to SEQ ID NO: 85289
  misc_feature 1..172: note = chr2:151795349-151795521
  misc_feature 1..172: note = Hypo
  source 1..172: mol_type = genomic DNA

SEQ ID NO: 118323 - DNA, 58 bp, Homo sapiens; identical to SEQ ID NO: 85290
  misc_feature 1..58: note = chr2:152118660-152118718
  misc_feature 1..58: note = Hyper
  source 1..58: mol_type = genomic DNA

SEQ ID NO: 118324 - DNA, 30 bp, Homo sapiens; identical to SEQ ID NO: 85291
  misc_feature 1..30: note = chr2:152234018-152234048
  misc_feature 1..30: note = Hypo
  source 1..30: mol_type = genomic DNA

SEQ ID NO: 118325 - DNA, 79 bp, Homo sapiens; identical to SEQ ID NO: 39697
  misc_feature 1..79: note = chr2:152266023-152266102
  misc_feature 1..79: note = Hypo
  source 1..79: mol_type = genomic DNA

SEQ ID NO: 118326 - DNA, 708 bp, Homo sapiens; identical to SEQ ID NO: 85293
  misc_feature 1..708: note = chr2:152954512-152955220
  misc_feature 1..708: note = Hyper
  source 1..708: mol_type = genomic DNA

SEQ ID NO: 118327 - DNA, 42 bp, Homo sapiens; identical to SEQ ID NO: 85294
  misc_feature 1..42: note = chr2:152955741-152955783
  misc_feature 1..42: note = Hyper
  source 1..42: mol_type = genomic DNA

SEQ ID NO: 118328 - DNA, 32 bp, Homo sapiens; identical to SEQ ID NO: 27565
  misc_feature 1..32: note = chr2:152956018-152956050
  misc_feature 1..32: note = Hyper
  source 1..32: mol_type = genomic DNA

SEQ ID NO: 118329 - DNA, 29 bp, Homo sapiens
  misc_feature 1..29: note = chr2:153044296-153044325
  misc_feature 1..29: note = Hypo
  source 1..29: mol_type = genomic DNA
tgagccaccgtgcccggccggatatgttt

SEQ ID NO: 118330 - DNA, 30 bp, Homo sapiens; identical to SEQ ID NO: 85297
  misc_feature 1..30: note = chr2:153192735-153192765
  misc_feature 1..30: note = Hyper
  source 1..30: mol_type = genomic DNA

SEQ ID NO: 118331 - DNA, 133 bp, Homo sapiens; identical to SEQ ID NO: 85298
  misc_feature 1..133: note = chr2:154079386-154079519
  misc_feature 1..133: note = Hypo
  source 1..133: mol_type = genomic DNA

SEQ ID NO: 118332 - DNA, 2355 bp, Homo sapiens
  misc_feature 1..2355: note = chr2:154333308-154335663
  misc_feature 1..2355: note = Hyper
  source 1..2355: mol_type = genomic DNA
cctagggagcattaacgtcactaacgtcactgtgtaccttagcagctacttttcctcgcattttataattccccttccctccgccccccggccccacccgtgggcagcatcccaaagccgcctggctgacgttggttagggtagagacgccctccctaaaggctgtccaagccgtctcttcctttcattagcggtgtaatcctgtgttcccgccggagcctggcacggaagtgtaatcttcccgcgggggcccttctgtcgtctcgcctacctgagagctgagactaaatgaaatataaaatattcacgataagaggaaacaaaggatgctgcctccaggacggctactgtgcctgaggctgggctccttctcagtcatcccagggcctctccgtctggccccaccctcgcccctccaggggatccacaagttgaatcgcagctctccagggttaattgccctggccgggagccagactcctcaccgccgccccgttcccccctgctggggagcgcagaatgaccaccaggaggccaggaacaaaacgcttaaatgttgcatttattaaggaaatgttaaataagaaaaaaacaaaaagtcaaaacggtgtcacggatgtcaagagcacttttgtggcgtaaaccgtgcagtcacgagctacgagttctattctgggtctttgtcccagggccagcaggaacgctagacgcctcccaaaagacccagtgggaaatgcactaaaagaaacaactcaccccgttcaaattcgcaggctccccctccccccaccccttctcccacaatgacaaaactgtaactcctcaggcaggcaaacaggccactggggcagaaaaagacttatcaaacatttgtattcaagcaaacaaacacaaaacctcttaaaacggcacgttacaatcaaaggtatttatcgcccctcccctccagggcagggggggagcaggagaagagtgggagcgcacccggacacggatttgtgagaccccatgagtctgctgcgtggcttttaacaggtcactcttccggtcacaaggcgatcagtgccgctgggtctctcccctgcccgccctctccacctgcccccagagcttggcccacctgcgggtggagaagggccttcgcaccgtcggtctccccgcattccaagtaagtagcagcttccaaagttctgcgccctaatcgccctcttcttgccactttctgctgagttcagagtctgggcgctctcctccgactgccaggcatgaggactttcagagggcgagggagaaaccggtcgcttctttccgaaaggccgaagtcgagagaaataattgactccgacaggtttgcttcgcccagtctctgatagtgaggggcacagccgggctagcaaagtgggcaggcgtgggagcggttgccgcgggggcagagggcgggtcagtagggccccacgaccaccgcctccacctccttagacggcctccggtccttcacgaggaagttgatcatgccctcggacttgatgagcagattgcagccgaggaagaagatgccgaagaccacggtgagtgagagcacgcacatgaccgcgatctgcaccacgcgcattatgtacaggctacgctcgtccgggcctccctccgcgaagccgtcgtcggtcaccacggacgcctgggtgcagcagcgcacggctcgctccagcgcctcgctgctgttggccaggaacaggcccgccacgtccgtctggttgcctagggccggattcatcgcaggaacgggcgggcgccgcgagcggcgcgggtccgaggggtgggaaggcggcggcgctggaggaacaggtgccgggctgagcgctcactcgcagactagcgcgtgcgagggctcctcgctctgctttcgaaagtccctgggccgtgggagtttcccaggagcctctccgacgcgcgcagcagctaggctcttctaaagccgtccgctccagccctggtggtgctcgttcccggcgctcgctcgagggggggctgttggaacttggcggggctggaccagcccggccgtgggaggtgcgggccgcggcggctgcagcggcggggtggctgcgctgagcaaacagcggccccttccggccgcaccgccgcgctgcgcgctgctcttgggaggtggaggaagcaaaggggcgaacctggtcttgctttttattgcttgcttcttttgcaaactccaaaggccaggcagaggtcactgtactcttctagcttgatggatgattaaagagtttgtcgggggagggtgcggtcagctgaaagtttcagaggaactgggacacacgagctctgcgtgtcctttgcctg

SEQ ID NO: 118333 - DNA, 563 bp, Homo sapiens
  misc_feature 1..563: note = chr2:154727902-154728465
  misc_feature 1..563: note = Hyper
  source 1..563: mol_type = genomic DNA
cctccgtcctttctgcggagggcgccgaagcgtcaagtaccccgcagcatctctcggctggagagccgacggcaagggtggggttgccggcgctttccccgagggcagtctctgatcctccagctcccctctaagaggctccctggtgcattgggcgaacgcggtgcacgcaggccggctttggcgttgtggggccccaaagcggccaggggtcgcgaggcgccctccggcgagaggagctgaccccagggttgctcttgggggccgtgcctgccaagtatcgcgggacttgcgcacatcgcagaagcgccagctccagaagcagctggagcgcgctcggtgcgcaccgccccagcccggggaggagcgggagcagggagggaggagggctgggggtgctggttacgtaaatgatactagcccagtgagaggcctccaggctggggctacgagaggaggagggaccacgcgaggaggagggaccgggaggcggcgggctggggtgggaggggggcgggggccggggagaagtgaccaggcggcggcggctctgctgaggtgac

SEQ ID NO: 118334 - DNA, 382 bp, Homo sapiens
  misc_feature 1..382: note = chr2:154728885-154729267
  misc_feature 1..382: note = Hyper
  source 1..382: mol_type = genomic DNA
agagtgccggggctaggtgccgcaaagtcccgcggcgagtgccggggcgcggagccgagcgccccgggccggtcccagggcaaaggcaggggcgcgggcggacctggcgacgcggcctcccgggagctccgagtgcgctcgcttgcggggctgcaggtgttgcgggaggaccgcgtggcgcggaactttctgccgccgcccaccttctgctctgcttttctggctaccccggtgagttgttggtggcgggggggggggggggagcggctctggccccctctgcgttctggtgacgttcctccgcgggggtggctcggcctccaagcccagacaactttctcgcaccagctgcaggcagccccggctgcgttgcgggcgtttc

SEQ ID NO: 118335 - DNA, 540 bp, Homo sapiens; identical to SEQ ID NO: 85306
  misc_feature 1..540: note = chr2:154729521-154730061
  misc_feature 1..540: note = Hyper
  source 1..540: mol_type = genomic DNA

SEQ ID NO: 118336 - DNA, 30 bp, Homo sapiens; identical to SEQ ID NO: 85307
  misc_feature 1..30: note = chr2:154870172-154870202
  misc_feature 1..30: note = Hypo
  source 1..30: mol_type = genomic DNA

SEQ ID NO: 118337 - DNA, 349 bp, Homo sapiens; identical to SEQ ID NO: 85308
  misc_feature 1..349: note = chr2:155555158-155555507
  misc_feature 1..349: note = Hyper
  source 1..349: mol_type = genomic DNA

SEQ ID NO: 118338 - DNA, 2018 bp, Homo sapiens
  misc_feature 1..2018: note = chr2:157176340-157178358
  misc_feature 1..2018: note = Hyper
  source 1..2018: mol_type = genomic DNA
gtagagaagaaggagcgctcccagccgcgggaagataagcgtacaggcggccccaaggcccctacaggcgcagccctgatctggccacttgactagacgctcgctccagcgctcgcaggcctagggctcattacatgcgttgcgaggagacctgaaagcagggcgggaacgcacaatctatcttcagagctttgggtcgtgagcacacgtgtggagcatggttgtggcatgggcgtctgggcccctctcctagacctccacgaggtgcggacgcgcctctgccccgcccttttgtgcgccctcaccactagaaaaagagttttccccagtgtcgcgtgggaggtcgccccagtccagctcagcgttccaagagaccagagactgaccggaaatcgttgggtgcagggagaagcaggagacgcgctccgcctcctgtgctcgtgccctagcgcaacagacgcgacctagaggcgacggcagcctgttgcagccttcgccctgagggtggggggcgggggggtgtagaacagctgaggaagacgcagggagcagctggggaggaaagggagggacaccgaggaaacaaagttcacccaagtgaatgcgtcctaattgctccaaggctctctccgcaaagtctacgactgcaagccgcaaagtcaaactacgtctccaaaacgcagtgggcagagcaggagggcttgtgtctccattttcgccgcagggcggatcgcggacacaagtcctctccagtaattccgaagcctcgaaataagactatgctgggaggaggggttggggggtgactaataagaaggcgtgggggtgggggtggggagtacgcggcaagaaccctgctttctggaattctcccgccactgtctgcagggcccagagcgcacttcgcggctagggaacaaaattgccgctctcttcgagcgcccccagcgtggggtggggccctgctttcccgcgtcaggaccgccccaccaggcgccctccgacggaagctggacttttcctaaggaaaggcaaagtcaaagtcggaggaaagatctttcttgcggccccagctgtcgctcctaatggtctcggggaacatactaaaggaaaatgactttaaatcacagtcttgccatcctaaatagttatgtgcaatattttggtttctagcaaaatttaaaagtaaaatggggatttccatatgttcattttattattaaaaacgaattactaaaaagtgatgacctgtttggaattcatatcttgctttacgagcagtcagccagtatcgactgaacacaataaatgcaggggtgcgaaacgtgattgctcgggttcgagttctgtcggatgcaccgatctaagcagaacctttcccgaagacttggaattgggtgcgcttttttttttaagttgtggctgagccctatggggaagaagggttaactgggcgtcggctgagaccccaaaccctcttcctcctccatgagactccaaaattgagtcagtcccagcccatagttgcctgggaagcttggaatcctgagaaattccggggtgcggccactatgcaagcattcctattctgacagcggggacaaatggagaggggaccttacaacctcctttggagaagaatatatgagaaactcacttccagacctctattcaatagtgaaaataatactgagaaaaagttttaaaatctccaagaatagatactctcctttccccttccaccttgagggaaacggtctccatttttgacctggatttgagagcatcggggcttgagacaagcgcgtcttccacagagagaggcgaggcccaggcagggagccccccagcctttactctcggcacctcggcgctgccgcgcggcggatacaaaaggaaacggacgagcgtgcgacgcgaggcggggaactggtggctcgaagacgcgcaacacgcgcgatgcctagaagtgctctggtgtcactcccctgtataggacctggcgagatggaattgta

SEQ ID NO: 118339 - DNA, 201 bp, Homo sapiens; identical to SEQ ID NO: 85312
  misc_feature 1..201: note = chr2:157178715-157178916
  misc_feature 1..201: note = Hyper
  source 1..201: mol_type = genomic DNA

SEQ ID NO: 118340 - DNA, 82 bp, Homo sapiens; identical to SEQ ID NO: 85313
  misc_feature 1..82: note = chr2:158454042-158454124
  misc_feature 1..82: note = Hyper
  source 1..82: mol_type = genomic DNA

SEQ ID NO: 118341 - DNA, 48 bp, Homo sapiens; identical to SEQ ID NO: 85316
  misc_feature 1..48: note = chr2:159744614-159744662
  misc_feature 1..48: note = Hypo
  source 1..48: mol_type = genomic DNA

SEQ ID NO: 118342 - DNA, 226 bp, Homo sapiens; identical to SEQ ID NO: 85317
  misc_feature 1..226: note = chr2:159825736-159825962
  misc_feature 1..226: note = Hyper
  source 1..226: mol_type = genomic DNA

SEQ ID NO: 118343 - DNA, 30 bp, Homo sapiens; identical to SEQ ID NO: 85319
  misc_feature 1..30: note = chr2:159964688-159964718
  misc_feature 1..30: note = Hypo
  source 1..30: mol_type = genomic DNA

SEQ ID NO: 118344 - DNA, 33 bp, Homo sapiens; identical to SEQ ID NO: 85320
  misc_feature 1..33: note = chr2:160141926-160141959
  misc_feature 1..33: note = Hypo
  source 1..33: mol_type = genomic DNA

SEQ ID NO: 118345 - DNA, 737 bp, Homo sapiens
  misc_feature 1..737: note = chr2:160760635-160761372
  misc_feature 1..737: note = Hyper
  source 1..737: mol_type = genomic DNA
gtggggaatccttggcgctgtgggtggaggctcctcttggccctgtggccaaggtgaccaagggccgaaggaaaagcgagaacgggagggacgggacgcaagagggcagatggggaaccccatactccagcaacattatataagagaggcgacgatggagcagcgcacccggccaaaaaagcctccgtgcgcctactctacggtgcaccgcgtcccctctgcaccagaagggccctgtcctcccacatccaccgcgccctcctccgggcccccgagggcactggggcgcttcctctgccagacctcccctgcgactcactcttccggctccagagcccccccgccccaacagcaaagcagccgtgacctgccccaggggcgcagccctgccccaggctggaaggcagcagagctgtggcgtcgaggcacccagcggactgcggggctggcgtgcccgcggttacctgcgcggccagagggctccgcgagatcgaagaaccagaagagcagcatgaggagccccgccgggcggcgaggggtcgcccagcctgtcctcatcctgagctggcgcaagccttccggccgggtcctcgggcgcacgcggctcccgccccgcctgctgagcgcggcctgccccgcccgcacctctgtctaggcctctgggggcgccccggccccgcccccgccgccctcggccaatcagacgtgcgtctcctcggccccggggcggagcgggc

SEQ ID NO: 118346 - DNA, 487 bp, Homo sapiens; identical to SEQ ID NO: 85326
  misc_feature 1..487: note = chr2:160918575-160919062
  misc_feature 1..487: note = Hyper
  source 1..487: mol_type = genomic DNA

SEQ ID NO: 118347 - DNA, 83 bp, Homo sapiens; identical to SEQ ID NO: 85327
  misc_feature 1..83: note = chr2:160919402-160919485
  misc_feature 1..83: note = Hyper
  source 1..83: mol_type = genomic DNA

SEQ ID NO: 118348 - DNA, 151 bp, Homo sapiens; identical to SEQ ID NO: 85328
  misc_feature 1..151: note = chr2:161253372-161253523
  misc_feature 1..151: note = Hypo
  source 1..151: mol_type = genomic DNA

SEQ ID NO: 118349 - DNA, 174 bp, Homo sapiens; identical to SEQ ID NO: 85329
  misc_feature 1..174: note = chr2:161264166-161264340
  misc_feature 1..174: note = Hyper
  source 1..174: mol_type = genomic DNA

SEQ ID NO: 118350 - DNA, 217 bp, Homo sapiens; identical to SEQ ID NO: 85330
  misc_feature 1..217: note = chr2:161264622-161264839
  misc_feature 1..217: note = Hyper
  source 1..217: mol_type = genomic DNA

SEQ ID NO: 118351 - DNA, 30 bp, Homo sapiens; identical to SEQ ID NO: 85331
  misc_feature 1..30: note = chr2:161349208-161349238
  misc_feature 1..30: note = Hyper
  source 1..30: mol_type = genomic DNA

SEQ ID NO: 118352 - DNA, 51 bp, Homo sapiens; identical to SEQ ID NO: 85332
  misc_feature 1..51: note = chr2:161350175-161350226
  misc_feature 1..51: note = Hyper
  source 1..51: mol_type = genomic DNA

SEQ ID NO: 118353 - DNA, 45 bp, Homo sapiens; identical to SEQ ID NO: 85333
  misc_feature 1..45: note = chr2:161560571-161560616
  misc_feature 1..45: note = Hyper
  source 1..45: mol_type = genomic DNA

SEQ ID NO: 118354 - DNA, 85 bp, Homo sapiens; identical to SEQ ID NO: 85334
  misc_feature 1..85: note = chr2:161987588-161987673
  misc_feature 1..85: note = Hypo
  source 1..85: mol_type = genomic DNA

SEQ ID NO: 118355 - DNA, 30 bp, Homo sapiens; identical to SEQ ID NO: 39698
  misc_feature 1..30: note = chr2:162087925-162087955
  misc_feature 1..30: note = Hypo
  source 1..30: mol_type = genomic DNA

SEQ ID NO: 118356 - DNA, 66 bp, Homo sapiens; identical to SEQ ID NO: 85336
  misc_feature 1..66: note = chr2:162094291-162094357
  misc_feature 1..66: note = Hyper
  source 1..66: mol_type = genomic DNA

SEQ ID NO: 118357 - DNA, 245 bp, Homo sapiens; identical to SEQ ID NO: 85337
  misc_feature 1..245: note = chr2:162094615-162094860
  misc_feature 1..245: note = Hyper
  source 1..245: mol_type = genomic DNA

SEQ ID NO: 118358 - DNA, 81 bp, Homo sapiens; identical to SEQ ID NO: 85338
  misc_feature 1..81: note = chr2:162095165-162095246
  misc_feature 1..81: note = Hyper
  source 1..81: mol_type = genomic DNA

SEQ ID NO: 118359 - DNA, 186 bp, Homo sapiens; identical to SEQ ID NO: 85339
  misc_feature 1..186: note = chr2:162095461-162095647
  misc_feature 1..186: note = Hyper
  source 1..186: mol_type = genomic DNA

SEQ ID NO: 118360 - DNA, 40 bp, Homo sapiens; identical to SEQ ID NO: 39699
  misc_feature 1..40: note = chr2:162166372-162166412
  misc_feature 1..40: note = Hypo
  source 1..40: mol_type = genomic DNA

SEQ ID NO: 118361 - DNA, 55 bp, Homo sapiens; identical to SEQ ID NO: 85342
  misc_feature 1..55: note = chr2:162271455-162271510
  misc_feature 1..55: note = Hyper
  source 1..55: mol_type = genomic DNA

SEQ ID NO: 118362 - DNA, 32 bp, Homo sapiens; identical to SEQ ID NO: 85343
  misc_feature 1..32: note = chr2:162272302-162272334
  misc_feature 1..32: note = Hyper
  source 1..32: mol_type = genomic DNA

SEQ ID NO: 118363 - DNA, 995 bp, Homo sapiens
  misc_feature 1..995: note = chr2:162273084-162274079
  misc_feature 1..995: note = Hyper
  source 1..995: mol_type = genomic DNA
ttaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggtaatactacatttttggctgccgctgctctaggcgcagccggggacaagtgcacctaggctgtgactgccgcggcagcgacgatttggggtcgggagcggagtggaaggcgccctagagttggctagttttggaaagggggaaagtggaagggataaccgccagggtgatgttggtgggggggaccccgttctaggaacatagtgggagagccagtcagtggccagaggaaggcaagaaaaaggaagagccctggccagcggctgggcgatgggagggacgcatcaacactggcatgcacggacaggtggagacgcaggtcgccaacctcgctctccacctgggcagtgataactgccaccttcccactccagctcacccgccgctctccctgatttgggttgcacttcttttcttctcccaccaccctttttctaatccagcaaatattcgcctatttgctgca

SEQ ID NO: 118364 - DNA, 138 bp, Homo sapiens; identical to SEQ ID NO: 85346
  misc_feature 1..138: note = chr2:162274300-162274438
  misc_feature 1..138: note = Hyper
  source 1..138: mol_type = genomic DNA

SEQ ID NO: 118365 - DNA, 970 bp, Homo sapiens
  misc_feature 1..970: note = chr2:162274832-162275802
  misc_feature 1..970: note = Hyper
  source 1..970: mol_type = genomic DNA
ggtcagtggctcaagcgctcgtgttttctctctctctcaccccttcctccctgacatccagttcgtcagtgtaaagcagcatatggaactggatacacgtttctttgcttcattaaaaagacttaaaaattgtatttccaccctccaaatttatattaaatctgtaaagttgttctcattggcaacacctccgtcggcccaattttggagtgcccgaccttcccaagtactaatactgattgattttgagaagaaaccccacaagatctgcaggttgtggaaatctttgttcctccttacaggaggactaggagaagggccctgaggatcgggcggtcggcttcccccttttttccggtgccccggcttatcttcgctcccagaggtgcgaaagccggtctgccccagccagccagccgccagccaggcgagtcccgcggtcagttagcctggaaggcgggctgcaggctgcctccgccggcccgggcgcgcagccgggcgcacacagccacgcgcacagcgaccgcgttaacacgccacccggcgctcccctttcttcccgccggacagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatgtaaggagacctaggggctgggggcgaggcgggcggcacagacatctctcccaccctctcacattctcccgccatgcaaggctagggtactagcagcgctaacatcagcaacagctggctccgctgtgcgttttaaggcttagggctcggggcctgcccacggcacctttcctaaataccaagccggtgggaaaaagctttctatttgttttcgtcgctggtcacccgggccacctttgag

SEQ ID NO: 118366 - DNA, 1221 bp, Homo sapiens
  misc_feature 1..1221: note = chr2:162279820-162281041
  misc_feature 1..1221: note = Hyper
  source 1..1221: mol_type = genomic DNA
accccaagggacctccgcgccacccctcggctctctctctctctctccctaccccgcaggatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacc

SEQ ID NO: 118367 - DNA, 30 bp, Homo sapiens; identical to SEQ ID NO: 85353
  misc_feature 1..30: note = chr2:162282190-162282220
  misc_feature 1..30: note = Hyper
  source 1..30: mol_type = genomic DNA

SEQ ID NO: 118368 - DNA, 30 bp, Homo sapiens; identical to SEQ ID NO: 27591
  misc_feature 1..30: note = chr2:162282450-162282480
  misc_feature 1..30: note = Hyper
  source 1..30: mol_type = genomic DNA

SEQ ID NO: 118369 - DNA, 738 bp, Homo sapiens
  misc_feature 1..738: note = chr2:162283365-162284103
  misc_feature 1..738: note = Hyper
  source 1..738: mol_type = genomic DNA
attaaaatgaaaattcgtgggaggataaaactaacttgccttccctggacaattccgccactagacggcgttccgtggagttttgtctgccacataaaaaagcgaggactgaatttcctttgtgtttctttcccctcctcacatctaagaactaagtaagaggacaaaagtacaagacacggtgcatgtgtggcgagtgaagtggagcagtgcattcgtgtcatcacccacccgaccccggctgcgctcctccgaccccgccgcctactcccgccgaggaggaggagcacgtgcggtcggtggggcgcagggccggggagccaggggggtgccggggctcgaggccgcggggccgcgggggccgcgctctgctctccgcccaggctgggccactggagcgcgggagccctggagcccggcgctgcccggcgctacccgccgccctcgggacagtcaccgtgagcaaaagagtcggtgtcatgtgcgtaaacgaagctcttaggagccgaggatagatttcacaggaacgtagtgccttgttctgaaagacgcgctttggttgatattaggaagtatttttaaaaaattggggaggtcgtttcccttgcagctccgccaccatctgctgcgtggactgagtcagcgtgaggtaaatttgcagcttcgcgctcctctcggaggcattgtgctgtcttgtccctttaaaacatgatcatttctcctcgcttccaagaagtc

SEQ ID NO: 118370 - DNA, 255 bp, Homo sapiens
  misc_feature 1..255: note = chr2:162284325-162284580
  misc_feature 1..255: note = Hyper
  source 1..255: mol_type = genomic DNA
ttttcaaaaagaggacgaaagaagaagacgagcgtgcggctagcactgtattctggctcgtgtcttcccgccactcgcaatccgcgccatcttaactaactttcaatgtccctcggggctgagcgtgccggcggcgggtgctgctcgggctgggagatgctgcggcctgggttctcaaccttccgggtggacgccgcccgtcggggtagacagaggcgggaacaaagcgcgttgcggcggcgggaggcaggccgg

SEQ ID NO: 118371 - DNA, 32 bp, Homo sapiens; identical to SEQ ID NO: 85358
  misc_feature 1..32: note = chr2:162311722-162311754
  misc_feature 1..32: note = Hypo
  source 1..32: mol_type = genomic DNA

SEQ ID NO: 118372 - DNA, 463 bp, Homo sapiens
  misc_feature 1..463: note = chr2:162930196-162930659
  misc_feature 1..463: note = Hyper
  source 1..463: mol_type = genomic DNA
ttcagagcacattagcgttggtttctctacccctgcccgggttcgggcgtgcgttctgtgagtggctctccgggacattcaaagctcgacgccagggtcctagcagaagccagggtccgaaagctaagcgagagctctgggacgtcccttcacctgtcagagggtggccttggggcttccgcctaaggggagtccctggtccggtttcgccagcttttgggccatttggggagtttggcgaagaggtccccacagctcgccccggggacgtacgtggcgcggcactcaccttcatcgtcggcgtctcctcggaagtgagcgttcagagaaggagcgcaggcagaagtcaccgcgggcggcggagacgcgcgtcctgcaccgctgctccgggcggtggagtcactcgccgctggcaagtttcggccccgagttaaacattagtgagcgccgagcccgctgggta

SEQ ID NO: 118373 - DNA, 49 bp, Homo sapiens; identical to SEQ ID NO: 85362
  misc_feature 1..49: note = chr2:162930921-162930970
  misc_feature 1..49: note = Hyper
  source 1..49: mol_type = genomic DNA

SEQ ID NO: 118374 - DNA, 689 bp, Homo sapiens
  misc_feature 1..689: note = chr2:163694871-163695560
  misc_feature 1..689: note = Hyper
  source 1..689: mol_type = genomic DNA
tccccaccttggaagcggtggacgccaagtgcactaacaaggcagaaagcgagggcgagagaagagaacaaacgaacttactttgcccttcaaatttccgaatgatggtccccagaaatgtattttgtggtgccacatgccccctgcgcacaggcatgttggccccggtcttccgaggagcgctcccccggagctctggagttctcccgggatctctcctcggctagagcccaggccagcgcgcgagccgctctttgtggcagagcatcctcttttgaaaccagaattctcttcccattagcaccacttctagacacccgctttccccaccggagtccaatccattcccctcaccttccggagggggcctcgcaccggactgccgcgggtgagagggtttgggggtggggaacgggaaggaggcggggtgaggggaggtggcgggggagggaaagagggagggagctgtgggggtggggtgggaagggggcggggagtcacaagggcaatcgatctgtttctcttctcccaaacagcgccaatttcccagtgcaaatgggcttaacctggcggttgcccagagcagtaaggaatggctgaggggggatggaagacttgtgccggttttgctggaaggagagagagaaaaggaggctgggggtcggcggggttgacgtttctatccccgc

SEQ ID NO: 118375 - DNA, 224 bp, Homo sapiens; identical to SEQ ID NO: 85367
  misc_feature 1..224: note = chr2:164591881-164592105
  misc_feature 1..224: note = Hyper
  source 1..224: mol_type = genomic DNA

SEQ ID NO: 118376 - DNA, 783 bp, Homo sapiens
  misc_feature 1..783: note = chr2:164592629-164593412
  misc_feature 1..783: note = Hyper
  source 1..783: mol_type = genomic DNA
agagggagaaagagacggaggctgccgtgagggagagaagacgggaggcagtggcgagaggcgggcagtggagagagacgggcagcgggaggaccaggagggagagggagaggcgcacggagcccgcggagctggagggggagaaagggaggcgggaggcgagccggcgagcgagctagagacgcgccagagattcatgggcagggagggctcaatggccgcgccgcgccggccggccggccgctcgggtcatgttacacggccggggccgcggcggccgcccagcctcgccgatgcgctcacgcggcccggagggggccccgaggtcatgattacgcgcgcggggactcgcagctctccctgcacgcactctctggcggcccagcctggggaaaggggagcagcgccgtagggggaagggggctttctttcccacgcgtgaccagccggcccctgcgctccccggcctgcgttggagggcccgggacagagccgcgctgctccccggcccgcgggctcttccctgccggttcccggccctctcgacagctgcggcccgtccgcccttccccaccccctctgcgcacgggacgggatctggtctcgagagcctggacctcaccggcaccctccccggggcccccagcaccagccagaaaacgacttgatctgcttagaagaggcaacttcggggagaaaattcgcgttcgcccagttcccctcccccgcctccctgtgaataaataaaatcctaagtgtctaggtgtgcggtcccctctcgcg

SEQ ID NO: 118377 - DNA, 33 bp, Homo sapiens; identical to SEQ ID NO: 85371
  misc_feature 1..33: note = chr2:165477563-165477596
  misc_feature 1..33: note = Hyper
  source 1..33: mol_type = genomic DNA

SEQ ID NO: 118378 - DNA, 185 bp, Homo sapiens; identical to SEQ ID NO: 85372
  misc_feature 1..185: note = chr2:165478170-165478355
  misc_feature 1..185: note = Hyper
  source 1..185: mol_type = genomic DNA

SEQ ID NO: 118379 - DNA, 38 bp, Homo sapiens; identical to SEQ ID NO: 85373
  misc_feature 1..38: note = chr2:166650068-166650106
  misc_feature 1..38: note = Hyper
  source 1..38: mol_type = genomic DNA

SEQ ID NO: 118380 - DNA, 54 bp, Homo sapiens
  misc_feature 1..54: note = chr2:166650427-166650481
  misc_feature 1..54: note = Hyper
  source 1..54: mol_type = genomic DNA
gccctgtccccaacacgtgaacccctgcggccgtcctcccgcctgctctaacgc

SEQ ID NO: 118381 - DNA, 30 bp, Homo sapiens; identical to SEQ ID NO: 85377
  misc_feature 1..30: note = chr2:167232024-167232054
  misc_feature 1..30: note = Hyper
  source 1..30: mol_type = genomic DNA

SEQ ID NO: 118382 - DNA, 80 bp, Homo sapiens; identical to SEQ ID NO: 85378
  misc_feature 1..80: note = chr2:167232373-167232453
  misc_feature 1..80: note = Hyper
  source 1..80: mol_type = genomic DNA

SEQ ID NO: 118383 - DNA, 30 bp, Homo sapiens; identical to SEQ ID NO: 85379
  misc_feature 1..30: note = chr2:167232714-167232744
  misc_feature 1..30: note = Hyper
  source 1..30: mol_type = genomic DNA

SEQ ID NO: 118384 - DNA, 57 bp, Homo sapiens
  misc_feature 1..57: note = chr2:167233037-167233094
  misc_feature 1..57: note = Hyper
  source 1..57: mol_type = genomic DNA
ggctttgctcacaaccgcgagtggggcggtgacgctcaagaccggtatctaggctat

SEQ ID NO: 118385 - DNA, 293 bp, Homo sapiens; identical to SEQ ID NO: 85381
  misc_feature 1..293: note = chr2:168148971-168149264
  misc_feature 1..293: note = Hyper
  source 1..293: mol_type = genomic DNA

SEQ ID NO: 118386 - DNA, 53 bp, Homo sapiens; identical to SEQ ID NO: 27606
  misc_feature 1..53: note = chr2:168149503-168149556
  misc_feature 1..53: note = Hyper
  source 1..53: mol_type = genomic DNA

SEQ ID NO: 118387 - DNA, 1186 bp, Homo sapiens
  misc_feature 1..1186: note = chr2:168149776-168150962
  misc_feature 1..1186: note = Hyper
  source 1..1186: mol_type = genomic DNA
ggaccctggctgcagcgtccctgtggcccgcgcgccagcccagcggccggagaccacgcgccccgcgggtaaggttctgtccggcagcgcccgcgacgcccccgggacggctggcgtggtctttgggggttacgaggcgcgtggtggccggggcatcccgacgaaggtgttgggacccggactgcgtgtcccgacgctgggctgtgctactgcccgcgcccgtgcggctccagctggtgcgttctcccttccgcgctcacagactttgacagcgcggggatggcattgtgtgagtgtggatgtggatgcgtgtgtgcgcgcgcgcggcttggggcactttgcagcgagaacagtgggtcccctctgcgtggcccgacgtccttcaaggacccaagctgggctggagtgagtaggatgctgttggctcggcgggaggtagaacgcacggagcgcacgggaaagtccaccgtggctcgtaaagagccgagcaaattgaactttattgcggtgattaaaaggagctgtggacctggcgcgccaggggagaggcgcgttccacgaggctccccaaagtcccactttgccccggggacttcggaggggaagggaagagagggaaaagtaactgttggtccacattgctgaagaaaaggaggaaagagaagttgggggtgggggtgggggtggaggttactcttgggggagtggcgacttttaggtgtctgaagccccgcgtgggaggcttgctacacttttctggagcgcagacttgaggatggagagtcccactctgaggtactggtagcggctcctcctgcctggtggcggcgtagggcgcagcgggacagcttggtggaggcagagcggggctccgacgcccgacggcccggcgtccaggtggggccactgcctccccaggccgctttggcccgctgacctcccaggttgagacccggcctggtgcgcctctggcagctgccaaatgcctggcggctccgctttccgacaaagttcaggcccgctggggtctggtccatcagacctaggacacgttaaccacgcagagtaaccaggttagggtacccagctgcctccagagcgtttttgtttcatattagattatcttatttgataaagctgttgagagttccacccgtgctgcaaagccttccgcagaaggcgaatt

SEQ ID NO: 118388 - DNA, 35 bp, Homo sapiens; identical to SEQ ID NO: 85385
  misc_feature 1..35: note = chr2:168310888-168310923
  misc_feature 1..35: note = Hypo
  source 1..35: mol_type = genomic DNA

SEQ ID NO: 118389 - DNA, 33 bp, Homo sapiens; identical to SEQ ID NO: 85387
  misc_feature 1..33: note = chr2:169103498-169103531
  misc_feature 1..33: note = Hypo
  source 1..33: mol_type = genomic DNA

SEQ ID NO: 118390 - DNA, 63 bp, Homo sapiens; identical to SEQ ID NO: 85388
  misc_feature 1..63: note = chr2:169312818-169312881
  misc_feature 1..63: note = Hyper
  source 1..63: mol_type = genomic DNA

SEQ ID NO: 118391 - DNA, 30 bp, Homo sapiens; identical to SEQ ID NO: 85389
  misc_feature 1..30: note = chr2:169948461-169948491
  misc_feature 1..30: note = Hypo
  source 1..30: mol_type = genomic DNA

SEQ ID NO: 118392 - DNA, 502 bp, Homo sapiens; identical to SEQ ID NO: 85390
  misc_feature 1..502: note = chr2:170218359-170218861
  misc_feature 1..502: note = Hyper
  source 1..502: mol_type = genomic DNA

SEQ ID NO: 118393 - DNA, 429 bp, Homo sapiens; identical to SEQ ID NO: 85391
  misc_feature 1..429: note = chr2:170219129-170219558
  misc_feature 1..429: note = Hyper
  source 1..429: mol_type = genomic DNA

SEQ ID NO: 118394 - DNA, 648 bp, Homo sapiens; identical to SEQ ID NO: 85392
  misc_feature 1..648: note = chr2:170219911-170220559
  misc_feature 1..648: note = Hyper
  source 1..648: mol_type = genomic DNA

SEQ ID NO: 118395 - DNA, 105 bp, Homo sapiens; identical to SEQ ID NO: 39700
  misc_feature 1..105: note = chr2:170282975-170283080
  misc_feature 1..105: note = Hypo
  source 1..105: mol_type = genomic DNA

SEQ ID NO: 118396 - DNA, 34 bp, Homo sapiens; identical to SEQ ID NO: 27613
  misc_feature 1..34: note = chr2:170335909-170335943
  misc_feature 1..34: note = Hyper
  source 1..34: mol_type = genomic DNA

SEQ ID NO: 118397 - DNA, 300 bp, Homo sapiens; identical to SEQ ID NO: 85395
  misc_feature 1..300: note = chr2:170336157-170336457
  misc_feature 1..300: note = Hyper
  source 1..300: mol_type = genomic DNA

SEQ ID NO: 118398 - DNA, 134 bp, Homo sapiens; identical to SEQ ID NO: 85396
  misc_feature 1..134: note = chr2:170419323-170419457
  misc_feature 1..134: note = Hypo
  source 1..134: mol_type = genomic DNA

SEQ ID NO: 118399 - DNA, 164 bp, Homo sapiens; identical to SEQ ID NO: 39701
  misc_feature 1..164: note = chr2:170551729-170551893
  misc_feature 1..164: note = Hypo
  source 1..164: mol_type = genomic DNA

SEQ ID NO: 118400 - DNA, 30 bp, Homo sapiens; identical to SEQ ID NO: 85398
  misc_feature 1..30: note = chr2:170571327-170571357
  misc_feature 1..30: note = Hypo
  source 1..30: mol_type = genomic DNA

SEQ ID NO: 118401 - DNA, 30 bp, Homo sapiens; identical to SEQ ID NO: 39702
  misc_feature 1..30: note = chr2:170584782-170584812
  misc_feature 1..30: note = Hypo
  source 1..30: mol_type = genomic DNA

SEQ ID NO: 118402 - DNA, 197 bp, Homo sapiens; identical to SEQ ID NO: 85400
  misc_feature 1..197: note = chr2:170681712-170681909
  misc_feature 1..197: note = Hypo
  source 1..197: mol_type = genomic DNA

SEQ ID NO: 118403 - DNA, 180 bp, Homo sapiens; identical to SEQ ID NO: 85401
  misc_feature 1..180: note = chr2:170682149-170682329
  misc_feature 1..180: note = Hypo
  source 1..180: mol_type = genomic DNA

SEQ ID NO: 118404 - DNA, 30 bp, Homo sapiens; identical to SEQ ID NO: 85402
  misc_feature 1..30: note = chr2:170807951-170807981
  misc_feature 1..30: note = Hypo
  source 1..30: mol_type = genomic DNA

SEQ ID NO: 118405 - DNA, 84 bp, Homo sapiens; identical to SEQ ID NO: 85403
  misc_feature 1..84: note = chr2:170860076-170860160
  misc_feature 1..84: note = Hypo
  source 1..84: mol_type = genomic DNA

SEQ ID NO: 118406 - DNA, 380 bp, Homo sapiens; identical to SEQ ID NO: 85407
  misc_feature 1..380: note = chr2:171568331-171568711
  misc_feature 1..380: note = Hyper
  source 1..380: mol_type = genomic DNA

SEQ ID NO: 118407 - DNA, 30 bp, Homo sapiens; identical to SEQ ID NO: 85408
  misc_feature 1..30: note = chr2:171569116-171569146
  misc_feature 1..30: note = Hyper
  source 1..30: mol_type = genomic DNA

SEQ ID NO: 118408 - DNA, 30 bp, Homo sapiens; identical to SEQ ID NO: 85409
  misc_feature 1..30: note = chr2:171569757-171569787
  misc_feature 1..30: note = Hyper
  source 1..30: mol_type = genomic DNA

SEQ ID NO: 118409 - DNA, 910 bp, Homo sapiens
  misc_feature 1..910: note = chr2:171570047-171570957
  misc_feature 1..910: note = Hyper
  source 1..910: mol_type = genomic DNA
gggagaaggtgggcccggaggcatcgcatccccgacccctgatggaagtgcggagggcatccttatacagtccagattccgagtccgttgtagttaggctaacctctgacgctgcatcgggagataggtcaccccgtccgtcccggtcgcagtgcggttcccgtgaggaagacgggcagagaggccgggcgcgaactgattaggggctcccccacggccggcggcctggagagtggagactgtgtccgacgggaggtgggtgggggagaggagtaggccgagctccggcggccactccgcagtgcgctctcgcgagccggggccgcgaggcctccaacgcggttccgcacccctaatgccccagggcggtgagcaccccgcggttccccgcccgcctcttcctccttccccgcccgcgcgcccgggagaggcgatccccgcgtccgcagtgccggggcaggacgcgccctgcgccctgggccaggaggaggcaggtggccctcctcggcaggaggtgagccgccagggagggatgggggtcacccaagcccctgcaagcgcgaccctgcccagagcaaagcacgccccgcgcctggtgaggaactttttctttccaaaggtggcaggaacaagtctgtactgacttttctcccgccttcgggatcctctctcgtatgatttgtggtttgtgggaccacaacaaccaggcttcctcgaccgcgccttttttccagtagctcctggtctgccaggcttgcgagagggcgcgctggcttggcggggctccgggcgagaaatcaccagcagcgctggggctttcggccccccacagcccagcccgggcctcctgggtggcctggggagaagggggcgggacagcacagcttcttcccctcgggtgggcatgacg

SEQ ID NO: 118410 - DNA, 44 bp, Homo sapiens; identical to SEQ ID NO: 27618
  misc_feature 1..44: note = chr2:171571200-171571244
  misc_feature 1..44: note = Hyper
  source 1..44: mol_type = genomic DNA

SEQ ID NO: 118411 - DNA, 44 bp, Homo sapiens; identical to SEQ ID NO: 85414
  misc_feature 1..44: note = chr2:171571476-171571520
  misc_feature 1..44: note = Hyper
  source 1..44: mol_type = genomic DNA

SEQ ID NO: 118412 - DNA, 61 bp, Homo sapiens; identical to SEQ ID NO: 27619
  misc_feature 1..61: note = chr2:171571846-171571907
  misc_feature 1..61: note = Hyper
  source 1..61: mol_type = genomic DNA

SEQ ID NO: 118413 - DNA, 374 bp, Homo sapiens; identical to SEQ ID NO: 85416
  misc_feature 1..374: note = chr2:171572347-171572721
  misc_feature 1..374: note = Hyper
  source 1..374: mol_type = genomic DNA

SEQ ID NO: 118414 - DNA, 31 bp, Homo sapiens; identical to SEQ ID NO: 85417
  misc_feature 1..31: note = chr2:171624030-171624061
  misc_feature 1..31: note = Hypo
  source 1..31: mol_type = genomic DNA

SEQ ID NO: 118415 - DNA, 895 bp, Homo sapiens
  misc_feature 1..895: note = chr2:171669846-171670741
  misc_feature 1..895: note = Hyper
  source 1..895: mol_type = genomic DNA
aatggaccttagctccgacttaagcagaatgaaaggttaagtaacgcttcccccagttctcgtctcgggagacagacgtttaaccggtgagcactgccattttttttttcctttctggtcataaattagacacttaaaatagattttaaggagccagctgaaacgaaccaataccatggctctaaattacgtttcctggaggctaaaaattctaattgcgtcaaaaaaaattgacgtgtcctgtctactcaccttgactgaccacgttttaggcgtgaagatctccccgcagcccgtttgggcgctccttcaacgcctcacgctcctcctactcacccgtttttccctttgcagaaaaggcttggccccaaatccggttggaatatctttaaacaatcccccacccacccacgacggggaaaggaataaagggcattgtgggcggagggtcgtgttcccaagtcccagcggtggttgacctaaggaaacgttatcctcggcagacagggtggagtagccggggctgcaagctcgcaaatccctaatgccggagagagactggaggggtcgcatatcgccccctccttcttctgcctttgagcgccgcgttcccatttcttcaaagcgcttcaaatacaatcgaaacagctgggcggacaccactcccttccgggccacccctcatcaccggttcgagtccccggagaggatatcttttttccacccccattatcccaagaatcctcccccaggaatgataaaagattaaaggaagagtgaaagacataaacaaaaatataggtttcaaatgttgtttagagccgaatgacaaccacggccactcttagttcaaattcctaccggagagaagagcagtgggcgaaatacctcaccc

SEQ ID NO: 118416 - DNA, 672 bp, Homo sapiens
  misc_feature 1..672: note = chr2:171671306-171671978
  misc_feature 1..672: note = Hyper
  source 1..672: mol_type = genomic DNA
agattccttctccaacgagattatttcattggctaaaacgttaggggtgttttgaactctggggtcaaaggaggaagtggttggaaatgtctcaatctcgtgccacaggtgaagtaaacgaatcttcctttccagggaatcacgggttttgggaaaaggttgaggcgagcgggcgtctatgctggacaatgaagaacgaggggcaccgggagatgtgttgcctcctccttcctgtctcctgccccgtgcgtcttgaatgatttagcactggcacctggctccctgattggtgcgagcgtctcgtttagggaaggctctaggagggccggtggatggaattccgagcttcacctggttgtatgccgcccacttcaagcagcgcagagcagctgccggttgagtggtttggggggacgtttcctacgtggagcagacacccccagcctgtccagccccaagcctcagtgcccggggctgcagtcaccgcgcgccccgccgtttaggatgttttttgtgtccttaaaaagtgccggggatttcatcgtcaggtggagacaaggcgacaaaacagtagtttctttagtaccaaaggcaacgcgattatttcaaaccccacagcgagatccctcttgctgatcaggccatgtctgcccagggcggacccttcgatct

SEQ ID NO: 118417 - DNA, 238 bp, Homo sapiens; identical to SEQ ID NO: 85422
  misc_feature 1..238: note = chr2:171674091-171674329
  misc_feature 1..238: note = Hyper
  source 1..238: mol_type = genomic DNA

SEQ ID NO: 118418 - DNA, 967 bp, Homo sapiens
  misc_feature 1..967: note = chr2:171674698-171675665
  misc_feature 1..967: note = Hyper
  source 1..967: mol_type = genomic DNA
tcccccacacccttgcgtcttgtactggccttggacccccaccccgaccccgaccccgcctcgtctcggcgcttcactccaggtcgcgccgatgcaccgccagactcgagagcggcccagggctacgctccctgcgccccagtaccggagctagcgcgcacgtctcctccgctgcccccacccctgcgcacccctaccaggcaggctcgctgcctttcctccctcttgtctctccagagccggatcttcaaggggagcctccgtgcccccggctgctcagtccctccggtgtgcaggaccccggaagtcctccccgcacagctctcgcttctctttgcagcctgtttctgcgccggaccagtcgaggactctggacagtagaggccccgggacgaccgagctgatggcgtcttcgaccccatcttcgtccgcaacctcctcgaacgcgggagcggaccccaataccactaacctgcgccccacaagtaggtcccgccccaattttctatcaaatgaactgcagggaagatgggggcgctgggacgtcgggaggctgagctggcggaaagggaagggggagcgcggagataatggaggctgggaaataaatggggctctgaccccgtccctgccagaggtcattcggctgtcagggacgctaggtgactcccagggcaccggaaagcgaggaccacgcaaggtccgagcagcggcgatcgttgagggcttcgcggaggaggaggggcgcgcagccagggtgttgtttttattctgttgtgtgtggtttctttgctccgtgggacgacaggggtcagcgcagggggcggaatgaagagctaggagccccagcaggaataagagttttcagtccccggctttcgttgagccaagatctgacctcctcctttccccctgggctgtgttcaaagtctataatcagcggaaatttcgacgttaattgcagctt

SEQ ID NO: 118419 - DNA, 169 bp, Homo sapiens
  misc_feature 1..169: note = chr2:171676684-171676853
  misc_feature 1..169: note = Hyper
  source 1..169: mol_type = genomic DNA
ggggtggggggttagcgggcagttgtgttaatttgccctccactcccggcgcccttacggaattcccggtggccgccagtcgccggcgcaaatgccaagtcaccggtaggagacacaacagaggcgatgacctgaatccgcacgtggcctggttcgcctggaagctgcc

SEQ ID NO: 118420 - DNA, 30 bp, Homo sapiens; identical to SEQ ID NO: 85426
  misc_feature 1..30: note = chr2:171677372-171677402
  misc_feature 1..30: note = Hyper
  source 1..30: mol_type = genomic DNA

SEQ ID NO: 118421 - DNA, 399 bp, Homo sapiens
  misc_feature 1..399: note = chr2:171677989-171678388
  misc_feature 1..399: note = Hyper
  source 1..399: mol_type = genomic DNA
gtcttccccactccccggtctgactgaagagcagccatgcgagcccgatcatctagtcaaatactatttttcacccaattaattcttgaactcttccacgaccccatttcatgccagtttattttaagctgccactaggctggagacccgccaagaaattatgagacgtttcggtcccagatgcctgtgttccctttctgggctgctgtggtcgccctttgagtctgcggggcccggccagtgggtgttgggcagctcgatcggagcctggccctttgcgtgtgggtcagccttcacccaactccgaccccacctccggagctgccgggcgggggtcgcttacgggcccggaggggcgccgggtgccccgcctctcagagacaccgttccatatttgaa

SEQ ID NO: 118422 - DNA, 247 bp, Homo sapiens
  misc_feature 1..247: note = chr2:171678790-171679037
  misc_feature 1..247: note = Hyper
  source 1..247: mol_type = genomic DNA
gacagccagcgaccacgctcccctacaggccctgaccctcctctgcccgccccagacctggtccccaggggtcttttcctctggagtccccaatccccaacacccagtggagcgaacgccgggtgccctgcctgggcgcagaagcgggaggaaagcgcccccgcgcggcaaccccgccttcctagccctgcgcgcaagcagctcccacccggtgccgtgcactctgcctgcgcgtcccaaaggtcgc

SEQ ID NO: 118423 - DNA, 30 bp, Homo sapiens
  misc_feature 1..30: note = chr2:171680056-171680086
  misc_feature 1..30: note = Hyper
  source 1..30: mol_type = genomic DNA
ccagcgcaggacgcccgtggggcaaggcca

SEQ ID NO: 118424 - DNA, 21 bp, Homo sapiens
  misc_feature 1..21: note = chr2:171718764-171718785
  misc_feature 1..21: note = Hypo
  source 1..21: mol_type = genomic DNA
ccactgcgcccagcccatttt

SEQ ID NO: 118425 - DNA, 23 bp, Homo sapiens
  misc_feature 1..23: note = chr2:171769313-171769336
  misc_feature 1..23: note = Hypo
  source 1..23: mol_type = genomic DNA
catctaatcgctttggtaacttc

SEQ ID NO: 118426 - DNA, 58 bp, Homo sapiens; identical to SEQ ID NO: 85433
  misc_feature 1..58: note = chr2:171822509-171822567
  misc_feature 1..58: note = Hypo
  source 1..58: mol_type = genomic DNA

SEQ ID NO: 118427 - DNA, 120 bp, Homo sapiens; identical to SEQ ID NO: 85434
  misc_feature 1..120: note = chr2:171906270-171906390
  misc_feature 1..120: note = Hypo
  source 1..120: mol_type = genomic DNA

SEQ ID NO: 118428 - DNA, 35 bp, Homo sapiens; identical to SEQ ID NO: 85435
  misc_feature 1..35: note = chr2:172129409-172129444
  misc_feature 1..35: note = Hypo
  source 1..35: mol_type = genomic DNA

SEQ ID NO: 118429 - DNA, 74 bp, Homo sapiens; identical to SEQ ID NO: 14471
  misc_feature 1..74: note = chr2:172367021-172367095
  misc_feature 1..74: note = Hypo
  source 1..74: mol_type = genomic DNA

SEQ ID NO: 118430 - DNA, 28 bp, Homo sapiens
  misc_feature 1..28: note = chr2:172372678-172372706
  misc_feature 1..28: note = Hypo
  source 1..28: mol_type = genomic DNA
ttttttttttttaggcggagtttcactc

SEQ ID NO: 118431 - DNA, 146 bp, Homo sapiens; identical to SEQ ID NO: 85438
  misc_feature 1..146: note = chr2:172378945-172379091
  misc_feature 1..146: note = Hyper
  source 1..146: mol_type = genomic DNA

SEQ ID NO: 118432 - DNA, 191 bp, Homo sapiens; identical to SEQ ID NO: 85439
  misc_feature 1..191: note = chr2:172379532-172379723
  misc_feature 1..191: note = Hyper
  source 1..191: mol_type = genomic DNA

SEQ ID NO: 118433 - DNA, 44 bp, Homo sapiens; identical to SEQ ID NO: 85440
  misc_feature 1..44: note = chr2:172382315-172382359
  misc_feature 1..44: note = Hypo
  source 1..44: mol_type = genomic DNA

SEQ ID NO: 118434 - DNA, 30 bp, Homo sapiens; identical to SEQ ID NO: 85441
  misc_feature 1..30: note = chr2:172396680-172396710
  misc_feature 1..30: note = Hypo
  source 1..30: mol_type = genomic DNA

SEQ ID NO: 118435 - DNA, 41 bp, Homo sapiens; identical to SEQ ID NO: 39709
  misc_feature 1..41: note = chr2:172411125-172411166
  misc_feature 1..41: note = Hypo
  source 1..41: mol_type = genomic DNA

SEQ ID NO: 118436 - DNA, 30 bp, Homo sapiens; identical to SEQ ID NO: 85443
  misc_feature 1..30: note = chr2:172428262-172428292
  misc_feature 1..30: note = Hypo
  source 1..30: mol_type = genomic DNA

SEQ ID NO: 118437 - DNA, 43 bp, Homo sapiens; identical to SEQ ID NO: 27633
  misc_feature 1..43: note = chr2:172945124-172945167
  misc_feature 1..43: note = Hyper
  source 1..43: mol_type = genomic DNA

SEQ ID NO: 118438 - DNA, 387 bp, Homo sapiens; identical to SEQ ID NO: 85445
  misc_feature 1..387: note = chr2:172945896-172946283
  misc_feature 1..387: note = Hyper
  source 1..387: mol_type = genomic DNA

SEQ ID NO: 118439 - DNA, 30 bp, Homo sapiens; identical to SEQ ID NO: 27635
  misc_feature 1..30: note = chr2:172946606-172946636
  misc_feature 1..30: note = Hyper
  source 1..30: mol_type = genomic DNA

SEQ ID NO: 118440 - DNA, 30 bp, Homo sapiens; identical to SEQ ID NO: 85447
  misc_feature 1..30: note = chr2:172947265-172947295
  misc_feature 1..30: note = Hyper
  source 1..30: mol_type = genomic DNA

SEQ ID NO: 118441 - DNA, 720 bp, Homo sapiens
  misc_feature 1..720: note = chr2:172947773-172948493
  misc_feature 1..720: note = Hyper
  source 1..720: mol_type = genomic DNA
ggtcccctgtgctaccgcaaaagtctttgatccttttccagctgtggacacagagcacccaagagactgtcgcgatgtgcggccgtctctccccttcccccaccttgcaagtctctggaatacactgtccctaggcggcccggccgtcgggtttcctcacgccttgccctgagctccgggaattaccaattccgctttccccggtcccaaccccgaccccgcgcccgccgcggcgatcacttacttgggcaaggccctcagggcacgcgcgagagacctggggcccggcagtatccgagcgactgtgctgggcacacggcgtggcactccataccctaaaacaggcactaggaaggagcaattaaaaccacaagtgcgacacagaaatcaggacgagccgagcggctcccggagttgcctggtggcggaatcattagctggctgttgctacaaagcctcaccgtgtggttcggtgattaagaaaaaaaaaatcttttaaacgttggcaaacccgttattggtttggcgtattgggttttttttgcttttgcttttctttttgctccaaccactctgcctgaaatatttctgcccccagcattgtgcccttaaaccaaaggagaggaattctgcgggcagcagcagctggtacagaagttaaaaaaaaagagaaaccccctctactaatatctgtaacgacagcaccgatgtaatttgttt

SEQ ID NO: 118442 - DNA, 1343 bp, Homo sapiens
  misc_feature 1..1343: note = chr2:172948890-172950233
  misc_feature 1..1343: note = Hyper
  source 1..1343: mol_type = genomic DNA
taatttgggattcaccgtggggctggcgggatggggaaccaacatccacttacagccagggtggtgtacgccacaccgcgagggactggctgtattggtagtagtggcgatggggtgggggctcttgtgcacttttttgtacctagcaccccagaagacagaaggagcagcggcagatcttgcctccactagccctgccccctaggcctggtggcgcgcgctttggccactggaggtgaggaagatcctgggtggcaacgagagacgtctacacatagataagggagcctaccacaggcctgggtttgctgcgggtttcggtgtcccccagggactcctaaactctggaagtcgcgctagacctcaggaggccggaaaatgaccacctggcgtcggtggctccagcagatctgagcccctaggccccctgggctccacgctgagccgcgctctcggggcgagtgagcccggggctctccgcgcatggggagtggagaagggagggggaggaggaggaaggctgggagggaaagaggatgtgtgtgttgggggagggggcggtgcagccgcctttcctgggaggagaagcgcgggttcctggctctccacgcgcactgctttaatcagacccgtgcagcctcgagctggagtggccagctgggcctggagcaatgcgagcgggccccagggagcgacagcggcgttggcgcagcggccgagtgagtgagttcgcagggagggcccctaagccccgactccagggatgcggcagagcgtaccggggaggcgcggccggataggcgctgcgctaggcacaaggctcttaggagaacctctgtctgttggccgcctcgggcgcccccagtgcgcgactccgcgctccagaggcagaggtcagtctcctcctgagccgccctagctctgcgccgaactgagtggcagcgacgagaagcggtcccgggtgtccggtgttagggaccgctgaagggtggggacagtggtaggggggcggcggcgcggagccgctggttggttcctggggaggaaagcgcgcgagggaggcgggaggccgatgagccgcgggccgcaggggccccggcgcagacgccgcagcccattgtgcttcctgcccggcgcgctctgttgcagaggagccccggccgggaagtgtggatgcgtcttacccgaggccgggccgcctcgcccgctctagtccagcggagcccgagcgcctcggaccaatccccagtgattatgcaagacagcggaccaatcagctccgccagctcatgaatatttatgaccttcgctgagtcaaagctttgaaccgagtttggggagct

SEQ ID NO: 118443 - DNA, 30 bp, Homo sapiens; identical to SEQ ID NO: 85452
  misc_feature 1..30: note = chr2:172950463-172950493
  misc_feature 1..30: note = Hyper
  source 1..30: mol_type = genomic DNA

SEQ ID NO: 118444 - DNA, 558 bp, Homo sapiens
  misc_feature 1..558: note = chr2:172951115-172951673
  misc_feature 1..558: note = Hyper
  source 1..558: mol_type = genomic DNA
ttaaacctcaactaccgcctgcaaaaatagcaaactttccctgcaaaggcaggagctgagctcctgggaacggctctatccctcctgcagcgtcccgggacaggccctcggattttgggggacccttccctggctttcagagtttcttgaacgttctctccctggtgctgcctccgccacccttcggtagccactcgctctcggctgttcgcactaaaggcggcccctcgtattaacaacgggccctacttctgctgtccctccaggggcggactcggagaagagcacggtggtggaaggcggtgaagtgcgcttcaatggcaagggaaaaaagatccgtaaacccaggacgatttattccagtttgcagttgcaggctttgaaccggaggttccagcaaactcagtacctagctctgccggagagggcggagctcgcggcctctttgggactcacacagactcaggtacctcgccgctgccgctccgttctgccacgcaggctttccgcggccggcctgcgcccgggtcttcatttgttgctcgctgggactcaggg

SEQ ID NO: 118445 - DNA, 603 bp, Homo sapiens
  misc_feature 1..603: note = chr2:172951948-172952551
  misc_feature 1..603: note = Hyper
  source 1..603: mol_type = genomic DNA
ctcggggcctgggtccgcgcctcagcctccctcctcctcctccttcttaccggttgggggtggggggagatcctttcctccgccctctcacctctcaagtcccagaccttagagaagaaacgggaccttccttcccggctttctgtaagactccggggagcccgtgagcgttcctgacggcggcgggcgcgggtttccgacgtccggtccgggatttggagcagagctggagaaagcaaacagacactagtgcaagaatggttttgaatccaaagagaagttcagcaaaaccttgaggcctccttagtccgtcccaactcaagggcagaaaagatggcgcatagaaaagttgggtcgcgttgcaaataaatttcctccactccttcctaggttttcgattctttttattgatgttgatattggaattgctggctcggtgttatgcaggcgctgtatcttccgcaggcggtagccacggtcggactgagcccctggcaggctaaggcctggatcccggttctcccctcatcacaactcctccctggctctctgagagctgcccccgtgggctgacggcggcgggaggttcggccttcgagcctt

SEQ ID NO: 118446 - DNA, 295 bp, Homo sapiens
  misc_feature 1..295: note = chr2:172952776-172953071
  misc_feature 1..295: note = Hyper
  source 1..295: mol_type = genomic DNA
tgaagcagggtggggcggctctggagggtagtgcgttggccaacggtcgggccctgtctgctggctccccacccgtgccgcccggctggaaccctaactcttcatccgggaagggctcaggaggaaacgcgggctcctatatccccagctacacatcgtggtacccttcagcgcaccaagaagctatgcagcaaccccaacttatgtgaggttgcccgcccgtctccttcttgtctccccggcccaggtccctcccgcctccaggtccatccatcccgtccggaaaagaaggacc

SEQ ID NO: 118447 - DNA, 151 bp, Homo sapiens
  misc_feature 1..151: note = chr2:172954811-172954962
  misc_feature 1..151: note = Hyper
  source 1..151: mol_type = genomic DNA
cagctcttgagaggccgggaggttgggaggctgagaggcctgaaagcagagacactgctttgcctctagccttcctccggatcaggcctccctgcttttgcatgcccggaggcgctggattccgtcgcggaaaagacgcagccagacgcca

SEQ ID NO: 118448 - DNA, 520 bp, Homo sapiens
  misc_feature 1..520: note = chr2:172955367-172955887
  misc_feature 1..520: note = Hyper
  source 1..520: mol_type = genomic DNA
atctcgcagccgagccgaggcagtcccggagagctgcgggcccagacaggctgccaagcgctgttcctacttctcccgcactcgccttccagcgctgctgcccgcgggagctggccctccacctttggggggtcttttcaggcgcgcggtggggagcagagcccggaaggcagtgatctgtgttgtgacaagcacccatttttcaattggtgctggtgaaagatcagatgcgccaggctcttccgacgccctttgggaaggggaggaggaagtggtggggctgctgggggtggggggaggcggtgtgatggaagcagggaaagtagtcgggggtgggggaatgatgccggggacctccaagccccttccaggcctgagattgggacttctccgcagcacctagaagaaccagcgctgatgggagagatcagacctcagaaaccaggatgtgggcagtcagatgggcctcaaagctgaggaaagaatgaatttcccagctcccgcgcggggtagggggtct

SEQ ID NO: 118449 - DNA, 359 bp, Homo sapiens; identical to SEQ ID NO: 85460
  misc_feature 1..359: note = chr2:172957707-172958066
  misc_feature 1..359: note = Hyper
  source 1..359: mol_type = genomic DNA

SEQ ID NO: 118450 - DNA, 43 bp, Homo sapiens; identical to SEQ ID NO: 85461
  misc_feature 1..43: note = chr2:172958308-172958351
  misc_feature 1..43: note = Hyper
  source 1..43: mol_type = genomic DNA

SEQ ID NO: 118451 - DNA, 30 bp, Homo sapiens; identical to SEQ ID NO: 85462
  misc_feature 1..30: note = chr2:172958565-172958595
  misc_feature 1..30: note = Hyper
  source 1..30: mol_type = genomic DNA

SEQ ID NO: 118452 - DNA, 99 bp, Homo sapiens; identical to SEQ ID NO: 85463
  misc_feature 1..99: note = chr2:172959209-172959308
  misc_feature 1..99: note = Hyper
  source 1..99: mol_type = genomic DNA

SEQ ID NO: 118453 - DNA, 148 bp, Homo sapiens; identical to SEQ ID NO: 85464
  misc_feature 1..148: note = chr2:172959765-172959913
  misc_feature 1..148: note = Hyper
  source 1..148: mol_type = genomic DNA

SEQ ID NO: 118454 - DNA, 1258 bp, Homo sapiens
  misc_feature 1..1258: note = chr2:172960759-172962017
  misc_feature 1..1258: note = Hyper
  source 1..1258: mol_type = genomic DNA
cttttgacttttgagcgagttcgggggacgccaggagtgggggagttgcactcgagttttactgcccgtaagaacgactttttgagaggggacggggcttcttgctcccggacattgttctcttgggcggaggggaccacttcagagcttctctttgcacccgcctcttctgcccctcgtcttctaccactgaactgtttgtaaacaaagttccagtcttcccccgctctctccgcctccaccaaaccggtatttctcccaaattcgctccatcagtctgggatcgttacacagggcggatattcacaattttcacaagtgatcctgaaagaaggcctaggggaagcctcctaaacggtcccacattgcagcagggctggtgaggcctgggatccattctctctcttttctgcccttcccatcccggagtctcggggccggcggcgggaattccgcgcagccggaggggggtctgcgcccagcggagcgccgtgctggggcgaggtggctgtgggcagagcgtgcaccggggttggggggagaaggggattgaaggggcggggggcgcgggagtacctgggcggcaggcagttggccctggagctcagtgcccgcgttctgcctgagttgggagagccctgccagagggtggagcggagagggccgtgcacccctcactcttcagcttccctccccctgcttcccagcgcttgtcatatcctgtctctggcctgatatttcacgcgagcaattggaaggagattacaatggagatttatgtgtgttctgagcactgctagtttcccagcgtagagagccgagatcgctgcttcccatttccatttttcattcgcgctttggggagctcagtagagcacggggggagcgtgtctgcgcggcggcgggctgatcacaggactccgcgtctccgggcgggccgggagactgtgagaaaggcttgccagcgcgtcgcccccggcggggctggagccggcccccgcctccaggagccaggctttgtttcctcccttgcctacccctccccctttccgccccctcatttctgggacctgggcgcgtccttgcaaccccttctctttgcccttctcgtggtctgcggaaacacccccttcctctggccccttcaccctcctgctctcggcttcgcaggctccctggggaaaggcacaccgtggcccggcccgaccctgtcgtcactgggtgccgggtaaggtgactccggcgagtctgtggggcc

SEQ ID NO: 118455 - DNA, 484 bp, Homo sapiens; identical to SEQ ID NO: 85467
  misc_feature 1..484: note = chr2:172963608-172964092
  misc_feature 1..484: note = Hyper
  source 1..484: mol_type = genomic DNA

SEQ ID NO: 118456 - DNA, 2315 bp, Homo sapiens
  misc_feature 1..2315: note = chr2:172964747-172967062
  misc_feature 1..2315: note = Hyper
  source 1..2315: mol_type = genomic DNA
caggaaggaaagaagcggcggggccgcccgggtcaaggggccacgtgggggagggcgggcaggcgggaccgggaggtcaataactgcagcgtccgagctgagcccaggggagcgggcgaggagaaagaagcctcagagcgcccgggaagcctcgcgcgcctgggaggcttccatctcccgggacccagctctcagcccggggcgaggaaggcgccagacaggctcacccggaggggagggaaggcaagtccgaggcggggctcgaaacagccgagacccggggctcaggtcagaaatgcggccttttagggaggcctttgccaagctgctgtccggttcccccgagagaggggcccgtttggtggccccgggagtgagcagggcctgagacgggccactgcaggtcgcagcctgcaggagaggtgggtggcggcagcgggccgggaggagggaaccccggctcggggtaagcaatgaggataagtggtctctgctctcagtctctggcgagttctccctggggttagaaaatcgtccccgcgctcaccggggcgcccccgccgccgtgatggtggtggtggtgatgcggctgcggggtctgagtggggtgcagcagcggcgccgtggcctgcaggtgtgaggcggatcccgaggtctggtggtaccaggggtagttgcccagaaaagccgaggccgcgctgctcgggctggagcccgagctgccggcgccgctgccgccactgcccggaccaccgccgcccgccatccgctgcggcacaccaaagtcccaggaggccggcgctgagactggcggcgaagcacaaggtggagaagcgctggccccagggtgctgctccgaggggatctcaccacttttccacatcttcttgaacttggaccggcggttctggaaccagattttgacctttgaggaaaaagacctgagcattagtggaggaacctagtcttggggcagtaggggttcgaagaggagaaaaaagaaggcagagaaaaaccgctggctagcggtgggcagcgagcgccctggggagataagaggatcacgggcggcggccttcgaggctctgccggttcctgctccctggggaggtaattgccaaaaggccaggactgctggtgtacgtgcactgtgatgatggtgacagcgggagggtgaggagggccagttatttcacccgcttaatcagtagcgagaggtacgggatttctgtccacccggtccctttccttccctcccacggcggccccttgggggtttccagctttgggcctagaagcttacttagggccgctcgaggcgcaggcctggaaatccttaaaagtacttaaaatgaactttaaaaagcattgtcctaaacccgcctgcttcccagccatctcaggcccgcgctctcctcgcccctgcagggcgcgagccccacctgagtctgggtgaggcccagagaggccgccagctcggctcgctccggcaaggccaagtattgagtcttttggaaacgccgctgaagagccgccagctggaaactggagtagatggtgcggggtttccggactttctttggcttcccgttcactatccgaatttcaggctcaaggtcctccttctctgcaacgataaagaatcgtaagaacagcgcaacccaggggtcctggagttcccgccctcctagagggcccggcgggggggacttggcttgagcaaagaggtgggtgcactgaactgtggcgccacgggcaggcgcaacttcgcagcgtgcgatcggagccgccaccgaccccgggagctgtaccctccagggaagggggagacaagtgcacacccaagagaaagaagctggtggcaaggagatgcccttatgaggcaggcagagcacgcccacttggctcttgaggccaccaggtcctaccaaaggagagagggacgtaaccggcgacctgcggcagattggaggctggggagggtaaagggcacaagcgggcggtgagcaggcagcgtgaaaatccagagctttcgaaggccccccgccccaaacacgtttacccatccatcccattaactagaccgactcggcactcttgacttcagcgttatgcataccaggctcgttgttggctggggacgaactggttccatagggagcgtaggaggtgtaggcggcggtgtagcccaggtcatagctgctcttggcggagtaagggacgttgttgaggccgctggcttggtactggtaggaacccatgtgcgcgtagggcgagcccccgccgccgccgccgcccgccgggtgctgctggtt

SEQ ID NO: 118457 - DNA, 1136 bp, Homo sapiens; identical to SEQ ID NO: 85472
  misc_feature 1..1136: note = chr2:172970558-172971694
  misc_feature 1..1136: note = Hyper
  source 1..1136: mol_type = genomic DNA

SEQ ID NO: 118458 - DNA, 520 bp, Homo sapiens
  misc_feature 1..520: note = chr2:172972735-172973255
  misc_feature 1..520: note = Hyper
  source 1..520: mol_type = genomic DNA
caatcacatggttaccgacgcgcagcagagtccgacctcgaactcagatctgggccatggaggcaaggccgctgtcgctctgggctgtttccggccaggggacgcgagagaaggcggcaccacacttacttctcccgggcctggtgctgccagctccgcggaacagattggaaggggcattggccgtcctgagggcgaccgcgcccctctctccccaaagagagtcctggaaggggggttcccctgggagaggaggaggcccgcccggctgcgcagagggtagccccgggaagattcctgaacagactcgagcctctgcggagagggcgggatgcgggtgccccctggcttggcacgtgaagccaagcttgaggacctgatgttttgttcccgctgggattccgccccaagttatctttgctccctgctggggtgtaagtaaaccccaggggcttgaaccgaaatcatcggttactcgacgcttccagccgtggcctttccgcggcgctgggcttctggt

SEQ ID NO: 118459 - DNA, 260 bp, Homo sapiens; identical to SEQ ID NO: 85475
  misc_feature 1..260: note = chr2:172973998-172974258
  misc_feature 1..260: note = Hyper
  source 1..260: mol_type = genomic DNA

SEQ ID NO: 118460 - DNA, 30 bp, Homo sapiens; identical to SEQ ID NO: 85476
  misc_feature 1..30: note = chr2:172984274-172984304
  misc_feature 1..30: note = Hypo
  source 1..30: mol_type = genomic DNA

SEQ ID NO: 118461 - DNA, 28 bp, Homo sapiens
  misc_feature 1..28: note = chr2:173036676-173036704
  misc_feature 1..28: note = Hypo
  source 1..28: mol_type = genomic DNA
atgtgagtcaccgcgcccagcccaataa

SEQ ID NO: 118462 - DNA, 121 bp, Homo sapiens; identical to SEQ ID NO: 85478
  misc_feature 1..121: note = chr2:173037688-173037809
  misc_feature 1..121: note = Hyper
  source 1..121: mol_type = genomic DNA

SEQ ID NO: 118463 - DNA, 749 bp, Homo sapiens
  misc_feature 1..749: note = chr2:173099681-173100430
  misc_feature 1..749: note = Hyper
  source 1..749: mol_type = genomic DNA
gttgtcggcggtgggcggcgccgggggagccgcgctcggggacagctggcggctcaacggcagcatcggcagcatcgagaaaggtgacgagttctgcaaataacagctgcggagcaatcgttatgtttggacaacgtgggaagggccattgttcacaaattgttctcttcaacaacacctgcatgcacagataataatccattgtcggtctccggcttcaaagacaaaaggcagccgcggagggaggagtcagcagagcctggagataacaggaccactttgcaaccggggagagtgcaaacgaggactccaagtcgcgtcccgggtctgccgcgacggtcgctcaccgcaggggtctccttcctcttctggcagcgagtgcgacctcttttatcctagcaggccaccaccttcgcggcaacaaacatcatttcctatgcagttgcaaagcatgctcccttgcaatcagcgatcaatactggcaaagtggctccaggataggaaaggtcgcacgtgtgttggtaaatggaaaggtttatgaggcgcaggtggtcgtgctccgcggagattgtggtattagcatgtcaaagacaaaacggaaccaaggtatacaggcacagagtctcttcctggggctccgggaaagcttggcacgaccctcttgagccttcagtttaaaatgaaacgctggcgccagatgtggccaccacattgctgataagtccagtaccttccgtttgtgcaaagct

SEQ ID NO: 118464 - DNA, 30 bp, Homo sapiens; identical to SEQ ID NO: 39711
  misc_feature 1..30: note = chr2:173291566-173291596
  misc_feature 1..30: note = Hypo
  source 1..30: mol_type = genomic DNA

SEQ ID NO: 118465 - DNA, 49 bp, Homo sapiens; identical to SEQ ID NO: 39712
  misc_feature 1..49: note = chr2:173422685-173422734
  misc_feature 1..49: note = Hypo
  source 1..49: mol_type = genomic DNA

SEQ ID NO: 118466 - DNA, 855 bp, Homo sapiens; identical to SEQ ID NO: 85483
  misc_feature 1..855: note = chr2:173600535-173601390
  misc_feature 1..855: note = Hyper
  source 1..855: mol_type = genomic DNA

SEQ ID NO: 118467 - DNA, 20 bp, Homo sapiens
  misc_feature 1..20: note = chr2:173927306-173927326
  misc_feature 1..20: note = Hypo
  source 1..20: mol_type = genomic DNA
tccaataggccggtgcgttg

SEQ ID NO: 118468 - DNA, 85 bp, Homo sapiens; identical to SEQ ID NO: 85485
  misc_feature 1..85: note = chr2:174219158-174219243
  misc_feature 1..85: note = Hyper
  source 1..85: mol_type = genomic DNA

SEQ ID NO: 118469 - DNA, 80 bp, Homo sapiens; identical to SEQ ID NO: 85491
  misc_feature 1..80: note = chr2:174932189-174932269
  misc_feature 1..80: note = Hypo
  source 1..80: mol_type = genomic DNA

SEQ ID NO: 118470 - DNA, 21 bp, Homo sapiens
  misc_feature 1..21: note = chr2:174932048-174932069
  misc_feature 1..21: note = Hypo
  source 1..21: mol_type = genomic DNA
tgtagtcccagctaccgggga

SEQ ID NO: 118471 - DNA, 1697 bp, Homo sapiens
  misc_feature 1..1697: note = chr2:175190771-175192468
  misc_feature 1..1697: note = Hyper
  source 1..1697: mol_type = genomic DNA
gaagaaagagaaactcgcgacaacagagttgccgaaagagaagtgttggcgcctcaaacttgaggatcagcttcttgggccccactccagggtgtcgcgggggtcgggttctttccgccgccccccgaaagattctcagctaaccctttccccgccgagaccaagaggccctcactctgacaccactccgggagccaagctactgtaaggagctgataccacccctcgccggcgcgaaccgcccatctccccagacccgcccaccccctgctgcgaatccctgacgttctagcccggcgaaggtcctcttaaattaggaaacaatagctatttaagaagaagcgcaaataacccgcgctctgcgcgcccaatcgtgggattcttgggagttccccgcgggcaaggaagtctgctgctccccgcagctgcggaggagaggagggagcctgcgtgctggggcagggtgtcgcgaacttggggcaacccacctccagagccccgcccccgctttcccgcctgccggggacctgccgaacgcggaaccaccctccttcctgaggcaaatttgggaggggagaggtccagaagctgtagagtcggggcgccaagcgccagattctgccgctcggaagttgggggcagtccccagtcccgcctcaggcccccgcgctcacagggcgctccgccgagggcgcgggccaggcgcgcggtgtcacctccacgaagtcatttacttgccctgaaggagctggccctcgaccccttggaggatggagattcctcccattccctcctccgcctcccccaggtcggcgaagagacgtggaattgagctggaccgatgattccgcgagctctgtaattatgcacacactgaaatcttcaccgttgacttaagttacttggcgctgcgagggctggggccctgcatattgattaaatgcagcctctatttacctaaacaataaatgtagagattagcaacgttcacttgatcacaataatgggattgacaattaaggggcaatgcatcccagatgtagcggaacctatgggctgcgtgcagcaggcagagggcttctcagagaggggcgctgggcagttgcggcggcggaggtagtgcagagcaggaagcagcgcggaagcacagcgggaggcggagggggacgcccagcctcgtcaaggtcttcggccaccccgcccgggaggctcgaaactggctttggggtacctgaatgcctcgactcccagggagacatcgggagctcggagccactctccctgtggcgatggcacctgcctcaaggccgtctcgcttgctgatgcctggccgggaaggaggatggacgccgctggcatgtgccctggtaagtgtgtctgtttgtcatcagtgtacattctgcatgtggcagcagggcgagggggaggcgcacgtgtctaaagtgcacggagccttcctctacccctatgtatatacccttcagtcaatgttccaagaagcgggtcagggcggagggtatccatctggactctggaagggcgtgggtttgacatcggtaggtgtgacaggaaagtccagcctgtcagagttgggctctacagtggccgaaatcaagaaaggatggacgtgtcggcccagggctggcctgtttccggatatgtcacgggggtgcctcgttcctcgaggggagttttag

SEQ ID NO: 118472 - DNA, 873 bp, Homo sapiens
  misc_feature 1..873: note = chr2:175193089-175193962
  misc_feature 1..873: note = Hyper
  source 1..873: mol_type = genomic DNA
ttcagagctgaaggccgactgtgggaggaggaggttaaacaaagggaatcctcctcctctgggacgggtgaagtgcgtttgtcttctccttgcaggctctggaaaaactggcaggaatttccttgtcgtgagaagatggacgagtgtgtctgcagccgaggagacaactacaaacagactttgggcagggaaggcgggcgggcgggggtgggggtgggggcgggggcctgctttgatcgctccagctctgttgtaattttgtcttcgccagatagattagctggaaccgccagccctagcttggagttccgttccacggagtaccctccctccccacccccagcgtcatctcgcgcctggagccgggtcgccgctccttccgaagtctcgctggaaacttcaagggctgatggttctgtgttcttgacgtaattaggaggccacgcagctctccaacactccgttaaacaaatatgtaagtcgtcctccccctctctggggacagactctagggaaggaggcagctgggcccgctccgggtggtgtccttggctagcggagtggcgtcgctgtgaccttccgccgcccctcggggccttggtctttctaagctctttcttaggaagcggagagaggggcagaaaacgtgcacctcgccacccaccggacaagccgagaggaccttgtctttgcttgaaaagttttctagataaatcgctcgggtggttctaagctatgacgaactagaggctgggcccggttcttctccagaacagcgtgtggatgtaaaggagatgaaatcgtcctcccccactgctttctttttcttccccatataaatcagtcatataattcattcgcattgtttaaggt

SEQ ID NO: 118473 - DNA, 41 bp, Homo sapiens
  misc_feature 1..41: note = chr2:175195883-175195924
  misc_feature 1..41: note = Hyper
  source 1..41: mol_type = genomic DNA
ccagcctggccaaggcgagcaccttccgttcctcctcccct

SEQ ID NO: 118474 - DNA, 30 bp, Homo sapiens; identical to SEQ ID NO: 85497
  misc_feature 1..30: note = chr2:175196266-175196296
  misc_feature 1..30: note = Hyper
  source 1..30: mol_type = genomic DNA

SEQ ID NO: 118475 - DNA, 61 bp, Homo sapiens; identical to SEQ ID NO: 85498
  misc_feature 1..61: note = chr2:175196514-175196575
  misc_feature 1..61: note = Hyper
  source 1..61: mol_type = genomic DNA

SEQ ID NO: 118476 - DNA, 298 bp, Homo sapiens; identical to SEQ ID NO: 27669
  misc_feature 1..298: note = chr2:175196967-175197265
  misc_feature 1..298: note = Hyper
  source 1..298: mol_type = genomic DNA

SEQ ID NO: 118477 - DNA, 149 bp, Homo sapiens; identical to SEQ ID NO: 85500
  misc_feature 1..149: note = chr2:175197915-175198064
  misc_feature 1..149: note = Hyper
  source 1..149: mol_type = genomic DNA

SEQ ID NO: 118478 - DNA, 306 bp, Homo sapiens
  misc_feature 1..306: note = chr2:175198594-175198900
  misc_feature 1..306: note = Hyper
  source 1..306: mol_type = genomic DNA
ggttaaacaaacagccgagcaagctgcagcttcagcggaggtggaggtgggggcggacgccgctcgcgccggtctctgtttccaaagttgttacagtgagaaaataagcggcttcgtgcagcgtgttgtatgggctgatgcctcccacccccatgccagcccacagcaaaacccggcagataatcagcacatcccactgtttagtcatatttgacaactgggttaacctggtatctaagcgctggcgaaaccgtacaaagggtgccctcaattaccaccagaagcctctagcgtgagtggcacttg

SEQ ID NO: 118479 - DNA, 567 bp, Homo sapiens
  misc_feature 1..567: note = chr2:175199368-175199935
  misc_feature 1..567: note = Hyper
  source 1..567: mol_type = genomic DNA
ggggtgcttgtggctcggtttcattggtacttaaacctggcttggtgcgtgagtgtaaatttttaattgcactgtaatttcttcagtccccagcccgccctcgccccccccccgcaagtatcccccactactcccccccacccccgcggccctagctagctgacttgactggcacgcgccgggagcccgggctcgggcccctcggagcgtctgattggctgcggggcagctccggtctgctctgcctgcgccctcattgggcgagaggcgcagccagcggcacttcaaagcgggtgctcctcgcacttaggctgagtttagccggcgggagcctggagtccgctcggcacgagcgcggggacgcgggagccgcgcgggacccaagcagtttttccgagcagccgccaggctcagccccgctcccagcctcgctgcgcagccagagacctgctatggccacgtctatactcggggtaagtcgcaagcgcggcaacgcatttgcttgttttaaccggagtaatttttcgttatggcttctggggtctgcggctccggagaaactgttgc

SEQ ID NO: 118480 - DNA, 2539 bp, Homo sapiens
  misc_feature 1..2539: note = chr2:175200172-175202711
  misc_feature 1..2539: note = Hyper
  source 1..2539: mol_type = genomic DNA
gaaaacagtcttaatcgttttgcagtccatctagtcacgctaataaacatttacatttccgcggctccccaattcgcccatgactttgaaatctgtctctggccgcttatcctcggattattgttttcataatcgctgtttttgtgtgtatgtaaactttaaaaccaaacgttttctattaaaaaagaaaagtcaagtcgtagccaccctgggagagctgcaagtttcgcccgtccctggcagctgtttcggccgcctccgccctcacccggtgtttgttgtctctggtctctgtgtttaccttcgcgcttcaccccgaagggcgacttggggtcttctgggagatgagccggtttacggcgacaacccaagtccggttgtaggcagggttgcagcggggaacacggaggcatctttgatttatagcctcagcgaagtgcaactttccggcgcctggaccttcgcccgggtgatcgcccctgctccgcgcccggtgcggcgactcctccgcgggcgcgtggggaggaggcgcgaggcggggagccaggaccccccgggagcagccgcaggggacgaggctgctcacgggtgcactttgtttcttcccccacttcctcttgccctcctccttcttgctccctcccccatcccacccactctaggaagagccgcgcttcggaacgaccccgttggccatgctggcggcgacctgcaacaagatcggcaacacgagcccgctgacgacgctgccagagtcgagcgccttcgccaaaggcggctttcacccctggaagcgctcctcgtccagctgcaacctcggctccagcctctcgggcttcgcggtggccaccgggggccgtggctcgggcggcctggcgggcggctcgggcgccgccaacagcgccttctgcctggcctccacgtcgcccacgtcgtccgccttcagcagcgactacggcggcctcttctccaactcggcggctgccgcggcggcagcggccggggtgtccccgcaggaggcgggtggccagtcggccttcatttccaaggtgcacacgacggcagccgacgggctgtacccgcgcgtgggcatggcgcacccgtacgagtcctggtacaagtcgggcttccattcgacgctggcggccggcgaggtgaccaacggcgcggcgtcgtcgtggtgggacgtgcacagcagcccgggctcgtggctggaagtgcagaaccccgctggggggctccagagctcgctgcactcgggcgccccccaggcctcgctgcactcgcagctgggcacctacaaccccgacttcagctcgctcacgcactccgccttcagctccacgggcctcggctcctccgccgccgccgcctcccacctgctctccaccagccagcacctgctggcccaggacggcttcaagccggtgttgccctcctattcggactccagcgccgccgtggcagccgccgccgccagcgccatgatatcgggcgccgcggctgccgccgccggggggagctcggcacgctctgcccgccgctactcgggccgcgccacctgcgactgccccaactgccaggaggcggagcggctgggcccggccggggcgagcctgcggcgcaagggcctgcacagctgccacattccgggctgcggcaaggtgtacgggaagacgtcgcacctgaaggcgcacctgcgctggcacacgggcgagcggcccttcgtgtgcaactggctcttctgcggcaagcgcttcacgcgctcggacgagctgcagcggcatctgcggactcacacgggcgagaagcgcttcgcctgtccggtgtgcaacaagcgcttcatgcgcagcgaccacctgagcaaacacattaagacgcacaacgggggcggcgggggcaaaaagggcagcgacagtgacacggacgccagcaacctggagacgccccgttccgaatcccccgacctcatcctgcatgactccggcgtcagtgccgcccgggcggcggcagcggcggcggcggcagcggcggcggcggcggcggcggcctccgcgggaggcaaggaagcagcgtctggccccaacgactcttagaggccgggcgagaggcgcgagcacacaagcgagtagagacaccgagaacgaacgagaggttcggagggcgagcgagcgggaggcgggagggcaggggcttcagtgacgcccccagggcccgggctgggcgcgaggtggagccgctcagggctcccgggctgcggttcgcccgctgtgcgaggagctcccctctgccttccgcgcccggataagaatcgaacgcgtggtccggaaacaaaagcgaaccatcctccgacacaaacactttaaaaactgtactcccagacgtacacatacaccggagacctacaaccacaagcacgcacactcgcgcgcgcacacacataccactcgcccaaacttctcgagcgaagagcaatacatagaaaggctccctctttgcccactctccacctccctccaacacccgtctctttcctttt

SEQ ID NO: 118481 - DNA, 309 bp, Homo sapiens; identical to SEQ ID NO: 85511
  misc_feature 1..309: note = chr2:175203142-175203451
  misc_feature 1..309: note = Hyper
  source 1..309: mol_type = genomic DNA

SEQ ID NO: 118482 - DNA, 175 bp, Homo sapiens; identical to SEQ ID NO: 85512
  misc_feature 1..175: note = chr2:175204088-175204263
  misc_feature 1..175: note = Hyper
  source 1..175: mol_type = genomic DNA

SEQ ID NO: 118483 - DNA, 1382 bp, Homo sapiens
  misc_feature 1..1382: note = chr2:175204492-175205874
  misc_feature 1..1382: note = Hyper
  source 1..1382: mol_type = genomic DNA
gataatttcgcaattcgaaaaaaatgttaatttagaaaataaagtacatatttacagaataaaaatatttctaaaagatttcccacacaagaggaaatacaagcgaagtcagcaccaacatattttttttttccatttttgattactgtccgccttgggaatttgagcgaagattttgatttttaggaaagaaaaaataaattcttgttattaacaatcagcaaaatgttttctcggaaactgttctgaaacaccaagtcgcaaagtagcgataaaacagaacgaaggtccccagcagggagtttgcagcgtgacattcaatggcttcttccttctccttcttgagctccccgcggccaggctgccccgctcttcttactcgagtttttcttcactttggccattttctctccccgatcaagctgttcataaccgggagccccccactccctaagcgcctctggtcgggggatggtcttccggagagccggctggcagggacgcgttttccggaggggcttcgggccggggcactggaggcccagagggtgcctggcgcgtttgggggccgcgggctggcggcgcggagtagagggtgtggtgggtctccccaggaacgcgggcgcccgggcgtcgggcccagggagctttgtttctcgttgataataaaggcagatcaaagggcccggtcgtgcaggtcccgctggccgcgcggctccctccgcaggccagtgatcaaggcctgtgtgcgctgcctctgccccgcgggtcagcggacgtccatcacccaggctcccgggagcggcgggcggcggccccggaccgagcgtccagccgggagacagcagtccgcggaacctgagcccagaggcagcggggccccggggccccggccgaagccaacaggcgaaaacagggcctaggccccctgcccggcctcccccaagccctaggcgcccctgggggcgcggggaaccttgacctgagcgggtggcgaccggccggccggtgatgaccaaattggagacagcgcgcgtgggaggcgagatcccgccagttacaacacgagttcggtccccaattgcggtggggcctcgcctccccagggccacctcggggccccagaggcctgtgcctttccggctcaggggccagaaggagctggaggcggtggtcaggggcccaagctcagaggcgggtagcggcctggaggtcggtgggggcgggggacgcggcctgggggcccagagtctcgcccgggcccggtaagggcagtgcgatttcgagtcccccggtttccctggcatttcctgtcccatagcttccagcgcaacagaggaacgaaaagcaagttttcctcggccctgcgcccacccagccac

SEQ ID NO: 118484 - DNA, 936 bp, Homo sapiens
  misc_feature 1..936: note = chr2:175206717-175207653
  misc_feature 1..936: note = Hyper
  source 1..936: mol_type = genomic DNA
ttgagagggctgaagcgttgtcggcggcgacgtggaccccaggatgtggggatccagctgtggacgcagacccctctgactctgcatccgtggctcccggcccgcgaggcccgcgtggactacccggggcccggctggaaccaggccgattcaaacaggccaccaaaccatcccacccccctaccccctcgtgggcaatcagggaggcaagggacccgccgctttcgcagccccaacccgaggcgggccggagcagccttctgcattgccttcgtcctccggcggacaccccagcccgagtggggcgcggggggcggctgggcaggcaggagccgggccggtcgcgcagggcccccgagggcggcgagaagcccccaaattccccgctcgaggcctccccaaagggtgcgcacaccctcctggagcaaaccgaccccttttgtcctctccttttccctttgaaacccaaatctgaaatcgggtaacagttgggggcgttggccgattttctctcctctcagcgtatcgtcctccccctgccgcccctttccctcctcttccagtccactatctccccgaccccagcccgtcttcatactgcgtggagtgacttcctcctcctccatttttgtgccccccacccccagcgcgtatttattgtattttaatttaaaaagcgacaccttcaaaccctgcgcccgaggcggcggaggcgccgtcacccgcagccgcgagagcccggccaaggcgcctgggtgccgggctccctgaactcgcgccggggagaagcagtgcgtttccggggactcgcagccacctttgcggcgggtaactcggctgggtttgtatttgctgttttaatacaaaccccgccgcactgcctatttcaaagatgtgctaattactacttggatagcagggcgcaaagtccttgtc

SEQ ID NO: 118485 - DNA, 1154 bp, Homo sapiens
  misc_feature 1..1154: note = chr2:175207981-175209135
  misc_feature 1..1154: note = Hyper
  source 1..1154: mol_type = genomic DNA
cccacccttcccagacgctggagtgtatagaaatatgtatgaggtaaatacatacagacatgcctcccccatatattgttgatgtaaatatagactgtgtgtttgcatctccagttaaggaaagggtttcagaatgtccgtggggacacgtccctccagggccggctgtcgaggacccggaaaaccacagcccctaagagttccagattttccaagacccttatactctcttcctgtagaatttcatactgggggttttgcattgttttgcaggcatgtaaccatttctgggtgattcatttatctataaaggaaatgcaaagtggcagggtgtctgccccagtccgcattctgcttgcagattgctgacgaaagttgatatcttcatgtttgtcccaggagcttcataaagcgccctcttcacctgtggagcccgagcgaccagaaaaattcgctcgctttcctaactgctgaaggcgagtccggcccgcgcgggggactgcgcccgaggcccggcaagcttaggcggggactagcagggccctcggcgggcgggcccccagcgaaaaggcctgagaattgcttctggggggtggcttgggccaacgggggcgagggagccgcgcagagggcaggccccgacccttccccgccgcaccttgtgggtcgggtgttgggcggcctcctggcgcgggaggcgcatctgctaggaagggtgtgcgctccccccttctcggcctccccatttcggtttggggtgttttcgcaaggttgccagacggtgcatccagaaggaaaccaccagagcacgcaggggggcgtcgcctcaggatgggaaggggcgacctcagccaggattcatcccatcaccctactccacccccattccggcttcctttaggtttagggcgacgtcctcctgggaagccctgctctgtcaacccaggagccctcggacctccacttctgtccaccccctcgcgaagcccttcaagcccaagggactggagaaaggcggctccggggcagctcgggccggagggtgcgtttcttttcattccaggcagctctccgcgttcgtcccgcacatcttcgtcattactgctacattctgggcattctgggggtgataagtgtggcgtgaagggaggaga

SEQ ID NO: 118486 - DNA, 60 bp, Homo sapiens; identical to SEQ ID NO: 85518
  misc_feature 1..60: note = chr2:175351002-175351062
  misc_feature 1..60: note = Hyper
  source 1..60: mol_type = genomic DNA

SEQ ID NO: 118487 - DNA, 1280 bp, Homo sapiens; identical to SEQ ID NO: 85519
  misc_feature 1..1280: note = chr2:175546788-175548068
  misc_feature 1..1280: note = Hyper
  source 1..1280: mol_type = genomic DNA

SEQ ID NO: 118488 - DNA, 30 bp, Homo sapiens; identical to SEQ ID NO: 85520
  misc_feature 1..30: note = chr2:175791881-175791911
  misc_feature 1..30: note = Hypo
  source 1..30: mol_type = genomic DNA

SEQ ID NO: 118489 - DNA, 24 bp, Homo sapiens
  misc_feature 1..24: note = chr2:176030420-176030444
  misc_feature 1..24: note = Hypo
  source 1..24: mol_type = genomic DNA
ggagtctcgctgtgtcgcccaggt

SEQ ID NO: 118490 - DNA, 79 bp, Homo sapiens; identical to SEQ ID NO: 39714
  misc_feature 1..79: note = chr2:176430829-176430908
  misc_feature 1..79: note = Hypo
  source 1..79: mol_type = genomic DNA

SEQ ID NO: 118491 - DNA, 30 bp, Homo sapiens; identical to SEQ ID NO: 85524
  misc_feature 1..30: note = chr2:176688101-176688131
  misc_feature 1..30: note = Hypo
  source 1..30: mol_type = genomic DNA

SEQ ID NO: 118492 - DNA, 34 bp, Homo sapiens; identical to SEQ ID NO: 85525
  misc_feature 1..34: note = chr2:176914363-176914397
  misc_feature 1..34: note = Hypo
  source 1..34: mol_type = genomic DNA

SEQ ID NO: 118493 - DNA, 474 bp, Homo sapiens; identical to SEQ ID NO: 85526
  misc_feature 1..474: note = chr2:176940167-176940641
  misc_feature 1..474: note = Hyper
  source 1..474: mol_type = genomic DNA

SEQ ID NO: 118494 - DNA, 589 bp, Homo sapiens; identical to SEQ ID NO: 85527
  misc_feature 1..589: note = chr2:176943178-176943767
  misc_feature 1..589: note = Hyper
  source 1..589: mol_type = genomic DNA

SEQ ID NO: 118495 - DNA, 5003 bp, Homo sapiens
  misc_feature 1..5003: note = chr2:176944072-176949075
  misc_feature 1..5003: note = Hyper
  source 1..5003: mol_type = genomic DNA
agaaaggtgttggaccgaaaaggaggcggcgcaacggccaccccttccagcacctcggctttgtccttcccggggaaggcggccacatccctacccgccttgctcctgaacgtagtaaacaatctcacaaacaaccaccgctgcccacgctctccatccgtcctcccggccttatcagacctccgttctcccgcactcttcgggcagggtccctaataagctcaggctgaaagaacgtttgccacctcccccaccctcgttgaaagaaaaggaagaaaaacagcagcagcgagaaacctccggggcgactcctcccccgcccccaagcaccagcgcacagcatccccctctgtctttgttgtggttctccgttgcttcgggccacgccgttcagccaagcaacccggacctgagagtgcacagccaggactagcttagggggcgaggggttggtctttgggaaaccaagcgctcaggacagaggtggaaagtgggtcccgggagccagaaaagagagagaagggcagacggctgggtggcaaatacaaaaatagaaataatttagggggatgcccgccaggcttttgcgcctgctccttctcccccaattcggagcaggttcccttcggcctcccgcgccccggggcgccccctggcggcagcggcagcagcgggcaacgcgcggagggctcagggggcgcacaggggactcccgggcacactcagagaggcgggcgcggccccctggcggtggcgacgtagttatctggtgagcggagcctcgtccctctggtccggcgggctcacggccgtcttactaagcaccgcggccgagtagggcaggaagccgctctcggaacgcggcgccgccgcgctgcagccgaagtccgagcctcccccggccccggcgcccccgccgccgccgccaccaccaccaccgccgccgccaccgccaccccgggaacccagggctgcggcagctgctgccgcggctgccgccgccgactgactgctgtggcaactgaggcacgagcagggtgcagagccgccgctggggggcgcgccggccgccgccgccgaggaggccgcagccgctgcggctgccgcggctgccgcggcagaggccgcgctgttgagccccgcggcggccgcgggagcctggtagagaccagggtggcggaagctacacagcagctccggccgagagtaggggtgcgagagggcgcggaaggtgtccagtggccggatggaagtagcgaagggcgacgaagccgcggccgccgcgcctgaggctgcagccgcggccgccgccgccgtgacgcccacgtgcgggtagtagtgcagcggcacgtgcgagtggaaggggtagggcaggcttccggtggcggccgcgtgcgtcatcatgtaggtgtagaagctggggtcggctgggtgcggccaggacatggccaggcgctgccgcttgtccttcatgcgccggttctggaaccacacctgcggggagagacgcgccgcagcctgggttagggagcgccccgtgttcccagctcctgtcccaggacctctgccccttccggacctctgaatggcttggtctacttctctccgaccaagcccaaccccgagtaccctgtggtctcccagctgggaaagtgtggacggcagtgtgtggaccgccgtgggcacaccgtcctcaacgaagagggtcctctcccccgcgtccggctgctgctgctcctcaggcttttattcccttacttcttgctgcacttttttgtcccaatccaacctttcctctccctcccgccacccaccagtgccggtctcgctgagcacccgtctctcaatcccaggatttgtacggggattctgggcagcctttgaagagaggctgccgctcagcttttctgagaggtcgccgcgcgaagtcttgagccctccgaactgcaaggacctgcccctaggggcacgggtccgattttgatattgaagggatgattttgttggaatcgtttgccttaaatgagtgggtagagcaatgtctccataaacggggaaggggacgtttccacccctcccaacactatctaataaagacatcattcgtcacaactctaaattaaagaaagcccgatcaaaccagagggagacttccacactcctcccctaccccgtggagattttttcttttttctgcagtgtcgaacgctccatgaagggctcaccaaatcgcctaacctcccggctatctctcccagacgtataataaaattaataacctaaagttatatataaataaggacaatttcgttgcatttttccccgcaggaggttgcccttttttcgttgcccaagaggaaaatgttcaggaaactactgtctcaaaccaatcgattttaaagatacagtatccttttctccgtgtaacgatttatgcggaaaataaatctccaagctcaagagcaaatgaaaagtttcacctctggttcctgcttgaggaacaaagaccaactgggcttgccgcctaggggaaagtggggccgtgggtatgggcgagggggcatctggccaggcgttgggcacaatggagcaggggcgagtgctttcagcattggagtcaccattcgggggccttcttagatccgtcaggccggacaaccgttcggattcggtggccgggaaataaataagccaattcctttggtgactaccccccgcggatttccagacccttagctaaatctagccacccagaaaggggaaaggggaaaaagaaacaatcaacccagatgcccccggggaggccagagcaggcatgcactggaattgataccttgatggtggtttcgggcaggttgagtgccgcggccagctcgcaccggcggggccgcgacacatagttctcccggtagaactccttctccaggcgcgcgatctgctcgcgggtgaacgccgtacggtagcgccgcacttgatccgcgccagagccggagccacccagcgccgcgctcccgccgctgcctccgctgcctccatgcaggcttccgaggcctgagcccgacgccgacgtcgtggtgccggcagccgagccgctctctgcgtaccctggcaaacaaacgaccaacagcgcatgagtggctgtaggaccaacagcccggcgctggcgctgcgcgcggatcggggaagccccgtcaggaaggagagtcgctgccggaattgatggggtctgtcatgcttacaaattgctgccgttaatggaatcaataaagtttggggagcccttcataagcaaataatagaaacggaattaggagatttcttttttaataattagaaattttcaaccaaggaggaaaagtggccgagggaaaatgcctacctctgggcgcagtttgggaagctctgggtttcccatggtctggagaccgcagggcagctttttatacggcctctaacctttatctgagtcttcggggtttcaaatattttaagagttccaacacagcagtagctcaaacccaagccaatagggggtgaaatatacttttcaactctttctcccgctgacctaaacagagacgccggcgaggcttcctccgacttacccagaagaatgccccctccagccctgagggcacaggggcaggggagttcagagtagttgcccagggtacctttcccaaaagcaactcggctgctgactaggggtctaccggctcgctcgggctcttagacacgagcgcagaaacattttctcggactcaggagcgagggcgggtgggcctggtgttccaggctccgcaggcctgagcctggcgggaaagctcaaggagcagaactggaaggcacggtcccagacatgcgtcccgcccccgcccgtgctagctcggtgtagcttgcctgtggagggtctgagaggggaaaaggcaccgggaaaggctggcgggggccgcggaggagcaaagaggatgggactggagagcgcggtgcggccggcgcggttacctttgccattgttttccttaagctgagcggcgccgaggcccccgggggagcgaagcgcggagcagcccacctccacgtcgctgctcatgtcggcctcagcggccgcctctgaataatggcccggcttcttgcggctctcggcggcggaggagatttcggaggagacggtgctttcgctgcccgtgtgctgcaggttgaacaaagtgtctatttcgaatttgcccttggcggggagttctcccagagcgctgtgcaggggggcagacggcaggcgcgggcttaggcgagccgggtgctgcgaattttccagggcctcgagcacagcattgccagccgagttggacaaattggagaatctcttgcccgccgtagggctgtgcagccctctctccatcagaatcatctcttttcttattctttccatcatctcagctttcttaaaaatgtcacagtggccctgctgtcccgtcctaatgataggctgcgcctagggctaattctcattcagccccagcgaacgcctctaaatattattatcgctttcggagggaggcggaaaaattgtgggatgccagagcgagggaatgactggtcaaaatgacccatacatccttccgatcccgagatgtcattcatcaaaaagtagcgcccgctcgtcattaaggtacgaatgacgctgttcgaataatcatttattgtaacaggtttataagcaaataaatacaccctcctgtcagtgggtaatgaaggcagcttcagagcagacaaatagatccaggtaggaggcgagaagagacaagtgaggaggaaggctccggtcctttgcccgctccgagccagttctgctcgcccgggggtttggcctcgggggtgaaattgacagtctgattaatagagcgcgccgcggcacatttcccccttcatttaggggcatcattacgctctcagtttgctaggttgccccttaggtcctaatcatgcagcgccttcttcatttt

SEQ ID NO: 118496 - DNA, 1109 bp, Homo sapiens
  misc_feature 1..1109: note = chr2:176949372-176950481
  misc_feature 1..1109: note = Hyper
  source 1..1109: mol_type = genomic DNA
gctctcctcccaccccgggagagagagagagcggaagagagggagagagggagagagggagaaagggagagggagacggagtgagagaaagagagagagagagagagagagaaatagaaatatcctagagttttgaaagcgctttcttgctacgtggccgcggaggtgcattgggcccgcgcctccaaacggaaatcattaggtcctctctgattttctaacaccgtctgcagagtgagatctgaactcgaagtccccggttttttacttttataatcctgctgatagaaagccttctcgcctacgcattttcctgaggggaaacgaactaggctggacgatttgatagcagaattcgacagctaactttaaacacagtggagatttacagcgccatacgggcgctccgaatccacgctcacgttgccagattttcccctccctcctcaaatagaattatttgcggcaaaggcgctggatttcgaggtcaaaagaggaaagaggagacagccttcttcccctacctccccgctgccctcccttcccctttgcttttcttccttctctctttcctcccctcatcaaccccagccccttacctgcggccacaggtattcccagcgttgggtccgggcgcagagagtcgccgaacagccttacagcagctctctgcggcctgggcttggaggctgagcctcttggcgacaactttgatagtcataatgacgccggtggcaaccattttaacgaagatcaatcttcactccaggccgctcctcatctcccgcggttgcgcccacccttccctgaccctccaagcactgtgcccacccgccaacggcccagccggagagagattcgcggacacaggcggaggcgagggaggacggggatgggacgcggaggtccgcccgtgagcttctgaagcggctgagagaccctgacaatctgggcgctgggcgcgggtcctgcatccccacatttagcctcaatccgaaccccaaccagggccccctcttctttctgccgacacacccagaacattggggtgtgttagggggcaagctcgagatctattcgcctatagctcttggcgctttccttttaac

SEQ ID NO: 118497 - DNA, 586 bp, Homo sapiens; identical to SEQ ID NO: 85538
  misc_feature 1..586: note = chr2:176952724-176953310
  misc_feature 1..586: note = Hyper
  source 1..586: mol_type = genomic DNA

SEQ ID NO: 118498 - DNA, 2307 bp, Homo sapiens
  misc_feature 1..2307: note = chr2:176956330-176958637
  misc_feature 1..2307: note = Hyper
  source 1..2307: mol_type = genomic DNA
cccttgaagtcagaccgtttctctgggctgctcctatcacaaaatccgaatttgcttggaacaagcgccctcttaatttgcccctctcagttctctgcagttgacagcttggaaaaggaagcgaaacaaaggtccctgggaaagtgaagttttcaattaatttggtgtgagaaacgggcgggagtgggtggtgactgcaaaatgcgaggccggtcggctgctggagagacacagaagtttcacggtgggaggctgagtggctttctcccccggcgccgttctcagggtctttctgcgggtcgaagaaggacccgcgggagctgagaggcccaggtcggaagcactcccggctggcccaagagtagaggcgaagagcgttgagtaggcatccatggacttttctttctgggacagattgtcaggctcactgcgccgatgcctgtctttcatctgtttaagtctctgccgccagccccaagggcgcttcatgggcattttccgaacggacagcgtgtgtgtataggaagggtctgctccaatgcctcttacctgtgtgaaatgcctttgccgggtaccagtgcacaaggtagggcaaattagctcactcggatttggggtctagaagtcgactaactgagggattcagcaacaggataaaaaaatgggcctgttttcacatcattctgatcatctctgtccttcgtcttcattttgctgtgcaactcggggagccgaggagaggtggcaaaaacagcggttgccgagacaaggcgcaggccttggcgcccgcctcagtcgcagacagggcctgggatgggccgtcgcgcaatcaactcgtgggggtggctgcagcgcgtacgcctgggtcgggggggagggcgggaatgggaggtggaccctgcaaggggcaggagaggggtgggggccggagtgggtgggtccagccaggcctgggccgggagccaggctcccccgcgttcctacccccacgtggccgcgcgcagccaatggcacgcccccggcgggggccctcggggcgggaggcggccccccgaccggcccaggccccctcccaacctgaacttcgtttttataaacgtcccgcgatgagctaacctgttggagggcaggcgggccggaggcgggaggctcacagagggagagagggctagaggaagagggcgggagcgagcgaaccagagagaaaggagaggagggaggaggcgcgccgcgccatggtgtcctgcgcggggccagggccagggccggggccgggccaggccgggccatgagccgcgccgggagctgggacatggacgggctgcgggcagacggcgggggcgccggtggcgccccggcctcttcctcctcctcatcggtggcggcggcggcggcgtcaggccagtgccgcggctttctctccgcgcctgtgttcgccgggacgcattcggggcgggcggcggcggcggcagcggcggctgcggcggcggcggcggcagcctccggctttgcgtaccccgggacctctgagcgcacgggctcttcctcgtcgtcgtcctcttctgccgttgtagcggcgcgcccggaggctcccccagccaaagagtgcccagcacccacgcctgcagcggccgctgcagcgcccccgagcgctccagcgctgggctacggctaccacttcggcaacggctactacagctgccgtatgtcgcacggcgtgggcttacagcagaatgcgctcaagtcatcgccgcacgcctcgctgggaggctttcccgtggagaagtacatggacgtgtcaggcctggcgagcagcagcgtaccggccaacgaggtgccagcgcgagccaaggaggtatccttctaccagggctatacgagcccttaccagcacgtgcccggctatatcgacatggtgtccactttcggctccggggagcctcggcacgaggcctacatctccatggaggggtaccagtcctggacgctggctaacgggtggaacagccaggtgtactgcaccaaggaccagccacaggggtcccacttttggaaatcttcctttccaggtaggggcgatggagaaaagggaccgacacgagggagggggagagagaaggagaaaagaaaggactaagagtatgcgcccctacttgggagtgggagttgtgcctgtgctccacacgtgaccagggttaacccagtggaaatttgtccagttcgtgtgaaatctgtaaattcctcctctgatttcaactgcctccgtcactgccctttctttcctgtgtgcagcgcagacacgttttt

SEQ ID NO: 118499 - DNA, 564 bp, Homo sapiens
  misc_feature 1..564: note = chr2:176958947-176959511
  misc_feature 1..564: note = Hyper
  source 1..564: mol_type = genomic DNA
gcttgttaagatgccggtttgagaaactatgataatcaatcaaattaaccattgttgttaagtgcaaataatccttctttaataacaggtaagtgttatgtctatgtacataataaagaccaaacagcatggcattttttaaaaatttcctgcacccctgcaaacgcacacacacacacacacacacacacacacacaatcctcagctaggtgctccgaatatcccagcctaatttttcttgtgcttttgtttgtatcaggggatgtggctctaaatcagccggacatgtgcgtctaccgaagagggaggaagaagagagtgccttacaccaaactgcagcttaaagaactggagaacgagtatgccattaacaaattcattaacaaggacaagcggcggcgtatctcggctgctacgaacctatctgagagacaagtgaccatttggtttcagaaccgaagagtgaaggacaagaaaattgtctccaagctcaaagatactgtctcctgatgtggtccaggttggccacagacagcttagaagccattcggttgtctccaaaa

SEQ ID NO: 118500 - DNA, 30 bp, Homo sapiens; identical to SEQ ID NO: 85543
  misc_feature 1..30: note = chr2:176961663-176961693
  misc_feature 1..30: note = Hyper
  source 1..30: mol_type = genomic DNA

SEQ ID NO: 118501 - DNA, 37 bp, Homo sapiens; identical to SEQ ID NO: 85544
  misc_feature 1..37: note = chr2:176962204-176962241
  misc_feature 1..37: note = Hyper
  source 1..37: mol_type = genomic DNA

SEQ ID NO: 118502 - DNA, 30 bp, Homo sapiens; identical to SEQ ID NO: 85545
  misc_feature 1..30: note = chr2:176962587-176962617
  misc_feature 1..30: note = Hyper
  source 1..30: mol_type = genomic DNA

SEQ ID NO: 118503 - DNA, 610 bp, Homo sapiens
  misc_feature 1..610: note = chr2:176963158-176963768
  misc_feature 1..610: note = Hyper
  source 1..610: mol_type = genomic DNA
gcaggaggaagaggccgattgcgttccccagagccacccaattggtcgccataactcacacaataaagtggcagcgcggcggtcagtcttgccctccggcggcgcctgtgtggtctcagtgcaggagcccgcgatctaaccaattccagcttggctcggagaccgagggtcctgctgcaggctgagactggcgccggtcaccgggtctcccagggtcttgggatcagaggcaggaggggaggacccctagtcctctggccggactaggcaagagggccagcgacggggtctgagcacaccgctcccggctaagaactgctgcctttcccacttccctgtttgtcagacccgtgaactccctatccccggcacccctgggggcgctgaggcaaggaactctgctagccagctgcctccgaacgcccgctgttccccggccaggtggttctggctcttctgcctttccacacccagtcgggggagttcgtcctgctttgccctccacttggtggatggggacacctcggagttctggtttgcagtgtgtagtcctggagaggactcctgaagataaaaggaatgtagcctttggccacgattggtggatcga

SEQ ID NO: 118504 - DNA, 1472 bp, Homo sapiens
  misc_feature 1..1472: note = chr2:176964050-176965522
  misc_feature 1..1472: note = Hyper
  source 1..1472: mol_type = genomic DNA
agctcctggtgccgccggaccgcgccctctccggataagtcgagaggcgccggttaatggaaaatgcctccgctgcaacttaaagccggtagaagcaagccgggcccagaaagcctgcggaaaacgaatcgcaaagccaatcacgaccaagaagagtcccaggggacacttgggcagagtcaccctcttgcccgatgtccccagctgctgaagccgggcctggaaacccgcagacagttagtcttcgctcaacctgatttggctctgctggcagcctcgtccttcgccatcgaacattgcgggtgttatcataatactctgaagggggggaaaacgggtcggggggatgtaggcggtgctgaaatgaccggctttgaagaacctgcaggcaaagtttcgtccaatcgtctgagcctgtcctcttattcccggttgtaactaaatactgttgcgagcgcagccgaagccctttgttggagatgtgtgagcgcagtctctacagagcgggctatgtgggctcgcttctgaatctgcagtcgccagactctttctacttctccaacctgaggccgaatggcggccagttggccgcgcttccccctatctcctacccgcgcggcgcgctgccctgggccgccacgcccgcctcctgcgcccccgcgcagcctgcgggcgccactgccttcggcggcttctcgcagccctacctggctggctccgggcctctcggcctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggtttgggccgggatgggaggtggggttcaagggagagtgtaaggggaggtgaaccgcctgggggcgggcaatagacagagtacgggctgggttgacgtgggttggggctgtgttgcaggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcc

SEQ ID NO: 118505 - DNA, 265 bp, Homo sapiens; identical to SEQ ID NO: 85552
  misc_feature 1..265: note = chr2:176968485-176968750
  misc_feature 1..265: note = Hyper
  source 1..265: mol_type = genomic DNA

SEQ ID NO: 118506 - DNA, 809 bp, Homo sapiens
  misc_feature 1..809: note = chr2:176969099-176969908
  misc_feature 1..809: note = Hyper
  source 1..809: mol_type = genomic DNA
cccagtcagcttttacgagagctgccagacagtgtctgttcacgttctccagataccaggggcgccctgacaaagttaaggtcaagttagtgtcttatcttgggtgactcaaaatcaccgcatcgcgtcctggcgctgtgcggaaagctctttctcgcggagcggctggctgcgccccgaaggcctggtgcgctccctgcgtttcgggtggggccgcgcaggcaaggacaaggccacagagtcggggtcttcacggtaggttctcgagcgggacgcgcgggtccggaggctgcggttttccctgggtttggggaatgggggtaggaactaggagggagctggggccaaagagccaagcgggctgggactggaatgaaagcgctctgggttgtggagtgggtcggggggcaagggtccgcgctaaggagccgaaaggggccggccgcccccttcccctatgcaccggcgcgccactgcagatggctcaccctcccccgccaaatcgctgctcccgccggagctgccgtcgccatgtcgttgaacttgaatggttcgtcctccccttttccctcttcggcggtcagcaggctccatactgggggcgccgggctgcctgcaccccaccccgtgccgccagtagagagaaggtgcgagaattttgcgaatccccagacacataaagacccgggttgaagtcctcgcagctgccctgggtcctgagctaccgcagggccagtgtgcagcgtccagggagccattttaggagagagatccaggggcgtcgaccacgagcccgaaagggagaggct

SEQ ID NO: 118507 - DNA, 68 bp, Homo sapiens; identical to SEQ ID NO: 27718
  misc_feature 1..68: note = chr2:176970219-176970287
  misc_feature 1..68: note = Hyper
  source 1..68: mol_type = genomic DNA

SEQ ID NO: 118508 - DNA, 30 bp, Homo sapiens; identical to SEQ ID NO: 27719
  misc_feature 1..30: note = chr2:176970603-176970633
  misc_feature 1..30: note = Hyper
  source 1..30: mol_type = genomic DNA

SEQ ID NO: 118509 - DNA, 213 bp, Homo sapiens; identical to SEQ ID NO: 85557
  misc_feature 1..213: note = chr2:176971223-176971436
  misc_feature 1..213: note = Hyper
  source 1..213: mol_type = genomic DNA

SEQ ID NO: 118510 - DNA, 276 bp, Homo sapiens
  misc_feature 1..276: note = chr2:176972712-176972988
  misc_feature 1..276: note = Hyper
  source 1..276: mol_type = genomic DNA
gggcgaccccaggaccggggctggtggcggcgggggcagtccctgcaccaaggcgacccctggctcggagcccaagggggcagcagaaggcagcggtggcgacggcgagggccccccgggagaggcgggggccgagaagagcagcagcgcaggtaggcaccgggtactgggcaagcggtgggcccgggggccgcgggggagggggggggggcggaggcctccctctgcttgcgcctttttatgtgctactttataagcattcgaagaggtttatac

SEQ ID NO: 118511 - DNA, 79 bp, Homo sapiens; identical to SEQ ID NO: 85559
  misc_feature 1..79: note = chr2:176974033-176974112
  misc_feature 1..79: note = Hyper
  source 1..79: mol_type = genomic DNA

SEQ ID NO: 118512 - DNA, 311 bp, Homo sapiens; identical to SEQ ID NO: 85560
  misc_feature 1..311: note = chr2:176976029-176976340
  misc_feature 1..311: note = Hyper
  source 1..311: mol_type = genomic DNA

SEQ ID NO: 118513 - DNA, 147 bp, Homo sapiens; identical to SEQ ID NO: 85561
  misc_feature 1..147: note = chr2:176976597-176976744
  misc_feature 1..147: note = Hyper
  source 1..147: mol_type = genomic DNA

SEQ ID NO: 118514 - DNA, 35 bp, Homo sapiens; identical to SEQ ID NO: 85562
  misc_feature 1..35: note = chr2:176976975-176977010
  misc_feature 1..35: note = Hyper
  source 1..35: mol_type = genomic DNA

SEQ ID NO: 118515 - DNA, 788 bp, Homo sapiens
  misc_feature 1..788: note = chr2:176980718-176981506
  misc_feature 1..788: note = Hyper
  source 1..788: mol_type = genomic DNA
ccagaggtccggccccgcagaggtcagggtgtggttcctctgagagccgaagcctcgtgtagccctccggggcgcataggaacccggagccaggcaggaggaccgagcgggaggacaacgcagggaccaacccatccatggggatccgggcccggccagctgcttggcctcccggccctcgcggccctttttgcctccgccctcctagagacaccttggccgcttcttagccccaagggatctttcctttggacccctggggtgggatgtctcagggcccgcggaatccgactcaccttcccgctgggctgcccgggactaaattaaccagcctgcgcccccacccgcttgtcctggacccggccctcttaagcgcgttctgcctggttgtgtgtggggggaatgcttctgtgcgctggcgccagggcactctggcttccctccccgtccgtgcgtgtccacttggaggcccctagagctgagactttccttccgccggttgggcccaggggccgaagcgggggacgcgagtggggcgggctggccgagcgagccctggagaggcggacaggagggcggcggagagcgctgggccggttgtctccagcgcgcactatcgcgggcgcgtagtagatgtcgctgttgtccgtgcttacccggccggccggccaggctctggagcacgtgacccgagaggaggctgcggctcaaggccattttcaaatctcattggcttggttgtcatgtggtcggcagaggcatccacaattacacggggaatgttttcc

SEQ ID NO: 118516 - DNA, 422 bp, Homo sapiens
  misc_feature 1..422: note = chr2:176982293-176982715
  misc_feature 1..422: note = Hyper
  source 1..422: mol_type = genomic DNA
aaggaaagcaaaggtcggtatgagcagagttgccaccccagcggggcgcgcagcccgggaacccggcagagagggagtgccggggtgcccagcgccgagccggagcccgacttggcaggtgctgctccgcctggttttagaggggtgatctcagccctgagatagtccccgcttctcccctgctgccctggccctctccgccagtcctggccccacgctgatggcgcccgggcagaggaaaagcttgccggttttatttttcctgagctagacctgaacacaacaaaagagcgcaaaggagacctgcggctcataaacacgaccacagagcctcttttctcctgctcagatttgcagttccagttttgccttgagcccaatgatcatgttaaggtgatccagggcaccgtgttcgtgttcaa

SEQ ID NO: 118517 - DNA, 83 bp, Homo sapiens; identical to SEQ ID NO: 85567
  misc_feature 1..83: note = chr2:176983753-176983836
  misc_feature 1..83: note = Hyper
  source 1..83: mol_type = genomic DNA

SEQ ID NO: 118518 - DNA, 1867 bp, Homo sapiens
  misc_feature 1..1867: note = chr2:176986559-176988426
  misc_feature 1..1867: note = Hyper
  source 1..1867: mol_type = genomic DNA
ggttctgccctgtggcgtgttctcttccagggcctttccagcatcatcggagaagacgaagcaccctggccgccactgtccgtgctgcgccaactcgcccggccgcccgcccttccgagggcaggcagaagcccctctgtgtcctccaccgccgcgccccggctcgcccctcgggccgcggcgtgtgcccagcctcacgtcggggtgtgtgtggccgcgcgggcgtgtgtgagtgtggcagggggagggggccctccgatctgctccatccgtccgttttattagggacacattaatctataatcaaatacacctcataaaatttttattgaaaggcataatatcattacagaggtcttccacctgttttaaacaacacgacaagctgtgagcaagcgtgtgtgtggggatgtgtggggaggggtgggtgtgagtagggagagaggcgaggggagaacagctcccctcgggcgctaggggccgccccgagggcccgcctgcctcgggcgacaccggcctggcgcccccgcggccgctccgtgtgccctggactcgccgcccgcggctcggaagctggagagtcagcgacggggcccgactgcgggaccgagggctgcaagaagaagcgaacaaatagtccccagcgcctcctctggatgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggccgtgttctctgcctcgtggtccgcggtgccctcccagcccccggcagcggcggcgatgagcggcctctaccacccgtacgttcccccgccgcccctggccgcctctgcctccgagcccggccgctacgtgcgctcctggatggagccgctgcccggcttcccgggcggtgcgggcggtggcggtggtggtggaggcggcggtccgggccgcggtcccagccctggccccagcggcccagccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcct

SEQ ID NO: 118519 - DNA, 53 bp, Homo sapiens
  misc_feature 1..53: note = chr2:176992935-176992988
  misc_feature 1..53: note = Hyper
  source 1..53: mol_type = genomic DNA
atatttcagtccacccggacacaagtcaggatcgcgctcgcaggctgggccaa

SEQ ID NO: 118520 - DNA, 1173 bp, Homo sapiens
  misc_feature 1..1173: note = chr2:176993464-176994637
  misc_feature 1..1173: note = Hyper
  source 1..1173: mol_type = genomic DNA
gctttgggaaaaattcgtaactttgaggcctgcgcgctctctcggcagtaatttcacaggcttggcggaggaagtaggatcgttagcataagatgggccgcctgcagctgcctggaaccggcgcgatctgaacgccggctgggaggctcctggggggaacttgcggtcgtctgccctccgcactcctccgggaaccgcagccggccctggttcgctgcgcgccggggctgagacccgggagccgcgtcctgcccgaggaaatgtcaccctccccagcgcgagccctttttcccgcctcagaacgtttctgtccgctcttctatttactctctcagcaagcctaatgccccctcctgcattcttcagcctccccctgcgcccagggctgacgtctatcaagggtgaaatgatggaaactatattcatgggcatgatttccattaaatatcaattaacctgagagcctcggccaggcttgcggtgcgtcaagggtaaatgtacatctcatttccacagggcccgctcggctggaaaagaaaggctttgatttgctttgataacgccaggatctggggccacactcgcggcttttaattaaaccacttcgatatgccccaactcaaatgcacggtccggtccgtcaacacctcttgtccacgttccctgggctgcacccgcgtgtccagagctgcaaaagccacgggcaacctctgcttttgcagccaggggctcggggaggcagtcatttgctccgcagcctcctgggagtggcctccttggctcccccaagtctaaggctccgccgcggcccctccctgccggctgcgatccgcattcccgcggccccggggcacacggagcccttggcagtgcgtctttatgggccccctttaaggccggcggaggcatctcgggccgggcgcggcgctccgtccgtcggccgtagcgactgaactgcgcgcggatccctccgcggggctcctcgtccccgtcacgctgactttccgtgcagtgctgtggtgcgaaaatgcctcgccggtgcgcaccgggtcggcagcctcggcggcgggggcgagattggcgggaggggggcgcggggggggcgcggtaagaggtggcggcgggcagagggtgttttttttcttttccctccagagccggggtttgtaaacc

SEQ ID NO: 118521 - DNA, 753 bp, Homo sapiens
  misc_feature 1..753: note = chr2:176994915-176995668
  misc_feature 1..753: note = Hyper
  source 1..753: mol_type = genomic DNA
gcctggcctcagaagcgacgcgcgagcgcgggcgggcggcagcagcgacgtagcccggcggtcccggcggcgagagcagccgccccacaggcccccgcggcagtgcggccgagtcgaggctcgctctctggctgcttagcgccgcccgcccgcccggggccgccgccgctgacgccccaatgagttcgtacttcgtgaacccgctgtactccaagtacaaggcggcggctgcggcggcggcggcggcgggcgaggccatcaatcccacttactacgactgtcacttcgcgcccgaggtcggcggccgtcacgccgccgccgcagcagccctgcagctctatggcaacagcgccgccggcttcccgcacgcgcccccgcaggcgcacgcgcacccgcacccgtccccgccgccctccgggactgggtgcggcggtagggaaggccggggccaggagtacttccaccccggcgggggcagcccggccgctgcctaccaggccgccccccctcctcctccgcatcctccgcctccgccgccacctcccccctgcggcgggattgcctgtcacggggagcccgcgaagttttacggatacgataacttacagagacagccgatttttacgacccagcaagaggccgagctggtacaatatcctgactgtaaatcgtccagtggtaatattggcgaggacccagaccacttaaatcagagctcgtctccttctcaaatgtttccgtggatgagaccac

SEQ ID NO: 118522 - DNA, 38 bp, Homo sapiens; identical to SEQ ID NO: 6554
  misc_feature 1..38: note = chr2:176996261-176996299
  misc_feature 1..38: note = Hyper
  source 1..38: mol_type = genomic DNA

SEQ ID NO: 118523 - DNA, 185 bp, Homo sapiens; identical to SEQ ID NO: 27734
  misc_feature 1..185: note = chr2:176997536-176997721
  misc_feature 1..185: note = Hyper
  source 1..185: mol_type = genomic DNA

SEQ ID NO: 118524 - DNA, 215 bp, Homo sapiens; identical to SEQ ID NO: 85576
  misc_feature 1..215: note = chr2:177000663-177000878
  misc_feature 1..215: note = Hyper
  source 1..215: mol_type = genomic DNA

SEQ ID NO: 118525 - DNA, 34 bp, Homo sapiens; identical to SEQ ID NO: 85577
  misc_feature 1..34: note = chr2:177000938-177000972
  misc_feature 1..34: note = Hyper
  source 1..34: mol_type = genomic DNA

SEQ ID NO: 118526 - DNA, 842 bp, Homo sapiens
  misc_feature 1..842: note = chr2:177001206-177002048
  misc_feature 1..842: note = Hyper
  source 1..842: mol_type = genomic DNA
tttatgacctatttgcggtcgtcattggctgcggctggtcatgtgcaggcgccgctcgccttcacggcctttttcctgatttccccggcgaatttccccccgcattctgctttcccagagcctcaccccctctttttctaacctttgtctctgcagaggtgggctccagtcaccggctgcgggattgcggagtccgccgcggcctcggctcccgcccggcgcccggcctggccccaccgccgctcactcggtccgcatcgccgccacctccggagctggtggggagcccggcgagggagggcctggaaggggccctgggcgccgagtcccccgccggcgccgacaccgcctgccaggagcagccggcctgctcgaggtgactgcagccgcgcggttctggcgcggcttcttcaccaacatgagcgggtctctgcgtccgagagtgagcgcagccgggcagcgcctagtggattacagcagacgcccggaccgaccgccgcctgtagctcggcagccttcgggtaagaatcgccccctccccgctccccagcatgccaccaagaagcctggggcgccgacccccttgggcagctcagtccggctgctcccctacatttcccggggaagtggggggtcgctgtctaagccccttcccccaatcacttcgttcctagggcgtcccctggggcctggggtggagtccggctgggttcagaagtctaagggggcagtattatttcaaaaattctgagatacgggtagccacagacaggatcccactgcctagatggagagcccctcaatcctaccctaggaaagtgtatagacgggttactactgaa

SEQ ID NO: 118527 - DNA, 30 bp, Homo sapiens
  misc_feature 1..30: note = chr2:177003159-177003189
  misc_feature 1..30: note = Hyper
  source 1..30: mol_type = genomic DNA
aggtcattctttgatcggggtaaaaaacat

SEQ ID NO: 118528 - DNA, 344 bp, Homo sapiens
  misc_feature 1..344: note = chr2:177003719-177004063
  misc_feature 1..344: note = Hyper
  source 1..344: mol_type = genomic DNA
catagatcagggagccgatagcatgtccgggccttggtgacgacgggtcaggccatgaactgggcttgagatctctggcgaggaccaggagaaagacgaagctcgaaattataaatgtggccaagcacgagagctgaaaacaaagcgtattttcccgtcagatgtttctacaaataaatttcgccagagttctgttttctgaatcagagaggcaagggaaatcgaacaaagacagtatttcaccctgggctggcaggcagctgttagaggtatttacggccttgccgcagtgcggcggccaggcagccgggtagggtatgcgggggcaccggaagctggggaga

SEQ ID NO: 118529 - DNA, 269 bp, Homo sapiens
  misc_feature 1..269: note = chr2:177004437-177004706
  misc_feature 1..269: note = Hyper
  source 1..269: mol_type = genomic DNA
tcctctgcatccaggcgtagaagcagtgcgcggtaccttatccgcactgcgcggtgcaagccggccgcacagctcacggtcccgcagcgcccgccacacacccgcgccagaggtccagcgcatgtgcagtgaaatggcctagcccgggaattcgatcggcaaagcacgggtgtgggggcgggggggtgggggggggcgagtggactcgagcaggaagatacacccgatctttccattctccctccgtcaaggctcgctactcatcttgc

SEQ ID NO: 118530 - DNA, 697 bp, Homo sapiens; identical to SEQ ID NO: 27742
  misc_feature 1..697: note = chr2:177004982-177005679
  misc_feature 1..697: note = Hyper
  source 1..697: mol_type = genomic DNA

SEQ ID NO: 118531 - DNA, 1024 bp, Homo sapiens
  misc_feature 1..1024: note = chr2:177042532-177043556
  misc_feature 1..1024: note = Hyper
  source 1..1024: mol_type = genomic DNA
ctccattgttcacagcgctgccctacaaataccatatccgtccccacctcctctgcaagggtcgagcggaagagtaggtctggtgagctgagctctagggagctggtaccatcttccctcaatccccctcggttaccccttggggcagcaacgacgccatcccagccccttccagagaacacacaaaggaagccccacccgtccttagacctgaggacacgctcgggagcgggctgacgtggaccccgtttcagggcgccccgggcccctgcggggaacaatagccgccgcctcctgggcggtctggcgggcgcgcggcacaaacgtccgcgccgccacgtgatgcgcgcgctcgttccgcgctctccgcgcctcagcgagcggccaggctgcgggcggggtgggctggcgctcctgatccacctggaacacttttgcaaagacagacggtgagttaatcaccctaccggctggcggccgcgtcccctctcgcccgcgaggaggactggagaaggggctggggtggaggttttctctgtgtgtgtctagggttgggggcaggagaggttagttctattaagagttcatcaatcacccggtgtgcacttttcgctcgacagcggttcctcctacttcagagcaagtctgggccagctgggatccgaccagaaatcgcaagcggaggagacgcagtagcgcaggctgagcgctaactgaaggcgcgacctgagcccggcgcctgctggggagctgcgcagccaggacagcggtcggcagcacagggcctgggcgcagggcccgccgtcaccacctcacgtcggaagccagcactgctgcccgccagccctgccgcctgccctcggacttcccagggcgcccagggtcctcccaacgcgcctgcacccacacccgcccctgagccacagtgaccttgcattccccgccccctgccacacctcctgcgtgcccgagtgtcacccttaaataccgctctacacccagagagggacgaatacacctctga

SEQ ID NO: 118532 - DNA, 152 bp, Homo sapiens; identical to SEQ ID NO: 85588
  misc_feature 1..152: note = chr2:177052592-177052744
  misc_feature 1..152: note = Hyper
  source 1..152: mol_type = genomic DNA

SEQ ID NO: 118533 - DNA, 1400 bp, Homo sapiens
  misc_feature 1..1400: note = chr2:177052963-177054363
  misc_feature 1..1400: note = Hyper
  source 1..1400: mol_type = genomic DNA
gcagtctccaccggccgcgcgtcacgctcccatttaaccttttccatgccgcgacgcccacactccgccctcgagggactagccccccccacgatccagagcagaagcggctcgccccgctgcatccacgggccctcacccaagcgtccagtcctgcctttctccccccacctcgcccaatacctgtccgagagcaggcgttctgccctctcgccccgcccttgcccaggcagcccccggtcgcgacggctctcctcggggctcgggggcgctgggcggcggccctgggctgctttggctaacttggctgcggggcaggcgcgaggagcggcgcgccgaccgggccgagcggagaggccgcccattggccggccagcgccacgtggccgcccccgccggtatattaggccactatttacctccggctcactcgccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggtaagtccgcgggccttggatggggccacctggggttggggacggagcctcccccgcggaaatgcgctgggagcgtggtgtcgctgcctttccagacagcggtttgggttttgtggaggagacgcgttcccgggcgaattccatggagtctgcctcgagtacagattcggaaaatgtgccag

SEQ ID NO: 118534 - DNA, 130 bp, Homo sapiens; identical to SEQ ID NO: 85593
  misc_feature 1..130: note = chr2:177133417-177133547
  misc_feature 1..130: note = Hypo
  source 1..130: mol_type = genomic DNA

SEQ ID NO: 118535 - DNA, 101 bp, Homo sapiens; identical to SEQ ID NO: 85597
  misc_feature 1..101: note = chr2:177498024-177498125
  misc_feature 1..101: note = Hypo
  source 1..101: mol_type = genomic DNA

SEQ ID NO: 118536 - DNA, 695 bp, Homo sapiens; identical to SEQ ID NO: 85598
  misc_feature 1..695: note = chr2:177502225-177502920
  misc_feature 1..695: note = Hyper
  source 1..695: mol_type = genomic DNA

SEQ ID NO: 118537 - DNA, 155 bp, Homo sapiens; identical to SEQ ID NO: 85599
  misc_feature 1..155: note = chr2:177502980-177503135
  misc_feature 1..155: note = Hyper
  source 1..155: mol_type = genomic DNA

SEQ ID NO: 118538 - DNA, 210 bp, Homo sapiens; identical to SEQ ID NO: 85600
  misc_feature 1..210: note = chr2:177580925-177581135
  misc_feature 1..210: note = Hypo
  source 1..210: mol_type = genomic DNA

SEQ ID NO: 118539 - DNA, 30 bp, Homo sapiens; identical to SEQ ID NO: 85601
  misc_feature 1..30: note = chr2:177842306-177842336
  misc_feature 1..30: note = Hypo
  source 1..30: mol_type = genomic DNA

SEQ ID NO: 118540 - DNA, 192 bp, Homo sapiens; identical to SEQ ID NO: 85602
  misc_feature 1..192: note = chr2:177895144-177895336
  misc_feature 1..192: note = Hypo
  source 1..192: mol_type = genomic DNA

SEQ ID NO: 118541 - DNA, 32 bp, Homo sapiens; identical to SEQ ID NO: 39717
  misc_feature 1..32: note = chr2:178089350-178089382
  misc_feature 1..32: note = Hypo
  source 1..32: mol_type = genomic DNA

SEQ ID NO: 118542 - DNA, 220 bp, Homo sapiens; identical to SEQ ID NO: 85604
  misc_feature 1..220: note = chr2:178119023-178119243
  misc_feature 1..220: note = Hypo
  source 1..220: mol_type = genomic DNA

SEQ ID NO: 118543 - DNA, 30 bp, Homo sapiens; identical to SEQ ID NO: 39718
  misc_feature 1..30: note = chr2:178131780-178131810
  misc_feature 1..30: note = Hypo
  source 1..30: mol_type = genomic DNA

SEQ ID NO: 118544 - DNA, 238 bp, Homo sapiens; identical to SEQ ID NO: 85607
  misc_feature 1..238: note = chr2:178972992-178973230
  misc_feature 1..238: note = Hypo
  source 1..238: mol_type = genomic DNA

SEQ ID NO: 118545 - DNA, 137 bp, Homo sapiens; identical to SEQ ID NO: 85608
  misc_feature 1..137: note = chr2:179058613-179058750
  misc_feature 1..137: note = Hyper
  source 1..137: mol_type = genomic DNA

SEQ ID NO: 118546 - DNA, 688 bp, Homo sapiens; identical to SEQ ID NO: 85609
  misc_feature 1..688: note = chr2:179278181-179278869
  misc_feature 1..688: note = Hyper
  source 1..688: mol_type = genomic DNA

SEQ ID NO: 118547 - DNA, 19 bp, Homo sapiens
  misc_feature 1..19: note = chr2:179317038-179317057
  misc_feature 1..19: note = Hypo
  source 1..19: mol_type = genomic DNA
aaagcgatttgttgttttg

SEQ ID NO: 118548 - DNA, 71 bp, Homo sapiens; identical to SEQ ID NO: 85611
  misc_feature 1..71: note = chr2:179413207-179413278
  misc_feature 1..71: note = Hypo
  source 1..71: mol_type = genomic DNA

SEQ ID NO: 118549 - DNA, 30 bp, Homo sapiens; identical to SEQ ID NO: 85612
  misc_feature 1..30: note = chr2:179440837-179440867
  misc_feature 1..30: note = Hypo
  source 1..30: mol_type = genomic DNA

SEQ ID NO: 118550 - DNA, 38 bp, Homo sapiens; identical to SEQ ID NO: 85613
  misc_feature 1..38: note = chr2:179564040-179564078
  misc_feature 1..38: note = Hypo
  source 1..38: mol_type = genomic DNA

SEQ ID NO: 118551 - DNA, 30 bp, Homo sapiens; identical to SEQ ID NO: 39721
  misc_feature 1..30: note = chr2:179672126-179672156
  misc_feature 1..30: note = Hypo
  source 1..30: mol_type = genomic DNA

SEQ ID NO: 118552 - DNA, 195 bp, Homo sapiens; identical to SEQ ID NO: 85615
  misc_feature 1..195: note = chr2:179893525-179893720
  misc_feature 1..195: note = Hypo
  source 1..195: mol_type = genomic DNA

SEQ ID NO: 118553 - DNA, 1539 bp, Homo sapiens; identical to SEQ ID NO: 85619
  misc_feature 1..1539: note = chr2:180725172-180726711
  misc_feature 1..1539: note = Hyper
  source 1..1539: mol_type = genomic DNA

SEQ ID NO: 118554 - DNA, 183 bp, Homo sapiens; identical to SEQ ID NO: 85620
  misc_feature 1..183: note = chr2:180886727-180886910
  misc_feature 1..183: note = Hypo
  source 1..183: mol_type = genomic DNA

SEQ ID NO: 118555 - DNA, 30 bp, Homo sapiens; identical to SEQ ID NO: 85621
  misc_feature 1..30: note = chr2:182059306-182059336
  misc_feature 1..30: note = Hypo
  source 1..30: mol_type = genomic DNA

SEQ ID NO: 118556 - DNA, 39 bp, Homo sapiens; identical to SEQ ID NO: 85622
  misc_feature 1..39: note = chr2:182116902-182116941
  misc_feature 1..39: note = Hypo
  source 1..39: mol_type = genomic DNA

SEQ ID NO: 118557 - DNA, 195 bp, Homo sapiens; identical to SEQ ID NO: 85623
  misc_feature 1..195: note = chr2:182155914-182156109
  misc_feature 1..195: note = Hypo
  source 1..195: mol_type = genomic DNA

SEQ ID NO: 118558 - DNA, 30 bp, Homo sapiens; identical to SEQ ID NO: 85624
  misc_feature 1..30: note = chr2:182303713-182303743
  misc_feature 1..30: note = Hypo
  source 1..30: mol_type = genomic DNA

SEQ ID NO: 118559 - DNA, 1738 bp, Homo sapiens
  misc_feature 1..1738: note = chr2:182321357-182323095
  misc_feature 1..1738: note = Hyper
  source 1..1738: mol_type = genomic DNA
gcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtgg

SEQ ID NO: 118560 - DNA, 160 bp, Homo sapiens; identical to SEQ ID NO: 85628
  misc_feature 1..160: note = chr2:182387465-182387625
  misc_feature 1..160: note = Hypo
  source 1..160: mol_type = genomic DNA

SEQ ID NO: 118561 - DNA, 30 bp, Homo sapiens; identical to SEQ ID NO: 85629
  misc_feature 1..30: note = chr2:182388455-182388485
  misc_feature 1..30: note = Hypo
  source 1..30: mol_type = genomic DNA

SEQ ID NO: 118562 - DNA, 89 bp, Homo sapiens; identical to SEQ ID NO: 85630
  misc_feature 1..89: note = chr2:182395490-182395579
  misc_feature 1..89: note = Hypo
  source 1..89: mol_type = genomic DNA

SEQ ID NO: 118563 - DNA, 148 bp, Homo sapiens; identical to SEQ ID NO: 39723
  misc_feature 1..148: note = chr2:182422221-182422369
  misc_feature 1..148: note = Hypo
  source 1..148: mol_type = genomic DNA

SEQ ID NO: 118564 - DNA, 271 bp, Homo sapiens; identical to SEQ ID NO: 85632
  misc_feature 1..271: note = chr2:182521375-182521646
  misc_feature 1..271: note = Hyper
  source 1..271: mol_type = genomic DNA

SEQ ID NO: 118565 - DNA, 37 bp, Homo sapiens; identical to SEQ ID NO: 27763
  misc_feature 1..37: note = chr2:182542469-182542506
  misc_feature 1..37: note = Hyper
  source 1..37: mol_type = genomic DNA

SEQ ID NO: 118566 - DNA, 470 bp, Homo sapiens
  misc_feature 1..470: note = chr2:182542848-182543318
  misc_feature 1..470: note = Hyper
  source 1..470: mol_type = genomic DNA
gcggcggaggcttaacgtggaagacatgggagctgtccatggtaccgtaaggcggactgggcagcccaggcgactggtaggagtaggggtgtacagggaaggaagcgctggccgtcggcaggtgggggggcatgtcctggttctgctcaggcagaaaagtccgaggattgagttgcaggcagcccgcaaccaggttggtggtgggttgggataagcccttgcaaagcgtctgaacgaaggagaccaggtctgggcttttgcctgagcgcaggatctccgacagagcccagatgtagttcttggccaagcgcagagtctcgattttggacagcttctgcgtcttagaatagcaaggcaccaccttgcgcaggttgtctagcgccgcgttcagtccgtgcatgcggttccgctcccgggcgttagccttcatgcgtctcaatttaaaacgctccaggcgagccttagtcatc

SEQ ID NO: 118567 - DNA, 344 bp, Homo sapiens; identical to SEQ ID NO: 27765
  misc_feature 1..344: note = chr2:182543758-182544102
  misc_feature 1..344: note = Hyper
  source 1..344: mol_type = genomic DNA

SEQ ID NO: 118568 - DNA, 188 bp, Homo sapiens; identical to SEQ ID NO: 85638
  misc_feature 1..188: note = chr2:182544428-182544616
  misc_feature 1..188: note = Hyper
  source 1..188: mol_type = genomic DNA

SEQ ID NO: 118569 - DNA, 892 bp, Homo sapiens
  misc_feature 1..892: note = chr2:182545193-182546085
  misc_feature 1..892: note = Hyper
  source 1..892: mol_type = genomic DNA
taaccctggggcctccggacgccgcgcctcctgcgtgggcgaattcctcgtgtcgtggccgcgcgggcgctcaggttatatagcccagttagtgatgctaagcgcgggcggggccgctagctgaggggctagcaggtctatgcgcctgacgcctgcgcacgcgtccaggctgtgcgctccccgttctcccctcctccccacttctccccacgccttgctcgtctcccgccctcctccgacaaccgctcccctcaccctccacccctacccccgcccctcctccttcctccccggcatgcgccatatggtcttcccggtccagccaagagcctggaaccacgtgacctgcccatttgtatgccgcggagcgctccattccggcccctttgtggccagaagaaagtggcccatctgtcgccagttagagactccgcggacctgtttttacccgcaggagagattaaccctttcaggcggcagaagggacggggatagaggggggaggggatttgagggaaggaagggaaaagctaatgttaactaggtctagatcagagcgagtggcctgctttcgcgccggaagtaggacagaggtgaaagaggcagaagcggggagactgaggcacgcagtgaagagtcctcgctcctttcgatttcttgtcctgacactggcatccagagcagcatgactccttgccctctctgaaaggcccatcccttggcttcttctccttggcagacgctttgatcattggcgccaaaggatggcttctcctaatctccgtcggcccctctaagcaaacatatacgccatataaaagcggcttcatctgtaaacgcagcgttgagattagttccccaacctccctaaccggatcgtcctctcccagtt

SEQ ID NO: 118570 - DNA, 258 bp, Homo sapiens
  misc_feature 1..258: note = chr2:182546292-182546550
  misc_feature 1..258: note = Hyper
  source 1..258: mol_type = genomic DNA
tggggacttctttgacggttgtattctgccttttaaccatggccactgggttgctggaaagggcaccctcactcagccagtccagggacgcttctggttccctggccagcccgccctggacggcctcggctctctagtccaggcattgaccacaagtacggtggtggacacctcgccacagccggacctgcgctcttgctcccctcagtctcgggtctgtataagatacttgattcagacaagcgttttcaaagagaa

SEQ ID NO: 118571 - DNA, 2346 bp, Homo sapiens
  misc_feature 1..2346: note = chr2:182547199-182549545
  misc_feature 1..2346: note = Hyper
  source 1..2346: mol_type = genomic DNA
acttggctgacaaagcgcataggggaggataaaataattcacccaggagcctgggcccaggatttacccctgtactgtctgtatcttcagtgttgggctaaaactcgagggcgtcggagtactagcccttagaagatagtacacagcccgacgtttgcggcagggccaggttaagtactgcccctcacccggcagctgccccgactggcagcacactatgccgcaggcatatgcaactcgtgcctaggctctcatttttccaactttggggagttccggaggagaactggggacggagtgggagaaaggactccagctagcttcgaggtcaggggtagcctagaggtccctctgctaaatccttgtcctcacccccagaaagcagaaacctccagttcgcgacatcctgtgcaatacaggagaattatggtggagtcagatgttcttgagcaagagggacgcccgagtgttttgccagacggagactcaaatgcgtaaagtgcgggaattactagtctgtttcctccctctacccttgataaattcatctctaatcccactgcgcgttgttcgctcaggcctggagatttgtacaaaggaaaggccactccaggatgtttcagagacagggctgaggttgggtctcacggtagctgtccttgggcttcccatcccgcagcgctccgatgtgaccctcctctgcgcggaaaatttcgacccggggcgccggcatcgcgacgctcagccagtgcccgcgaggctcccaggagatgcggggtagtaaggccctaaaaagaggagcctggacacggcctggattgaggtgcgttttgtttggggttgaaggcgcgagaaattggggcgagagaagagagtcagccggatcccggagaggacagagctgaaggcgcggcggggcttagcactgaggaccttctccgcggccccgctcctcctccttattttcttctctttggacttgtttggacggttgcacacttttccccctcctgattccctaagttttttgtctctcccctcgctgcccgttagctgtactcccccagctcccgtccctactgggcgctgcaggctacccagcggcacgcgaaccgcacgcgcggacaacaaaagcctctttcatgactcactgccctcgagcaatgccccaaatctgccgcctcccgggtccccgctctgagcgcgcggcgcgggccgggcgtcccggccgttacagcggcagccggagcgcccgcgggaaggggggcgggaggaggcgtgtggccaggggtggggagaggggagtgtggcctgggccgggcggaggggaagggggaggcatgtgggaggatgggggtggggaagggatggaggcgtgtggcccggacgtagggggtgggaagcgtgtggctggaggcgaaagcggggagcgggaggtcgggggcgaagcattcacagggccaagataaagcgcaggggccgggccggcgtccctggcggtgacctgtttctcagggaaacagatgctcgctcttgcaaagggaggtttgcgttcaatgaaaggatcaagtgtggccagggcagcccggccgacctcgagaggttcccgcgtcctctccccgccctgcctaggagtggggtgtcggggcctgggcgcgggagagcggagtgagggggccgggtggctgaggggcccgcgagaccgtggggctcaggggccgcaggaacggagggctgagagctgcaggtcctgcacaggctgggtagctcggaggctcttgagagcttcgggggatgaaggggggttgatgcgggttctgaccagaccgccgacgcggcgcctccgccccgggggaggcagttgggctcccgggtcctggcctgaggctggagctgcccaggctcgacaggcaggcgacccgggagagccaagagcaacgagagacgctattaaaatgcctcgccgtcgccccgagcgcaaaacccatcctccccaaatctcctgggcttgcggcataatcttaattaagataattgattcatattgcacctgcgagaacggaaaaaattgatttcaacccccaaccccacaaatcgcttagagctattggatggagcacgacgcgactgtgatttagggagtgatttagtgccgggcttccccagctcggcctgcctgggcctttttatttattatttatgccctcccggtcccgacggggctttggtggctcctttgtcggctcccacaggccttggaaggacttgtctctgattccctgtcaggatccaggggctttccttaaaccatccaacactcagaatcaacaacgtaaaatcaactca

SEQ ID NO: 118572 - DNA, 248 bp, Homo sapiens
  misc_feature 1..248: note = chr2:182549876-182550124
  misc_feature 1..248: note = Hyper
  source 1..248: mol_type = genomic DNA
cgcacacctgtttcccggggatcgaggaacagcttgctgtccaaaggggatcgcagggccagggaactgacaagcacacgctatttgccaacctttgccttaatagaaagaagcaagcaaacaaaaatcctcggtagctgtgtgtagcttcaggagtggagagccgagacacaccgacggcgccggagcgtcgcaagaacaatggttgctgcagtgggttgggagagaggacccggacaagttcctaa

SEQ ID NO: 118573 - DNA, 319 bp, Homo sapiens; identical to SEQ ID NO: 27778
  misc_feature 1..319: note = chr2:182819030-182819349
  misc_feature 1..319: note = Hyper
  source 1..319: mol_type = genomic DNA

SEQ ID NO: 118574 - DNA, 933 bp, Homo sapiens
  misc_feature 1..933: note = chr2:183731173-183732106
  misc_feature 1..933: note = Hyper
  source 1..933: mol_type = genomic DNA
tcacaggctgcagcccgagccccgggcacccggagcaggcagagagcagccagggcaagcagcccggcccgcagcagcagcatccctcccgggctgccgcagaccatgatcccggcaggatggggcagggtgcagccgcgcagtggacgccaaaaggcccgctccgccgtctccgcctcccccgctgcaagtggacacaaggatctgggagcttctcctcccccggcaatcaccgcttccttggatcaaattcccccaatggggtcccacgagctttaccgagctccagccaccgcccctgccgcccaggctgctctttcccaacgtctaagccttcggaagcagcaacatctatttattcctctccctctggcagaagcatcagacttcgcagatcagtcagataagagggacacgagaggaggcgaggaagacataaaaacaaaagtagaattcagctgagagctagttggagctctggggtgtctcctcccctagatcacgcacacaaaaagatgctaaagaaagcattaaattccccaaagtgaggaggacagaggggttggggggaaggagggaggaaaagctcctaatgggagagaagggtgcagtaagagtttacaagtcctgtgtgggctaagagctgcggccgccgctgcggctgcgaccctggctggcaggagggacgctcaggaggagccccgcagggacgtctgtgcctctgcccgggcggctctgcactttcctacctcccgcctgagagggagctccgcccctggggcagtctctgccctccagtgccggctgctcttcccgagaatggagtgggcgcccggggaagagaaggcctgggagtcgcaggcggtggggtgcgaagccgtgcgagtgcgagaccccaagacagcgccgagtcgagcgcgccctcacactagg

SEQ ID NO: 118575 - DNA, 17 bp, Homo sapiens
  misc_feature 1..17: note = chr2:183991037-183991054
  misc_feature 1..17: note = Hypo
  source 1..17: mol_type = genomic DNA
tgcgccttctactgtgt

SEQ ID NO: 118576 - DNA, 220 bp, Homo sapiens; identical to SEQ ID NO: 85653
  misc_feature 1..220: note = chr2:184406833-184407053
  misc_feature 1..220: note = Hypo
  source 1..220: mol_type = genomic DNA

SEQ ID NO: 118577 - DNA, 1197 bp, Homo sapiens; identical to SEQ ID NO: 85655
  misc_feature 1..1197: note = chr2:185462620-185463817
  misc_feature 1..1197: note = Hyper
  source 1..1197: mol_type = genomic DNA

SEQ ID NO: 118578 - DNA, 210 bp, Homo sapiens; identical to SEQ ID NO: 27782
  misc_feature 1..210: note = chr2:186603443-186603653
  misc_feature 1..210: note = Hyper
  source 1..210: mol_type = genomic DNA

SEQ ID NO: 118579 - DNA, 141 bp, Homo sapiens; identical to SEQ ID NO: 39725
  misc_feature 1..141: note = chr2:188235961-188236102
  misc_feature 1..141: note = Hypo
  source 1..141: mol_type = genomic DNA

SEQ ID NO: 118580 - DNA, 146 bp, Homo sapiens; identical to SEQ ID NO: 85660
  misc_feature 1..146: note = chr2:188418955-188419101
  misc_feature 1..146: note = Hyper
  source 1..146: mol_type = genomic DNA

SEQ ID NO: 118581 - DNA, 91 bp, Homo sapiens; identical to SEQ ID NO: 85661
  misc_feature 1..91: note = chr2:188809066-188809157
  misc_feature 1..91: note = Hypo
  source 1..91: mol_type = genomic DNA

SEQ ID NO: 118582 - DNA, 36 bp, Homo sapiens; identical to SEQ ID NO: 85662
  misc_feature 1..36: note = chr2:189075849-189075885
  misc_feature 1..36: note = Hypo
  source 1..36: mol_type = genomic DNA

SEQ ID NO: 118583 - DNA, 210 bp, Homo sapiens; identical to SEQ ID NO: 27783
  misc_feature 1..210: note = chr2:189156634-189156844
  misc_feature 1..210: note = Hyper
  source 1..210: mol_type = genomic DNA

SEQ ID NO: 118584 - DNA, 30 bp, Homo sapiens; identical to SEQ ID NO: 85665
  misc_feature 1..30: note = chr2:189157587-189157617
  misc_feature 1..30: note = Hyper
  source 1..30: mol_type = genomic DNA

SEQ ID NO: 118585 - DNA, 32 bp, Homo sapiens; identical to SEQ ID NO: 85667
  misc_feature 1..32: note = chr2:189764815-189764847
  misc_feature 1..32: note = Hypo
  source 1..32: mol_type = genomic DNA

SEQ ID NO: 118586 - DNA, 75 bp, Homo sapiens; identical to SEQ ID NO: 27784
  misc_feature 1..75: note = chr2:190445180-190445255
  misc_feature 1..75: note = Hyper
  source 1..75: mol_type = genomic DNA

SEQ ID NO: 118587 - DNA, 35 bp, Homo sapiens; identical to SEQ ID NO: 85669
  misc_feature 1..35: note = chr2:190446074-190446109
  misc_feature 1..35: note = Hyper
  source 1..35: mol_type = genomic DNA

SEQ ID NO: 118588 - DNA, 431 bp, Homo sapiens
  misc_feature 1..431: note = chr2:191045074-191045505
  misc_feature 1..431: note = Hyper
  source 1..431: mol_type = genomic DNA
ccaaggcaggccccgcgggggagaggccttggagggcagcgccccctctcaccagggcggagctcaggagagttcgcagcccagggggccgagaccaggggcagggccagcgaaatgcctcgctggctcttactttcattgacctctgcgatgcctcgctggcttctgctttcattgacctttgcgggtctgttcccgctgcggcgccggcagctgcttggtagttgcggggggcgtgagggcggtggcccagaccaaccggctggcagcccagctccgctccgcccgcccctgcctcggaccctgcgcctgaggaagtatcgaggcaaccctctgccacccgaagttcgtgggtcgctcccagagggcgcgccctggagccgagcgcccttgggcggccatctggaggccaggtgcgggccgcgaacccg

SEQ ID NO: 118589 - DNA, 55 bp, Homo sapiens; identical to SEQ ID NO: 85673
  misc_feature 1..55: note = chr2:192015371-192015426
  misc_feature 1..55: note = Hyper
  source 1..55: mol_type = genomic DNA

SEQ ID NO: 118590 - DNA, 126 bp, Homo sapiens; identical to SEQ ID NO: 85674
  misc_feature 1..126: note = chr2:192110177-192110303
  misc_feature 1..126: note = Hyper
  source 1..126: mol_type = genomic DNA

SEQ ID NO: 118591 - DNA, 1935 bp, Homo sapiens
  misc_feature 1..1935: note = chr2:193059011-193060946
  misc_feature 1..1935: note = Hyper
  source 1..1935: mol_type = genomic DNA
ggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcagcgggctactgagcatcccgcggacggcggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggagacgggagtccaggggcagacgagtggagcccgaggaggcagggtggagggagagtcaaggcgccccgcagcccggcagccgcctctcgagctctgccgcccgcatccctctggcgtttgggaagcagcaggtcctcagcccgcccggggtcacgtgggaagaggcagtcgggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgc

SEQ ID NO: 118592 - DNA, 40 bp, Homo sapiens; identical to SEQ ID NO: 85679
  misc_feature 1..40: note = chr2:193061440-193061480
  misc_feature 1..40: note = Hyper
  source 1..40: mol_type = genomic DNA

SEQ ID NO: 118593 - DNA, 97 bp, Homo sapiens; identical to SEQ ID NO: 85680
  misc_feature 1..97: note = chr2:193363553-193363650
  misc_feature 1..97: note = Hypo
  source 1..97: mol_type = genomic DNA

SEQ ID NO: 118594 - DNA, 36 bp, Homo sapiens; identical to SEQ ID NO: 85681
  misc_feature 1..36: note = chr2:193363710-193363746
  misc_feature 1..36: note = Hypo
  source 1..36: mol_type = genomic DNA

SEQ ID NO: 118595 - DNA, 75 bp, Homo sapiens; identical to SEQ ID NO: 85697
  misc_feature 1..75: note = chr2:196302358-196302433
  misc_feature 1..75: note = Hypo
  source 1..75: mol_type = genomic DNA

SEQ ID NO: 118596 - DNA, 78 bp, Homo sapiens; identical to SEQ ID NO: 85698
  misc_feature 1..78: note = chr2:196319761-196319839
  misc_feature 1..78: note = Hypo
  source 1..78: mol_type = genomic DNA

SEQ ID NO: 118597 - DNA, 33 bp, Homo sapiens; identical to SEQ ID NO: 85700
  misc_feature 1..33: note = chr2:197298088-197298121
  misc_feature 1..33: note = Hypo
  source 1..33: mol_type = genomic DNA

SEQ ID NO: 118598 - DNA, 1352 bp, Homo sapiens; identical to SEQ ID NO: 85701
  misc_feature 1..1352: note = chr2:197457183-197458535
  misc_feature 1..1352: note = Hyper
  source 1..1352: mol_type = genomic DNA

SEQ ID NO: 118599 - DNA, 30 bp, Homo sapiens; identical to SEQ ID NO: 39728
  misc_feature 1..30: note = chr2:197503336-197503366
  misc_feature 1..30: note = Hypo
  source 1..30: mol_type = genomic DNA

SEQ ID NO: 118600 - DNA, 26 bp, Homo sapiens
  misc_feature 1..26: note = chr2:197503796-197503822
  misc_feature 1..26: note = Hypo
  source 1..26: mol_type = genomic DNA
tccacccttggcgacagaggaagacc

SEQ ID NO: 118601 - DNA, 185 bp, Homo sapiens; identical to SEQ ID NO: 85704
  misc_feature 1..185: note = chr2:198174643-198174828
  misc_feature 1..185: note = Hyper
  source 1..185: mol_type = genomic DNA

SEQ ID NO: 118602 - DNA, 37 bp, Homo sapiens; identical to SEQ ID NO: 85705
  misc_feature 1..37: note = chr2:198317068-198317105
  misc_feature 1..37: note = Hypo
  source 1..37: mol_type = genomic DNA

SEQ ID NO: 118603 - DNA, 88 bp, Homo sapiens; identical to SEQ ID NO: 85706
  misc_feature 1..88: note = chr2:198456603-198456691
  misc_feature 1..88: note = Hypo
  source 1..88: mol_type = genomic DNA

SEQ ID NO: 118604 - DNA, 142 bp, Homo sapiens; identical to SEQ ID NO: 85707
  misc_feature 1..142: note = chr2:198651498-198651640
  misc_feature 1..142: note = Hyper
  source 1..142: mol_type = genomic DNA

SEQ ID NO: 118605 - DNA, 35 bp, Homo sapiens; identical to SEQ ID NO: 27793
  misc_feature 1..35: note = chr2:198670222-198670257
  misc_feature 1..35: note = Hyper
  source 1..35: mol_type = genomic DNA

SEQ ID NO: 118606 - DNA, 30 bp, Homo sapiens; identical to SEQ ID NO: 85709
  misc_feature 1..30: note = chr2:199113318-199113348
  misc_feature 1..30: note = Hypo
  source 1..30: mol_type = genomic DNA

SEQ ID NO: 118607 - DNA, 115 bp, Homo sapiens; identical to SEQ ID NO: 85710
  misc_feature 1..115: note = chr2:200321883-200321998
  misc_feature 1..115: note = Hyper
  source 1..115: mol_type = genomic DNA

SEQ ID NO: 118608 - DNA, 113 bp, Homo sapiens; identical to SEQ ID NO: 85711
  misc_feature 1..113: note = chr2:200322498-200322611
  misc_feature 1..113: note = Hyper
  source 1..113: mol_type = genomic DNA

SEQ ID NO: 118609 - DNA, 30 bp, Homo sapiens; identical to SEQ ID NO: 85712
  misc_feature 1..30: note = chr2:200326625-200326655
  misc_feature 1..30: note = Hyper
  source 1..30: mol_type = genomic DNA

SEQ ID NO: 118610 - DNA, 92 bp, Homo sapiens; identical to SEQ ID NO: 85713
  misc_feature 1..92: note = chr2:200326868-200326960
  misc_feature 1..92: note = Hyper
  source 1..92: mol_type = genomic DNA

SEQ ID NO: 118611 - DNA, 555 bp, Homo sapiens
  misc_feature 1..555: note = chr2:200327239-200327794
  misc_feature 1..555: note = Hyper
  source 1..555: mol_type = genomic DNA
cgtctggggactgaccggagcgcagggcgggggacacttacttcgttatccgcacgccttcctcgttggcatcagagccggacaaatcccaacccgcgccaggcaaagataaatgactcctggctcccccggcagctcagggggtctgggcgggggcggagagggaaggaagccgtcggccgccggaggtagagactgtggaggtcctcctcccggccccaagcgaatgagcccctgcggcccgagcagagagatacgcctcagagggacgactgatggggaaggatggtgggcaacgagtctgcgctaggcggtgagcctagcaccccagaggcccgagggtctggggctagtggggccgaccgttcaggagccgggtgggcgggaagggaattgccaaggtcggcccaggagctgcctcaggcgaggacggggagctttctgcactgggcttcccggggtaggagatgggcgtcgggtgtgggcactgcctgccctgggggaagaaagcgaggagataggtttcagagctgggggagtcgttggtgggagatc

SEQ ID NO: 118612 - DNA, 222 bp, Homo sapiens; identical to SEQ ID NO: 85717
  misc_feature 1..222: note = chr2:200328171-200328393
  misc_feature 1..222: note = Hyper
  source 1..222: mol_type = genomic DNA

SEQ ID NO: 118613 - DNA, 1078 bp, Homo sapiens
  misc_feature 1..1078: note = chr2:200328667-200329745
  misc_feature 1..1078: note = Hyper
  source 1..1078: mol_type = genomic DNA
gaggctatgggcccacgccggtcttgaaccaagcggagagggcgaaaaagcccgctgcgggacccacggtcccagacacctactggagccagggacgaggggggcagtgtatccggcggcccaaactcgtaaggagtgggggccaacttagagggcttcccgagctggcgcctcgcctgttttctcggtatcacgaatcccctcggacaccgtttcagtccgtcaagaccttggcctccgggaaaggcccaagtgactgtgacggcggcgactcgggctcagttctcccccaccccgtggtgccttccctccccgccctacagccaagcccagaggaacagggcatcgcctcgcgcggtcccggagccacatccggacttgggaaccccgtgtcgggcttagaggacttcactgggcgggttggggtttattttcaataaattcagctgttcacatacacccccaccaccatttccacgcgcgcgcgcgcacacacacacacacacacacagagggacttgtcaactattgagacagcgacccagaaaggtgtaaattcacctggtgcccacccaattgcaaagctcccagacccacacaaaacactagcgagccctggaggtctgagacgccccgcgcccgactcacggcgcgaacaccagcgctccggccgggtcgcaggggccggtgcccagcgggccggggtctggcgagccaggcagcgggccggctgagctcctgcgccccgcggtcgcgtggcctactcgcctactcccttattattggctgggacctgttcctttccaaagtgtgatgcccggtgtcctaccctaggccacgcggagctctctcccggcgtgtcgggccctgcgcccctgcccagtggctcacctcggctcgctgcgcccgccttcgccccaagtgcccaggacggagcgaggggctgtgggtcggcgcagggacgctggctgctcacctccaggagccgacagaaggtgccttcggcgtcacgcgtccaaccctggggctgatttaaataactaataagctcagagaaattttacgaggggaacttttc

SEQ ID NO: 118614 - DNA, 259 bp, Homo sapiens
  misc_feature 1..259: note = chr2:200330766-200331025
  misc_feature 1..259: note = Hyper
  source 1..259: mol_type = genomic DNA
gggctccccttagttcgtctcgttttatgctgtaagacccaaagtctgctgagggctgcccctgccaggtaacttccggagacccggagttacttggagacagacccggccctttgcacattccaagtgaaggacgtctcgcgcattcttcccagagctaccacacacctaacctcttctggacacccaacagctggggcactggagcacctgaccctactcaagatcatcccccagcccttgccggcacttagggaca

SEQ ID NO: 118615 - DNA, 30 bp, Homo sapiens; identical to SEQ ID NO: 85721
  misc_feature 1..30: note = chr2:200331923-200331953
  misc_feature 1..30: note = Hyper
  source 1..30: mol_type = genomic DNA

SEQ ID NO: 118616 - DNA, 100 bp, Homo sapiens
  misc_feature 1..100: note = chr2:200333734-200333834
  misc_feature 1..100: note = Hyper
  source 1..100: mol_type = genomic DNA
gaagggactggtctgcgtgcctcaccgggttccccagcctggctccgaggaaaggccgcgcggaggcgagaaagggcccacatctcgagtctccagtctc

SEQ ID NO: 118617 - DNA, 252 bp, Homo sapiens; identical to SEQ ID NO: 85724
  misc_feature 1..252: note = chr2:200334149-200334401
  misc_feature 1..252: note = Hyper
  source 1..252: mol_type = genomic DNA

SEQ ID NO: 118618 - DNA, 267 bp, Homo sapiens; identical to SEQ ID NO: 85725
  misc_feature 1..267: note = chr2:200334964-200335231
  misc_feature 1..267: note = Hyper
  source 1..267: mol_type = genomic DNA

SEQ ID NO: 118619 - DNA, 989 bp, Homo sapiens
  misc_feature 1..989: note = chr2:200335437-200336426
  misc_feature 1..989: note = Hyper
  source 1..989: mol_type = genomic DNA
acaccagtgggtacccggagcagcacccacttggcagaactgatgactgcttgggcccagcggagtgcgcattgcgctaacacgcgcacgggaattgcacccttgccggagcctccgcaccgtgcgcccttcaaagagctggcgaccccgctcacgtgtaagcaacctcccactttgaaactaattcgcacccgggtctttcaccccaaaggactttgctgcggacgctgctctgacccaagacgcgggagagaagtcccaaaggctacagccaggggctgggggactcctctgctcaccttagtccttgatttcgaaggccccaattaactatctgttgtgtcagaatcggcgagtgcaaagtagctgcgccccgctgacgcgctctctcctgggtccgggtatcccagggcatccggagctggggagggttgtgcggactacccaaggcacgcgcagataccgggcagggaagaagggctccgtgttccaaggatggtcgtttacctctcctgagatcagccctaatcccttggtaacttaagcgcctctgaactcggggagcgcttggtggggcgcctccctgcatccacccctacccctggctccttcccaggcccagcatctttcccaccattctcacccccaccacccccacggccccgcccgtttagaggcgtgcggtgggcacttggtttacagaaccggcgtttcagatgtttatttgcaactaatttcttgtgctggaaaatgcttgttacccgggcggagcgcttccgctctgcgcggtccggcccggcgggcggtagctcgctgatccctccggcgaagcctccaaggagcgggcggctgggagaggttgtgccacccgggaccaagccatcggcgctgctccggactcccggtagggggagccgccgcgggcgccaggccggattgtgttctggcctcggggcggccctgctgccagcggccgggactctcagcac

SEQ ID NO: 118620 - DNA, 311 bp, Homo sapiens; identical to SEQ ID NO: 85728
  misc_feature 1..311: note = chr2:200523986-200524297
  misc_feature 1..311: note = Hyper
  source 1..311: mol_type = genomic DNA

SEQ ID NO: 118621 - DNA, 159 bp, Homo sapiens; identical to SEQ ID NO: 85729
  misc_feature 1..159: note = chr2:200524603-200524762
  misc_feature 1..159: note = Hypo
  source 1..159: mol_type = genomic DNA

SEQ ID NO: 118622 - DNA, 30 bp, Homo sapiens; identical to SEQ ID NO: 85731
  misc_feature 1..30: note = chr2:200699425-200699455
  misc_feature 1..30: note = Hypo
  source 1..30: mol_type = genomic DNA

SEQ ID NO: 118623 - DNA, 29 bp, Homo sapiens
  misc_feature 1..29: note = chr2:200775707-200775736
  misc_feature 1..29: note = Hyper
  source 1..29: mol_type = genomic DNA
gaaacagggagcttcgtatactcaaaagt

SEQ ID NO: 118624 - DNA, 28 bp, Homo sapiens
  misc_feature 1..28: note = chr2:200818848-200818876
  misc_feature 1..28: note = Hypo
  source 1..28: mol_type = genomic DNA
agggtctcaccctctcgcccatgctgga

SEQ ID NO: 118625 - DNA, 588 bp, Homo sapiens
  misc_feature 1..588: note = chr2:201450490-201451078
  misc_feature 1..588: note = Hyper
  source 1..588: mol_type = genomic DNA
caatgtttgctaagacgcaagagggtgtgacacagacgctaagcgccactggcgaggagatgaaggggtcgtcttcatcttcgccggatgatttccgcccacatagagggcgccagtgacgcccacacacgtgctggtgtcccgggaagagttcctggcaaagagctcaggaacgttggatcttaatcaaggctttctccgtcggggtggatgggttggactttaggctccagcaagccccgccccactcggcgggtcggtgccgccgggtcccaggtgcccgctacttcccagaacctccgcctcccgctccgggccctcgaaccagcgcggacaccacaatggaccgggcgtccgagctgctcttctacgtgaacggccgcaaggtgagcgcccgcgggcttcctctgcccccagacctgcggccagggccggggcagagaggagcccctgccgttcgtcccatcctttcgtgcccgccgtttaaggcactcaggcacggactggctttctcccgtaacagcggctttgccttcgcattcccacccctgcctccggggcagctaaaggctgcgttttcagggactg

SEQ ID NO: 118626 - DNA, 30 bp, Homo sapiens; identical to SEQ ID NO: 85737
  misc_feature 1..30: note = chr2:201652312-201652342
  misc_feature 1..30: note = Hypo
  source 1..30: mol_type = genomic DNA

SEQ ID NO: 118627 - DNA, 35 bp, Homo sapiens; identical to SEQ ID NO: 85738
  misc_feature 1..35: note = chr2:202041399-202041434
  misc_feature 1..35: note = Hypo
  source 1..35: mol_type = genomic DNA

SEQ ID NO: 118628 - DNA, 65 bp, Homo sapiens
  misc_feature 1..65: note = chr2:202097078-202097143
  misc_feature 1..65: note = Hyper
  source 1..65: mol_type = genomic DNA
gaagcaccagaacccggaagagaaatccagtcctctgctaggccttgcaccgtccctctggcgcc

SEQ ID NO: 118629 - DNA, 16 bp, Homo sapiens
  misc_feature 1..16: note = chr2:202490069-202490085
  misc_feature 1..16: note = Hypo
  source 1..16: mol_type = genomic DNA
gcgagactccatctcc

SEQ ID NO: 118630 - DNA, 132 bp, Homo sapiens; identical to SEQ ID NO: 85742
  misc_feature 1..132: note = chr2:202897471-202897603
  misc_feature 1..132: note = Hyper
  source 1..132: mol_type = genomic DNA

SEQ ID NO: 118631 - DNA, 390 bp, Homo sapiens
  misc_feature 1..390: note = chr2:202899687-202900077
  misc_feature 1..390: note = Hyper
  source 1..390: mol_type = genomic DNA
tgcgcccgtgtgcaccgtgctcgatcaggccatcccgccgtgtcgttctctgtgcgagcgcgcccgccagggctgcgaggcgctcatgaacaagttcggcttccagtggcccgagcggctgcgctgcgagaacttcccggtgcacggtgcgggcgagatctgcgtgggccagaacacgtcggacggctccgggggcccaggcggcggccccactgcctaccctaccgcgccctacctgccggacctgcccttcaccgcgctgcccccgggggcctcagatggcagggggcgtcccgccttccccttctcatgcccccgtcagctcaaggtgcccccgtacctgggctaccgcttcctgggtgagcgcgattgtggcgccccgtgcgaacc

SEQ ID NO: 118632 - DNA, 234 bp, Homo sapiens; identical to SEQ ID NO: 85746
  misc_feature 1..234: note = chr2:203129128-203129362
  misc_feature 1..234: note = Hypo
  source 1..234: mol_type = genomic DNA

SEQ ID NO: 118633 - DNA, 16 bp, Homo sapiens
  misc_feature 1..16: note = chr2:203206750-203206766
  misc_feature 1..16: note = Hypo
  source 1..16: mol_type = genomic DNA
ccgtctcaaaaaaaca

SEQ ID NO: 118634 - DNA, 30 bp, Homo sapiens; identical to SEQ ID NO: 85748
  misc_feature 1..30: note = chr2:203231652-203231682
  misc_feature 1..30: note = Hypo
  source 1..30: mol_type = genomic DNA

SEQ ID NO: 118635 - DNA, 41 bp, Homo sapiens; identical to SEQ ID NO: 85749
  misc_feature 1..41: note = chr2:203484358-203484399
  misc_feature 1..41: note = Hypo
  source 1..41: mol_type = genomic DNA

SEQ ID NO: 118636 - DNA, 37 bp, Homo sapiens; identical to SEQ ID NO: 85755
  misc_feature 1..37: note = chr2:205205376-205205413
  misc_feature 1..37: note = Hypo
  source 1..37: mol_type = genomic DNA

SEQ ID NO: 118637 - DNA, 81 bp, Homo sapiens; identical to SEQ ID NO: 85761
  misc_feature 1..81: note = chr2:206546689-206546770
  misc_feature 1..81: note = Hyper
  source 1..81: mol_type = genomic DNA

SEQ ID NO: 118638 - DNA, 1451 bp, Homo sapiens
  misc_feature 1..1451: note = chr2:206550029-206551480
  misc_feature 1..1451: note = Hyper
  source 1..1451: mol_type = genomic DNA
cagctccccaaaatgcgatctcaagccgtgagctgctcaggctttcaggcggagcaaagcactggcaccctgggagccggcagcgggtggccagggcgaggccaagccacatacctctgactcacccggtgtgcgccggccgggaagggggcctggttcagccgccgccgccggcgacgagaaccaattctgggaaggagcaagatggggcagaaggtgcgcgcgggggagcaactgagcaaataacacggcggtcgcggcgcgcggcaccttgggctggcgcgtggctgggaggccgcatgggcgacgcgcaccaggctgcccctctcctcactgcgccgcctcgccagaccgcagtgcagccgctagcctgcctccctccctgccccgggcgcccccgccagtcccctgcgctccgctctgcgcggcaggctcgccgcgacccctagagagacggctttgagtggcgggaggccgaggccggctggcttgggaatccaagcgctggcccaactaggtgagaggaaactggggtgggatttcggagaggagggcggagagaggcgggaaggaaccagcttgagccccaggaatgcgcgcaacttgcacagcctctagaagcgccgcgcgcccagcgcccgccggtgcgcaggaacaggtgaagagcacgcggcgtgcggccatccacgtggtggggacgtgatagcccctcagctctcctcctagccctccctccccttccccgccccccagcgccttctctaacgccgcatcgatttgtttgggctacgcagcagaaacagagcccagcgatccataaacattctattaagcaaaaatattcccagcgaaagcaaaaccgaggctgaagcctccgcgaagttggccgcctccaactactccatgcttgtgccctcctcctcctcctcctcctaaggacacccccagggaaaagcctgcggcatttcttcaacgctgccctatgccggaaagttaggtctcggctgcagcgctggtctctggagaagcctctgcctgcagccgccggcgagttcccgcctcccctccccagccgcctcgctctttgcttttccacgtgagaaaaagaaatgttcacggccgatgcttcattttcactgattgatttctttttaatatcaacacaagttaatggaggcaaggcgcgctctgattgaagggctgcccccgcccttcgactcgggctggctgtgccgggggtctttcccaccgggtcgcaggcgtccagcggctgggtggcgggcgccggtagccctagtgtttggaggtgggggagggatttggaatagacttgtcgcccctctgggaatcatctgggttggggaaccttcgggaatcagctttccagaccaagttttaggggatcttgcccatatgcgttgcggcttctgcggctccggctgaatttcttc

SEQ ID NO: 118639 - DNA, 187 bp, Homo sapiens; identical to SEQ ID NO: 85766
  misc_feature 1..187: note = chr2:206585987-206586174
  misc_feature 1..187: note = Hypo
  source 1..187: mol_type = genomic DNA

SEQ ID NO: 118640 - DNA, 106 bp, Homo sapiens; identical to SEQ ID NO: 39732
  misc_feature 1..106: note = chr2:206757186-206757292
  misc_feature 1..106: note = Hypo
  source 1..106: mol_type = genomic DNA

SEQ ID NO: 118641 - DNA, 30 bp, Homo sapiens; identical to SEQ ID NO: 85768
  misc_feature 1..30: note = chr2:206830630-206830660
  misc_feature 1..30: note = Hypo
  source 1..30: mol_type = genomic DNA

SEQ ID NO: 118642 - DNA, 30 bp, Homo sapiens; identical to SEQ ID NO: 39733
  misc_feature 1..30: note = chr2:206859091-206859121
  misc_feature 1..30: note = Hypo
  source 1..30: mol_type = genomic DNA

SEQ ID NO: 118643 - DNA, 1285 bp, Homo sapiens
  misc_feature 1..1285: note = chr2:207139050-207140335
  misc_feature 1..1285: note = Hyper
  source 1..1285: mol_type = genomic DNA
tagctctcttagccccgttttcttttctacattcatacgttgctttgaattggcaagcagtttttatttggaccctcaaacgctaaaaccttggtctctacttcgcgtcccaactgtgcttatgagtctagtcatttttgttggaacgcgatagatttcccaagctccggagtggggccctgaccagggaggaagtgtccgctttaagagcttctggaggggaggaaggggctcctccgcccgggtgggagagtgagtgagtgggtgggcgggcagggggcggtcccgccgctcctgcgtcagaaggggtctggttttcgcaccttccctgacgtcaaacctccatcagggttgcaacgccacgttgccttggatgcctgcgtgagtggagtcgcgactcggggcccgcgtcctgagagacgcgctcccgcgccgcttctcgcctccggaccgcaggggccgaagtcgcctatttctggctccgcgggcagcggggccgtggcgctcggacggtctgggattcgggcgccgccgcggaaccggaataagaagggagagcgcccggctcggtcctcggtctccaccgcggcccggaaggaatccgggcagcctccgcggaggtgagtgccgcggcgggggcggggcgcggccggggcgacgcccgcgggcggggcctgctcgccgggcgcccggggcgccttcttcccgagggacgccaggaccgctcgctgggctcccgcggccgcctcgcaggtcctcggcttccccccaccccgcgtccctttctgcccctgctgcgtgagaggtgtcggcggctccgggccgggatcgaggtggcggggcgagggaaggaggtggggcgcaggctgcattgcgcttctgtccggggccctgggtcagaggggccggcggacgaggcctcgggtccgggcttggggagggggcggtctgcggggtcggattgagggccgggaacccgcggagtcttgcccctgggcacctgtggggccgagatcccgagccacctgtccacacacccccttcccccagtgccctgcgttgggtccagctggccccagacctaggcctttcccagcctcgggcgattatagtttatttgaaaacgtttgatttttgtgttaatgattcttttactaccgccgtgcaacagttgtgtaaatgtggtcgtgttacgccatcgtttttacttgctcctaagaagggccttaccagctcctgcgattatctcacgcgatgattcttggtagctcgtgaaaaaaatgca

SEQ ID NO: 118644 - DNA, 1497 bp, Homo sapiens
  misc_feature 1..1497: note = chr2:207307463-207308960
  misc_feature 1..1497: note = Hyper
  source 1..1497: mol_type = genomic DNA
tctgtattgcttccccgccagaatgtcgaagtccttcccgaatatgcccagtcatactttctgaacttttgagcaaacaccgtccggcttcttgtgctttcctcaaagaccccaggcaccggcagggaggacacaggccggggcagagcgcccctgcgcgggggattcctgccactccgcgccagcctgcggcgcaaacgctcttctcagccgcagtcccacccgctgctggcaatctgaatgaggagccgcgctatttttacctccccggctgcaatcctttatatttacatgcaggaagcaaatatataagggattaagaaggagatgcgtggccttagtttatccagagcaggaagaggttggaataggagagggtatgtgaagtctggggtggtggaaaaggcaggtggacttcggctggttgttttctcccgatcatccctgtctctggcctggaaacccccgtactctctttcttctggcttatccgtgactgccggctccccctccaccgcccccatcttttgaggtaccacccgtcacctccgatgctgcttgggctgctgcatcactctgctgctttacccccttccccgccccccaacaaagcatgcgcagtgcgttccgggccaggcaacagcagcagcacagcatccagcaacagcatcagcacccgaagccccgctcgggcgcgctctcggggggcggggcgcacgcccgctccgcgcgtccccgcgccgctcgctcccgcgcgtccccgcgccgctcgctcccgcgcgccgcctcagcatcctcaggcccggcggcagcccccgcagtcgctgaagcggccgcgcccgccgggggagggagtagccgctggggaggctccaagttggcggagcggcgaggacccctggactcctctgcgtcccgccccgggagtggctgcgaggctaggcgagccgggaaagggggcgccgcccagccccgagccccgcgccccgtgccccgagcccggagccccctgcccgccgcggcaccatgcgcgccgagccggcgtgaccggctccgcccgcggccgccccgcagctagcccggcgctctcgccggccacacggagcggcgcccgggagctatgagccatgaagccgcccggcagcagctcgcggcagccgcccctggcgggctgcagccttgccggcgcttcctgcggcccccaacgcggccccgccggctcggtgcctgccagcgccccggcccgcacgccgccctgccgcctgcttctcgtccttctcctgctgcctccgctcgccgcctcgtcccggccccgcgcctggggggctgctgcgcccagcggtgggtatggccccgtgccctttgcgttggctttcccgcggggccctgcagaggaaagcgaagggcgcgcgggtccgtgtgctccgggcttgtccccggctcggcctttccttccctccctgcctgtctttccacccttctcgttcccaaaccccc

SEQ ID NO: 118645 - DNA, 39 bp, Homo sapiens; identical to SEQ ID NO: 85774
  misc_feature 1..39: note = chr2:207309199-207309238
  misc_feature 1..39: note = Hyper
  source 1..39: mol_type = genomic DNA

SEQ ID NO: 118646 - DNA, 30 bp, Homo sapiens; identical to SEQ ID NO: 85775
  misc_feature 1..30: note = chr2:207398286-207398316
  misc_feature 1..30: note = Hypo
  source 1..30: mol_type = genomic DNA

SEQ ID NO: 118647 - DNA, 619 bp, Homo sapiens; identical to SEQ ID NO: 85776
  misc_feature 1..619: note = chr2:207506691-207507310
  misc_feature 1..619: note = Hyper
  source 1..619: mol_type = genomic DNA

SEQ ID NO: 118648 - DNA, 107 bp, Homo sapiens; identical to SEQ ID NO: 39735
  misc_feature 1..107: note = chr2:207557814-207557921
  misc_feature 1..107: note = Hypo
  source 1..107: mol_type = genomic DNA

SEQ ID NO: 118649 - DNA, 514 bp, Homo sapiens; identical to SEQ ID NO: 85778
  misc_feature 1..514: note = chr2:208029820-208030334
  misc_feature 1..514: note = Hyper
  source 1..514: mol_type = genomic DNA

SEQ ID NO: 118650 - DNA, 106 bp, Homo sapiens; identical to SEQ ID NO: 85779
  misc_feature 1..106: note = chr2:208031833-208031939
  misc_feature 1..106: note = Hyper
  source 1..106: mol_type = genomic DNA

SEQ ID NO: 118651 - DNA, 58 bp, Homo sapiens; identical to SEQ ID NO: 85780
  misc_feature 1..58: note = chr2:208140340-208140398
  misc_feature 1..58: note = Hypo
  source 1..58: mol_type = genomic DNA

SEQ ID NO: 118652 - DNA, 87 bp, Homo sapiens; identical to SEQ ID NO: 27827
  misc_feature 1..87: note = chr2:208546197-208546284
  misc_feature 1..87: note = Hyper
  source 1..87: mol_type = genomic DNA

SEQ ID NO: 118653 - DNA, 240 bp, Homo sapiens; identical to SEQ ID NO: 85782
  misc_feature 1..240: note = chr2:208574906-208575146
  misc_feature 1..240: note = Hypo
  source 1..240: mol_type = genomic DNA

SEQ ID NO: 118654 - DNA, 30 bp, Homo sapiens; identical to SEQ ID NO: 27828
  misc_feature 1..30: note = chr2:208633276-208633306
  misc_feature 1..30: note = Hyper
  source 1..30: mol_type = genomic DNA

SEQ ID NO: 118655 - DNA, 153 bp, Homo sapiens; identical to SEQ ID NO: 85784
  misc_feature 1..153: note = chr2:208635621-208635774
  misc_feature 1..153: note = Hyper
  source 1..153: mol_type = genomic DNA

SEQ ID NO: 118656 - DNA, 30 bp, Homo sapiens; identical to SEQ ID NO: 85789
  misc_feature 1..30: note = chr2:208694549-208694579
  misc_feature 1..30: note = Hypo
  source 1..30: mol_type = genomic DNA

SEQ ID NO: 118657 - DNA, 24 bp, Homo sapiens
  misc_feature 1..24: note = chr2:209094651-209094675
  misc_feature 1..24: note = Hypo
  source 1..24: mol_type = genomic DNA
gatgcaggctgggggcggtggctc

SEQ ID NO: 118658 - DNA, 234 bp, Homo sapiens; identical to SEQ ID NO: 85791
  misc_feature 1..234: note = chr2:209225159-209225393
  misc_feature 1..234: note = Hypo
  source 1..234: mol_type = genomic DNA

SEQ ID NO: 118659 - DNA, 352 bp, Homo sapiens
  misc_feature 1..352: note = chr2:209271264-209271616
  misc_feature 1..352: note = Hyper
  source 1..352: mol_type = genomic DNA
ctggaagacccagggcgcccctagagacagggccctggaacccgggacagagtggagggaagcagaaacattgcgaatcgggggtggcggcagcagcgacatgagatcctttgccctccgccccctgggctgcgggacccagtgacttcgaggaggagcgcgagcgcagccgcgcggggcgcacccggatccgcctggggcgggagccgcccccttcccgccgcaggcggcgcggggctgcgagtcaagtccaggactcgggccagtctctccggaagacaagaccaacctcgcgccgcggcgcagcagcacgcgggttctgagaagcgcgtggctccggcgacaagacccc

SEQ ID NO: 118660 - DNA, 20 bp, Homo sapiens
  misc_feature 1..20: note = chr2:209313347-209313367
  misc_feature 1..20: note = Hypo
  source 1..20: mol_type = genomic DNA
gaatccgtctcaaaaaaaaa

SEQ ID NO: 118661 - DNA, 197 bp, Homo sapiens; identical to SEQ ID NO: 85794
  misc_feature 1..197: note = chr2:209876323-209876520
  misc_feature 1..197: note = Hypo
  source 1..197: mol_type = genomic DNA

SEQ ID NO: 118662 - DNA, 30 bp, Homo sapiens; identical to SEQ ID NO: 85796
  misc_feature 1..30: note = chr2:210359777-210359807
  misc_feature 1..30: note = Hypo
  source 1..30: mol_type = genomic DNA

SEQ ID NO: 118663 - DNA, 733 bp, Homo sapiens
  misc_feature 1..733: note = chr2:210636329-210637062
  misc_feature 1..733: note = Hyper
  source 1..733: mol_type = genomic DNA
ctcctgagtgcagctcggagcggggaaagccgaattccgggggctgaagaggccgcgcaggggacgagcgcctgcgatgcggagcgtggacttcttgggccgtacccctgcggctcaagctgccccggattcgcttctccggccgtgcagcccggcgcgggccgctgtccacagtgggaggtgctgaaagcagggagcgggtgcgggggcggcgaggcggaccgctgctccgagcgcccccctcctcgctccgcggctcctccagccctcccctcctcccgcagccatgttccacgcgcggggaggggtggggggaggggagaggcacgggggatcagggcggagagagccggctctgcctcggggaaggaggggatgagagttgggagcagcgggaggaggcggcggcggcggctagcgaggagacagagctgggtcctgcagtaggactcccgggagccaccattatggtgaagaggaagagctccgagggccaggagcaggacggcggccgcggcatccccctgcccatccagaccttcctgtggcggcaaaccaggtgaggggcgcagagggcgcaccgcgggccgccctgggctgggggcgctcctggggccgcccgggtcgccgctgccgccgccgccgctgaggccgcgccacagcctgcagctccctctctggggctggaaaacaagccctctgcaccagcttaaaaacacgcattaaaatatgt

SEQ ID NO: 118664 - DNA, 564 bp, Homo sapiens
  misc_feature 1..564: note = chr2:211089509-211090073
  misc_feature 1..564: note = Hyper
  source 1..564: mol_type = genomic DNA
acacagatcgcagcccgcgctcctgcagccgggcccagggggtgaccacctcctcccaaaacgcaggctcccgggtcccactgcaggccgctgaactagacgggttggattggggctccggaatgaacttctggagaaatctttcggctttccccgacgtgggctcggcggtctgttctcggggcggcacggctgacacccctttttcctccgcccagatgctggttgcacccagtccgcgggatccaggaaaggaggccagctctagcccggcgccggagttggggagcactcccagccgcgcgcgcaccgccctgcttcaagccagcgacaggagtgactcgctgccccaccccacagcctcccggcctgcagccgcggaagtcccggctggcactcaccgcgcggcgggcagctggcgcggcgcacggtggccgcccaggacgcgtagggaccctcggagaaggcgtgcggccatgtccgaaacacaggggcggcggggcgacggaggcgactctgcggctactcggcgactcggggcagggtccccgggagggaggacga

SEQ ID NO: 118665 - DNA, 831 bp, Homo sapiens
  misc_feature 1..831: note = chr2:213401179-213402010
  misc_feature 1..831: note = Hyper
  source 1..831: mol_type = genomic DNA
tgaacaagtgaggctcgcctttgtgcccccagaatttcaagtacagagtcacacacggaacaacaatggcacgctaatcctcgcgctctaaatgggctcacttgtgggtctgacaattcgcccagggaaacgagaagagacgaagcgagggcgcgagctagtgtcgcctgagacgaggaagaggacagctgcagaactaatttggattacattccttgcagaaattctgaaaagggcttttcggcatagctcaactcggagccgcacagttaataccaaattgctgcggactcggagcggggtcccccagtggcagaggctgaaccagacagcccccagtaggtcgcctcgtagaaattcctctcggctaagcctgcatgtcggtcgccaatgcctttgaatgggtcaatgtgcataatcaacccattgagggaaaatatgaagggactcgaagtggggagggagataaaaagagatgtatctaagaggccgcttggaatgtcaagtccgtgttggtgtgattccggaggtggctggagcgcgggacctggtatgcgtgaagaatttcggagtaattgggagggtgcaaacggccagcacaaacgcctcacatgtgccattcgaaggtcattttgaaagactcgataattgtaacttgttatttactaggcaaaggaggcggcggcggcggcggcggcggagcgggaaaactacagctagccgttttcttggtgaggtcagaaggacaccctccgggggcctaaagcgctccctatcgccactcccgggggctttatcacctcaagctacttcccacgctccagtcaccat

SEQ ID NO: 118666 - DNA, 1402 bp, Homo sapiens; identical to SEQ ID NO: 85806
  misc_feature 1..1402: note = chr2:213402608-213404010
  misc_feature 1..1402: note = Hyper
  source 1..1402: mol_type = genomic DNA

SEQ ID NO: 118667 - DNA, 16 bp, Homo sapiens
  misc_feature 1..16: note = chr2:213586068-213586084
  misc_feature 1..16: note = Hypo
  source 1..16: mol_type = genomic DNA
ccggcctgccactcta

SEQ ID NO: 118668 - DNA, 175 bp, Homo sapiens; identical to SEQ ID NO: 39740
  misc_feature 1..175: note = chr2:214080302-214080477
  misc_feature 1..175: note = Hypo
  source 1..175: mol_type = genomic DNA

SEQ ID NO: 118669 - DNA, 79 bp, Homo sapiens; identical to SEQ ID NO: 85809
  misc_feature 1..79: note = chr2:214149050-214149129
  misc_feature 1..79: note = Hyper
  source 1..79: mol_type = genomic DNA

SEQ ID NO: 118670 - DNA, 30 bp, Homo sapiens; identical to SEQ ID NO: 85810
  misc_feature 1..30: note = chr2:216162594-216162624
  misc_feature 1..30: note = Hypo
  source 1..30: mol_type = genomic DNA

SEQ ID NO: 118671 - DNA, 209 bp, Homo sapiens; identical to SEQ ID NO: 85811
  misc_feature 1..209: note = chr2:216300169-216300378
  misc_feature 1..209: note = Hyper
  source 1..209: mol_type = genomic DNA

SEQ ID NO: 118672 - DNA, 197 bp, Homo sapiens; identical to SEQ ID NO: 85812
  misc_feature 1..197: note = chr2:216300975-216301172
  misc_feature 1..197: note = Hyper
  source 1..197: mol_type = genomic DNA

SEQ ID NO: 118673 - DNA, 370 bp, Homo sapiens; identical to SEQ ID NO: 85813
  misc_feature 1..370: note = chr2:216301417-216301787
  misc_feature 1..370: note = Hyper
  source 1..370: mol_type = genomic DNA

SEQ ID NO: 118674 - DNA, 243 bp, Homo sapiens
  misc_feature 1..243: note = chr2:217236010-217236253
  misc_feature 1..243: note = Hyper
  source 1..243: mol_type = genomic DNA
cacccctgctgcagtcggcaaatccgtggcgccctcccctcggttccatcaaaggtcccttcggtcgaggggcaagagccgagagaagggcaggtccgggcgggcgagtggcctcgccttctcctcctcttcctcctctgggtcgcggtcgccctcctcctccggctccgggtcggcccgcgcccgcagctgctgctgcggcggcggaggcgactgctgctcggcgtccgggtgtctccgggg

SEQ ID NO: 118675 - DNA, 41 bp, Homo sapiens; identical to SEQ ID NO: 85818
  misc_feature 1..41: note = chr2:217236563-217236604
  misc_feature 1..41: note = Hyper
  source 1..41: mol_type = genomic DNA

SEQ ID NO: 118676 - DNA, 201 bp, Homo sapiens; identical to SEQ ID NO: 85819
  misc_feature 1..201: note = chr2:217236943-217237144
  misc_feature 1..201: note = Hyper
  source 1..201: mol_type = genomic DNA

SEQ ID NO: 118677 - DNA, 699 bp, Homo sapiens
  misc_feature 1..699: note = chr2:217497788-217498487
  misc_feature 1..699: note = Hyper
  source 1..699: mol_type = genomic DNA
cggccacaggggaagcgcgcaaacgaagtcctcgcgaactgaactgagagcagacaaaagcacgcgctcttctccaccgccacgccggtcctacccaaacccgcgagttatccgtattctccttcaggagtcatagtcaggccagaagagtgcggagggacggggcccgggaagagcagggaacccccagagcccgcagccaacgcggaggtgggcgagcgggcgtgcgcgcactcacttgccggcgcgagggagtgtcgggggggaagggagtggtctccaaaagggggaggggagaaggcagggggcggggagaagccggccctttaggacccggctgcggcggcgagggaggaggaagaagcggaggaggcggctcccgcgctcgcagggccgtgccacctgcccgcccgcccgctcgctcgctcgcccgccgcgccgcgctgccgaccgccagcatgctgccgagagtgggctgccccgcgctgccgctgccgccgccgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccggg

SEQ ID NO: 118678 - DNA, 49 bp, Homo sapiens; identical to SEQ ID NO: 85822
  misc_feature 1..49: note = chr2:217556962-217557011
  misc_feature 1..49: note = Hyper
  source 1..49: mol_type = genomic DNA

SEQ ID NO: 118679 - DNA, 71 bp, Homo sapiens; identical to SEQ ID NO: 27846
  misc_feature 1..71: note = chr2:217557250-217557321
  misc_feature 1..71: note = Hyper
  source 1..71: mol_type = genomic DNA

SEQ ID NO: 118680 - DNA, 652 bp, Homo sapiens; identical to SEQ ID NO: 85824
  misc_feature 1..652: note = chr2:217558904-217559556
  misc_feature 1..652: note = Hyper
  source 1..652: mol_type = genomic DNA

SEQ ID NO: 118681 - DNA, 173 bp, Homo sapiens; identical to SEQ ID NO: 85825
  misc_feature 1..173: note = chr2:217675049-217675222
  misc_feature 1..173: note = Hypo
  source 1..173: mol_type = genomic DNA

SEQ ID NO: 118682 - DNA, 152 bp, Homo sapiens; identical to SEQ ID NO: 85826
  misc_feature 1..152: note = chr2:218339252-218339404
  misc_feature 1..152: note = Hypo
  source 1..152: mol_type = genomic DNA

SEQ ID NO: 118683 - DNA, 30 bp, Homo sapiens; identical to SEQ ID NO: 85827
  misc_feature 1..30: note = chr2:218664369-218664399
  misc_feature 1..30: note = Hypo
  source 1..30: mol_type = genomic DNA

SEQ ID NO: 118684 - DNA, 30 bp, Homo sapiens; identical to SEQ ID NO: 85828
  misc_feature 1..30: note = chr2:218665208-218665238
  misc_feature 1..30: note = Hypo
  source 1..30: mol_type = genomic DNA

SEQ ID NO: 118685 - DNA, 48 bp, Homo sapiens; identical to SEQ ID NO: 85829
  misc_feature 1..48: note = chr2:218697889-218697937
  misc_feature 1..48: note = Hypo
  source 1..48: mol_type = genomic DNA

SEQ ID NO: 118686 - DNA, 213 bp, Homo sapiens; identical to SEQ ID NO: 85830
  misc_feature 1..213: note = chr2:218806147-218806360
  misc_feature 1..213: note = Hyper
  source 1..213: mol_type = genomic DNA

SEQ ID NO: 118687 - DNA, 37 bp, Homo sapiens; identical to SEQ ID NO: 85831
  misc_feature 1..37: note = chr2:218874667-218874704
  misc_feature 1..37: note = Hyper
  source 1..37: mol_type = genomic DNA

SEQ ID NO: 118688 - DNA, 16 bp, Homo sapiens
  misc_feature 1..16: note = chr2:218955815-218955831
  misc_feature 1..16: note = Hypo
  source 1..16: mol_type = genomic DNA
cttttttttttgagac

SEQ ID NO: 118689 - DNA, 314 bp, Homo sapiens
  misc_feature 1..314: note = chr2:219232545-219232859
  misc_feature 1..314: note = Hyper
  source 1..314: mol_type = genomic DNA
ggacgtggtcaccttcgccgccgagttcttcggccccttcgacccgtggcgtccgtcgtcaccggccttgggctcctcccaccggcccaaccctttccgctccctggagccggagggagacgcccgctcgggggcggcctaagcggggcccaggcccggacagggcaggaaaccaggggtcgggctgggacgcgggcgggacgcgccggggcgggtgcgctttccgggctgcggttttgggggaataaatggggccctcccgcttctctgcagcgcccgtcgacagcgtccctggctagcgtctagtgtctcgg

SEQ ID NO: 118690 - DNA, 92 bp, Homo sapiens; identical to SEQ ID NO: 85836
  misc_feature 1..92: note = chr2:219250043-219250135
  misc_feature 1..92: note = Hypo
  source 1..92: mol_type = genomic DNA

SEQ ID NO: 118691 - DNA, 30 bp, Homo sapiens; identical to SEQ ID NO: 39743
  misc_feature 1..30: note = chr2:219251809-219251839
  misc_feature 1..30: note = Hypo
  source 1..30: mol_type = genomic DNA

SEQ ID NO: 118692 - DNA, 96 bp, Homo sapiens; identical to SEQ ID NO: 85838
  misc_feature 1..96: note = chr2:219253096-219253192
  misc_feature 1..96: note = Hypo
  source 1..96: mol_type = genomic DNA

SEQ ID NO: 118693 - DNA, 36 bp, Homo sapiens; identical to SEQ ID NO: 85839
  misc_feature 1..36: note = chr2:219255964-219256000
  misc_feature 1..36: note = Hypo
  source 1..36: mol_type = genomic DNA

SEQ ID NO: 118694 - DNA, 23 bp, Homo sapiens
  misc_feature 1..23: note = chr2:219282664-219282687
  misc_feature 1..23: note = Hypo
  source 1..23: mol_type = genomic DNA
aaactccaggtgggccgggtgca

SEQ ID NO: 118695 - DNA, 185 bp, Homo sapiens; identical to SEQ ID NO: 39744
  misc_feature 1..185: note = chr2:219284495-219284680
  misc_feature 1..185: note = Hypo
  source 1..185: mol_type = genomic DNA

SEQ ID NO: 118696 - DNA, 39 bp, Homo sapiens; identical to SEQ ID NO: 85842
  misc_feature 1..39: note = chr2:219294028-219294067
  misc_feature 1..39: note = Hypo
  source 1..39: mol_type = genomic DNA

SEQ ID NO: 118697 - DNA, 203 bp, Homo sapiens; identical to SEQ ID NO: 85843
  misc_feature 1..203: note = chr2:219431996-219432199
  misc_feature 1..203: note = Hypo
  source 1..203: mol_type = genomic DNA

SEQ ID NO: 118698 - DNA, 34 bp, Homo sapiens; identical to SEQ ID NO: 85844
  misc_feature 1..34: note = chr2:219586056-219586090
  misc_feature 1..34: note = Hypo
  source 1..34: mol_type = genomic DNA

SEQ ID NO: 118699 - DNA, 30 bp, Homo sapiens; identical to SEQ ID NO: 39746
  misc_feature 1..30: note = chr2:219611841-219611871
  misc_feature 1..30: note = Hypo
  source 1..30: mol_type = genomic DNA

SEQ ID NO: 118700 - DNA, 399 bp, Homo sapiens
  misc_feature 1..399: note = chr2:219646417-219646816
  misc_feature 1..399: note = Hyper
  source 1..399: mol_type = genomic DNA
atgactggcccccctcgctccgaactgactccgggatcaatccggaaggccattgggagaagccgagggcagcttagccacggccggttcccgttccctccaggacgcgagggtcgccttgggtggggaaccgcgaccgggcgaggacctatcccggtgtggggcttcccgatttcgaaagaatctcgctgcacccccgcccagagttcagaccaagcgaaaagttatttgagaggcctcgggggcgcggggtgaggagtcgtggcggaggccttggtcggggcgccgtggatatccccgagtcaccgcgtccctctcctgcagctcccgcgtcgctgggaggagcgagggagcgagcgggaaggggtctagctggcctttgctcggccctccccagcg

SEQ ID NO: 118701 - DNA, 117 bp, Homo sapiens
  misc_feature 1..117: note = chr2:219647021-219647138
  misc_feature 1..117: note = Hyper
  source 1..117: mol_type = genomic DNA
ggccaccggagctcccggagccgggcctggtgtccggcggcggcaacggagcttagaggagattccacgtctaggacagctgcgcttcttctttcagctgttcgttcaaggctatgc

SEQ ID NO: 118702 - DNA, 252 bp, Homo sapiens; identical to SEQ ID NO: 85846
  misc_feature 1..252: note = chr2:219723919-219724171
  misc_feature 1..252: note = Hyper
  source 1..252: mol_type = genomic DNA

SEQ ID NO: 118703 - DNA, 361 bp, Homo sapiens; identical to SEQ ID NO: 85847
  misc_feature 1..361: note = chr2:219724722-219725083
  misc_feature 1..361: note = Hyper
  source 1..361: mol_type = genomic DNA

SEQ ID NO: 118704 - DNA, 30 bp, Homo sapiens; identical to SEQ ID NO: 85848
  misc_feature 1..30: note = chr2:219725453-219725483
  misc_feature 1..30: note = Hyper
  source 1..30: mol_type = genomic DNA

SEQ ID NO: 118705 - DNA, 820 bp, Homo sapiens; identical to SEQ ID NO: 85849
  misc_feature 1..820: note = chr2:219735785-219736605
  misc_feature 1..820: note = Hyper
  source 1..820: mol_type = genomic DNA

SEQ ID NO: 118706 - DNA, 35 bp, Homo sapiens; identical to SEQ ID NO: 85850
  misc_feature 1..35: note = chr2:219745580-219745615
  misc_feature 1..35: note = Hyper
  source 1..35: mol_type = genomic DNA

SEQ ID NO: 118707 - DNA, 49 bp, Homo sapiens; identical to SEQ ID NO: 85851
  misc_feature 1..49: note = chr2:219757965-219758014
  misc_feature 1..49: note = Hyper
  source 1..49: mol_type = genomic DNA

SEQ ID NO: 118708 - DNA, 108 bp, Homo sapiens; identical to SEQ ID NO: 85852
  misc_feature 1..108: note = chr2:219773253-219773361
  misc_feature 1..108: note = Hypo
  source 1..108: mol_type = genomic DNA

SEQ ID NO: 118709 - DNA, 230 bp, Homo sapiens; identical to SEQ ID NO: 85853
  misc_feature 1..230: note = chr2:219773687-219773917
  misc_feature 1..230: note = Hyper
  source 1..230: mol_type = genomic DNA

SEQ ID NO: 118710 - DNA, 104 bp, Homo sapiens; identical to SEQ ID NO: 85854
  misc_feature 1..104: note = chr2:219823873-219823977
  misc_feature 1..104: note = Hyper
  source 1..104: mol_type = genomic DNA

SEQ ID NO: 118711 - DNA, 239 bp, Homo sapiens; identical to SEQ ID NO: 85855
  misc_feature 1..239: note = chr2:219824213-219824452
  misc_feature 1..239: note = Hyper
  source 1..239: mol_type = genomic DNA

SEQ ID NO: 118712 - DNA, 1153 bp, Homo sapiens
  misc_feature 1..1153: note = chr2:219824786-219825939
  misc_feature 1..1153: note = Hyper
  source 1..1153: mol_type = genomic DNA
aggtgacacccaagccggcatccacgggccccgaccccctggtccagcaacgcaaccgcgagaaccttctccgcaagggccgggatccccccgacggcggcggcaccgccaagcccctggcggtgccagtgcccaccgtgcccgcggctgccgccacctgcgagccaccgtcggggggcagcgcggccgctcagccgccgggctcgggcgggggaaagcctccgccgccgcctcccccagccccgcaggtggcgccgccggtgcctggcggctcgccgcggcgggtcatcgtgcaggcgtccaccggcgagctgctgcgctgtctgggcgacttcgtgtgccgacgctgctatcgcctcaaggagctgagcccgggcgagctggtgggctggttccgcggtgtggaccgctcgctgctgctgcagggctggcaagaccaggccttcattacgcctgcaaacctggtgttcgtgtacctgctgtgccgcgagtcgctgcgtggggacgagctggcgtcggccgccgagctgcaggccgccttcctcacctgcctctacctcgcctactcctacatgggcaacgagatctcctacccactcaagcccttcctcgtggagcccgacaaggagcgcttctggcagcgctgcctgcgcctcatccagcggctcagcccgcagatgctgcggctcaacgccgacccccacttcttcacgcaggtctttcaagacctcaagaacgagggcgaggccgccgccagcggcgggggcccaccgagcgggggcgcgcccgccgcctcctcggccgccagggacagctgcgcggccggaaccaagcactggactatgaacctggaccgctagggatacccaggggccgcgcccatcccccgccccagcccctgacacacactcggaccccccgggaccacaaagccaccgccgctgttaccgccgctcagcgccccggctgggcggaggaggagacgcccatgcccctcaggggaaagtggagaccgggacaccagaggccgcggtgtttggatttgctgggcgtggagtggggacggaagatgagcgcgggaaaggcactccaacctcactcttcccgtctgtctgcgcccccatttctccatttctgccggggtctccccctt

SEQ ID NO: 118713 - DNA, 196 bp, Homo sapiens; identical to SEQ ID NO: 85858
  misc_feature 1..196: note = chr2:219826727-219826923
  misc_feature 1..196: note = Hyper
  source 1..196: mol_type = genomic DNA

SEQ ID NO: 118714 - DNA, 237 bp, Homo sapiens; identical to SEQ ID NO: 85859
  misc_feature 1..237: note = chr2:219827646-219827883
  misc_feature 1..237: note = Hyper
  source 1..237: mol_type = genomic DNA

SEQ ID NO: 118715 - DNA, 1219 bp, Homo sapiens
  misc_feature 1..1219: note = chr2:219846397-219847616
  misc_feature 1..1219: note = Hyper
  source 1..1219: mol_type = genomic DNA
atggccccccaagtgcgaggctgcggccacggccccgaagggcccgggcgggggctgcaagctgggactggggtagagcgcggcggtggcggcggcagcggtggcggcggggcccgggcccggccagtaggagaagccggcgggcgcgaccccggccgaggcggccatgaggttgagtttggagaggccggggaagggcagcggggcgaggccggcgggcagcttgtagagcgcgccgtcctgggcggccgcggcggcggcagcagctgcggcggcggcatgagcgtgcgcgggcggcggctggcaggcctgcgccaggccctggaagtcgaagcggtaggcgtagcgcttgccatgcaccttgctcatgatgttcttgtcgtagtagtagcgcagggcgcggctcagcttgtcgtagttcatgttgggcttgctcttgcgctcgccccaccgccgcgccacctcgtccgggtccgtgagcttgaactcgccgtgaccgccctcccacgcgatgcagccggcgttcgcgcggtcagccagcagctccagcagaaactgccacagctggatctgtccgctgcctgtggggaggggggcggtcagccacaggcgggagcggggaggcgggaactggggaagagtgctggcgggaaactgacccaccccggcaggaaccggcactgggggaggaaaagtgcaagtcaaactgcagctgcgttcggcgggagaggccggccccggaggggctgatcagcagagtggtgtgtagccttaccgcgcttttgcacaatggaaatgcggcttccactgaagagcacgtagctttccagatgcacggttttgtggaacttgggggttggggggaaggggaagcattgcctccccccacgtgagcgcagcggcgcaccaaggcacttggctttccaaggcgagcaaggacagatatccgccgccactctccatctcagccgggcgcccttatttagggaaaagacgcacaaccgtacagggcggccttgggcagaatgatcggactgccccatcccagctggaccacatccagaggtgggaagggacaggcgtgcagcaggacgaccccaaccactgctggacaaggcccagctagtcccgagtccccaaagacgtagttggacaggctactcctgaggtggagtggtggctggctcccttgggacaccacatccgacaggagtaggaa

SEQ ID NO: 118716 - DNA, 668 bp, Homo sapiens
  misc_feature 1..668: note = chr2:219848809-219849477
  misc_feature 1..668: note = Hyper
  source 1..668: mol_type = genomic DNA
tcttcccaaggcctccgcacaaccaggccaggactccgggcttcagtgtgaaccctgggtccacactgctcccacctactgtccgcctgtgccctgaccccaaccaacctcgcctccgccgcccagcgcgccggccatctcacctttctgaaccgcggggctcagcggcccccagctcgggttcttcccgtccttgaagagaccgtctccgacgggatctgcaagcagcagaagaaaagaatcaggagaaccccgggcggaagttgtgggcttgacaaaagggccccgggccaaggcttaaggggggtgctgtggtccccaggcgcgaggctgggggcccgggccacccggctcctcctcccggagcctggtccaggcgcgctgcgcggagcccctccatagagcccaagtcaggaaacgcgtccaggaaaaaggaaatccgctttccgaaggggccggctggagccttataaagccgagcggggaactgcgccagccgagctggagcgcgaagagaagaggagggtgcctggagggccggcctgaagctcgtagcaggaaggtgaggagccgtgagagcgcaggggagacgcccgcggaccacagccttctggtacggctcggccacagagtactccaccacgccagagacccgtgcttcccctctc

SEQ ID NO: 118717 - DNA, 414 bp, Homo sapiens; identical to SEQ ID NO: 85865
  misc_feature 1..414: note = chr2:219849858-219850272
  misc_feature 1..414: note = Hyper
  source 1..414: mol_type = genomic DNA

SEQ ID NO: 118718 - DNA, 30 bp, Homo sapiens; identical to SEQ ID NO: 27865
  misc_feature 1..30: note = chr2:219850482-219850512
  misc_feature 1..30: note = Hyper
  source 1..30: mol_type = genomic DNA

SEQ ID NO: 118719 - DNA, 742 bp, Homo sapiens
  misc_feature 1..742: note = chr2:219857726-219858468
  misc_feature 1..742: note = Hyper
  source 1..742: mol_type = genomic DNA
caatcactcacacgccgttttccaccttgaccgagcgcaccctgggcaggcctccgcgctcgcagacgttcgcacagtcgcttagcagccgacagcgacggccctggaagtcctcctcgtcccagagcgtgaggctggcgggcgccgggcccggcgcgggggcgctgctcatgccgctgcggacaggaagggtggcaccacgcgctcagcgtctcaagagccccgtttcgagccacacacagcctgcccaacctgggtagcggatgaagaacccgggggctggacccggcctagctctggacccggctgccaggggctcgcagtcttcccgcgctcccctcccttccccaccccagcagagggcattcaccgggtgggtgagcgcggcacgcgagggaaatggaccggctgcgaggctgcgcgcggccgggcgggccgagctttatacctgggccttgtccccctgtccgcaccctttccctcgggggtggggtcgctgagtcagcaggcaggctgcggtcggctctggtctccgctggggagccgaggcctctcccgcagccgccgctgtggccccagcccgcgggaaagacaacagaaagtgctgaggcgcgcaccccgcgcccgccgcagcccaggctgactccgcgctttctttctttccagcctgagccaggcagggcacgccaggcctcggggcagaacgcgccctccctgtcccggccctcggggacgaagggac

SEQ ID NO: 118720 - DNA, 36 bp, Homo sapiens; identical to SEQ ID NO: 85869
  misc_feature 1..36: note = chr2:219858715-219858751
  misc_feature 1..36: note = Hyper
  source 1..36: mol_type = genomic DNA

SEQ ID NO: 118721 - DNA, 245 bp, Homo sapiens
  misc_feature 1..245: note = chr2:219866368-219866613
  misc_feature 1..245: note = Hyper
  source 1..245: mol_type = genomic DNA
ctcacgcgagccgaacgaacaaaacgctcaggtccggtttgtgcgaggggctcgtcgcggggcgggagcggagggcccggggcctggcggtcgccctcggtgatctcctggtcctggtcttccgcgagctcagtgctgcacagcgccccgctagcctccgccctcacctgaacgcatctgcggctgacacgtcggcggccgcggcggccaccgcaggtgcgcacctggcccgcccctcctttccc

SEQ ID NO: 118722 - DNA, 430 bp, Homo sapiens; identical to SEQ ID NO: 85871
  misc_feature 1..430: note = chr2:219867582-219868012
  misc_feature 1..430: note = Hyper
  source 1..430: mol_type = genomic DNA

SEQ ID NO: 118723 - DNA, 98 bp, Homo sapiens; identical to SEQ ID NO: 85872
  misc_feature 1..98: note = chr2:219923137-219923235
  misc_feature 1..98: note = Hyper
  source 1..98: mol_type = genomic DNA

SEQ ID NO: 118724 - DNA, 42 bp, Homo sapiens; identical to SEQ ID NO: 85873
  misc_feature 1..42: note = chr2:219923695-219923737
  misc_feature 1..42: note = Hyper
  source 1..42: mol_type = genomic DNA

SEQ ID NO: 118725 - DNA, 30 bp, Homo sapiens; identical to SEQ ID NO: 27869
  misc_feature 1..30: note = chr2:219924566-219924596
  misc_feature 1..30: note = Hyper
  source 1..30: mol_type = genomic DNA

SEQ ID NO: 118726 - DNA, 465 bp, Homo sapiens; identical to SEQ ID NO: 85875
  misc_feature 1..465: note = chr2:219925148-219925613
  misc_feature 1..465: note = Hyper
  source 1..465: mol_type = genomic DNA

SEQ ID NO: 118727 - DNA, 315 bp, Homo sapiens; identical to SEQ ID NO: 85876
  misc_feature 1..315: note = chr2:219925828-219926143
  misc_feature 1..315: note = Hyper
  source 1..315: mol_type = genomic DNA

SEQ ID NO: 118728 - DNA, 197 bp, Homo sapiens; identical to SEQ ID NO: 85877
  misc_feature 1..197: note = chr2:220080662-220080859
  misc_feature 1..197: note = Hypo
  source 1..197: mol_type = genomic DNA

SEQ ID NO: 118729 - DNA, 87 bp, Homo sapiens; identical to SEQ ID NO: 85878
  misc_feature 1..87: note = chr2:220083558-220083645
  misc_feature 1..87: note = Hyper
  source 1..87: mol_type = genomic DNA

SEQ ID NO: 118730 - DNA, 30 bp, Homo sapiens; identical to SEQ ID NO: 85879
  misc_feature 1..30: note = chr2:220096000-220096030
  misc_feature 1..30: note = Hypo
  source 1..30: mol_type = genomic DNA

SEQ ID NO: 118731 - DNA, 30 bp, Homo sapiens; identical to SEQ ID NO: 85880
  misc_feature 1..30: note = chr2:220150841-220150871
  misc_feature 1..30: note = Hypo
  source 1..30: mol_type = genomic DNA

SEQ ID NO: 118732 - DNA, 30 bp, Homo sapiens; identical to SEQ ID NO: 85881
  misc_feature 1..30: note = chr2:220161540-220161570
  misc_feature 1..30: note = Hypo
  source 1..30: mol_type = genomic DNA

SEQ ID NO: 118733 - DNA, 47 bp, Homo sapiens; identical to SEQ ID NO: 85882
  misc_feature 1..47: note = chr2:220173293-220173340
  misc_feature 1..47: note = Hyper
  source 1..47: mol_type = genomic DNA

SEQ ID NO: 118734 - DNA, 572 bp, Homo sapiens
  misc_feature 1..572: note = chr2:220173772-220174344
  misc_feature 1..572: note = Hyper
  source 1..572: mol_type = genomic DNA
ccctttcctccgagacgccctctcaccttcctcatctcgcatgcctcccccaacccatattctccccgagcttcatgacatttcaccctcacccccaccgagtttcgctccaggccccaagctgctccccgccccccaccacccgccagcccaagtttcctcctgaccgtgggcactaacggcgctgcagccccccgggcggctgctcagcagcaggaggcagaggagcagccggagacccccggatcccccgagacccccaggccgccgcgggcgccgcatctttccgagctccgggcgctcgctcccgggccggagccgcagcgacgctggcgggagcctgccagaggggctgaggcggggcttgccgctccccacctccctacgaggcggggtctacatgcccctctcgctgcaacgcggccaaccgcaggcgggtgctgacgacacctccacccccggctcgtaagctaatttgcgtcacatatggcgtaagagccctgtcggagcgggggacctacctagcccatccctcctccatcaaatagtaggcgcctcgctagaattcccac

SEQ ID NO: 118735 - DNA, 41 bp, Homo sapiens; identical to SEQ ID NO: 85885
  misc_feature 1..41: note = chr2:220180029-220180070
  misc_feature 1..41: note = Hypo
  source 1..41: mol_type = genomic DNA

SEQ ID NO: 118736 - DNA, 481 bp, Homo sapiens; identical to SEQ ID NO: 85886
  misc_feature 1..481: note = chr2:220196354-220196835
  misc_feature 1..481: note = Hyper
  source 1..481: mol_type = genomic DNA

SEQ ID NO: 118737 - DNA, 413 bp, Homo sapiens; identical to SEQ ID NO: 85887
  misc_feature 1..413: note = chr2:220197187-220197600
  misc_feature 1..413: note = Hyper
  source 1..413: mol_type = genomic DNA

SEQ ID NO: 118738 - DNA, 870 bp, Homo sapiens
  misc_feature 1..870: note = chr2:220222920-220223790
  misc_feature 1..870: note = Hyper
  source 1..870: mol_type = genomic DNA
ccccgctgtcatcagcgctgacgccctggacccacacagcggcggggtttggtttgacgtggctcccaaaggcgagggcggagctggggaaggtgagagcacccaggcatccgcacaggcgtgaccctctgcccaccaggcaccctgcccacacagcgcgccgcaggaagccctccgcattggtgtccaagctcgagcaccaggtggaggaacccgtggccatcgggtgtggggtgtgcagggtgcggagaaggctaggattcctcccaatcctctgctgcgccctcccccagccgcctccccaggttgaggggaggccccggcccaggactgggctcttcccgaggtggggactggatgcccgcgctccggactcctgccggagatgccaaccccccagcgctgggcaccttgccttgacccctcagcgcgtctcacatggcccggatctcggtcccttgggcactccctcttgcccaactccgaattggagttcttgtagttctagtttccaccccgtcttccgacgtttaagaccccgcttccaagacgccctctggctttctcttcccatcccgcacacttccctagcttctgagctgtgtgcacccaccaacccgcagccctccctcaggatcgcccctgcccttcccccaggtttcctcctgacggtggggactaatggcgtcccagccccccgggcggctgctcagcagcaggaagcagagaatcagaggcacccccgctgggccccgagccccatgcgcgcgcaggggcccccgcatcttgttgggcgcgcgctgccccgcctgcaccgcagcgaccgcggccagagccaggccaggcggctctgcgcgtccctctctccgc

SEQ ID NO: 118739 - DNA, 687 bp, Homo sapiens
  misc_feature 1..687: note = chr2:220283066-220283753
  misc_feature 1..687: note = Hyper
  source 1..687: mol_type = genomic DNA
ggatacaaatagtgccgacggctgggggccctgtctcccctcgccgcatccactctccggccggccgcctgcccgccgcctcctccgtgcgcccgccagcctcgcccgcgccgtcaccatgagccaggcctactcgtccagccagcgcgtgtcctcctaccgccgcaccttcggcggggccccgggcttcccactcggctccccgctgagttcgcccgtgttcccgcgggcgggtttcggctctaagggctcctccagctcggtgacgtcccgcgtgtaccaggtgtcgcgcacgtcgggcggggccgggggcctggggtcgctgcgggccagccggctggggaccacccgcacgccctcctcctacggcgcaggcgagctgctggacttctcactggccgacgcggtgaaccaggagtttctgaccacgcgcaccaacgagaaggtggagctgcaggagctcaatgaccgcttcgccaactacatcgagaaggtgcgcttcctggagcagcagaacgcggcgctcgccgccgaagtgaaccggctcaagggccgcgagccgacgcgagtggccgagctctacgaggaggagctgcgggagctgcggcgccaggtggaggtgctcactaaccagcgcgcgcgcgtcgacgtcgagcgcgacaacctgctcgacgacctgcagcggct

SEQ ID NO: 118740 - DNA, 668 bp, Homo sapiens
  misc_feature 1..668: note = chr2:220299468-220300136
  misc_feature 1..668: note = Hyper
  source 1..668: mol_type = genomic DNA
tgccccctccctccacggctccctcgcaacccgagccggggggcctaaaaatagcccccaggcgcaatcgccggccgccccggtgaccttctgggtagcacaggccgaaggcgggcgggcagcaggaaggcaggccgccggccccccagacttgtctcctagggcaccgtcccgcgggtgcccccgtggccgcccagttccggcgtccccccagcccagctctcagtggccatgcagaaagcccggggcacgcgaggcgaggatgcgggcacgagggcaccccccagccccggagtgcccccgaaaagggccaaggtgggggccggcggcggggctcctgtggccgtggccggggcgccagtcttcctgcggcccctgaagaacgcggcggtgtgcgcgggcagcgacgtgcggctgcgggtggtggtgagcgggacgccccagcccagcctccgctggttccgggatgggcagctcctgcccgcgccggcccccgagcccagctgcctgtggctgcggcgctgcggggcgcaggacgccggcgtgtacagctgcatggcccagaacgagcggggccgggcctcctgcgaggcggtgctcacagtgctggaggtcggaggtaaagggcaggtgggggccgcgcccggcaggggcggggtgctcagagg

SEQ ID NO: 118741 - DNA, 30 bp, Homo sapiens; identical to SEQ ID NO: 85895
  misc_feature 1..30: note = chr2:220309719-220309749
  misc_feature 1..30: note = Hypo
  source 1..30: mol_type = genomic DNA

SEQ ID NO: 118742 - DNA, 33 bp, Homo sapiens
  misc_feature 1..33: note = chr2:220313798-220313831
  misc_feature 1..33: note = Hyper
  source 1..33: mol_type = genomic DNA
tcctgccctgggccacgccgggcctggagggcg

SEQ ID NO: 118743 - DNA, 41 bp, Homo sapiens; identical to SEQ ID NO: 85896
  misc_feature 1..41: note = chr2:220316287-220316328
  misc_feature 1..41: note = Hypo
  source 1..41: mol_type = genomic DNA

SEQ ID NO: 118744 - DNA, 803 bp, Homo sapiens
  misc_feature 1..803: note = chr2:220348994-220349797
  misc_feature 1..803: note = Hyper
  source 1..803: mol_type = genomic DNA
agagcccaagccccacgctgctgtctttgccagggtggcctccccacctccgggagcccccgagaagcgcgtgccctcagccgggggtcccccggtgctagccgagaaagcccgagttcccacggtgccccccaggccaggcagcagtctcagtagcagcatcgaaaacttggagtcggaggccgtgttcgaggccaagttcaagcgcagccgcgagtcgcccctgtcgctggggctgcggctgctgagccgttcgcgctcggaggagcgcggccccttccgtggggccgaggaggaggatggcatataccggcccagcccggcggggaccccgctggagctggtgcgacggcctgagcgctcacgctcggtgcaggacctcagggctgtcggagagcctggcctcgtccgccgcctctcgctgtcactgtcccagcggctgcggcggacccctcccgcgcagcgccacccggcctgggaggcccgcggcggggacggagagagctcggagggcgggagctcggcgcggggctccccggtgctggcgatgcgcaggcggctgagcttcaccctggagcggctgtccagccgattgcagcgcagtggcagcagcgaggactcggggggcgcgtcgggccgcagcacgccgctgttcggacggcttcgcagggccacgtccgagggcgagagtctgcggcgccttggccttccgcacaaccagttggccgcccaggccggcgccaccacgccttccgccgagtccctgggctccgaggccagcgccacgtcgggctcctcaggtg

SEQ ID NO: 118745 - DNA, 206 bp, Homo sapiens
  misc_feature 1..206: note = chr2:220361419-220361625
  misc_feature 1..206: note = Hyper
  source 1..206: mol_type = genomic DNA
gtttaggggtctggccggtccagggggcaggtaggagatggtgcgctcgcggtaagggctgtggccgggcctgtcttaggaactctgggccctgactcggcccgcgggtaggtcccggaaggagctgcgcgagaaggggccgccgcgggtgctggagccgctgaaggacgtggtgctgatcgaaggcagcgcggccaagctcactt

SEQ ID NO: 118746 - DNA, 523 bp, Homo sapiens
  misc_feature 1..523: note = chr2:220361826-220362349
  misc_feature 1..523: note = Hyper
  source 1..523: mol_type = genomic DNA
tcctcgtggaaggtacgcgcgccccgggcgcagcgccagggcgcagaccagcaccactcagccagagcccgcagcccggtccagctgcgcgtgtttacctctgggcctagctacagggtccccgccagcccagctctgggcacggcctggggcgcatcgccgcgccagccaagtgcgtccttccctacctcgggatccagctccacccgggctgagcagtcagctgtggacttccatcacgcggctccgggtccccaaggtcacacagcaagccagaggcagagccagggttggacccgggtcttctggctcccaactctggcaatttccactacccggagcggtctctgaggcaccgcgagatgtgtgaacattcaggggctttcgcccgccttatctctcttgatcctctattcgaccccgagaagtaggagaggcagggataagtccctttaacagccaaggagatgaaaccagagaggctaatgatttgctcaacgtcacactgcgagtttaaatgcat

SEQ ID NO: 118747 - DNA, 67 bp, Homo sapiens; identical to SEQ ID NO: 85901
  misc_feature 1..67: note = chr2:220362553-220362620
  misc_feature 1..67: note = Hyper
  source 1..67: mol_type = genomic DNA

SEQ ID NO: 118748 - DNA, 246 bp, Homo sapiens; identical to SEQ ID NO: 85902
  misc_feature 1..246: note = chr2:220379093-220379339
  misc_feature 1..246: note = Hyper
  source 1..246: mol_type = genomic DNA

SEQ ID NO: 118749 - DNA, 38 bp, Homo sapiens; identical to SEQ ID NO: 85903
  misc_feature 1..38: note = chr2:220383596-220383634
  misc_feature 1..38: note = Hypo
  source 1..38: mol_type = genomic DNA

SEQ ID NO: 118750 - DNA, 42 bp, Homo sapiens; identical to SEQ ID NO: 39750
  misc_feature 1..42: note = chr2:220384416-220384458
  misc_feature 1..42: note = Hypo
  source 1..42: mol_type = genomic DNA

SEQ ID NO: 118751 - DNA, 267 bp, Homo sapiens; identical to SEQ ID NO: 85905
  misc_feature 1..267: note = chr2:220387586-220387853
  misc_feature 1..267: note = Hyper
  source 1..267: mol_type = genomic DNA

SEQ ID NO: 118752 - DNA, 1406 bp, Homo sapiens; identical to SEQ ID NO: 85906
  misc_feature 1..1406: note = chr2:220416306-220417712
  misc_feature 1..1406: note = Hyper
  source 1..1406: mol_type = genomic DNA

SEQ ID NO: 118753 - DNA, 865 bp, Homo sapiens; identical to SEQ ID NO: 85907
  misc_feature 1..865: note = chr2:220435389-220436254
  misc_feature 1..865: note = Hyper
  source 1..865: mol_type = genomic DNA

SEQ ID NO: 118754 - DNA, 92 bp, Homo sapiens; identical to SEQ ID NO: 85908
  misc_feature 1..92: note = chr2:221861740-221861832
  misc_feature 1..92: note = Hypo
  source 1..92: mol_type = genomic DNA

SEQ ID NO: 118755 - DNA, 24 bp, Homo sapiens
  misc_feature 1..24: note = chr2:222034371-222034395
  misc_feature 1..24: note = Hypo
  source 1..24: mol_type = genomic DNA
gcgagactccgtctcaaaaaaaaa

SEQ ID NO: 118756 - DNA, 84 bp, Homo sapiens; identical to SEQ ID NO: 85910
  misc_feature 1..84: note = chr2:222435773-222435857
  misc_feature 1..84: note = Hyper
  source 1..84: mol_type = genomic DNA

SEQ ID NO: 118757 - DNA, 984 bp, Homo sapiens; identical to SEQ ID NO: 85911
  misc_feature 1..984: note = chr2:222435977-222436961
  misc_feature 1..984: note = Hyper
  source 1..984: mol_type = genomic DNA

SEQ ID NO: 118758 - DNA, 54 bp, Homo sapiens; identical to SEQ ID NO: 85912
  misc_feature 1..54: note = chr2:222437367-222437421
  misc_feature 1..54: note = Hyper
  source 1..54: mol_type = genomic DNA

SEQ ID NO: 118759 - DNA, 30 bp, Homo sapiens; identical to SEQ ID NO: 85913
  misc_feature 1..30: note = chr2:222438857-222438887
  misc_feature 1..30: note = Hyper
  source 1..30: mol_type = genomic DNA

SEQ ID NO: 118760 - DNA, 36 bp, Homo sapiens; identical to SEQ ID NO: 27894
  misc_feature 1..36: note = chr2:223104874-223104910
  misc_feature 1..36: note = Hyper
  source 1..36: mol_type = genomic DNA

SEQ ID NO: 118761 - DNA, 30 bp, Homo sapiens; identical to SEQ ID NO: 85915
  misc_feature 1..30: note = chr2:223154920-223154950
  misc_feature 1..30: note = Hyper
  source 1..30: mol_type = genomic DNA

SEQ ID NO: 118762 - DNA, 423 bp, Homo sapiens; identical to SEQ ID NO: 85916
  misc_feature 1..423: note = chr2:223155765-223156188
  misc_feature 1..423: note = Hyper
  source 1..423: mol_type = genomic DNA

SEQ ID NO: 118763 - DNA, 1694 bp, Homo sapiens
  misc_feature 1..1694: note = chr2:223158730-223160424
  misc_feature 1..1694: note = Hyper
  source 1..1694: mol_type = genomic DNA
ctttcagttccatgtcgttactcaggcgcagagacaccgcgcatgaagggaccttgatccgagctgggcttggctgccgtcagatcaccaatgtcagctagccgatgccctccaagtcacccagcaagtgcgccgcccaaggcgccaccgcttacctcgctcgctcaggatgccgtcgatgctgtgtttggccttcttctcgctttcctctgcctccttcctctccaagtcggcctcctcctcttcacctttcccgaatttacttctcaggatgcggctgatggaactcactgggggcgggaggaggaaggaagcaagggagcgcacatggttgagacaagcagggctgtgcgggaaggaccccccacccccaaacaccagccagggccctagagccgctgccctgcactgctcgcgggtgtctcctcctgcatctctggacatcctcatccttctccagccctctcatcctgccactcaaacccccctccctattatctgtatctcggtactgaaagacggaggctgggaaaaccgtgcctccaagttagggccggatgccatctttgtccctcgattctgggcaggaagcatttcccttcctggactccgaagaccgggctctaggtctgcaatctaagagaattctcccaccagcccaccgggtaccctccttcctccccacctgaatgcatggatcctgcggttcgccttaagggaggaagaaccaaagccgacttgtccgcgcccccccccacccccccgtaaatcaagtttcttttttttcctttcttcccttttttttttttttttaaggctataaagggtttaaatttcaactgcagaatcgtttcctattgtaaaaatcaaaagaaaatgcactctctcccacttattttttccagattccagtctggtaaacaaatccatgctctgaaatatgtttctcacagagggaaaaagggagtttccttttaattaaaaacaaaccctcccgtgcgccctctcgctggccccgtgcttgcccctcttctccctccgcctcccccaggctgccgtggcggggggctccggaccgtccctgagactctcggaggaaatcggggccgttgtggaagcctccacggctttgcgcacacggcaaagtccctcccggcgcgggccccatctcccttcggttggggttaccaaaacatttgtttctctttaaaagggaacatcaatattaataaacgctctgcctccgcctcacgtttcctgccctgcctcctcgacagaaatcttctttggggcgtcctcagcggtggtctcgccaccctccgtccccaggacaagcagctcacccctccctccataaagtgccaagaacaccgggttggcaaatattgcagggcctcgggagaggccacctcccaatagctgagatcgataattggggtgattacgtctgggtcgacgtgccggggtaatagcgactgactgtcgcgcctcggggagaggttaatgggcctagtacctgacggcacggtgtttcgatcacagaccgcgtccttgagtaatttgtctcggatttcccagctgaacatgcccgggttctctcttttgtattcctcaattttcttctccacgtcaggcgttgtcacctgctttaagagaacaggcgggcaggcgttggtacccggtaccctgggcca

SEQ ID NO: 118764 - DNA, 30 bp, Homo sapiens; identical to SEQ ID NO: 27899
  misc_feature 1..30: note = chr2:223161247-223161277
  misc_feature 1..30: note = Hyper
  source 1..30: mol_type = genomic DNA

SEQ ID NO: 118765 - DNA, 810 bp, Homo sapiens
  misc_feature 1..810: note = chr2:223161526-223162336
  misc_feature 1..810: note = Hyper
  source 1..810: mol_type = genomic DNA
cagggcgcgtgcacacgtacacacacacacgcgcgcctttacgcaccttcacaaacctcagaaataactcattggagagccccagatgtcagccgttaccccccgcccggtcttccccaacacaggggaccacagtctgggagccaggagggcaaggcccgcccgctcaccttgggcttgctgccgccgatggcaccaggacgtatggagccagtctcctggtacctgcacaggatcttggagacgcagccgtgggacacgcgcagctggcgcgagatgacgcagggccggatgccgtggtgggccatctccacgatcttgtggcggatgtggttgggcagcggcctgccgttgataaaaacaccgccgagctggttgacgcggccctggccgaggggagtggacactgtgggaaggtgaaaaagagaagcaagggaaaagtcactggaggaaaataaaaagcaaagaacagcagcacgtaatttcgcagtcttctgtcctatcctcatgttacagcaccgacgctgaaactgctcgacatcggactcccagacccagacctcctttcaatcacatttgttcaaattattcagcaatatagcgcatgtaatcttgtgtaaagacagcaaatggggcaaaataattctccccagagaaagcgtcttccccttcgggcccggggagtggcaacttaggagaccctgcagctggtagagagtctagcttgctctagaaacagcctcctggcgaagagaagttcacccaggagctggccttgatgaactctgctcccaccgatccctgtccaat

SEQ ID NO: 118766 - DNA, 1438 bp, Homo sapiens
  misc_feature 1..1438: note = chr2:223162565-223164003
  misc_feature 1..1438: note = Hyper
  source 1..1438: mol_type = genomic DNA
gaagggagtgggtggcgggggcgatgagcatctctgctggggcgccctaacctggaaaaccattgaaaacggctcaggcttgcaagacttcctgcctccccgggattcccagaatcttcaagtggacggaaaggcgattcctaaacaagttatagaaacttctagatgctatttgagatacatagaattctaatttatttaattattctaaaaattccaatcacaatggcgcggcgttagccaccacaactttgcagggcaaaaaaaaaaaaatacttcctgaactaacatatgtttcacaagtgtgggcgcagccgggacaatttcgagacaacttcgagacaatttcgaatggacaaattgcggagaagttgcttctgccgctcagaagccggttcacctccttctccaccgcggcatttccaaaacaacagggacaagtctccccggctcgccgcaggcctgaccgcccagctccgccaggatttgcagagagcagcgcgctccatttgcagaaaggaaatcgagtaggtcctcgcccccgactggtgcttcttggggtgtggggtgcccagggaatgggcttcctggaagcaccaaaggagcctgcggagcctggggatggggtgaggcagccggtcccaggccctgggatccaggcggcgcgctgaggccctcccttaccttccagcgggaacccgctacgcgggtagttctgccccgggcccggccgcatcatcctgggcacagcgccggccagcgtggtcatcctgggggcagcttcgctcggaaattatatccaggtgaaggcgaaacggaaaggcgagtgcggcgcggatgaccctcgggaactatccggagcgtggagagcccctccccaaaacggctggagagagagggagggacgcggggaggggggctgtcggttcctagtccagaggccggagctggaacccgggaaaggggaggacggggaggccccggagtccaggatcccgagcccagggcggaaaagtttggtacgagtctgggcaaatgttccagcgactggggtccctgaaaagggggctcagagagccacggcgagccggggagcctggtgaggctggagcgcggcctgcctgagtctcctcctgtggtgacaccgagtgcggggatccgggctcgggagcatttattagttcttttacccaaagcttggtcaggagccctgagctgcgattggccgacgggtagaccgtcccgggtggcggagacacgcgctgattgggcaacagcgaccactttctcttcccatctctggtggtgccgaggcctctgctggccccgagggggacccgcgctgcgccccttgcccaggagagaaggttggcccggtggaaactgagagagacagccccagggagatggcagttgctgagggcggagaagttcctgt

SEQ ID NO: 118767 - DNA, 511 bp, Homo sapiens
  misc_feature 1..511: note = chr2:223164384-223164895
  misc_feature 1..511: note = Hyper
  source 1..511: mol_type = genomic DNA
gaggagtccagggtgcgctgatgttcttttgtcttctccgtccgcaagcggggctaatgtgaagcacaggcagccgtcgctaggcccaagcactcgttagttgaaggctgggggtatgggggagggtgcagaaaaaaacctggctcctcttcttggtgtaaaaaccgctctggcaagctgcggttctaaatctctacatatagatccccgatgcgtcgacagagatgtgtctgtatgttaaagttttgcccgggttcagcgtttgttctcaggaatttattatggcattcagactaaactgctggaaaaataaaaggaacgaagtcttggctaggagctgaagtgtccccagcaggatatgacgccaggagtgttgtaaagactgtctgtccttagagaaggtaccattgtgcatagccttttatttataacttggtaagtgccagcgaactcgcctcctttacacccccgagtgccagccccgcgctctgcactgcgctttattcgctcg

SEQ ID NO: 118768 - DNA, 1416 bp, Homo sapiens
  misc_feature 1..1416: note = chr2:223165434-223166850
  misc_feature 1..1416: note = Hyper
  source 1..1416: mol_type = genomic DNA
attttctttttaaggcgttggggccaccaaagcctgtgtccgtacgttttaagccacttctcagcgatagcattttgagagctagactttttccaagttttcttcttcccaaaggttaagcagagtcgacagagcactttctggggtcagcggtaattgctgtgtgaaggaggtaccagaagtgtaatttcaagaaggcaaaagtaggctcaactctcagctaaaataaactcttggaccccgcgagcagttaaagaacatctagagctgagtctcatttgtttttgagccggaggcttggtctccaagccctcccagcgtccacccgtctctctcctgccgggagttttctctcctaagagccggcagatgctggagggaagcgcttgctgcaagattccttctcccggtcccgtagattgcagagtccgcgggaccgttgaacggaggtactgccggctgagctgggtcttaagtgcccatgggttcataaactagctgtcacttgctataaacatgtacaaatggaggccacaaggatgtgggggtgctggggacctaaagctccggaatcaggaggcgactcattttctctcctttccggcctctttcttttctgccgagcgctctgagattcatatgtacccagatgatcagcccggcccttctcaccggccagtggccagaggtccctggacacccggagaggggtgggagggcacccttaggctctggacagctgggccacatccaaagacttaatgaatctaaatttcttgtggcctgtgtccccgaagtccgacctgggatggccaggacagcaaagttggctgaggctgcctggcctagggcgcccgcacgccgccaaacctaacccggctcagagccgtgactccgcagaacagggcgcaacaggtctcaggaatgccgggtgattccagccactctttctctgtctccgagtcttgggcctcccctttatttctttctgaagtctctccggagcccaagccaccccacacccaaaccccgcagctggatgggagtccaggccacttccctatccgcagccggtgggccaaggagtcctggtgccaaatttggccgcggtacaggcgctaattggtaaagggatgacccagcggtggggcttggaaggcgagggcccgcgccctgcatccttgaaccctggtttgggaggcagtgacttttacctgggctaacaaattacccagaaagcatcagtgggactctccacaacggtgttgtgaacgagtgtagggtccactcacgctctgtgcacgttcgaaatgaaacgggagccttgaagacgatatttggataatttgacaaaaaaaaaaaaaaggtgggcgggggagatagcttctattgtcccctctgcgcctctgcccccag

SEQ ID NO: 118769 - DNA, 477 bp, Homo sapiens
  misc_feature 1..477: note = chr2:223167154-223167631
  misc_feature 1..477: note = Hyper
  source 1..477: mol_type = genomic DNA
tgacctagtggggagcgggggtggtgtctgccacccagacctttttcctcccgtctgaagggccgagctctggcaggctgacacggtcgagcagagaagttcctggccacccgcccggccccaggcgtgattctcaggatgcagtaaaagttgggcaaacgccgagaaaccctcaatcccacagaaaggctgccgggggctcacggggaggacatcaaaacgccaggttcgtgatcatgagcttccggtccggatgtgatgatacaggattggtgaatgcccgggttaaacccgtggtccttcgcagccgctgcctcagtgacagtcattaggccccccgcagttatttgtcaaaagcattggcgccgctcttctccccatcgaaaaatcagtcgggatgagttcggattaagggactagatgaggatgtggacatcccattgaaacatggtgtaggccagccgaagtgggtttgct

SEQ ID NO: 118770 - DNA, 2006 bp, Homo sapiens
  misc_feature 1..2006: note = chr2:223168205-223170211
  misc_feature 1..2006: note = Hyper
  source 1..2006: mol_type = genomic DNA
aaaatctgatctgtgcggaggcaggtgaaggctgtgagtgaggtgggggcgggaacagagctggaggaagtgaataaaagaaaccttggggtccgttggtttccttgactcgtggagcaaaaaagtaggcgagtgaccactccaggaactcctgcctccgggcgccggtacataaagagctggggctgtgtgtcctgctcttgggggaggagggtactgggaagggggaactaacaggtctttctttcgctcggatcaggactggactccttctgactccacgcggccccagctcctgaaccagcgcagtgagcctcagccgcttctcaaactgggtctcagaaaatttctcctcgagatggatttcagcggcaggaaagaggggccagtgacgcgaggagcaagaaaagagtaacatgggagatgaatgttcaaacccagatctcctcgctgagcctggaagctcgccaccgtgggatcacgggaaccagaggcaagaggctgcgaatgagtccaacacccgcgttcctcgagttttaaaagcacacctggggccagagactgcacagccaactaaacggagtaaacgcaacaggtggaggaggcagagttgtcaggggccaagcccggcgcgatctggccagttcttggggagcgcggacctgggactgcagagaggcgttttgaagagtgctgcgcgcacctgcctctcggagatatccaactccacccgggcgtctcctgagagcgcacagtccacagaccccgggagggctgcccgccctaggacacgtactctcccgacccctcactctttcaaaattggggaagaggcggaggagatgaaaaagaagaaagagagaaagagaagaaaagagagaaagaaggaaagaaattttaaaaaataataaaaggagggaagaatggaggtaaaacgcgggggagagaagaggggagaaactctcctcaccacaaccaaagcaggaggcctaagcttcctgaatttctacacatgacttgcattaagttccttcctagaacttaaactttttcatctcccgtcacccaagaaaacacccatttcctcttttaaataaagtttctttttctggagatgaacctttaaataagtcgtacgtttgggagcgagggacaggagaataattttgatccagaaccttggagattggagaagcaggtggaaaaattctaaaaagatgaaaactgaccatctccgacacagaaacccatcgaaaggggccaccgagacccgttgattagctggagggagcatgcggcagaagtgcagacccctcgctaacccgccaacctccaagagccctcttgcagaaagctgcccggctccccacggtggccctgcgcgcgcaccatcctcgcggtctcgcttcttcgccccggaaaactctatgaggggcaccccagcctcagccgggttaagacaagtagccccaagaggaaggagcctcagagagcctttcttcctgttcttcttcgtcttcttttttttctaaacgaaatctaatactatctggctgcaaaaatatattatcaccggctctcagcctaagagactaacatttggatatgtaggaaatgtaatctgcatggctaattgattctcagcgtatcagtttaaaggataaagatcgatatctacatgatggatattgtattaataggggcataaataaaggtcgaagagtcgttaccaaaacctttgaagccgcttttcggctctcgggccctccacgcggccagtgggtctctcccacctccccgcccccagctgctgctgggcagggagcatttgcttccccctccaacccgggaccagggtggaggagtctatggttaaagcgaaagtgtttcactgcggcaacgctggggaaaggaggttcttttttcctgggctgcagcaggtggacagtaaggcccgagaaaatgtaatattttaacaaaacgcaccactccccgaaacacacgta

SEQ ID NO: 118771 - DNA, 1285 bp, Homo sapiens; identical to SEQ ID NO: 85934
  misc_feature 1..1285: note = chr2:223170271-223171556
  misc_feature 1..1285: note = Hyper
  source 1..1285: mol_type = genomic DNA

SEQ ID NO: 118772 - DNA, 432 bp, Homo sapiens
  misc_feature 1..432: note = chr2:223171840-223172272
  misc_feature 1..432: note = Hyper
  source 1..432: mol_type = genomic DNA
gcctgcccaccctcacgtcctcgggcgcccttggctcgagggcctttcggagcctccgcgggaagcagaaagtcgcacctcacactgagcctttccttcgagcgctctgccgggagctactgagccccagcacgcagccttgggcacccggtggcgggcgaaggaacctgccccattgtgctgctgggctgcactagcggagacgagagtgcgtgtgggagtggcccactagcaccacccgccagggtttagcagcgcctggagcacctccctcttccctgctgtttccttaatgctggagctgggcacactccgatgtcccgcattctcacattcaatcattcattctccctctgaaagttctcaggctcctttgctcacgggtcgtctctggacctgagacacctgcgaaccttgcggatcaccagattg

SEQ ID NO: 118773 - DNA, 185 bp, Homo sapiens; identical to SEQ ID NO: 27915
  misc_feature 1..185: note = chr2:223173045-223173230
  misc_feature 1..185: note = Hyper
  source 1..185: mol_type = genomic DNA

SEQ ID NO: 118774 - DNA, 1582 bp, Homo sapiens
  misc_feature 1..1582: note = chr2:223176096-223177678
  misc_feature 1..1582: note = Hyper
  source 1..1582: mol_type = genomic DNA
gaattctaagcttctcgccttcctgttacagccgatctgctctgcatttggaatgcggcgtctttgcgggcgttctgagtcattcctactccgctgcaagccccgcagagaacctcgccttcttcccgaccgccaagtctgattgtacagacttcatagaaggtctggaataaggactgtgttgctgcagaggccgggtcttgggcccctgggcgtgaggacgcaggctcggcccctgggaagaaatgtactaacgcacctcaagactcctaaggtgtttccaagtcccccctccaactttcgtgtccaggtcacgctgccccgccctcggacaatgagagggtgtgtcaagatgctctttgcatctttggaagccgagggggaaataggagactttcgacggggagcaggttttccggagccgtttggggctgagattctcgaacccctgctgggggccgaaagcgccggagaaacctgggactaaacgaaggcgactccccgcagggcgcaggcaccgcacccggcgtttgttttattcttaatttacttttttgggcacctctgctattgttacaaataaatgcgaacgcggagctttcgggcgggctctgggagcggcccgtgggcatcttggaatattaaaaacgtcatccggttgtaaataacctactccccagcccttgaaatccgggacgtcacaggtgaggctgaataccaggttcgcacaaaggcaaaccaaactcagccgggatgccgagtgatggggttggcaagatagtgtggcctctggttccctccacgcgtgataagtgggatcatgacagcgtccttgtgccttcgatttgtccccaagccctcctctgcctttccgatctcaaactaacccgtaatggagctggcaagtgggacgaacgggacagcctaaagcgtcgttggcccggccaagaggggctcaacgcctgtcaccccgggcggccttgggtcctttgcagtcggagaggctgcaggggaggaggaagacccagccagctccagggtgcaggattctgcccttccacccgagagcctcccccggtgtcccagtggcagtggctgccccgggctgcggtcgcagagtaagcaggggctccagtcctcggtccgcgcgccctgccccttgggctcagctgcgagccaccgccggcgtgcgcacccacaaggagagaaatggaggtaatcccccgcttcccaccgactgccggaagctcggcctctgtgcaaaccgaagtatacctgcacccaagagcgtggaaataatttacacgctgaatggctactattaaaaaggatctttttaacagatctcctggcgagtattttaaaacaggactctgcgctagatcagctcgcccgtcggcagctgtcagcgaccagccgacaagctgagattcccctttcagctgtcactggcgatgacacccacatctatcactggcgatgttttgttaatttaacctcgagacttccctgattatccgcataatccgtcctcaaatcccctcgttgtcactgcattttgatgacacgggggacttggaaa

SEQ ID NO: 118775 - DNA, 325 bp, Homo sapiens; identical to SEQ ID NO: 85940
  misc_feature 1..325: note = chr2:223185130-223185455
  misc_feature 1..325: note = Hyper
  source 1..325: mol_type = genomic DNA

SEQ ID NO: 118776 - DNA, 473 bp, Homo sapiens; identical to SEQ ID NO: 85941
  misc_feature 1..473: note = chr2:223536200-223536673
  misc_feature 1..473: note = Hyper
  source 1..473: mol_type = genomic DNA

SEQ ID NO: 118777 - DNA, 130 bp, Homo sapiens; identical to SEQ ID NO: 85942
  misc_feature 1..130: note = chr2:223753473-223753603
  misc_feature 1..130: note = Hypo
  source 1..130: mol_type = genomic DNA

SEQ ID NO: 118778 - DNA, 18 bp, Homo sapiens
  misc_feature 1..18: note = chr2:223764729-223764747
  misc_feature 1..18: note = Hypo
  source 1..18: mol_type = genomic DNA
agtcgctctggttcaaac

SEQ ID NO: 118779 - DNA, 130 bp, Homo sapiens; identical to SEQ ID NO: 85945
  misc_feature 1..130: note = chr2:224909475-224909605
  misc_feature 1..130: note = Hypo
  source 1..130: mol_type = genomic DNA

SEQ ID NO: 118780 - DNA, 75 bp, Homo sapiens; identical to SEQ ID NO: 39754
  misc_feature 1..75: note = chr2:225394300-225394375
  misc_feature 1..75: note = Hypo
  source 1..75: mol_type = genomic DNA

SEQ ID NO: 118781 - DNA, 158 bp, Homo sapiens; identical to SEQ ID NO: 85947
  misc_feature 1..158: note = chr2:225906010-225906168
  misc_feature 1..158: note = Hyper
  source 1..158: mol_type = genomic DNA

SEQ ID NO: 118782 - DNA, 1216 bp, Homo sapiens
  misc_feature 1..1216: note = chr2:225906404-225907620
  misc_feature 1..1216: note = Hyper
  source 1..1216: mol_type = genomic DNA
tgggtttttaccctgcggtgggagggctgttccaagtacatctatttctgcgatagttaacgtcggggggccccagctctaaccagggcgaggaccacggactgcatccctctctctcagcgcactggtctgtttactggagggtgagagggacgcgcagacctccggactcaggggttctgttctgtagatccccccaccccacccggggtctctggcactcgtatcacttagcaccagtgtgactggcggtgcattccggccccctcgcgccccattaaagcccctgcacatcctctcccacgctgcgcttctgctacccacgcagctgctcctctgagcgtcccgcgtgcacaaacgcgcccccggtccttacgcgtcggtggcgctgcctcgctgaggtggcgccgggggagcccgcagaggcggcgggggagggagtgcggaggagaggacccgtgagctgcggggacctgggcccgccgagcttttggggaagctgggctccgttccccccgggcgcctggggcgcgcgggaaggcgcggaggacgcgccgcactcacccgctgctgctgccggctgctgactgccaccgcggcggcggacgcggcgctgtgccggagctcggccgcctgcccaggtctcaacaggctccgggtgaacctgcgggtccgctcaccggccatcgccggtcacgccaatcgcgccgcgggcccggggcgcgcctcccgccggtcttccccgcgccaaccttctctatccacccgccgttcaggaagcggaactcggagccttcccccccctcttcctcgctcaactcgcaagaggcgggtttttctctcttgcacccccactcttcccacccccttccctcctctgaagcttctcgaagactttccaaactctgcgctcccccgggcgcgcgcggccaactcggctggcggccgggccctgcagcggcgcatctggagcgggcgtcgcgggacgcgtgtggggcggctcctgcccgcgccgcccacacgggctcagctggccggccggggctgtccacgccgcccgggggaactgcaggctgcgggggagggcggggggcggccgccgaggggctccgggcggggcctgtccaaggccgtcgcctgtccaaggccgtcagcctcatttggaggttgctgggagagttggagccctggatgcatttgccgtttagacttctat

SEQ ID NO: 118783 - DNA, 30 bp, Homo sapiens; identical to SEQ ID NO: 85951
  misc_feature 1..30: note = chr2:225975877-225975907
  misc_feature 1..30: note = Hypo
  source 1..30: mol_type = genomic DNA

SEQ ID NO: 118784 - DNA, 32 bp, Homo sapiens; identical to SEQ ID NO: 85952
  misc_feature 1..32: note = chr2:225987036-225987068
  misc_feature 1..32: note = Hypo
  source 1..32: mol_type = genomic DNA

SEQ ID NO: 118785 - DNA, 24 bp, Homo sapiens
  misc_feature 1..24: note = chr2:226298377-226298401
  misc_feature 1..24: note = Hypo
  source 1..24: mol_type = genomic DNA
aaaaaattagttgggcgtgatggc

SEQ ID NO: 118786 - DNA, 30 bp, Homo sapiens; identical to SEQ ID NO: 85954
  misc_feature 1..30: note = chr2:226845723-226845753
  misc_feature 1..30: note = Hypo
  source 1..30: mol_type = genomic DNA

SEQ ID NO: 118787 - DNA, 433 bp, Homo sapiens; identical to SEQ ID NO: 85955
  misc_feature 1..433: note = chr2:226895900-226896333
  misc_feature 1..433: note = Hyper
  source 1..433: mol_type = genomic DNA

SEQ ID NO: 118788 - DNA, 96 bp, Homo sapiens; identical to SEQ ID NO: 85956
  misc_feature 1..96: note = chr2:227663424-227663520
  misc_feature 1..96: note = Hyper
  source 1..96: mol_type = genomic DNA

SEQ ID NO: 118789 - DNA, 88 bp, Homo sapiens; identical to SEQ ID NO: 85957
  misc_feature 1..88: note = chr2:227820585-227820673
  misc_feature 1..88: note = Hypo
  source 1..88: mol_type = genomic DNA

SEQ ID NO: 118790 - DNA, 349 bp, Homo sapiens
  misc_feature 1..349: note = chr2:228029273-228029622
  misc_feature 1..349: note = Hyper
  source 1..349: mol_type = genomic DNA
ctgggtggggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaaggtgagtgggggctgcgcgacccccacccccgcacttccatccctcctccacgcgtccgggggacgcgctggccccacccgcagcggcgcggta

SEQ ID NO: 118791 - DNA, 30 bp, Homo sapiens; identical to SEQ ID NO: 85960
  misc_feature 1..30: note = chr2:228146693-228146723
  misc_feature 1..30: note = Hypo
  source 1..30: mol_type = genomic DNA

SEQ ID NO: 118792 - DNA, 30 bp, Homo sapiens; identical to SEQ ID NO: 85961
  misc_feature 1..30: note = chr2:228253378-228253408
  misc_feature 1..30: note = Hypo
  source 1..30: mol_type = genomic DNA

SEQ ID NO: 118793 - DNA, 27 bp, Homo sapiens
  misc_feature 1..27: note = chr2:228264615-228264642
  misc_feature 1..27: note = Hypo
  source 1..27: mol_type = genomic DNA
aaatagccaccgcgcctggcctataaa

SEQ ID NO: 118794 - DNA, 92 bp, Homo sapiens; identical to SEQ ID NO: 85963
  misc_feature 1..92: note = chr2:228466753-228466845
  misc_feature 1..92: note = Hypo
  source 1..92: mol_type = genomic DNA

SEQ ID NO: 118795 - DNA, 40 bp, Homo sapiens
  misc_feature 1..40: note = chr2:228582794-228582834
  misc_feature 1..40: note = Hyper
  source 1..40: mol_type = genomic DNA
cacgctttgcatatgcgaatccgggcgtccagacctttca

SEQ ID NO: 118796 - DNA, 32 bp, Homo sapiens; identical to SEQ ID NO: 85966
  misc_feature 1..32: note = chr2:228589295-228589327
  misc_feature 1..32: note = Hypo
  source 1..32: mol_type = genomic DNA

SEQ ID NO: 118797 - DNA, 49 bp, Homo sapiens; identical to SEQ ID NO: 85967
  misc_feature 1..49: note = chr2:228735796-228735845
  misc_feature 1..49: note = Hypo
  source 1..49: mol_type = genomic DNA

SEQ ID NO: 118798 - DNA, 429 bp, Homo sapiens
  misc_feature 1..429: note = chr2:228736154-228736583
  misc_feature 1..429: note = Hyper
  source 1..429: mol_type = genomic DNA
tagctcctctgaggtcgcccttagtgaggacacgaggtgccctcacctctttcactctagacacctccagaacactcgccccccgcgcgccggagccccgggtcgccaccaaccgcccgcggagccagacctcccagctctgcgccccaggaccgcgcggtgcaacctgcgcatgcgcacccgcgtcccgctgctgtttagccgtttccaaggctacgaagcccatcggccggggataagagagcaagaaaatgaagctcaagagcctcctgctccggtattacccgccaggtacgcaccagcccggccccgtcatccccacgtgggaccctgggctcccagactgggagggtttggggcggaggagggcgcagccactgaaaggcggcggggtccccaggtggggcaggaagtcgggcacttcccaac

SEQ ID NO: 118799 - DNA, 35 bp, Homo sapiens; identical to SEQ ID NO: 85970
  misc_feature 1..35: note = chr2:228882048-228882083
  misc_feature 1..35: note = Hypo
  source 1..35: mol_type = genomic DNA

SEQ ID NO: 118800 - DNA, 215 bp, Homo sapiens; identical to SEQ ID NO: 39759
  misc_feature 1..215: note = chr2:228888319-228888534
  misc_feature 1..215: note = Hypo
  source 1..215: mol_type = genomic DNA

SEQ ID NO: 118801 - DNA, 64 bp, Homo sapiens; identical to SEQ ID NO: 85972
  misc_feature 1..64: note = chr2:229044914-229044978
  misc_feature 1..64: note = Hyper
  source 1..64: mol_type = genomic DNA

SEQ ID NO: 118802 - DNA, 30 bp, Homo sapiens; identical to SEQ ID NO: 85973
  misc_feature 1..30: note = chr2:229045852-229045882
  misc_feature 1..30: note = Hyper
  source 1..30: mol_type = genomic DNA

SEQ ID NO: 118803 - DNA, 671 bp, Homo sapiens
  misc_feature 1..671: note = chr2:229046107-229046778
  misc_feature 1..671: note = Hyper
  source 1..671: mol_type = genomic DNA
cccctgtagctccagcgaggctgggccggacttatttacaagtgcagtgacccctgtctcctcgctgggagccccgtgcaaaccgaagcgctctggggcaagttggtgagcgactcacaacgcggaacggagtttgatcgacatggtattgggcatagaaagaagcgggtcttaccttggtaccgagagcagggagttgccatccattgttggtgggcgcccagagaagaaagacggaaagtgcaggcgaaggataagtctgtggtgctaggacccagctcccagagtgccagactggcgcgcgccaggagagaggcgcgcaggctggggcggcggcggcgcccacggagactagctcctccctggccagcaagctctgtgcgctgcgaccgcccgctgtcccctcccgccgtcctctctgatcttgcaggagcgcgtggccaacgctcccacctttctgcctggctcctgcctcctgcaggcgggccccagtctcagttgctcgaggatcctgctctatcgctcattcgtgcccagaagcataggtgactccgacaaaattcctctctccccaaccaccatcgtctcccctccctttctcgctggcgtacagtaggtctgagccctgaagttgttcacgcactttcccacattcacgccctcactcctgg

SEQ ID NO: 118804 - DNA, 157 bp, Homo sapiens; identical to SEQ ID NO: 85975
  misc_feature 1..157: note = chr2:230135693-230135850
  misc_feature 1..157: note = Hyper
  source 1..157: mol_type = genomic DNA

SEQ ID NO: 118805 - DNA, 25 bp, Homo sapiens
  misc_feature 1..25: note = chr2:230174052-230174077
  misc_feature 1..25: note = Hypo
  source 1..25: mol_type = genomic DNA
ccatcgcgcccggccaggaaactgg

SEQ ID NO: 118806 - DNA, 1131 bp, Homo sapiens; identical to SEQ ID NO: 85977
  misc_feature 1..1131: note = chr2:230578047-230579178
  misc_feature 1..1131: note = Hyper
  source 1..1131: mol_type = genomic DNA

SEQ ID NO: 118807 - DNA, 256 bp, Homo sapiens; identical to SEQ ID NO: 85978
  misc_feature 1..256: note = chr2:230579495-230579751
  misc_feature 1..256: note = Hyper
  source 1..256: mol_type = genomic DNA

SEQ ID NO: 118808 - DNA, 117 bp, Homo sapiens; identical to SEQ ID NO: 85979
  misc_feature 1..117: note = chr2:230600571-230600688
  misc_feature 1..117: note = Hypo
  source 1..117: mol_type = genomic DNA

SEQ ID NO: 118809 - DNA, 73 bp, Homo sapiens; identical to SEQ ID NO: 85980
  misc_feature 1..73: note = chr2:230785500-230785573
  misc_feature 1..73: note = Hyper
  source 1..73: mol_type = genomic DNA

SEQ ID NO: 118810 - DNA, 100 bp, Homo sapiens; identical to SEQ ID NO: 39760
  misc_feature 1..100: note = chr2:230795535-230795635
  misc_feature 1..100: note = Hypo
  source 1..100: mol_type = genomic DNA

SEQ ID NO: 118811 - DNA, 217 bp, Homo sapiens; identical to SEQ ID NO: 85982
  misc_feature 1..217: note = chr2:230932847-230933064
  misc_feature 1..217: note = Hyper
  source 1..217: mol_type = genomic DNA

SEQ ID NO: 118812 - DNA, 65 bp, Homo sapiens; identical to SEQ ID NO: 85983
  misc_feature 1..65: note = chr2:231170246-231170311
  misc_feature 1..65: note = Hypo
  source 1..65: mol_type = genomic DNA

SEQ ID NO: 118813 - DNA, 40 bp, Homo sapiens; identical to SEQ ID NO: 85984
  misc_feature 1..40: note = chr2:231170527-231170567
  misc_feature 1..40: note = Hypo
  source 1..40: mol_type = genomic DNA

SEQ ID NO: 118814 - DNA, 33 bp, Homo sapiens; identical to SEQ ID NO: 85985
  misc_feature 1..33: note = chr2:231188088-231188121
  misc_feature 1..33: note = Hypo
  source 1..33: mol_type = genomic DNA

SEQ ID NO: 118815 - DNA, 34 bp, Homo sapiens; identical to SEQ ID NO: 27934
  misc_feature 1..34: note = chr2:231191860-231191894
  misc_feature 1..34: note = Hyper
  source 1..34: mol_type = genomic DNA

SEQ ID NO: 118816 - DNA, 30 bp, Homo sapiens; identical to SEQ ID NO: 85987
  misc_feature 1..30: note = chr2:231268620-231268650
  misc_feature 1..30: note = Hypo
  source 1..30: mol_type = genomic DNA

SEQ ID NO: 118817 - DNA, 30 bp, Homo sapiens; identical to SEQ ID NO: 85988
  misc_feature 1..30: note = chr2:231276161-231276191
  misc_feature 1..30: note = Hyper
  source 1..30: mol_type = genomic DNA

SEQ ID NO: 118818 - DNA, 67 bp, Homo sapiens
  misc_feature 1..67: note = chr2:231281248-231281315
  misc_feature 1..67: note = Hyper
  source 1..67: mol_type = genomic DNA
acttgccataacacacgtgactttcttgttttggatttactgctcagctgaccgggacactctaaac

SEQ ID NO: 118819 - DNA, 188 bp, Homo sapiens; identical to SEQ ID NO: 85989
  misc_feature 1..188: note = chr2:231620583-231620771
  misc_feature 1..188: note = Hypo
  source 1..188: mol_type = genomic DNA

SEQ ID NO: 118820 - DNA, 391 bp, Homo sapiens
  misc_feature 1..391: note = chr2:231693118-231693509
  misc_feature 1..391: note = Hyper
  source 1..391: mol_type = genomic DNA
cccgcggcctgtccacgcgtccggcacccggagctagggcgtggccaggtcggaagccggcttagcgcgcctttcacccctggccccacccagggctcagcccagcgccgcggcgggcccgggctcccaggtctgcggctttcactgggccgcgtccctgcagagggccccggcgactggggaggaggccgccctttccttccggcccgcgaccgccccgggctgtccctacccaagggagactcccagcggcccggagcctcagactctccgggagccaggcggcggcgccccagggctggggccttggagcctgggaaagcaaccgggggtctctggggagtcctgagcgcaggcgcccgcccacggccaagaccgtggcccagccctc

SEQ ID NO: 118821 - DNA, 132 bp, Homo sapiens; identical to SEQ ID NO: 85991
  misc_feature 1..132: note = chr2:231714877-231715009
  misc_feature 1..132: note = Hyper
  source 1..132: mol_type = genomic DNA

SEQ ID NO: 118822 - DNA, 179 bp, Homo sapiens; identical to SEQ ID NO: 85992
  misc_feature 1..179: note = chr2:231902993-231903172
  misc_feature 1..179: note = Hyper
  source 1..179: mol_type = genomic DNA

SEQ ID NO: 118823 - DNA, 105 bp, Homo sapiens; identical to SEQ ID NO: 85993
  misc_feature 1..105: note = chr2:232243072-232243177
  misc_feature 1..105: note = Hypo
  source 1..105: mol_type = genomic DNA

SEQ ID NO: 118824 - DNA, 279 bp, Homo sapiens; identical to SEQ ID NO: 85994
  misc_feature 1..279: note = chr2:232276822-232277101
  misc_feature 1..279: note = Hyper
  source 1..279: mol_type = genomic DNA

SEQ ID NO: 118825 - DNA, 76 bp, Homo sapiens; identical to SEQ ID NO: 85995
  misc_feature 1..76: note = chr2:232283697-232283773
  misc_feature 1..76: note = Hypo
  source 1..76: mol_type = genomic DNA

SEQ ID NO: 118826 - DNA, 18 bp, Homo sapiens
  misc_feature 1..18: note = chr2:232330287-232330305
  misc_feature 1..18: note = Hypo
  source 1..18: mol_type = genomic DNA
aaaatcacctcaggccgg

SEQ ID NO: 118827 - DNA, 30 bp, Homo sapiens; identical to SEQ ID NO: 85997
  misc_feature 1..30: note = chr2:232379667-232379697
  misc_feature 1..30: note = Hyper
  source 1..30: mol_type = genomic DNA

SEQ ID NO: 118828 - DNA, 562 bp, Homo sapiens
  misc_feature 1..562: note = chr2:232394918-232395480
  misc_feature 1..562: note = Hyper
  source 1..562: mol_type = genomic DNA
tgacccgagaagttgcgaggctccccggtggcggggacggggggcaccccgacggagccctcggacccttcccgccctaggacgaccctgcccgcaccgagccccggcccagctgccgcgccctagcccacgccggcgcctgcgcacctaccatgcggcccgcggcccgcgagaccccggcttccaccctccgagcgacggacacagacgcggcgcgggagccagtggactgactgacagcggccccagcccgcgccccgacgccccgcctgtccggccgggaacgccgccagggggcagtgcagtccccgcagcccgggcggcgccccctcccgcactggcggaggacgcggccgttggaggcgacacctccacaagcagcgtggaggcgacacctccacaagcagcgttatctgacggaaccctcacaacaacccgttttacagatgagaaaactgagcctcagagagccgcagaggaggagcccgagagacctggggctcacatgtgattcccgccctccagcgtgctgagtttagcttaacgccgtcacggtgtccct

SEQ ID NO: 118829 - DNA, 169 bp, Homo sapiens; identical to SEQ ID NO: 86000
  misc_feature 1..169: note = chr2:232479285-232479454
  misc_feature 1..169: note = Hyper
  source 1..169: mol_type = genomic DNA

SEQ ID NO: 118830 - DNA, 68 bp, Homo sapiens; identical to SEQ ID NO: 86001
  misc_feature 1..68: note = chr2:232485651-232485719
  misc_feature 1..68: note = Hypo
  source 1..68: mol_type = genomic DNA

SEQ ID NO: 118831 - DNA, 79 bp, Homo sapiens; identical to SEQ ID NO: 86002
  misc_feature 1..79: note = chr2:232506690-232506769
  misc_feature 1..79: note = Hypo
  source 1..79: mol_type = genomic DNA

SEQ ID NO: 118832 - DNA, 18 bp, Homo sapiens
  misc_feature 1..18: note = chr2:232526119-232526137
  misc_feature 1..18: note = Hypo
  source 1..18: mol_type = genomic DNA
aaaatttctactggccgg

SEQ ID NO: 118833 - DNA, 579 bp, Homo sapiens; identical to SEQ ID NO: 86004
  misc_feature 1..579: note = chr2:232526660-232527239
  misc_feature 1..579: note = Hyper
  source 1..579: mol_type = genomic DNA

SEQ ID NO: 118834 - DNA, 63 bp, Homo sapiens; identical to SEQ ID NO: 86005
  misc_feature 1..63: note = chr2:232527687-232527750
  misc_feature 1..63: note = Hypo
  source 1..63: mol_type = genomic DNA

SEQ ID NO: 118835 - DNA, 57 bp, Homo sapiens; identical to SEQ ID NO: 86006
  misc_feature 1..57: note = chr2:232541188-232541245
  misc_feature 1..57: note = Hypo
  source 1..57: mol_type = genomic DNA

SEQ ID NO: 118836 - DNA, 29 bp, Homo sapiens
  misc_feature 1..29: note = chr2:232544635-232544664
  misc_feature 1..29: note = Hypo
  source 1..29: mol_type = genomic DNA
tgagccactgcgcccggcctaaagccctc

SEQ ID NO: 118837 - DNA, 27 bp, Homo sapiens
  misc_feature 1..27: note = chr2:232546676-232546703
  misc_feature 1..27: note = Hypo
  source 1..27: mol_type = genomic DNA
attaaaagagctggccgggcgcggtga

SEQ ID NO: 118838 - DNA, 28 bp, Homo sapiens
  misc_feature 1..28: note = chr2:232570350-232570378
  misc_feature 1..28: note = Hypo
  source 1..28: mol_type = genomic DNA
cctgcatgggaataacgtcagaaaacag

SEQ ID NO: 118839 - DNA, 131 bp, Homo sapiens; identical to SEQ ID NO: 86010
  misc_feature 1..131: note = chr2:232790653-232790784
  misc_feature 1..131: note = Hyper
  source 1..131: mol_type = genomic DNA

SEQ ID NO: 118840 - DNA, 93 bp, Homo sapiens; identical to SEQ ID NO: 86011
  misc_feature 1..93: note = chr2:232791047-232791140
  misc_feature 1..93: note = Hyper
  source 1..93: mol_type = genomic DNA

SEQ ID NO: 118841 - DNA, 576 bp, Homo sapiens; identical to SEQ ID NO: 86012
  misc_feature 1..576: note = chr2:232791530-232792106
  misc_feature 1..576: note = Hyper
  source 1..576: mol_type = genomic DNA

SEQ ID NO: 118842 - DNA, 33 bp, Homo sapiens; identical to SEQ ID NO: 86013
  misc_feature 1..33: note = chr2:232827152-232827185
  misc_feature 1..33: note = Hypo
  source 1..33: mol_type = genomic DNA

SEQ ID NO: 118843 - DNA, 196 bp, Homo sapiens; identical to SEQ ID NO: 86014
  misc_feature 1..196: note = chr2:233165754-233165950
  misc_feature 1..196: note = Hypo
  source 1..196: mol_type = genomic DNA

SEQ ID NO: 118844 - DNA, 30 bp, Homo sapiens; identical to SEQ ID NO: 86015
  misc_feature 1..30: note = chr2:233198553-233198583
  misc_feature 1..30: note = Hypo
  source 1..30: mol_type = genomic DNA

SEQ ID NO: 118845 - DNA, 648 bp, Homo sapiens; identical to SEQ ID NO: 86016
  misc_feature 1..648: note = chr2:233283249-233283897
  misc_feature 1..648: note = Hyper
  source 1..648: mol_type = genomic DNA

SEQ ID NO: 118846 - DNA, 79 bp, Homo sapiens; identical to SEQ ID NO: 86017
  misc_feature 1..79: note = chr2:233285052-233285131
  misc_feature 1..79: note = Hyper
  source 1..79: mol_type = genomic DNA

SEQ ID NO: 118847 - DNA, 242 bp, Homo sapiens; identical to SEQ ID NO: 86018
  misc_feature 1..242: note = chr2:233285766-233286008
  misc_feature 1..242: note = Hyper
  source 1..242: mol_type = genomic DNA

SEQ ID NO: 118848 - DNA, 30 bp, Homo sapiens; identical to SEQ ID NO: 86019
  misc_feature 1..30: note = chr2:233302001-233302031
  misc_feature 1..30: note = Hypo
  source 1..30: mol_type = genomic DNA

SEQ ID NO: 118849 - DNA, 102 bp, Homo sapiens; identical to SEQ ID NO: 86020
  misc_feature 1..102: note = chr2:233322912-233323014
  misc_feature 1..102: note = Hypo
  source 1..102: mol_type = genomic DNA

SEQ ID NO: 118850 - DNA, 2742 bp, Homo sapiens
  misc_feature 1..2742: note = chr2:233350208-233352950
  misc_feature 1..2742: note = Hyper
  source 1..2742: mol_type = genomic DNA
tctgtccggggcattcgtaggtcccccactgacagttgggacccctagctttggggccagctccagacctcgcggagacgtcaacccagcccgccggcgcgcctctccctcctggccctcactgcctgccagagggctgggaaattgcggctcccgcggctcctctaaacaccgcaattaccccagggaaattacttgcgccctcctcccgcgctctgcctctgtgcgctcccctcccctcccctctcctgctcgtctcttccctcctctcctctcacgcacccgcctcccgcgcgcagggacccctgggcaaggccactgcgccccggatccgcggccgctggcagggcgctcagggggcgcactcacgcggatgacgtagcgcgaggagttcctgtcgtccaggctgaccgtgagcgagaagagcgcggcggcgctgtacacgccctgcgccttgtacagcagccggttgaggtcccatcgcgccgcgacccccggacgctcctccgcgccgcccaggtcccagcccccgcagtcctcgatgacctctagcatgggtcgcgggcccagtcgctcgatctcgcgcatgtcgaggcacgagcggaagaaggcgcgcaccttgcgctgggccgcgccgccaggcccacccccgggccgcgccagcaggcgccgtaggcgctcctcgttttgctcgccgatggccgcgatggtgccataggtgagcttgtcgtcggggatggcgtggcgccgcagccaaccgccgcaggcgaacgagtagaagtcctggcatgggtcgatgctggcgtccaggttggcggccaggaagcgagcggcgcgcgcgaaggccttgcgctcagggcagccctcgggacaggcgccgccgccggccgcgaccgggcccaggtacttgagggccagcatagccgccagaatggcgcagaggccggcggcgaacaccagccccgacagcaggcacacctcgcgccggttccagcgcggcagcccggaccgggccccggtggcgctgcgcgcagcgcccaacgggaagcccgggggcagggaggccccgcgcgcgccccccgcgccgcagcggctcacgtacttgacctcttggaactcatcgtagtgcgccgtcagcgaatacgggggctccatggcgccgaggccgccgcggtgcagacctgggccacctgggctacgggatgcgcgtggccgccggcctcctcgtgggcctccgcatggccctggggccgcagctgcgggaagggcggaagcaggctcaggaggcgccgcagccggatggggctcagggtcaccgcgaggagggacacaggcctgggtgcagaggccccagccgcgggcctcattcactgcggaaaccagggactatgagggttcggcggggccaccacccccgggtgcacagtggagtcttcccccctgtcccctccctgcacacacttgagggccgcagggttgggagggctcttattggaagcaagaggcgccaggcaaggggcctggcacgtagtgggccttcattgaaaggtcgtccctcttccccttcgcctttctcttccacgacctgccccagccaaggccgggtggagtgggggaagaagcggaggctggagtgaggaggtgcggtcaggggcgcgtctatgcgacactttcagctctccgcgctggacccagacagacgctccgcaaagcggccaaagaaccaaactttgtcctcgcggaagtccgcgggatcgaccacgccaaccccgctccctggctccttctgctcggtggcccgacggcccactcgccccttccctaggggcgcgcgccaacgccccagggtggcggacacacaacccacccactggacggccctgatggagaacccgagacgggttccctccccccactcccaccatctctgtccccgccccgagccactcctggcttcaacaggttctccccagaacccaaacttgggcgaagtttcacccccggcggggagcgagctggctggcgacccccgagccccggcgccgtgcggcgcagtccgcggagcccgagagccgagcccgggagccgcagccgcagccgcagccggagccgcagccgagaggacgcagacaaagccgggaggctccgcgcagtggcggcggcggcgacggaagtggccgcggtggtggcctcagcggcagggactcgggcgccacttacccggcaggtgcgcgcccgagccggcggtgaccgagcgggtcgggcccgagcgggggcctgagccgcagcgcagccgagcgggcgtccggtgtctcccagcgcccgccgcctcctctgccgccgcgccgagcccgccgcgccgcccgcctgccggcccgagggagggggcgcgccggcggctccaccctcctccgcccgccccgcgcgcccctccttcctcctgcatctctcgggccacctggcagtggggcggcagcgcggacgtgggtcggcggccgcggagacaggctcccgggggtcgtgcgcgggctgcggtcggggactccgggtccagccgcgttccgagacgagtgagggcagcgagtactcccgtgaagggtcccctccgatccagtgtccccactcccagccgcccaccagccggctggaaaggggctggagctggagatgaggagccgaggactcctccgaagggctgggggcggtgtcagtagtgcctgtgtctgccggcacagtccctgg

SEQ ID NO: 118851 - DNA, 562 bp, Homo sapiens
  misc_feature 1..562: note = chr2:233367784-233368346
  misc_feature 1..562: note = Hyper
  source 1..562: mol_type = genomic DNA
caaacacgcactctgcggaaggccggggcgggcctggccgctgcgggactcctggcccggcgcccttgacgtcagcggctgggccgtgacgtcacctcaccgcccccgccgcgctcccgcccccgcccgcgggcactcagtctccgctaatggcaggcgacggggaatggcacatctgtcttgccgggaattagttcattgaatcaggcggcccgagctgcggcagcgaccttagccctggccccagggaggggtctgggcgggcggcgtgggggaggttcaggctggagggctgagtgcggggacgggaggaggggactcacctggactcgcgagggggactgagcgctctccaaatataggtcaatgtcccgctcagcctccctcccccagcaccgtgaggaccgaggcctggggcctggcgcccgcctggtggacctcgggggcaggctggggaccgggcccctgcgggacgcggcgcggcaggacgctccccgcgcctttctttctgcacctgcccctcggggtgggtccccctctttaccctcgcttccccccgcgg

SEQ ID NO: 118852 - DNA, 776 bp, Homo sapiens; identical to SEQ ID NO: 86029
  misc_feature 1..776: note = chr2:233388398-233389174
  misc_feature 1..776: note = Hyper
  source 1..776: mol_type = genomic DNA

SEQ ID NO: 118853 - DNA, 94 bp, Homo sapiens; identical to SEQ ID NO: 86030
  misc_feature 1..94: note = chr2:233405327-233405421
  misc_feature 1..94: note = Hypo
  source 1..94: mol_type = genomic DNA

SEQ ID NO: 118854 - DNA, 162 bp, Homo sapiens; identical to SEQ ID NO: 86031
  misc_feature 1..162: note = chr2:233474440-233474602
  misc_feature 1..162: note = Hypo
  source 1..162: mol_type = genomic DNA

SEQ ID NO: 118855 - DNA, 62 bp, Homo sapiens; identical to SEQ ID NO: 86032
  misc_feature 1..62: note = chr2:233497779-233497841
  misc_feature 1..62: note = Hyper
  source 1..62: mol_type = genomic DNA

SEQ ID NO: 118856 - DNA, 1091 bp, Homo sapiens
  misc_feature 1..1091: note = chr2:233498221-233499312
  misc_feature 1..1091: note = Hyper
  source 1..1091: mol_type = genomic DNA
gcgcctccttaaagccgcagctccgccccgaccgccccgcccgccagtccgtcctcagaccctcccaaccgccgggtccccgccgcctcggcggagtgttgtagagcctcgagcctgcgaggagcgcgccgcccgccagctccctgcgtcccgtcccgcgtccccgcgttcccgcgtcctgcgatccgccgccatggccagtgaggagctggcgtgcaagctggagcgccggctgcggcgcgaggaggccgaggagagtggcccccagctggctcccctcggcgccccagccccggagcccaagcccgagcccgagcctcccgcccgtgcgcccacggccagcgccgacgcggagctgagcgcccagctgagccggcggctggacatcaacgagggcgctgcgcggccccggcgctgcagggtcttcaacccctacacggagttcccggagttcagccgccgcctcatcaaggacctggagagcatgttcaaactgtgagctcccgctgcgcgcccttcgcccccgggaccagggagggagcgggagggctttctggtccgaagtcccgggccctgtttgtgtggggaggggtcccggggtgcaggtagcatttggcccaacgcagccagatcttgcgtgctcgggtctatctcggcgcggtgggggacggggccgaagaggggggacaccaggagcaggagctctccgggacggagcccaaaagttctcggcggctgccgggcccgagttccaggtcccccaaccccgaccactggtcccgccccctccgcccgccagtccggagatttgctccgaaagcaacttctaggaaagggagccgtcgccgcgcctcacctgccagctttcactgtatccccccaagggaaaaattagcccctgttggccttttatcttttaaaacaaaaggggaaagttaatccttggctgcagcgcggggtctgatgaatgagcggaggccgagaacggggagtttggtaaagtcgttgtaagagattcaggactttcctggagcaggcgcggcccgggagcctcctgggggcgcggggagggggggcggttgtgggaaccg

SEQ ID NO: 118857 - DNA, 30 bp, Homo sapiens; identical to SEQ ID NO: 86036
  misc_feature 1..30: note = chr2:233735535-233735565
  misc_feature 1..30: note = Hypo
  source 1..30: mol_type = genomic DNA

SEQ ID NO: 118858 - DNA, 810 bp, Homo sapiens; identical to SEQ ID NO: 86037
  misc_feature 1..810: note = chr2:233740776-233741586
  misc_feature 1..810: note = Hyper
  source 1..810: mol_type = genomic DNA

SEQ ID NO: 118859 - DNA, 50 bp, Homo sapiens; identical to SEQ ID NO: 39772
  misc_feature 1..50: note = chr2:233750505-233750555
  misc_feature 1..50: note = Hypo
  source 1..50: mol_type = genomic DNA

SEQ ID NO: 118860 - DNA, 67 bp, Homo sapiens
  misc_feature 1..67: note = chr2:233793411-233793478
  misc_feature 1..67: note = Hyper
  source 1..67: mol_type = genomic DNA
ccgggcgagtctggtcgcaggacgagccacgctcagctacgcacgaccctggcgggtctgggatggg

SEQ ID NO: 118861 - DNA, 105 bp, Homo sapiens; identical to SEQ ID NO: 86039
  misc_feature 1..105: note = chr2:233846572-233846677
  misc_feature 1..105: note = Hypo
  source 1..105: mol_type = genomic DNA

SEQ ID NO: 118862 - DNA, 30 bp, Homo sapiens; identical to SEQ ID NO: 14487
  misc_feature 1..30: note = chr2:233960620-233960650
  misc_feature 1..30: note = Hypo
  source 1..30: mol_type = genomic DNA

SEQ ID NO: 118863 - DNA, 30 bp, Homo sapiens; identical to SEQ ID NO: 86041
  misc_feature 1..30: note = chr2:233969832-233969862
  misc_feature 1..30: note = Hypo
  source 1..30: mol_type = genomic DNA

SEQ ID NO: 118864 - DNA, 36 bp, Homo sapiens; identical to SEQ ID NO: 86042
  misc_feature 1..36: note = chr2:233970346-233970382
  misc_feature 1..36: note = Hypo
  source 1..36: mol_type = genomic DNA

SEQ ID NO: 118865 - DNA, 227 bp, Homo sapiens; identical to SEQ ID NO: 86043
  misc_feature 1..227: note = chr2:233986775-233987002
  misc_feature 1..227: note = Hypo
  source 1..227: mol_type = genomic DNA

SEQ ID NO: 118866 - DNA, 180 bp, Homo sapiens; identical to SEQ ID NO: 86044
  misc_feature 1..180: note = chr2:233990977-233991157
  misc_feature 1..180: note = Hypo
  source 1..180: mol_type = genomic DNA

SEQ ID NO: 118867 - DNA, 189 bp, Homo sapiens; identical to SEQ ID NO: 86045
  misc_feature 1..189: note = chr2:233997086-233997275
  misc_feature 1..189: note = Hypo
  source 1..189: mol_type = genomic DNA

SEQ ID NO: 118868 - DNA, 30 bp, Homo sapiens; identical to SEQ ID NO: 86046
  misc_feature 1..30: note = chr2:234059490-234059520
  misc_feature 1..30: note = Hypo
  source 1..30: mol_type = genomic DNA

SEQ ID NO: 118869 - DNA, 60 bp, Homo sapiens; identical to SEQ ID NO: 86047
  misc_feature 1..60: note = chr2:234077773-234077833
  misc_feature 1..60: note = Hypo
  source 1..60: mol_type = genomic DNA

SEQ ID NO: 118870 - DNA, 87 bp, Homo sapiens; identical to SEQ ID NO: 86048
  misc_feature 1..87: note = chr2:234079049-234079136
  misc_feature 1..87: note = Hypo
  source 1..87: mol_type = genomic DNA

SEQ ID NO: 118871 - DNA, 210 bp, Homo sapiens; identical to SEQ ID NO: 86049
  misc_feature 1..210: note = chr2:234079595-234079805
  misc_feature 1..210: note = Hypo
  source 1..210: mol_type = genomic DNA

SEQ ID NO: 118872 - DNA, 30 bp, Homo sapiens; identical to SEQ ID NO: 86050
  misc_feature 1..30: note = chr2:234090326-234090356
  misc_feature 1..30: note = Hypo
  source 1..30: mol_type = genomic DNA

SEQ ID NO: 118873 - DNA, 176 bp, Homo sapiens; identical to SEQ ID NO: 39778
  misc_feature 1..176: note = chr2:234109964-234110140
  misc_feature 1..176: note = Hypo
  source 1..176: mol_type = genomic DNA

SEQ ID NO: 118874 - DNA, 30 bp, Homo sapiens; identical to SEQ ID NO: 86052
  misc_feature 1..30: note = chr2:234199097-234199127
  misc_feature 1..30: note = Hypo
  source 1..30: mol_type = genomic DNA

SEQ ID NO: 118875 - DNA, 30 bp, Homo sapiens; identical to SEQ ID NO: 39779
  misc_feature 1..30: note = chr2:234330364-234330394
  misc_feature 1..30: note = Hypo
  source 1..30: mol_type = genomic DNA

SEQ ID NO: 118876 - DNA, 244 bp, Homo sapiens; identical to SEQ ID NO: 86054
  misc_feature 1..244: note = chr2:234331271-234331515
  misc_feature 1..244: note = Hypo
  source 1..244: mol_type = genomic DNA

SEQ ID NO: 118877 - DNA, 510 bp, Homo sapiens; identical to SEQ ID NO: 86055
  misc_feature 1..510: note = chr2:234369602-234370112
  misc_feature 1..510: note = Hypo
  source 1..510: mol_type = genomic DNA

SEQ ID NO: 118878 - DNA, 30 bp, Homo sapiens; identical to SEQ ID NO: 86056
  misc_feature 1..30: note = chr2:234373355-234373385
  misc_feature 1..30: note = Hypo
  source 1..30: mol_type = genomic DNA

SEQ ID NO: 118879 - DNA, 324 bp, Homo sapiens
  misc_feature 1..324: note = chr2:234475179-234475503
  misc_feature 1..324: note = Hyper
  source 1..324: mol_type = genomic DNA
ccgaaaccactgccccgactccaggagagcgccgcgtcctcaggcaggcctgggcagcctctcgcctcgccctcctcagactgggccaccaacactgtccctacgcttcccacgtccctcccaggatccccgggcgccagccgcacttactgcctaaagcccagacccccgccctggccaaaacgcgaagcgaacgaacccgccccaactgggcgccgccatgttggcgagggcgggtctccagaaagtgatttatggatcgtggactatgcttcccaggatgccccgctggagcgccggcccctcgcacggggccttatggga

SEQ ID NO: 118880 - DNA, 78 bp, Homo sapiens; identical to SEQ ID NO: 86060
  misc_feature 1..78: note = chr2:234737331-234737409
  misc_feature 1..78: note = Hypo
  source 1..78: mol_type = genomic DNA

SEQ ID NO: 118881 - DNA, 35 bp, Homo sapiens; identical to SEQ ID NO: 86061
  misc_feature 1..35: note = chr2:234776737-234776772
  misc_feature 1..35: note = Hypo
  source 1..35: mol_type = genomic DNA

SEQ ID NO: 118882 - DNA, 30 bp, Homo sapiens; identical to SEQ ID NO: 39782
  misc_feature 1..30: note = chr2:235382081-235382111
  misc_feature 1..30: note = Hypo
  source 1..30: mol_type = genomic DNA

SEQ ID NO: 118883 - DNA, 695 bp, Homo sapiens
  misc_feature 1..695: note = chr2:235404276-235404971
  misc_feature 1..695: note = Hyper
  source 1..695: mol_type = genomic DNA
tcgcttttgtctttccgacaactgagccttccacctggggctgggagggcggacagcaggaccggctcttccactccccaccgcggccccccgacctggtcagtagctctggcgttcagacaaaaggtcccctgagctgggggtggggggcaggtcgagagtaggccggtaaatcagacttcgcagctccttaagtcaccagtcctgcatttgggtgcagagattccgttttaaaaattcgaagcatcgctttggttcgctctttgttcgcgggcgcgggttctcgctcatccatccatccatccatccaaccatccatccatccattcattctttcttgacgcactcgctcgctccccggtcgctccgggcgcattaccgcttcttcttctgcttgagggacttcctgcgtttcaggatcatctcatagagcttgtccatgccctcggtgaggccctcgccgatgatggcgcacgccggctggacgtgataggtggtggccgggataagctcgtgcagcgccagctgcttctcaatctctgccaccggcagcgacttgggcaggtcctgcttgttggcgatgaccagcagcggcgtgccctggttctcggcgaacttggtcaccttgtgcagctccgtcttggcctcctccagccggtccacgtccaccgagtccaccacgtagatgatgccgt

SEQ ID NO: 118884 - DNA, 181 bp, Homo sapiens; identical to SEQ ID NO: 86068
  misc_feature 1..181: note = chr2:235859973-235860154
  misc_feature 1..181: note = Hyper
  source 1..181: mol_type = genomic DNA

SEQ ID NO: 118885 - DNA, 59 bp, Homo sapiens; identical to SEQ ID NO: 86069
  misc_feature 1..59: note = chr2:235860892-235860951
  misc_feature 1..59: note = Hyper
  source 1..59: mol_type = genomic DNA

SEQ ID NO: 118886 - DNA, 90 bp, Homo sapiens; identical to SEQ ID NO: 86072
  misc_feature 1..90: note = chr2:236256461-236256551
  misc_feature 1..90: note = Hypo
  source 1..90: mol_type = genomic DNA

SEQ ID NO: 118887 - DNA, 436 bp, Homo sapiens; identical to SEQ ID NO: 86073
  misc_feature 1..436: note = chr2:236401968-236402404
  misc_feature 1..436: note = Hyper
  source 1..436: mol_type = genomic DNA

SEQ ID NO: 118888 - DNA, 100 bp, Homo sapiens; identical to SEQ ID NO: 86074
  misc_feature 1..100: note = chr2:236402701-236402801
  misc_feature 1..100: note = Hyper
  source 1..100: mol_type = genomic DNA

SEQ ID NO: 118889 - DNA, 175 bp, Homo sapiens; identical to SEQ ID NO: 86075
  misc_feature 1..175: note = chr2:236403151-236403326
  misc_feature 1..175: note = Hyper
  source 1..175: mol_type = genomic DNA

SEQ ID NO: 118890 - DNA, 87 bp, Homo sapiens; identical to SEQ ID NO: 86076
  misc_feature 1..87: note = chr2:236403854-236403941
  misc_feature 1..87: note = Hyper
  source 1..87: mol_type = genomic DNA

SEQ ID NO: 118891 - DNA, 181 bp, Homo sapiens; identical to SEQ ID NO: 86078
  misc_feature 1..181: note = chr2:236417611-236417792
  misc_feature 1..181: note = Hypo
  source 1..181: mol_type = genomic DNA

SEQ ID NO: 118892 - DNA, 193 bp, Homo sapiens; identical to SEQ ID NO: 86079
  misc_feature 1..193: note = chr2:236452425-236452618
  misc_feature 1..193: note = Hypo
  source 1..193: mol_type = genomic DNA

SEQ ID NO: 118893 - DNA, 125 bp, Homo sapiens; identical to SEQ ID NO: 86080
  misc_feature 1..125: note = chr2:236577930-236578055
  misc_feature 1..125: note = Hyper
  source 1..125: mol_type = genomic DNA

SEQ ID NO: 118894 - DNA, 221 bp, Homo sapiens; identical to SEQ ID NO: 86081
  misc_feature 1..221: note = chr2:236579027-236579248
  misc_feature 1..221: note = Hyper
  source 1..221: mol_type = genomic DNA

SEQ ID NO: 118895 - DNA, 126 bp, Homo sapiens
  misc_feature 1..126: note = chr2:236579583-236579709
  misc_feature 1..126: note = Hyper
  source 1..126: mol_type = genomic DNA
ggcgggccctcgccacggagcggagcctcgcggccacgcggctacttcagcctgcggcgggccccggccgaagcgcactcgtccagcgccgagagcatcgacggctccccgcgcagaggtgggcag

SEQ ID NO: 118896 - DNA, 42 bp, Homo sapiens; identical to SEQ ID NO: 86082
  misc_feature 1..42: note = chr2:236877226-236877268
  misc_feature 1..42: note = Hypo
  source 1..42: mol_type = genomic DNA

SEQ ID NO: 118897 - DNA, 297 bp, Homo sapiens
  misc_feature 1..297: note = chr2:237068390-237068687
  misc_feature 1..297: note = Hyper
  source 1..297: mol_type = genomic DNA
ttgggggtgggtgcccggagtgacgtccgcccccccaccccgggcccggccctgcctcaggcttttgcctcgggcccaggccgctctcgagccgtgggcgcgccctcggggctcggcccccggtttcggtctcaggcccccgggagtatcaggagaacaaggtcgcccgagatgggccgccgcgccccccgacggcctccctgcctccctgagtgtccgagccgccaggctggtagcgcagccgggcctcctgcctctctccctcgaggcccacggggtgcacggcttcctgcagga

SEQ ID NO: 118898 - DNA, 16 bp, Homo sapiens
  misc_feature 1..16: note = chr2:237068925-237068941
  misc_feature 1..16: note = Hyper
  source 1..16: mol_type = genomic DNA
gcggtggaggctaggg

SEQ ID NO: 118899 - DNA, 1367 bp, Homo sapiens
  misc_feature 1..1367: note = chr2:237072335-237073702
  misc_feature 1..1367: note = Hyper
  source 1..1367: mol_type = genomic DNA
ctcaggtgtgtgggtcgggggacggcgtccctgcgggcctcgaatgctgcagcagcgtcgtgtggccagtgggtacctgccccgagcagcaggcgctcaccggcaacctgcactcagcgcttcctggcgggcgggatcccggccttgcggcccccgcgccaggccagggcgcgacccgggcgccatcccctccctgccaggcttcatggcgctgggcggggcgcggccaggagcctctgcggctctcggcgccccgcagagccggccgacgccctcggaggactggcccttctattttattgggctcgaaaaccaagtctgggccattttccgccaccggaactgttgggaacgcggcgggaaagggtgactcggtcgctcccagccttcaccctgcgcctgaagtttgggtggaggtcttggtccccaggcccctccgccgtggggaggtgacggcctgtaagtagtaaaaattaagtcaatattagtactaacccatggcgggccgcgcttccccttcttcggctgagaacctcgccgagggccgagcgccgctgcatcgcagcggctcaccggcctcccctccttcccccactcgaaaggctgaggctggcgaagccccggcttctctcgcgcttcgggctgctggcttggtggcaccacgctcacactcgctggcccgctgaacgcccctgggcctgtccgccgcagtatctggcggcgcgcttcggggtccggcagcgagcggacagggctctgagcgcagggccggggttgggacaggagtgggcttggggaccaggcacgccccaccgagatggggaggcgcgcagctccccgtcccttgcagaccgactcccagctcccctgcgtagcctctcccgttttccccctttgtggtgcggactaccggggcgtccttggggtggggcggtgcccgggtcccgccccctcgaccccgcccggagggggaggtgccggggccgggggcgctccagccagcctccgcctccgactgagggctgccgggaagccggctgggctcgctgggtttttgctcctgtcgccagataacgcccggagcctgatttatggaccctccactctgccggcaggcgagcaccgcttcttttcgggccggagatatttgtaaaggaaagacgtttcctccctggctgtagtcgatttggagcatcaggagtttgtgcaaagccaccaatacccgcactcgcttgcctcctccgggcacccacctcctcctctgccgaagtttgccggcctactaggtatcgattaggctgtgcaaaagggggagatagatttctaaggtgagaattaggttttcttaaattcgtaatcctatcggc

SEQ ID NO: 118900 - DNA, 55 bp, Homo sapiens; identical to SEQ ID NO: 27979
  misc_feature 1..55: note = chr2:237075130-237075185
  misc_feature 1..55: note = Hyper
  source 1..55: mol_type = genomic DNA

SEQ ID NO: 118901 - DNA, 370 bp, Homo sapiens; identical to SEQ ID NO: 86091
  misc_feature 1..370: note = chr2:237075817-237076187
  misc_feature 1..370: note = Hyper
  source 1..370: mol_type = genomic DNA

SEQ ID NO: 118902 - DNA, 189 bp, Homo sapiens
  misc_feature 1..189: note = chr2:237076558-237076747
  misc_feature 1..189: note = Hyper
  source 1..189: mol_type = genomic DNA
ctactccccagcgggcgctgcatcatcatcagcgacggcgggaacgctgcgctcatagacgcgctcggtagaggccagcgagaggcgaaaagtccccgcgccgcgccgccgccgggaagcccgccggacgccgggagcaccgccgggagcgccgggcaggggccgagcgggacccggagagcagacgcc

SEQ ID NO: 118903 - DNA, 608 bp, Homo sapiens
  misc_feature 1..608: note = chr2:237076991-237077599
  misc_feature 1..608: note = Hyper
  source 1..608: mol_type = genomic DNA
cggcgtacttatctccggcgggcgcagccagcacctttaaatcgcgctcctctttctcattcacattttgcctgccgcctggcccggctcgcctcacgtggggctgggcgcctctggccattggctgagcggggcgggggtggggcgaaagcggggccccgccctttccacccaagctggcctcgagcgggctgcgggcgccaccgtcggagcgcgcgggccggggagccggagcctgcatgcctagcccgtgccgcgcaaacttgagacgggcggatggcacctccaaggctcggaccttggggccctgcagccttgtcgaggccacctcgaagggtagcctccggggcccgcacccccacggctgggccgggggcgctttatttcttttactgtatttgccatggaaccaacctgcctgcggctcactccagcgctgggtgctccggctgcgcctggggtccgggcgagggtcctggagttgggggcagggtcctgcccctccggagccacccccggggcgaaggctgggagctggcagcgcctgcccgccgccagaaacccgccgggttgctcgctgtaggtccgcgcaccgggtggggcgggga

SEQ ID NO: 118904 - DNA, 60 bp, Homo sapiens; identical to SEQ ID NO: 86097
  misc_feature 1..60: note = chr2:237077904-237077964
  misc_feature 1..60: note = Hyper
  source 1..60: mol_type = genomic DNA

SEQ ID NO: 118905 - DNA, 467 bp, Homo sapiens
  misc_feature 1..467: note = chr2:237078192-237078659
  misc_feature 1..467: note = Hyper
  source 1..467: mol_type = genomic DNA
cgagcggggcttcctcgagtctccaaggcccgggcttcaacttcccgggtctagacgtcagccctgaaccgccaacagcaccgggttggggagaaggaaagaagggcattgttagttcggtcattaaaaatcagctcacgccgaggagctagtggttggggagttggcccgtgttggacgtgtgttatgtatcacttacaagcacatttaattgggagataaagataaatcgatctttatgaatttatcgacccgattctttgaagctcttttttcgcgttcttcctctttctctcgctctagccccaaggccccccgggggacgtcttaatcccagatcagctcctctgccaggagtcccgccggagacccactgcccacccagcagacctggaggaaagaggggagggtgtgtccttggcgccccgggacgctgggaaaactcgctggtccgccgccagccctct

SEQ ID NO: 118906 - DNA, 42 bp, Homo sapiens; identical to SEQ ID NO: 86099
  misc_feature 1..42: note = chr2:237079083-237079125
  misc_feature 1..42: note = Hyper
  source 1..42: mol_type = genomic DNA

SEQ ID NO: 118907 - DNA, 258 bp, Homo sapiens; identical to SEQ ID NO: 86100
  misc_feature 1..258: note = chr2:237080173-237080431
  misc_feature 1..258: note = Hyper
  source 1..258: mol_type = genomic DNA

SEQ ID NO: 118908 - DNA, 1538 bp, Homo sapiens
  misc_feature 1..1538: note = chr2:237081182-237082720
  misc_feature 1..1538: note = Hyper
  source 1..1538: mol_type = genomic DNA
cagaaacaaaacaaccgcaaaatagaaatgtgaaggggaggggcttttcttcttcttcatttcctcctgggagttgaaaaatgttatccgcaggcctgaaggctgggaaacgtgacccttcacacctgcgccgccctctccactccagcgacgaggaacaggaggagccacagccgctcggcccgcgaggcgagccctcgtggcatctgggaatgggagggtgggggtggaatgctacacagccccggagcccctggggcggcgggcgctgtcgcgccgacggcgcacccggcgagcgttgcgtgcgcttggagcccgggactaccccaactccacgcggaactcggctcccccggccgggatccagatgtccgagggcgcttgcgggtgtcctagttctttttcagagcagccgtaacgattgaggctggggagttcaagaccactgggggtaactgatcgcccatcgcccttcgtcctggaagcccagcgcccgcgctcaccgcgcgtctctccgggagcacctagccaggcaaagggggattctccgtggggactgaggcgtacgcccgccccggggctcccggcttgggaagagggagcaccaggcgaaggccaggctgggggctcgggtccaagggctgcagctgtgcgggcggaggccgggggtgcgggcgggagtggtgtccccttgtgtcctgcccgggtctggctccggccggggttctggaggccgcgtccgtcggcgaaccccagcccttggagtgttggggagggagacgccggccgccaggcgcttctcacctgggtttatctcctcccatctgctccctcggattcccgaggccccacctttcggggacttcaaacgcgccctgccacccggtgcccggctttcatctcccgcacagcaggcattgtttgcgggacttcacagagatgctaatccccgggccgcgtgaaccgcggcctgggaaccgggcagagggcacggaggggtgagggggtgcgctttggcctgggctggggaccttcgggatggcctctcgggcagccctcctgaggagcccgggtctgctaccgtgcgggcgccgcatcccgcctgcctcgtcctggaaggctgcgggcacgtcgcaatgggcctgggctggacgcagccagcgtccaacacacggagaaggaagaagcagaggccagagacgatggccggcgcttagctgtgagccccatgagcttccaatgctcgccaggagaccgtgtgtctaggagaggcaggccatggaccctatgagtcttccctggaggctggaaccccccgggactcctggacaccccaaaccaagtccccagccgctgcctccacgacggccccgacccccttcagggaagtagtattttaaagaggatgcggtctgcccggagggcacgcatttaaccctttagaaaccgcgctggagggagcagaagggtgttgaatcaacagccatgcacaccaggggcacccctccaactttagcttcttccgggaccaaatgagc

SEQ ID NO: 118909 - DNA, 780 bp, Homo sapiens
  misc_feature 1..780: note = chr2:237086290-237087070
  misc_feature 1..780: note = Hyper
  source 1..780: mol_type = genomic DNA
ggcctctggaacatctaaaaacagaccagaggccacccaatggaacaggatgcagtgtgacatttcacaacatacgacgcctctcctgggaagggagagctcgcgagcgcctctactgggtgggcgcagcgccatccccattgcacgaaccgagacggaggtgcggaggccgtgtctggccctggagagtcctccctctgtcgtctgctctcagcaccaagtctggcatcgccagggcgccaggcacggccttcccagggagaagccttttctgtcatttttgattattttactttaaatatgtgtgcaaaaccttagctacattctcgtgggccagggataggcaacgcgtgcacctagacctcttgcttgcccccacactccgtctccccagggccaccccctcaacccccccatgccatcagagttttgaacaccgctggagatggcgggggggaggggggcgaatttggaggcgggacccgaactgccggccaaggaccaagggctggcctcgcccttcgctcccactgggcaccgttctcgccgcgggaccttgccttgagcgcgccccctgcgggccgcggtggggattggccccttggaaagagggaaataggctgcgcgcgccggggcgggagaggcgctgcctccagtcctcccgggtgggggtctcccctccgagatccccgagggaacccgtcccgtgcactaccggatttccggtctctgaccagctggggcttcatttctacgcgtgcttttactgctctcctcctc

SEQ ID NO: 118910 - DNA, 196 bp, Homo sapiens; identical to SEQ ID NO: 86106
  misc_feature 1..196: note = chr2:237087422-237087618
  misc_feature 1..196: note = Hyper
  source 1..196: mol_type = genomic DNA

SEQ ID NO: 118911 - DNA, 228 bp, Homo sapiens; identical to SEQ ID NO: 86107
  misc_feature 1..228: note = chr2:237088011-237088239
  misc_feature 1..228: note = Hyper
  source 1..228: mol_type = genomic DNA

SEQ ID NO: 118912 - DNA, 861 bp, Homo sapiens
  misc_feature 1..861: note = chr2:237145136-237145997
  misc_feature 1..861: note = Hyper
  source 1..861: mol_type = genomic DNA
tgtacgccttaaacacgtgccgcttgctgaatgtcaatcacacctcggtaaagctgcttttaaagagcattgctagaaccttgtttccttcctctttctcaagactggcgggggtccacgtggccccctgatcccccctctgaactcaaatgacctttcttaggtgggtcccctgcctgagtccctgaatgcccagcagtcccgcctgcctgcgttgctgcccctgctgggcaggacatccaggcaactttgacagtcggtggagaagcagcaagggcgatgcggtttctgagagagccgcgcgggttcccagcactaaacgtgggcgactttccttaatcttcccccagagacagaaggccatgcaatgacaactccaagggcaggggctggagcattttgactaacagaaaagtcaggatgacacaatgcaagccgagaaaccccacacgagtcctgtgcaaagacaggtggccccgctgcctttccgagacccggagcacacgctgggagggcgctctctggggacgggggctgcgggacccccagaccccgcgcccgggcgcgaactagctgagcggccgctgggcctccctagaggccggcacagctccgcttccgagcgggcctggaagccccgcccgaggagctaaccatttatgtcacactgtgacaattattctgcataaaattatcattaaaaaccctaatttttcagcctccaaccccgccagtggccttttagcatccccggcgccggcggctgggctgtgatcaccgcgctcattacctcggcgtggcgcctcccgcgcgcgctcgcaatcaagcgctaattaaacccgcgggggccggggccggggc

SEQ ID NO: 118913 - DNA, 560 bp, Homo sapiens; identical to SEQ ID NO: 86111
  misc_feature 1..560: note = chr2:237146057-237146617
  misc_feature 1..560: note = Hyper
  source 1..560: mol_type = genomic DNA

SEQ ID NO: 118914 - DNA, 390 bp, Homo sapiens
  misc_feature 1..390: note = chr2:237416039-237416429
  misc_feature 1..390: note = Hyper
  source 1..390: mol_type = genomic DNA
gagaaaccaggactgcgagaatcttctgcttcgggcaggaaaaggtgaggccgggtttgcttcgcaggcacggagcgcgcaggcgcagagaggtgtttcactccttcccgtcgcgacccagagactcgcgaacctcacttcggccactcaggtgggcgcgacgcggccctagcaacggaaacgccgcgcctgcgcattgccttccgcctgccccctccccccccccgccccccgcattccgcgcctgcgccaccgcgggaggcctgggtgggcgcagctgtgggagccggtcggagtccgagcgctccgtcgcggggcccggccgcttggcgagcctgctccgggccccagcacttagcctgtggtcctccaggccgtcttcccgctttc

SEQ ID NO: 118915 - DNA, 30 bp, Homo sapiens; identical to SEQ ID NO: 86113
  misc_feature 1..30: note = chr2:237486176-237486206
  misc_feature 1..30: note = Hypo
  source 1..30: mol_type = genomic DNA

SEQ ID NO: 118916 - DNA, 92 bp, Homo sapiens; identical to SEQ ID NO: 86114
  misc_feature 1..92: note = chr2:237544340-237544432
  misc_feature 1..92: note = Hypo
  source 1..92: mol_type = genomic DNA

SEQ ID NO: 118917 - DNA, 81 bp, Homo sapiens; identical to SEQ ID NO: 86115
  misc_feature 1..81: note = chr2:237904291-237904372
  misc_feature 1..81: note = Hypo
  source 1..81: mol_type = genomic DNA

SEQ ID NO: 118918 - DNA, 314 bp, Homo sapiens; identical to SEQ ID NO: 86116
  misc_feature 1..314: note = chr2:238280498-238280812
  misc_feature 1..314: note = Hypo
  source 1..314: mol_type = genomic DNA

SEQ ID NO: 118919 - DNA, 377 bp, Homo sapiens; identical to SEQ ID NO: 86117
  misc_feature 1..377: note = chr2:238395078-238395455
  misc_feature 1..377: note = Hyper
  source 1..377: mol_type = genomic DNA

SEQ ID NO: 118920 - DNA, 157 bp, Homo sapiens; identical to SEQ ID NO: 86118
  misc_feature 1..157: note = chr2:238395729-238395886
  misc_feature 1..157: note = Hyper
  source 1..157: mol_type = genomic DNA

SEQ ID NO: 118921 - DNA, 129 bp, Homo sapiens; identical to SEQ ID NO: 86119
  misc_feature 1..129: note = chr2:238475087-238475216
  misc_feature 1..129: note = Hypo
  source 1..129: mol_type = genomic DNA

SEQ ID NO: 118922 - DNA, 30 bp, Homo sapiens; identical to SEQ ID NO: 86120
  misc_feature 1..30: note = chr2:238490173-238490203
  misc_feature 1..30: note = Hyper
  source 1..30: mol_type = genomic DNA

SEQ ID NO: 118923 - DNA, 993 bp, Homo sapiens
  misc_feature 1..993: note = chr2:238535860-238536853
  misc_feature 1..993: note = Hyper
  source 1..993: mol_type = genomic DNA
tcaaccggtgcccaccgccctggcgcgcgtcgctccgcgattaccggcccgccaaacagtccccgcaaagtccaccctccggggctcccggtccctcaggtcccgcgtgcccggccctgggcatccgcagcgtccccgtggtatcggacccccatcgtccctgacacctggcgtctccgccccccgcccccgtcccccgccccgccgtccctggcccctgcagtccctggcccgcgctgcggacctccggctctggcttcccccgggtccccgcggcccccgtccccccgcgtccccgcgtccccggcccagcgcccgctgacgccatgacgccgcggcggagggaggggccggggccggggccgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggtgagcgctccgggagggcagccggggggcgccgggcgggcgcgggggccggacggctgtcagggtctctccggcgtccgtctgtcccgctgtgcgtctgtgccactgcgcgtccggctccaggcgggtgggccgggcaggcgcgcgccggggcgctgatccccaggcgctgcgccccggccccgatctccgaggcctgcggaccccgcacccgttctccagccccgggcccagcccgcgacgctgcgcgccctcccccaccccggccaccgtcggccgctgcgccctcgggagaggagccgggcgccgccagcgcgcgaggtggcccgggctggccgggtgggggcgagcgccccgctttgttgtgcggcatgggaggaggcgggggcttaggcccgacctggaggcagtggacggtcgccggaggccacatggccctgctgaaatggccgagtcgctcaggtgaccat

SEQ ID NO: 118924 - DNA, 30 bp, Homo sapiens; identical to SEQ ID NO: 86123
  misc_feature 1..30: note = chr2:238768112-238768142
  misc_feature 1..30: note = Hyper
  source 1..30: mol_type = genomic DNA

SEQ ID NO: 118925 - DNA, 30 bp, Homo sapiens; identical to SEQ ID NO: 86124
  misc_feature 1..30: note = chr2:238768375-238768405
  misc_feature 1..30: note = Hyper
  source 1..30: mol_type = genomic DNA

SEQ ID NO: 118926 - DNA, 18 bp, Homo sapiens
  misc_feature 1..18: note = chr2:238833221-238833239
  misc_feature 1..18: note = Hypo
  source 1..18: mol_type = genomic DNA
actcggtctcaaaaaaca

SEQ ID NO: 118927 - DNA, 741 bp, Homo sapiens
  misc_feature 1..741: note = chr2:238864558-238865299
  misc_feature 1..741: note = Hyper
  source 1..741: mol_type = genomic DNA
cccctggaccccaggcgaggccaccagcgcccaccatccaaagggcgacagggaggcgtccccccaaccccggcggcgatgcctcctgagtcctaaccacacgccgtggacccccgcaccctcagtagccccgcgccgagtgtaaccgcgccccgtgtcctgggatcccgcggcccgggtaaccaggtcccatgtaaccgcagcctggtgaagccgtgcgccctgggcgcggctacttggccctcacggcagggcggagatgcgaggccccagggttcggccccgcagcgccgctgagtccaaggaccgagctgggagtgggggcggagccaagaaggggcgcccctgcgcccacaagccgcagcgcccaggaatcccctgggcgcctccgcgtcccccgcgggctgtcccggcaggcaggcagcccaccccagggctcccctcgtggaaggacacccctgctgaccctggccctggttctggcggtgtctccactcagccctcggagggacgcccacctcccgcggagctgggggactgtggcttcctcctgcgcggggaggtcggtgggcgccgtggacccgtcccgcccctgtctgaggagccgagtcggccacagaggggcagcagactagggagggctgatgggccgtgcacttagctccctccgggctgctggccggggcccttgaacggacagatgccaactggcagatgagggggctgcgtccacccccaccc

SEQ ID NO: 118928 - DNA, 46 bp, Homo sapiens; identical to SEQ ID NO: 86129
  misc_feature 1..46: note = chr2:239039796-239039842
  misc_feature 1..46: note = Hypo
  source 1..46: mol_type = genomic DNA

SEQ ID NO: 118929 - DNA, 368 bp, Homo sapiens; identical to SEQ ID NO: 86130
  misc_feature 1..368: note = chr2:239050963-239051331
  misc_feature 1..368: note = Hypo
  source 1..368: mol_type = genomic DNA

SEQ ID NO: 118930 - DNA, 84 bp, Homo sapiens; identical to SEQ ID NO: 86131
  misc_feature 1..84: note = chr2:239051823-239051907
  misc_feature 1..84: note = Hypo
  source 1..84: mol_type = genomic DNA

SEQ ID NO: 118931 - DNA, 30 bp, Homo sapiens; identical to SEQ ID NO: 86132
  misc_feature 1..30: note = chr2:239071498-239071528
  misc_feature 1..30: note = Hypo
  source 1..30: mol_type = genomic DNA

SEQ ID NO: 118932 - DNA, 740 bp, Homo sapiens
  misc_feature 1..740: note = chr2:239072151-239072891
  misc_feature 1..740: note = Hyper
  source 1..740: mol_type = genomic DNA
tggggcacttctgcccgagcttcccaaatcttgagggaaacgggagccgctgcagggtcaggacgcaaagactccgaggcccttcaggccgaggggacgtcgccctcgccccacccctgcgcccggcaggcccctggtctcgctagcacctgtcgttcagggctggacccacgcggcgggcgggtgaggggtccctggcgcgcggccaccgctcgctctgtgccaggtgcggtgcggcagcgggagcgcgcggagcccgaaccctgtacgtgtggccccgccgggccggtcgctgcgagcctcgccccggtctcggccaccgccggggaggacgacgacgacgtggtgggggacgtgctggcactgctggccgcgcccctggccccggggccgcgggcgccgcgcgtggaggccgctttcctctgccgcctgcgccgggacgcgttggtggagcggcgcgcgctgcacgagcttggcgtctactacctggtgagtgccggcgcgcgggagggcgggtgagtccggccgggcgggagccggggtgaccatccgtgcccctcgcagcccgacgccgagggtgccttccgccgcggcccgggcctgaacttgaccagcggccagtacagggcgcccgtggctggcttctacgctctcgccgccacgctgcacgtgggtgaggcccggggcgtgggaggatcgcccgctctgtcgcccaccccgccgcccgcccgcttgaccac

SEQ ID NO: 118933 - DNA, 30 bp, Homo sapiens; identical to SEQ ID NO: 39787
  misc_feature 1..30: note = chr2:239083135-239083165
  misc_feature 1..30: note = Hypo
  source 1..30: mol_type = genomic DNA

SEQ ID NO: 118934 - DNA, 43 bp, Homo sapiens; identical to SEQ ID NO: 86136
  misc_feature 1..43: note = chr2:239132262-239132305
  misc_feature 1..43: note = Hypo
  source 1..43: mol_type = genomic DNA

SEQ ID NO: 118935 - DNA, 30 bp, Homo sapiens; identical to SEQ ID NO: 86137
  misc_feature 1..30: note = chr2:239133018-239133048
  misc_feature 1..30: note = Hypo
  source 1..30: mol_type = genomic DNA

SEQ ID NO: 118936 - DNA, 30 bp, Homo sapiens; identical to SEQ ID NO: 86138
  misc_feature 1..30: note = chr2:239133524-239133554
  misc_feature 1..30: note = Hypo
  source 1..30: mol_type = genomic DNA

SEQ ID NO: 118937 - DNA, 113 bp, Homo sapiens; identical to SEQ ID NO: 86139
  misc_feature 1..113: note = chr2:239133985-239134098
  misc_feature 1..113: note = Hypo
  source 1..113: mol_type = genomic DNA

SEQ ID NO: 118938 - DNA, 431 bp, Homo sapiens
  misc_feature 1..431: note = chr2:239139974-239140405
  misc_feature 1..431: note = Hyper
  source 1..431: mol_type = genomic DNA
ctcaatcgttgatttcggctgcacttcctatccctgggggagctttcaacgctccgccgtccaggccgccgggccccgcagcccgcgccccgctctctagggctgggcccccaggggctggacgacctctctcgccttcgctttctcaagcgtaaatcgggcggcgggggctgcagagccttcatctcttcctccgtcccgggatgtcggagagacggcagcccagcctccgccaccgcaaagctgcttaacgggcagcgcgagtccctcgggcaccgttggaggccgttgctcaccgttgggcaagtgctttaagaagcacgaggatgtcgagtgtcaaatgcggcaaagggctcagagctcgccgccaaggggcgtggcctccgggccgcggcggcctctgggagttgtagtcccgcctcaacttgtgg

SEQ ID NO: 118939 - DNA, 165 bp, Homo sapiens; identical to SEQ ID NO: 86141
  misc_feature 1..165: note = chr2:239147044-239147209
  misc_feature 1..165: note = Hypo
  source 1..165: mol_type = genomic DNA

SEQ ID NO: 118940 - DNA, 215 bp, Homo sapiens; identical to SEQ ID NO: 86142
  misc_feature 1..215: note = chr2:239147417-239147632
  misc_feature 1..215: note = Hypo
  source 1..215: mol_type = genomic DNA

SEQ ID NO: 118941 - DNA, 78 bp, Homo sapiens; identical to SEQ ID NO: 86143
  misc_feature 1..78: note = chr2:239152958-239153036
  misc_feature 1..78: note = Hypo
  source 1..78: mol_type = genomic DNA

SEQ ID NO: 118942 - DNA, 30 bp, Homo sapiens; identical to SEQ ID NO: 39790
  misc_feature 1..30: note = chr2:239183260-239183290
  misc_feature 1..30: note = Hypo
  source 1..30: mol_type = genomic DNA

SEQ ID NO: 118943 - DNA, 41 bp, Homo sapiens; identical to SEQ ID NO: 86145
  misc_feature 1..41: note = chr2:239186621-239186662
  misc_feature 1..41: note = Hypo
  source 1..41: mol_type = genomic DNA

SEQ ID NO: 118944 - DNA, 86 bp, Homo sapiens; identical to SEQ ID NO: 86146
  misc_feature 1..86: note = chr2:239265701-239265787
  misc_feature 1..86: note = Hypo
  source 1..86: mol_type = genomic DNA

SEQ ID NO: 118945 - DNA, 30 bp, Homo sapiens; identical to SEQ ID NO: 86147
  misc_feature 1..30: note = chr2:239317559-239317589
  misc_feature 1..30: note = Hypo
  source 1..30: mol_type = genomic DNA

SEQ ID NO: 118946 - DNA, 184 bp, Homo sapiens; identical to SEQ ID NO: 39792
  misc_feature 1..184: note = chr2:239322426-239322610
  misc_feature 1..184: note = Hypo
  source 1..184: mol_type = genomic DNA

SEQ ID NO: 118947 - DNA, 67 bp, Homo sapiens; identical to SEQ ID NO: 86149
  misc_feature 1..67: note = chr2:239482485-239482552
  misc_feature 1..67: note = Hypo
  source 1..67: mol_type = genomic DNA

SEQ ID NO: 118948 - DNA, 30 bp, Homo sapiens; identical to SEQ ID NO: 86150
  misc_feature 1..30: note = chr2:239482782-239482812
  misc_feature 1..30: note = Hypo
  source 1..30: mol_type = genomic DNA

SEQ ID NO: 118949 - DNA, 181 bp, Homo sapiens; identical to SEQ ID NO: 86151
  misc_feature 1..181: note = chr2:239684667-239684848
  misc_feature 1..181: note = Hypo
  source 1..181: mol_type = genomic DNA

SEQ ID NO: 118950 - DNA, 30 bp, Homo sapiens; identical to SEQ ID NO: 86152
  misc_feature 1..30: note = chr2:239705259-239705289
  misc_feature 1..30: note = Hypo
  source 1..30: mol_type = genomic DNA

SEQ ID NO: 118951 - DNA, 295 bp, Homo sapiens
  misc_feature 1..295: note = chr2:239755112-239755407
  misc_feature 1..295: note = Hyper
  source 1..295: mol_type = genomic DNA
gcggaggaaggagggcggtcaggccgggtggggctgggtgcggtggctctgcagaacctttaggcaccgaactgaagccgcgggtccggtgcgcggacactgcgcagggcgctgctaccgactcacatgcatgcgagggcccgctcctaggcgttctgccttcctggacggattgttggtaaaacgtcccctagaacggccggagccagggccctcggacaggggcgcgaagggcccgctctttgccgtcctcgggtttcccaacgcggtggtcgtggcccgcgggccccacctc

SEQ ID NO: 118952 - DNA, 247 bp, Homo sapiens
  misc_feature 1..247: note = chr2:239755687-239755934
  misc_feature 1..247: note = Hyper
  source 1..247: mol_type = genomic DNA
cggggtccgtggtgtcgctcaccgaggccgggccccacactccagccaccctgagcctcctgctcggagctgcccgcgggctgccagcgcagcggaggctgggcccggggcagcctcgtgcagctcccggagcgccctccgtcctctgctgacccgcgaagcgaaggcggagcgcagaggctggggccgtacaaggcgggccggcaggcgccccaacccgcgcccagcaacccgggtagggccaggc

SEQ ID NO: 118953 - DNA, 81 bp, Homo sapiens
  misc_feature 1..81: note = chr2:239756425-239756506
  misc_feature 1..81: note = Hyper
  source 1..81: mol_type = genomic DNA
gccgggcctagggctcggggcggcctgagagtgccctgcgttcggggtgggggcgcgggcggcgggcgaggacccggcccc

SEQ ID NO: 118954 - DNA, 1159 bp, Homo sapiens
  misc_feature 1..1159: note = chr2:239757296-239758455
  misc_feature 1..1159: note = Hyper
  source 1..1159: mol_type = genomic DNA
gtggcgcatggagggcgcgtggtccatgtccgcctcccactagcgccgcgccacccacctccggaccggcgcgccagggtaggtgctgcgcgcgcgacgggcgccctccgctgcggggggcgggcggcaggggcgcaggggcattggggcctgctcgtgtctcctcggcgaggccccgcgggccgcgggggcttggatgccgtgcgcttttcctcttagcaaggaaggcgggcgggcgggacgctcacagtcccagggacacccctgagtgcagacttccacgcgagggtgtcagttgggaaccggcggaccggtgactcccccggcgggttctgaagatacttagacagatggtcgcagttttcattctcggtggtgtgtgggtgtccgtggttggcggtggaaggagcgagcatcagaaaaacctcctggggccggctggggactgggatatgaggaccagctgccctttgcgtccgccgcagcgcaggccgcccgcgaagctgcccgagccgggtgttgccgggcgaatggcttcgctttcttcctgggcaagggtagagcgcgtccgtcgggcggacactcagatctacccagctgctcgcgcctggggtccccggccgtcggcgccctggcctgcccagtgggcgtagaggtgcgggcctgcggctccagggtttgcctggggaggacgggaggaaactgccctgcgcttcggggccagagcagccacagggccgggtgtgcccgagaagggccctgggccgagagcgcagagcctggagcgctgaggcaggcgggtccgacgcagccgcgcggagccccagggcgcccgcaggcaggtggagctgacctaggaactgggagccctgagtcccaaccttgaccctggagtacccgggaggggccccgcccatccagccccgcagggatgggcgaggggtccaggctgggaaacgggtctgggggacagggaggctgtgcgcgccgggccctgcgcgaggagaaggctcgggggacacagctgccaggagcactccaagttctggtttcctctggaagagcgattagggcgtcctgcaccgggtccttttcaccagacaccttccaagtccctttagacaagctcgagccacggaggcgccgtccttaggctctg

SEQ ID NO: 118955 - DNA, 30 bp, Homo sapiens; identical to SEQ ID NO: 86159
  misc_feature 1..30: note = chr2:239780321-239780351
  misc_feature 1..30: note = Hypo
  source 1..30: mol_type = genomic DNA

SEQ ID NO: 118956 - DNA, 271 bp, Homo sapiens; identical to SEQ ID NO: 86160
  misc_feature 1..271: note = chr2:239888518-239888789
  misc_feature 1..271: note = Hypo
  source 1..271: mol_type = genomic DNA

SEQ ID NO: 118957 - DNA, 274 bp, Homo sapiens; identical to SEQ ID NO: 86161
  misc_feature 1..274: note = chr2:239957240-239957514
  misc_feature 1..274: note = Hypo
  source 1..274: mol_type = genomic DNA

SEQ ID NO: 118958 - DNA, 127 bp, Homo sapiens; identical to SEQ ID NO: 39794
  misc_feature 1..127: note = chr2:239997460-239997587
  misc_feature 1..127: note = Hypo
  source 1..127: mol_type = genomic DNA

SEQ ID NO: 118959 - DNA, 30 bp, Homo sapiens; identical to SEQ ID NO: 86163
  misc_feature 1..30: note = chr2:240003796-240003826
  misc_feature 1..30: note = Hypo
  source 1..30: mol_type = genomic DNA

SEQ ID NO: 118960 - DNA, 30 bp, Homo sapiens; identical to SEQ ID NO: 86164
  misc_feature 1..30: note = chr2:240067129-240067159
  misc_feature 1..30: note = Hypo
  source 1..30: mol_type = genomic DNA

SEQ ID NO: 118961 - DNA, 55 bp, Homo sapiens; identical to SEQ ID NO: 86165
  misc_feature 1..55: note = chr2:240080007-240080062
  misc_feature 1..55: note = Hypo
  source 1..55: mol_type = genomic DNA

SEQ ID NO: 118962 - DNA, 197 bp, Homo sapiens; identical to SEQ ID NO: 86166
  misc_feature 1..197: note = chr2:240080368-240080565
  misc_feature 1..197: note = Hypo
  source 1..197: mol_type = genomic DNA

SEQ ID NO: 118963 - DNA, 487 bp, Homo sapiens; identical to SEQ ID NO: 86167
  misc_feature 1..487: note = chr2:240103578-240104065
  misc_feature 1..487: note = Hypo
  source 1..487: mol_type = genomic DNA

SEQ ID NO: 118964 - DNA, 23 bp, Homo sapiens
  misc_feature 1..23: note = chr2:240165134-240165157
  misc_feature 1..23: note = Hypo
  source 1..23: mol_type = genomic DNA
accgctcccggctggataaatta

SEQ ID NO: 118965 - DNA, 349 bp, Homo sapiens; identical to SEQ ID NO: 86169
  misc_feature 1..349: note = chr2:240168786-240169135
  misc_feature 1..349: note = Hypo
  source 1..349: mol_type = genomic DNA

SEQ ID NO: 118966 - DNA, 30 bp, Homo sapiens; identical to SEQ ID NO: 86170
  misc_feature 1..30: note = chr2:240169782-240169812
  misc_feature 1..30: note = Hypo
  source 1..30: mol_type = genomic DNA

SEQ ID NO: 118967 - DNA, 116 bp, Homo sapiens; identical to SEQ ID NO: 86171
  misc_feature 1..116: note = chr2:240213695-240213811
  misc_feature 1..116: note = Hypo
  source 1..116: mol_type = genomic DNA

SEQ ID NO: 118968 - DNA, 66 bp, Homo sapiens; identical to SEQ ID NO: 86172
  misc_feature 1..66: note = chr2:240216405-240216471
  misc_feature 1..66: note = Hypo
  source 1..66: mol_type = genomic DNA

SEQ ID NO: 118969 - DNA, 30 bp, Homo sapiens; identical to SEQ ID NO: 86173
  misc_feature 1..30: note = chr2:240226977-240227007
  misc_feature 1..30: note = Hypo
  source 1..30: mol_type = genomic DNA

SEQ ID NO: 118970 - DNA, 146 bp, Homo sapiens; identical to SEQ ID NO: 86175
  misc_feature 1..146: note = chr2:240270365-240270511
  misc_feature 1..146: note = Hypo
  source 1..146: mol_type = genomic DNA

SEQ ID NO: 118971 - DNA, 30 bp, Homo sapiens; identical to SEQ ID NO: 86176
  misc_feature 1..30: note = chr2:240319982-240320012
  misc_feature 1..30: note = Hypo
  source 1..30: mol_type = genomic DNA

SEQ ID NO: 118972 - DNA, 40 bp, Homo sapiens; identical to SEQ ID NO: 86177
  misc_feature 1..40: note = chr2:240399164-240399204
  misc_feature 1..40: note = Hypo
  source 1..40: mol_type = genomic DNA

SEQ ID NO: 118973 - DNA, 30 bp, Homo sapiens; identical to SEQ ID NO: 86178
  misc_feature 1..30: note = chr2:240485257-240485287
  misc_feature 1..30: note = Hypo
  source 1..30: mol_type = genomic DNA

SEQ ID NO: 118974 - DNA, 155 bp, Homo sapiens; identical to SEQ ID NO: 86179
  misc_feature 1..155: note = chr2:240505959-240506114
  misc_feature 1..155: note = Hypo
  source 1..155: mol_type = genomic DNA

SEQ ID NO: 118975 - DNA, 58 bp, Homo sapiens; identical to SEQ ID NO: 39800
  misc_feature 1..58: note = chr2:240566166-240566224
  misc_feature 1..58: note = Hypo
  source 1..58: mol_type = genomic DNA

SEQ ID NO: 118976 - DNA, 55 bp, Homo sapiens; identical to SEQ ID NO: 39801
  misc_feature 1..55: note = chr2:240582300-240582355
  misc_feature 1..55: note = Hypo
  source 1..55: mol_type = genomic DNA

SEQ ID NO: 118977 - DNA, 167 bp, Homo sapiens; identical to SEQ ID NO: 86182
  misc_feature 1..167: note = chr2:240612421-240612588
  misc_feature 1..167: note = Hypo
  source 1..167: mol_type = genomic DNA

SEQ ID NO: 118978 - DNA, 348 bp, Homo sapiens; identical to SEQ ID NO: 86183
  misc_feature 1..348: note = chr2:240619528-240619876
  misc_feature 1..348: note = Hypo
  source 1..348: mol_type = genomic DNA

SEQ ID NO: 118979 - DNA, 30 bp, Homo sapiens; identical to SEQ ID NO: 86184
  misc_feature 1..30: note = chr2:240650547-240650577
  misc_feature 1..30: note = Hypo
  source 1..30: mol_type = genomic DNA

SEQ ID NO: 118980 - DNA, 754 bp, Homo sapiens; identical to SEQ ID NO: 86185
  misc_feature 1..754: note = chr2:240658183-240658937
  misc_feature 1..754: note = Hypo
  source 1..754: mol_type = genomic DNA

SEQ ID NO: 118981 - DNA, 157 bp, Homo sapiens; identical to SEQ ID NO: 86186
  misc_feature 1..157: note = chr2:240690401-240690558
  misc_feature 1..157: note = Hypo
  source 1..157: mol_type = genomic DNA

SEQ ID NO: 118982 - DNA, 27 bp, Homo sapiens
  misc_feature 1..27: note = chr2:240756273-240756300
  misc_feature 1..27: note = Hypo
  source 1..27: mol_type = genomic DNA
gggggtggtggctcacgcccagcactt

SEQ ID NO: 118983 - DNA, 398 bp, Homo sapiens; identical to SEQ ID NO: 86188
  misc_feature 1..398: note = chr2:240809303-240809701
  misc_feature 1..398: note = Hypo
  source 1..398: mol_type = genomic DNA

SEQ ID NO: 118984 - DNA, 167 bp, Homo sapiens; identical to SEQ ID NO: 86189
  misc_feature 1..167: note = chr2:240874074-240874241
  misc_feature 1..167: note = Hyper
  source 1..167: mol_type = genomic DNA

SEQ ID NO: 118985 - DNA, 30 bp, Homo sapiens; identical to SEQ ID NO: 86190
  misc_feature 1..30: note = chr2:240965962-240965992
  misc_feature 1..30: note = Hypo
  source 1..30: mol_type = genomic DNA

SEQ ID NO: 118986 - DNA, 112 bp, Homo sapiens; identical to SEQ ID NO: 86191
  misc_feature 1..112: note = chr2:241074559-241074671
  misc_feature 1..112: note = Hypo
  source 1..112: mol_type = genomic DNA

SEQ ID NO: 118987 - DNA, 181 bp, Homo sapiens; identical to SEQ ID NO: 86192
  misc_feature 1..181: note = chr2:241095604-241095785
  misc_feature 1..181: note = Hypo
  source 1..181: mol_type = genomic DNA

SEQ ID NO: 118988 - DNA, 170 bp, Homo sapiens; identical to SEQ ID NO: 86193
  misc_feature 1..170: note = chr2:241107135-241107305
  misc_feature 1..170: note = Hypo
  source 1..170: mol_type = genomic DNA

SEQ ID NO: 118989 - DNA, 30 bp, Homo sapiens; identical to SEQ ID NO: 86194
  misc_feature 1..30: note = chr2:241157270-241157300
  misc_feature 1..30: note = Hypo
  source 1..30: mol_type = genomic DNA

SEQ ID NO: 118990 - DNA, 38 bp, Homo sapiens; identical to SEQ ID NO: 86195
  misc_feature 1..38: note = chr2:241236738-241236776
  misc_feature 1..38: note = Hypo
  source 1..38: mol_type = genomic DNA

SEQ ID NO: 118991 - DNA, 70 bp, Homo sapiens; identical to SEQ ID NO: 86196
  misc_feature 1..70: note = chr2:241262151-241262221
  misc_feature 1..70: note = Hypo
  source 1..70: mol_type = genomic DNA

SEQ ID NO: 118992 - DNA, 34 bp, Homo sapiens; identical to SEQ ID NO: 86197
  misc_feature 1..34: note = chr2:241263378-241263412
  misc_feature 1..34: note = Hypo
  source 1..34: mol_type = genomic DNA

SEQ ID NO: 118993 - DNA, 30 bp, Homo sapiens; identical to SEQ ID NO: 86198
  misc_feature 1..30: note = chr2:241264182-241264212
  misc_feature 1..30: note = Hypo
  source 1..30: mol_type = genomic DNA

SEQ ID NO: 118994 - DNA, 148 bp, Homo sapiens; identical to SEQ ID NO: 86199
  misc_feature 1..148: note = chr2:241350165-241350313
  misc_feature 1..148: note = Hypo
  source 1..148: mol_type = genomic DNA

SEQ ID NO: 118995 - DNA, 58 bp, Homo sapiens; identical to SEQ ID NO: 86200
  misc_feature 1..58: note = chr2:241375833-241375891
  misc_feature 1..58: note = Hyper
  source 1..58: mol_type = genomic DNA

SEQ ID NO: 118996 - DNA, 36 bp, Homo sapiens; identical to SEQ ID NO: 86201
  misc_feature 1..36: note = chr2:241392394-241392430
  misc_feature 1..36: note = Hyper
  source 1..36: mol_type = genomic DNA

SEQ ID NO: 118997 - DNA, 334 bp, Homo sapiens
  misc_feature 1..334: note = chr2:241393135-241393469
  misc_feature 1..334: note = Hyper
  source 1..334: mol_type = genomic DNA
gtgtccagacccctgcgcacccgctccggctgcgcggtttgccgtcttcgtccctggccgcggcggctggcgactggcatcggggcgcccgggacccccagggcggcgacgctgccgccggtgccgccgagcctttgttccgccgccggggccggtttcacgcctgtcgccctcgcaagcagccgcgggtgacaggagccttagccggcctggggcgcggaccctcccacccggggcagaggtgtccctacgacgcccctcggtttcgggtcgcagtgcgcggcggaggttctgcggcggcggaggggctccttggcgacgctgtcatttgggt

SEQ ID NO: 118998 - DNA, 83 bp, Homo sapiens; identical to SEQ ID NO: 86204
  misc_feature 1..83: note = chr2:241398532-241398615
  misc_feature 1..83: note = Hypo
  source 1..83: mol_type = genomic DNA

SEQ ID NO: 118999 - DNA, 30 bp, Homo sapiens; identical to SEQ ID NO: 86205
  misc_feature 1..30: note = chr2:241515213-241515243
  misc_feature 1..30: note = Hypo
  source 1..30: mol_type = genomic DNA

SEQ ID NO: 119000 - DNA, 118 bp, Homo sapiens; identical to SEQ ID NO: 86206
  misc_feature 1..118: note = chr2:241542135-241542253
  misc_feature 1..118: note = Hypo
  source 1..118: mol_type = genomic DNA

SEQ ID NO: 119001 - DNA, 149 bp, Homo sapiens; identical to SEQ ID NO: 86207
  misc_feature 1..149: note = chr2:241543418-241543567
  misc_feature 1..149: note = Hypo
  source 1..149: mol_type = genomic DNA

SEQ ID NO: 119002 - DNA, 51 bp, Homo sapiens; identical to SEQ ID NO: 86208
  misc_feature 1..51: note = chr2:241544980-241545031
  misc_feature 1..51: note = Hypo
  source 1..51: mol_type = genomic DNA

SEQ ID NO: 119003 - DNA, 33 bp, Homo sapiens; identical to SEQ ID NO: 86209
  misc_feature 1..33: note = chr2:241581574-241581607
  misc_feature 1..33: note = Hypo
  source 1..33: mol_type = genomic DNA

SEQ ID NO: 119004 - DNA, 30 bp, Homo sapiens; identical to SEQ ID NO: 86210
  misc_feature 1..30: note = chr2:241581963-241581993
  misc_feature 1..30: note = Hypo
  source 1..30: mol_type = genomic DNA

SEQ ID NO: 119005 - DNA, 30 bp, Homo sapiens; identical to SEQ ID NO: 86211
  misc_feature 1..30: note = chr2:241642432-241642462
  misc_feature 1..30: note = Hypo
  source 1..30: mol_type = genomic DNA

SEQ ID NO: 119006 - DNA, 179 bp, Homo sapiens; identical to SEQ ID NO: 86212
  misc_feature 1..179: note = chr2:241647044-241647223
  misc_feature 1..179: note = Hypo
  source 1..179: mol_type = genomic DNA

SEQ ID NO: 119007 - DNA, 39 bp, Homo sapiens; identical to SEQ ID NO: 86213
  misc_feature 1..39: note = chr2:241656179-241656218
  misc_feature 1..39: note = Hypo
  source 1..39: mol_type = genomic DNA

SEQ ID NO: 119008 - DNA, 30 bp, Homo sapiens; identical to SEQ ID NO: 86214
  misc_feature 1..30: note = chr2:241657313-241657343
  misc_feature 1..30: note = Hypo
  source 1..30: mol_type = genomic DNA

SEQ ID NO: 119009 - DNA, 73 bp, Homo sapiens; identical to SEQ ID NO: 86215
  misc_feature 1..73: note = chr2:241662384-241662457
  misc_feature 1..73: note = Hypo
  source 1..73: mol_type = genomic DNA

SEQ ID NO: 119010 - DNA, 30 bp, Homo sapiens; identical to SEQ ID NO: 86216
  misc_feature 1..30: note = chr2:241681007-241681037
  misc_feature 1..30: note = Hypo
  source 1..30: mol_type = genomic DNA

SEQ ID NO: 119011 - DNA, 30 bp, Homo sapiens; identical to SEQ ID NO: 86217
  misc_feature 1..30: note = chr2:241717092-241717122
  misc_feature 1..30: note = Hypo
  source 1..30: mol_type = genomic DNA

SEQ ID NO: 119012 - DNA, 53 bp, Homo sapiens; identical to SEQ ID NO: 86218
  misc_feature 1..53: note = chr2:241721534-241721587
  misc_feature 1..53: note = Hypo
  source 1..53: mol_type = genomic DNA

SEQ ID NO: 119013 - DNA, 67 bp, Homo sapiens; identical to SEQ ID NO: 86219
  misc_feature 1..67: note = chr2:241722175-241722242
  misc_feature 1..67: note = Hypo
  source 1..67: mol_type = genomic DNA

SEQ ID NO: 119014 - DNA, 111 bp, Homo sapiens; identical to SEQ ID NO: 86220
  misc_feature 1..111: note = chr2:241729006-241729117
  misc_feature 1..111: note = Hypo
  source 1..111: mol_type = genomic DNA

SEQ ID NO: 119015 - DNA, 2530 bp, Homo sapiens
  misc_feature 1..2530: note = chr2:241758266-241760796
  misc_feature 1..2530: note = Hyper
  source 1..2530: mol_type = genomic DNA
ccgcaagatccaatccgcttgccctggcaggcctttaattccagcaatgcaggcaccccttggaaagggctgacgcttggggaaggggtcctccagtctctgggggaaagtccctattcccggggacgtgggcgcgcatcgggtccgcgccgggcgacgtcgcgctcgcgcccagcaggccccatgacttggcattccctccttcccctccccctcccgcccctgcggccggcagggcccccccaaccccacctaccggcgcccagcgccccgctcctgcggaccctccctcccggcggggatgctgccccggcccttcccagcgagagggcagcgcggctggtttgggggaagtcagcgtgaggagcggcttaaagcgggagtgcgaaggtcttcgcggccactgttccttcgtgtcatccgagcccgggcgccgggggcgcgccgccagcctagaccctgcggccccgcagcccctccctcgccgccgggccacacctgttacaggggcgctggctgctgagacgcaggcagtgctcgccggcggcccctcccaggtgctgggtctttctggaagggagctggggtctctggcgtgggagggggtgatgggcaggccggccgtgcaacgaagcgggtggccaggccccaacgccgcagcccccgccccgcccgcctgttttgctcccggctccagcatccgccctcccccaccccgggaaccggagcagctgcccgcgcccggccgccctgcgcgctctcccctcgggccgaggcgctgcagccgcgcaccctcccaggtgcggcgtcagcgtcctcagccccgctcaccatccctcccctcccccgccgtctgggcgcagcccctcccgcagccccgccggtggctcctctccagggaagcggaatagccggggaagggcgggggtatcccgatcccgccggccgggcgagccctcccgagggcgacccccgcccgcctaagccgagggtcccgctgcagccgagatcgcggcaaagggaccttttccagcggcacctgaagggcggacacccctgaatttcccccattgttctctgcggagatggaggaaggtctggaagtgaaggggcctcgcagtgcctgcgctttgggcggcaacaagggcgccgggccggagctccccgccctgggcgcagtgggtgcaggtgcgggctgcgggcgcgggctgccgggcgcaggtgcggggcgaggggcgcgggcgcgggaggccgggcgggcggcggccttacctctccggcgtcactggcggcggccccgcatgggcactggcatgggcgcgggctctcgagcccggagctgctgccgctcgccggctgctctgcgctgtgacggcgccgccgcgtgacgggctgcgcgcccccggcccggaccgccccgcgcccctcccgaggcgctggttggctgcgcgcggcgtccgagctccagtcgccagctggtttgtcgcgcggggagagggacgggcgacgcggccgccgcggggatggggctggggacggagggggccggggccgggctgtgacgtcaccgctgacaccgcggcgggccccgcggagggtgggggaccgacacccggctcggacgcagcgtcccctcccccggcgtgcccctgagacctcgcgggggagggacccggcggcgccccgtcccgaagccccgcgtgcacctgaacttgcccgcggacccctcgccgggccgtcccccaccctggcccctttcgagtgaaatcgtaaaacgtccacctgcccccgctctgagccagcgacagacgcatcgtggggggcgggcggggctggggagggagggctccttgcgccagggatgctggctccgggtgtaacaggtgcgcggtgaaatcgcatcttgtgtcggggccggggcgccgggggaagagcagcagtgacccaggccctccccgccggatgatgcaacccgcccgcggacccgccgcctcgcctctaccgcggctcgtggggaccccccgccctcctctcgccccacctctccaggcccccattgtcctcaccccagcctgtccagtttaacttccttggacccccaagtcacacgccgctcgggggccaccccggcaaaccccagcctgcgtcacccgcccccagccgccttcctagttccaggggctgactggtatctctgtgcgcgccaccgtcctccctccaccgtcccagggctgggcaacttcgacaaagcctctgggcagctcgcccatgggaacctccccgcactgcggtgcgggggtgcacggatttcgggccaccctgaaccccggggctgggtcccctccagcccagcccctgccatcgagcccctgccatgggcatcctggcgtcgcctggctaagcctccctggcgcccagcaggggcctgcgctgccctagcggcctcgccgttaaccatttcatccacactcctgggagagccggcttcacctcagtcccgacagctgcgtgcgagcgccttgcaggtggc

SEQ ID NO: 119016 - DNA, 280 bp, Homo sapiens; identical to SEQ ID NO: 86224
  misc_feature 1..280: note = chr2:241771102-241771382
  misc_feature 1..280: note = Hyper
  source 1..280: mol_type = genomic DNA

SEQ ID NO: 119017 - DNA, 188 bp, Homo sapiens; identical to SEQ ID NO: 86225
  misc_feature 1..188: note = chr2:241771583-241771771
  misc_feature 1..188: note = Hyper
  source 1..188: mol_type = genomic DNA

SEQ ID NO: 119018 - DNA, 160 bp, Homo sapiens; identical to SEQ ID NO: 86226
  misc_feature 1..160: note = chr2:241771976-241772136
  misc_feature 1..160: note = Hyper
  source 1..160: mol_type = genomic DNA

SEQ ID NO: 119019 - DNA, 41 bp, Homo sapiens; identical to SEQ ID NO: 86227
  misc_feature 1..41: note = chr2:241859518-241859559
  misc_feature 1..41: note = Hypo
  source 1..41: mol_type = genomic DNA

SEQ ID NO: 119020 - DNA, 270 bp, Homo sapiens; identical to SEQ ID NO: 86228
  misc_feature 1..270: note = chr2:241861858-241862128
  misc_feature 1..270: note = Hypo
  source 1..270: mol_type = genomic DNA

SEQ ID NO: 119021 - DNA, 145 bp, Homo sapiens; identical to SEQ ID NO: 86229
  misc_feature 1..145: note = chr2:241862358-241862503
  misc_feature 1..145: note = Hypo
  source 1..145: mol_type = genomic DNA

SEQ ID NO: 119022 - DNA, 671 bp, Homo sapiens; identical to SEQ ID NO: 39818
  misc_feature 1..671: note = chr2:241864757-241865428
  misc_feature 1..671: note = Hypo
  source 1..671: mol_type = genomic DNA

SEQ ID NO: 119023 - DNA, 30 bp, Homo sapiens; identical to SEQ ID NO: 86231
  misc_feature 1..30: note = chr2:241868098-241868128
  misc_feature 1..30: note = Hypo
  source 1..30: mol_type = genomic DNA

SEQ ID NO: 119024 - DNA, 30 bp, Homo sapiens; identical to SEQ ID NO: 86232
  misc_feature 1..30: note = chr2:241873900-241873930
  misc_feature 1..30: note = Hypo
  source 1..30: mol_type = genomic DNA

SEQ ID NO: 119025 - DNA, 89 bp, Homo sapiens; identical to SEQ ID NO: 86233
  misc_feature 1..89: note = chr2:241874844-241874933
  misc_feature 1..89: note = Hypo
  source 1..89: mol_type = genomic DNA

SEQ ID NO: 119026 - DNA, 146 bp, Homo sapiens; identical to SEQ ID NO: 86234
  misc_feature 1..146: note = chr2:241896932-241897078
  misc_feature 1..146: note = Hypo
  source 1..146: mol_type = genomic DNA

SEQ ID NO: 119027 - DNA, 224 bp, Homo sapiens; identical to SEQ ID NO: 86235
  misc_feature 1..224: note = chr2:241937658-241937882
  misc_feature 1..224: note = Hyper
  source 1..224: mol_type = genomic DNA

SEQ ID NO: 119028 - DNA, 86 bp, Homo sapiens; identical to SEQ ID NO: 86236
  misc_feature 1..86: note = chr2:241938205-241938291
  misc_feature 1..86: note = Hyper
  source 1..86: mol_type = genomic DNA

SEQ ID NO: 119029 - DNA, 30 bp, Homo sapiens; identical to SEQ ID NO: 86237
  misc_feature 1..30: note = chr2:241971172-241971202
  misc_feature 1..30: note = Hypo
  source 1..30: mol_type = genomic DNA

SEQ ID NO: 119030 - DNA, 30 bp, Homo sapiens; identical to SEQ ID NO: 86238
  misc_feature 1..30: note = chr2:241989234-241989264
  misc_feature 1..30: note = Hypo
  source 1..30: mol_type = genomic DNA

SEQ ID NO: 119031 - DNA, 307 bp, Homo sapiens; identical to SEQ ID NO: 86239
  misc_feature 1..307: note = chr2:242004869-242005176
  misc_feature 1..307: note = Hypo
  source 1..307: mol_type = genomic DNA

SEQ ID NO: 119032 - DNA, 105 bp, Homo sapiens; identical to SEQ ID NO: 86240
  misc_feature 1..105: note = chr2:242006589-242006694
  misc_feature 1..105: note = Hypo
  source 1..105: mol_type = genomic DNA

SEQ ID NO: 119033 - DNA, 314 bp, Homo sapiens; identical to SEQ ID NO: 86241
  misc_feature 1..314: note = chr2:242009344-242009658
  misc_feature 1..314: note = Hypo
  source 1..314: mol_type = genomic DNA

SEQ ID NO: 119034 - DNA, 30 bp, Homo sapiens; identical to SEQ ID NO: 39822
  misc_feature 1..30: note = chr2:242011200-242011230
  misc_feature 1..30: note = Hypo
  source 1..30: mol_type = genomic DNA

SEQ ID NO: 119035 - DNA, 122 bp, Homo sapiens; identical to SEQ ID NO: 86243
  misc_feature 1..122: note = chr2:242011442-242011564
  misc_feature 1..122: note = Hypo
  source 1..122: mol_type = genomic DNA

SEQ ID NO: 119036 - DNA, 70 bp, Homo sapiens; identical to SEQ ID NO: 39823
  misc_feature 1..70: note = chr2:242021761-242021831
  misc_feature 1..70: note = Hypo
  source 1..70: mol_type = genomic DNA

SEQ ID NO: 119037 - DNA, 30 bp, Homo sapiens; identical to SEQ ID NO: 86245
  misc_feature 1..30: note = chr2:242022435-242022465
  misc_feature 1..30: note = Hypo
  source 1..30: mol_type = genomic DNA

SEQ ID NO: 119038 - DNA, 59 bp, Homo sapiens; identical to SEQ ID NO: 86246
  misc_feature 1..59: note = chr2:242128768-242128827
  misc_feature 1..59: note = Hypo
  source 1..59: mol_type = genomic DNA

SEQ ID NO: 119039 - DNA, 30 bp, Homo sapiens; identical to SEQ ID NO: 86247
  misc_feature 1..30: note = chr2:242129507-242129537
  misc_feature 1..30: note = Hypo
  source 1..30: mol_type = genomic DNA

SEQ ID NO: 119040 - DNA, 30 bp, Homo sapiens; identical to SEQ ID NO: 39825
  misc_feature 1..30: note = chr2:242131916-242131946
  misc_feature 1..30: note = Hypo
  source 1..30: mol_type = genomic DNA

SEQ ID NO: 119041 - DNA, 164 bp, Homo sapiens; identical to SEQ ID NO: 86249
  misc_feature 1..164: note = chr2:242138184-242138348
  misc_feature 1..164: note = Hypo
  source 1..164: mol_type = genomic DNA

SEQ ID NO: 119042 - DNA, 30 bp, Homo sapiens; identical to SEQ ID NO: 86250
  misc_feature 1..30: note = chr2:242143600-242143630
  misc_feature 1..30: note = Hypo
  source 1..30: mol_type = genomic DNA

SEQ ID NO: 119043 - DNA, 190 bp, Homo sapiens; identical to SEQ ID NO: 86251
  misc_feature 1..190: note = chr2:242148690-242148880
  misc_feature 1..190: note = Hypo
  source 1..190: mol_type = genomic DNA

SEQ ID NO: 119044 - DNA, 143 bp, Homo sapiens; identical to SEQ ID NO: 86252
  misc_feature 1..143: note = chr2:242153667-242153810
  misc_feature 1..143: note = Hypo
  source 1..143: mol_type = genomic DNA

SEQ ID NO: 119045 - DNA, 122 bp, Homo sapiens; identical to SEQ ID NO: 86253
  misc_feature 1..122: note = chr2:242156554-242156676
  misc_feature 1..122: note = Hypo
  source 1..122: mol_type = genomic DNA

SEQ ID NO: 119046 - DNA, 159 bp, Homo sapiens; identical to SEQ ID NO: 86254
  misc_feature 1..159: note = chr2:242294167-242294326
  misc_feature 1..159: note = Hypo
  source 1..159: mol_type = genomic DNA

SEQ ID NO: 119047 - DNA, 147 bp, Homo sapiens; identical to SEQ ID NO: 86257
  misc_feature 1..147: note = chr2:242436356-242436503
  misc_feature 1..147: note = Hypo
  source 1..147: mol_type = genomic DNA

SEQ ID NO: 119048 - DNA, 30 bp, Homo sapiens; identical to SEQ ID NO: 86258
  misc_feature 1..30: note = chr2:242439539-242439569
  misc_feature 1..30: note = Hypo
  source 1..30: mol_type = genomic DNA

SEQ ID NO: 119049 - DNA, 47 bp, Homo sapiens; identical to SEQ ID NO: 86259
  misc_feature 1..47: note = chr2:242448500-242448547
  misc_feature 1..47: note = Hyper
  source 1..47: mol_type = genomic DNA

SEQ ID NO: 119050 - DNA, 89 bp, Homo sapiens; identical to SEQ ID NO: 86260
  misc_feature 1..89: note = chr2:242467414-242467503
  misc_feature 1..89: note = Hypo
  source 1..89: mol_type = genomic DNA

SEQ ID NO: 119051 - DNA, 46 bp, Homo sapiens; identical to SEQ ID NO: 86261
  misc_feature 1..46: note = chr2:242472490-242472536
  misc_feature 1..46: note = Hypo
  source 1..46: mol_type = genomic DNA

SEQ ID NO: 119052 - DNA, 513 bp, Homo sapiens
  misc_feature 1..513: note = chr2:242498287-242498800
  misc_feature 1..513: note = Hyper
  source 1..513: mol_type = genomic DNA
ggcgccggggcggggcgcgcgtcctcgcgggtctgaatggaagggtcgaggtcgtcgtcggcggcgagcagatcctgaagccagaactccaccccggcgcccgcgccatgcggcgggagaggtgagcgcggcgggcgtggcgtccgtgccggggtgcccggggtgccacgggaacggcgaggccggggacacgcgcgcaggacgccagcggcggaggtgggcggccccgggccggggcggggagggccgggtcctggcagtcgccgtgggggacgcgctgggctgtgccctccgcccccgccgcccacgcactcgtcttcgagggcgggcccggcggccccggagcaaaccgccgtctccccgcggccccaccggtccctggcagcctcggggaatgtctgtagctgaattcgggctctgaaagaaggtggcgctgggtttttaaagatttggggcacaaaaaacgagagcggacccggcgccggctacggcccttcccgagggccacgccca

SEQ ID NO: 119053 - DNA, 91 bp, Homo sapiens; identical to SEQ ID NO: 86263
  misc_feature 1..91: note = chr2:242499035-242499126
  misc_feature 1..91: note = Hyper
  source 1..91: mol_type = genomic DNA

SEQ ID NO: 119054 - DNA, 30 bp, Homo sapiens; identical to SEQ ID NO: 86264
  misc_feature 1..30: note = chr2:242501690-242501720
  misc_feature 1..30: note = Hypo
  source 1..30: mol_type = genomic DNA

SEQ ID NO: 119055 - DNA, 134 bp, Homo sapiens; identical to SEQ ID NO: 86265
  misc_feature 1..134: note = chr2:242523955-242524089
  misc_feature 1..134: note = Hypo
  source 1..134: mol_type = genomic DNA

SEQ ID NO: 119056 - DNA, 37 bp, Homo sapiens; identical to SEQ ID NO: 86266
  misc_feature 1..37: note = chr2:242524369-242524406
  misc_feature 1..37: note = Hypo
  source 1..37: mol_type = genomic DNA

SEQ ID NO: 119057 - DNA, 51 bp, Homo sapiens; identical to SEQ ID NO: 86267
  misc_feature 1..51: note = chr2:242549626-242549677
  misc_feature 1..51: note = Hyper
  source 1..51: mol_type = genomic DNA

SEQ ID NO: 119058 - DNA, 120 bp, Homo sapiens; identical to SEQ ID NO: 86268
  misc_feature 1..120: note = chr2:242550007-242550127
  misc_feature 1..120: note = Hyper
  source 1..120: mol_type = genomic DNA

SEQ ID NO: 119059 - DNA, 75 bp, Homo sapiens; identical to SEQ ID NO: 86269
  misc_feature 1..75: note = chr2:242554549-242554624
  misc_feature 1..75: note = Hypo
  source 1..75: mol_type = genomic DNA

SEQ ID NO: 119060 - DNA, 124 bp, Homo sapiens; identical to SEQ ID NO: 86270
  misc_feature 1..124: note = chr2:242598673-242598797
  misc_feature 1..124: note = Hypo
  source 1..124: mol_type = genomic DNA

SEQ ID NO: 119061 - DNA, 99 bp, Homo sapiens; identical to SEQ ID NO: 86271
  misc_feature 1..99: note = chr2:242602250-242602349
  misc_feature 1..99: note = Hypo
  source 1..99: mol_type = genomic DNA

SEQ ID NO: 119062 - DNA, 30 bp, Homo sapiens; identical to SEQ ID NO: 86272
  misc_feature 1..30: note = chr2:242617894-242617924
  misc_feature 1..30: note = Hypo
  source 1..30: mol_type = genomic DNA

SEQ ID NO: 119063 - DNA, 39 bp, Homo sapiens; identical to SEQ ID NO: 86273
  misc_feature 1..39: note = chr2:242625092-242625131
  misc_feature 1..39: note = Hypo
  source 1..39: mol_type = genomic DNA

SEQ ID NO: 119064 - DNA, 120 bp, Homo sapiens; identical to SEQ ID NO: 86274
  misc_feature 1..120: note = chr2:242636865-242636985
  misc_feature 1..120: note = Hypo
  source 1..120: mol_type = genomic DNA

SEQ ID NO: 119065 - DNA, 87 bp, Homo sapiens; identical to SEQ ID NO: 86275
  misc_feature 1..87: note = chr2:242637045-242637132
  misc_feature 1..87: note = Hypo
  source 1..87: mol_type = genomic DNA

SEQ ID NO: 119066 - DNA, 71 bp, Homo sapiens; identical to SEQ ID NO: 39832
  misc_feature 1..71: note = chr2:242672951-242673022
  misc_feature 1..71: note = Hypo
  source 1..71: mol_type = genomic DNA

SEQ ID NO: 119067 - DNA, 30 bp, Homo sapiens; identical to SEQ ID NO: 86277
  misc_feature 1..30: note = chr2:242714055-242714085
  misc_feature 1..30: note = Hypo
  source 1..30: mol_type = genomic DNA

SEQ ID NO: 119068 - DNA, 30 bp, Homo sapiens; identical to SEQ ID NO: 86278
  misc_feature 1..30: note = chr2:242716305-242716335
  misc_feature 1..30: note = Hypo
  source 1..30: mol_type = genomic DNA

SEQ ID NO: 119069 - DNA, 89 bp, Homo sapiens; identical to SEQ ID NO: 86280
  misc_feature 1..89: note = chr2:242735157-242735246
  misc_feature 1..89: note = Hypo
  source 1..89: mol_type = genomic DNA

SEQ ID NO: 119070 - DNA, 782 bp, Homo sapiens; identical to SEQ ID NO: 86281
  misc_feature 1..782: note = chr2:242755844-242756626
  misc_feature 1..782: note = Hypo
  source 1..782: mol_type = genomic DNA

SEQ ID NO: 119071 - DNA, 180 bp, Homo sapiens; identical to SEQ ID NO: 86282
  misc_feature 1..180: note = chr2:242757477-242757657
  misc_feature 1..180: note = Hypo
  source 1..180: mol_type = genomic DNA

SEQ ID NO: 119072 - DNA, 53 bp, Homo sapiens; identical to SEQ ID NO: 86283
  misc_feature 1..53: note = chr2:242762778-242762831
  misc_feature 1..53: note = Hypo
  source 1..53: mol_type = genomic DNA

SEQ ID NO: 119073 - DNA, 60 bp, Homo sapiens; identical to SEQ ID NO: 86284
  misc_feature 1..60: note = chr2:242763132-242763192
  misc_feature 1..60: note = Hypo
  source 1..60: mol_type = genomic DNA

SEQ ID NO: 119074 - DNA, 99 bp, Homo sapiens; identical to SEQ ID NO: 86285
  misc_feature 1..99: note = chr2:242766114-242766213
  misc_feature 1..99: note = Hypo
  source 1..99: mol_type = genomic DNA

SEQ ID NO: 119075 - DNA, 132 bp, Homo sapiens; identical to SEQ ID NO: 86286
  misc_feature 1..132: note = chr2:242784279-242784411
  misc_feature 1..132: note = Hypo
  source 1..132: mol_type = genomic DNA

SEQ ID NO: 119076 - DNA, 39 bp, Homo sapiens; identical to SEQ ID NO: 39837
  misc_feature 1..39: note = chr2:242791597-242791636
  misc_feature 1..39: note = Hypo
  source 1..39: mol_type = genomic DNA

SEQ ID NO: 119077 - DNA, 244 bp, Homo sapiens; identical to SEQ ID NO: 86288
  misc_feature 1..244: note = chr2:242794852-242795096
  misc_feature 1..244: note = Hypo
  source 1..244: mol_type = genomic DNA

SEQ ID NO: 119078 - DNA, 30 bp, Homo sapiens; identical to SEQ ID NO: 39839
  misc_feature 1..30: note = chr2:242814897-242814927
  misc_feature 1..30: note = Hypo
  source 1..30: mol_type = genomic DNA

SEQ ID NO: 119079 - DNA, 111 bp, Homo sapiens; identical to SEQ ID NO: 86290
  misc_feature 1..111: note = chr2:242815269-242815380
  misc_feature 1..111: note = Hypo
  source 1..111: mol_type = genomic DNA

SEQ ID NO: 119080 - DNA, 30 bp, Homo sapiens; identical to SEQ ID NO: 86291
  misc_feature 1..30: note = chr2:242827465-242827495
  misc_feature 1..30: note = Hypo
  source 1..30: mol_type = genomic DNA

SEQ ID NO: 119081 - DNA, 30 bp, Homo sapiens; identical to SEQ ID NO: 86292
  misc_feature 1..30: note = chr2:242829172-242829202
  misc_feature 1..30: note = Hypo
  source 1..30: mol_type = genomic DNA

SEQ ID NO: 119082 - DNA, 30 bp, Homo sapiens; identical to SEQ ID NO: 86293
  misc_feature 1..30: note = chr2:242829930-242829960
  misc_feature 1..30: note = Hypo
  source 1..30: mol_type = genomic DNA

SEQ ID NO: 119083 - DNA, 388 bp, Homo sapiens; identical to SEQ ID NO: 86294
  misc_feature 1..388: note = chr2:242832880-242833268
  misc_feature 1..388: note = Hypo
  source 1..388: mol_type = genomic DNA

SEQ ID NO: 119084 - DNA, 363 bp, Homo sapiens; identical to SEQ ID NO: 86295
  misc_feature 1..363: note = chr2:242833478-242833841
  misc_feature 1..363: note = Hypo
  source 1..363: mol_type = genomic DNA

SEQ ID NO: 119085 - DNA, 247 bp, Homo sapiens; identical to SEQ ID NO: 86296
  misc_feature 1..247: note = chr2:242836393-242836640
  misc_feature 1..247: note = Hypo
  source 1..247: mol_type = genomic DNA

SEQ ID NO: 119086 - DNA, 30 bp, Homo sapiens; identical to SEQ ID NO: 86297
  misc_feature 1..30: note = chr2:242849495-242849525
  misc_feature 1..30: note = Hypo
  source 1..30: mol_type = genomic DNA

SEQ ID NO: 119087 - DNA, 60 bp, Homo sapiens; identical to SEQ ID NO: 86298
  misc_feature 1..60: note = chr2:242890284-242890344
  misc_feature 1..60: note = Hypo
  source 1..60: mol_type = genomic DNA

SEQ ID NO: 119088 - DNA, 84 bp, Homo sapiens; identical to SEQ ID NO: 86299
  misc_feature 1..84: note = chr2:242891217-242891301
  misc_feature 1..84: note = Hypo
  source 1..84: mol_type = genomic DNA

SEQ ID NO: 119089 - DNA, 172 bp, Homo sapiens; identical to SEQ ID NO: 86300
  misc_feature 1..172: note = chr2:242891535-242891707
  misc_feature 1..172: note = Hypo
  source 1..172: mol_type = genomic DNA

SEQ ID NO: 119090 - DNA, 30 bp, Homo sapiens; identical to SEQ ID NO: 39845
  misc_feature 1..30: note = chr2:242892372-242892402
  misc_feature 1..30: note = Hypo
  source 1..30: mol_type = genomic DNA

SEQ ID NO: 119091 - DNA, 38 bp, Homo sapiens; identical to SEQ ID NO: 86302
  misc_feature 1..38: note = chr2:242913228-242913266
  misc_feature 1..38: note = Hypo
  source 1..38: mol_type = genomic DNA

SEQ ID NO: 119092 - DNA, 180 bp, Homo sapiens; identical to SEQ ID NO: 86303
  misc_feature 1..180: note = chr2:242925496-242925676
  misc_feature 1..180: note = Hypo
  source 1..180: mol_type = genomic DNA

SEQ ID NO: 119093 - DNA, 159 bp, Homo sapiens; identical to SEQ ID NO: 86304
  misc_feature 1..159: note = chr2:242929019-242929178
  misc_feature 1..159: note = Hypo
  source 1..159: mol_type = genomic DNA

SEQ ID NO: 119094 - DNA, 39 bp, Homo sapiens; identical to SEQ ID NO: 86305
  misc_feature 1..39: note = chr2:242930454-242930493
  misc_feature 1..39: note = Hypo
  source 1..39: mol_type = genomic DNA

SEQ ID NO: 119095 - DNA, 30 bp, Homo sapiens; identical to SEQ ID NO: 86306
  misc_feature 1..30: note = chr2:242933429-242933459
  misc_feature 1..30: note = Hypo
  source 1..30: mol_type = genomic DNA

SEQ ID NO: 119096 - DNA, 30 bp, Homo sapiens; identical to SEQ ID NO: 86307
  misc_feature 1..30: note = chr2:242948345-242948375
  misc_feature 1..30: note = Hypo
  source 1..30: mol_type = genomic DNA

SEQ ID NO: 119097 - DNA, 131 bp, Homo sapiens; identical to SEQ ID NO: 86308
  misc_feature 1..131: note = chr2:242985060-242985191
  misc_feature 1..131: note = Hypo
  source 1..131: mol_type = genomic DNA

SEQ ID NO: 119098 - DNA, 99 bp, Homo sapiens; identical to SEQ ID NO: 87264
  misc_feature 1..99: note = chr20:244370-244469
  misc_feature 1..99: note = Hypo
  source 1..99: mol_type = genomic DNA

SEQ ID NO: 119099 - DNA, 36 bp, Homo sapiens; identical to SEQ ID NO: 87330
  misc_feature 1..36: note = chr20:276977-277013
  misc_feature 1..36: note = Hypo
  source 1..36: mol_type = genomic DNA

SEQ ID NO: 119100 - DNA, 321 bp, Homo sapiens
  misc_feature 1..321: note = chr20:291052-291373
  misc_feature 1..321: note = Hyper
  source 1..321: mol_type = genomic DNA
cccccaaatccaggccgccctgccccctccggaaaggggagttgggggcgagcgccgaaatctgagtggctctttcaagcctccgttgccatagaaaccggccgcacaggccgatgctgtccattacaccatcctctagcctcgcagccaatggactccgagctccatcgccagaggccccgccccccagctctggggagtccaccaatcagcaggtcccgtgacttagagccctgccctcggcccagggacaccaccaatgcgcttcgaccctgccctccttctcttcggtgtaacaagaagactcgatatttttttttt

SEQ ID NO: 119101 - DNA, 40 bp, Homo sapiens; identical to SEQ ID NO: 87364
  misc_feature 1..40: note = chr20:304445-304485
  misc_feature 1..40: note = Hypo
  source 1..40: mol_type = genomic DNA

SEQ ID NO: 119102 - DNA, 182 bp, Homo sapiens; identical to SEQ ID NO: 87433
  misc_feature 1..182: note = chr20:327689-327871
  misc_feature 1..182: note = Hyper
  source 1..182: mol_type = genomic DNA

SEQ ID NO: 119103 - DNA, 250 bp, Homo sapiens; identical to SEQ ID NO: 87544
  misc_feature 1..250: note = chr20:399939-400189
  misc_feature 1..250: note = Hypo
  source 1..250: mol_type = genomic DNA

SEQ ID NO: 119104 - DNA, 1155 bp, Homo sapiens; identical to SEQ ID NO: 87550
  misc_feature 1..1155: note = chr20:401016-402171
  misc_feature 1..1155: note = Hypo
  source 1..1155: mol_type = genomic DNA

SEQ ID NO: 119105 - DNA, 821 bp, Homo sapiens
  misc_feature 1..821: note = chr20:590311-591132
  misc_feature 1..821: note = Hyper
  source 1..821: mol_type = genomic DNA
cctaccccgacctggcggccgcagcgagggacgcagcacactcacccccttgcgctggttgctgaggcagaaggtgcagatggagcgcggctggcggccgccgtcggcggcggcggggacggcgcccttggcactgcccgcggcacggaagcacggctgcccgtcgtcggccgagtcgcccagcagcagcacgttggccaggtgcgcgatgtagctggacgccaggcgcacggtctcgatcttggacagcttgcggtccaccggctcggtggggatgagcgtgcgcagcgccgtgaaggccgtgttcacgctctgagtgcggtcccgctcccgcgcgttggccgcctgccgctgtcgcaccaccaccacggggcccgcgccgccgccgccgcccgcccgccgcccgcccccggggcccgggccgcgccgcgccgcctccgggccctcgcagcagccgaacgactggtccgacgcgtcgctctcgctgcggttctcctcgtcctcgctcagcagccgcacgtccgggtacagcacgtgcgcgccgacgggccgcagcagcgcgaacgccatgggcgccggccgcgtccctccgtgcgccgcgtcccagcgtcggccgcgccccgccgtgcgctcccgcgcgctcccacggccccgccggcccccgccttataggcgagggaggggccaatggcaaggccgccccggccgggggcggagggctccgcccggccaatggggaggcgtccgcccggccaatggggaggcgtccgccgcgccctggccaatggcgacgctcccaccgcctccgtcccccaggttga

SEQ ID NO: 119106 - DNA, 193 bp, Homo sapiens
  misc_feature 1..193: note = chr20:592405-592598
  misc_feature 1..193: note = Hyper
  source 1..193: mol_type = genomic DNA
cctggatccccccaccgccagcatttgaccgtgaccccagccaggctgggctttggggaggagggaaacagccagcatgggccccctccccgcagggctggtcccacacacagccccagaccaggctgctgcttcctgagccgatgaattattaccgggagatttccttccctgtctgcgcctcctcacaggg

SEQ ID NO: 119107 - DNA, 30 bp, Homo sapiens; identical to SEQ ID NO: 88333
  misc_feature 1..30: note = chr20:620674-620704
  misc_feature 1..30: note = Hypo
  source 1..30: mol_type = genomic DNA

SEQ ID NO: 119108 - DNA, 30 bp, Homo sapiens; identical to SEQ ID NO: 88396
  misc_feature 1..30: note = chr20:624100-624130
  misc_feature 1..30: note = Hypo
  source 1..30: mol_type = genomic DNA

SEQ ID NO: 119109 - DNA, 1253 bp, Homo sapiens
  misc_feature 1..1253: note = chr20:644114-645367
  misc_feature 1..1253: note = Hyper
  source 1..1253: mol_type = genomic DNA
ggacgctggggaagacggtgtggaagtgagtcgtgggtttgggggttggggagaaaagttccgggccgggccgggggtccccacgagagggtcatgggcagggaaacgcagccggggctgggcgagggcgctgcgggcgcaggtagggggcccggggcgcgtggagagcgagttccgggcgcgagggcgaggcggaaggctcagctggccgggccggcgggggtcggcgggggtggctcggccgccttggcgcaggccgcctcgcagtgcttgtggaggtaggacttgagcgcgaagctcttgtcgcactggcggcagcggtagtgcttgaaggccgagtgcgtctgcatgtgcgcgcgcaggttggagcggtcggcgaaggccttgccgcagtgcgcgcagccgaacggcttttcgccggtgtgcgagcgcatgtgaccctgcagcagccagggccgcgagaaggccttgccgcagacgccgcacttgtggcgcaggttgtgcgtgagcaggtgcatggcgagcgcgggcatggacacgtaggccttgccgcacgtcgggcatttgcgcgccagctggctgtccaggctgcggtgcgtctgcttgtggcggctcaggttcgacgacgtggcgtaggtcttgccgcactcggcgcacgcgtgccggtgcccgccgcccgcctgcgcccccgcgcgccccgcgcgccccccggcgccccccgcgtctcccgagccccccgcgtccccgccgcccccgccccgccgccgccgcgagcgcccgtccgagatgaagaaggcgtccatggagtagctgtcggtcactgccgcctcccctcggaagtagcgcgccgacaggctcgactgcgggctttcggggtcgctgtactcctccggcgccgccggcgggtacgcgggctcggccggggccagctccaggcccggcttctggtccgcatcgtagctgctcgggggcaggcggtgcggggcgtaccctggagggggcgagaagtggaggggcggtgagaggaggcgccgaagagggtttcccgctttgagcgcgtcaccctttgcgccttccagcttggcgcccctgtggcagctccgacagtggtggtctccgacctgcacctcagctcttcctgtcaggcagcctgggttcaattccttcctccatcgacggcagtgcaaatagccgccaccccaacccacggagcatggggccagcacggttgtacagagcgtaccttcactatc

SEQ ID NO: 119110 - DNA, 63 bp, Homo sapiens; identical to SEQ ID NO: 88455
  misc_feature 1..63: note = chr20:656222-656285
  misc_feature 1..63: note = Hyper
  source 1..63: mol_type = genomic DNA

SEQ ID NO: 119111 - DNA, 155 bp, Homo sapiens; identical to SEQ ID NO: 88456
  misc_feature 1..155: note = chr20:656542-656697
  misc_feature 1..155: note = Hyper
  source 1..155: mol_type = genomic DNA

SEQ ID NO: 119112 - DNA, 188 bp, Homo sapiens; identical to SEQ ID NO: 88457
  misc_feature 1..188: note = chr20:656937-657125
  misc_feature 1..188: note = Hyper
  source 1..188: mol_type = genomic DNA

SEQ ID NO: 119113 - DNA, 27 bp, Homo sapiens
  misc_feature 1..27: note = chr20:673796-673823
  misc_feature 1..27: note = Hypo
  source 1..27: mol_type = genomic DNA
cagaaaactaggactcggacacaccag

SEQ ID NO: 119114 - DNA, 86 bp, Homo sapiens; identical to SEQ ID NO: 88459
  misc_feature 1..86: note = chr20:673883-673969
  misc_feature 1..86: note = Hypo
  source 1..86: mol_type = genomic DNA

SEQ ID NO: 119115 - DNA, 30 bp, Homo sapiens; identical to SEQ ID NO: 88462
  misc_feature 1..30: note = chr20:688324-688354
  misc_feature 1..30: note = Hypo
  source 1..30: mol_type = genomic DNA

SEQ ID NO: 119116 - DNA, 224 bp, Homo sapiens; identical to SEQ ID NO: 88463
  misc_feature 1..224: note = chr20:690677-690901
  misc_feature 1..224: note = Hyper
  source 1..224: mol_type = genomic DNA

SEQ ID NO: 119117 - DNA, 251 bp, Homo sapiens; identical to SEQ ID NO: 88464
  misc_feature 1..251: note = chr20:708600-708851
  misc_feature 1..251: note = Hyper
  source 1..251: mol_type = genomic DNA

SEQ ID NO: 119118 - DNA, 213 bp, Homo sapiens; identical to SEQ ID NO: 88465
  misc_feature 1..213: note = chr20:741858-742071
  misc_feature 1..213: note = Hypo
  source 1..213: mol_type = genomic DNA

SEQ ID NO: 119119 - DNA, 30 bp, Homo sapiens; identical to SEQ ID NO: 88467
  misc_feature 1..30: note = chr20:796141-796171
  misc_feature 1..30: note = Hypo
  source 1..30: mol_type = genomic DNA

SEQ ID NO: 119120 - DNA, 45 bp, Homo sapiens; identical to SEQ ID NO: 46068
  misc_feature 1..45: note = chr20:799104-799149
  misc_feature 1..45: note = Hypo
  source 1..45: mol_type = genomic DNA

SEQ ID NO: 119121 - DNA, 44 bp, Homo sapiens; identical to SEQ ID NO: 46069
  misc_feature 1..44: note = chr20:799689-799733
  misc_feature 1..44: note = Hypo
  source 1..44: mol_type = genomic DNA

SEQ ID NO: 119122 - DNA, 30 bp, Homo sapiens; identical to SEQ ID NO: 88471
  misc_feature 1..30: note = chr20:848500-848530
  misc_feature 1..30: note = Hypo
  source 1..30: mol_type = genomic DNA

SEQ ID NO: 119123 - DNA, 108 bp, Homo sapiens; identical to SEQ ID NO: 88472
  misc_feature 1..108: note = chr20:865993-866101
  misc_feature 1..108: note = Hyper
  source 1..108: mol_type = genomic DNA

SEQ ID NO: 119124 - DNA, 547 bp, Homo sapiens
  misc_feature 1..547: note = chr20:982661-983208
  misc_feature 1..547: note = Hyper
  source 1..547: mol_type = genomic DNA
cggtcctccggcccccggtctgccccgcagcgcctgcccggccgccctgcccagccaccccttgtaccttgcttcttccttcggttcagggcgagcatgtccacggcgtgggcgacgagcaggagcaggcagagtggcgcccgcatctgggcagccggatccgggctggcgctccccaggcggcccgacggcccaagggccccacgtcccggcggcggcacggcgggcgcgggggctgctgtgggcgcgccgggcgcatccgccaggcgcgggtcggtccggccgccaggtctagtgagggcgttggcggagccggggcactgccctggcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcaggtacagatgc

SEQ ID NO: 119125 - DNA, 30 bp, Homo sapiens; identical to SEQ ID NO: 87098
  misc_feature 1..30: note = chr20:1165419-1165449
  misc_feature 1..30: note = Hyper
  source 1..30: mol_type = genomic DNA

SEQ ID NO: 119126 - DNA, 30 bp, Homo sapiens; identical to SEQ ID NO: 87100
  misc_feature 1..30: note = chr20:1167086-1167116
  misc_feature 1..30: note = Hypo
  source 1..30: mol_type = genomic DNA

SEQ ID NO: 119127 - DNA, 68 bp, Homo sapiens; identical to SEQ ID NO: 87102
  misc_feature 1..68: note = chr20:1206095-1206163
  misc_feature 1..68: note = Hyper
  source 1..68: mol_type = genomic DNA

SEQ ID NO: 119128 - DNA, 507 bp, Homo sapiens; identical to SEQ ID NO: 87103
  misc_feature 1..507: note = chr20:1206684-1207191
  misc_feature 1..507: note = Hyper
  source 1..507: mol_type = genomic DNA

SEQ ID NO: 119129 - DNA, 156 bp, Homo sapiens; identical to SEQ ID NO: 87108
  misc_feature 1..156: note = chr20:1323452-1323608
  misc_feature 1..156: note = Hypo
  source 1..156: mol_type = genomic DNA

SEQ ID NO: 119130 - DNA, 30 bp, Homo sapiens; identical to SEQ ID NO: 87111
  misc_feature 1..30: note = chr20:1644048-1644078
  misc_feature 1..30: note = Hypo
  source 1..30: mol_type = genomic DNA

SEQ ID NO: 119131 - DNA, 91 bp, Homo sapiens; identical to SEQ ID NO: 87114
  misc_feature 1..91: note = chr20:1692213-1692304
  misc_feature 1..91: note = Hypo
  source 1..91: mol_type = genomic DNA

SEQ ID NO: 119132 - DNA, 1139 bp, Homo sapiens
  misc_feature 1..1139: note = chr20:1783321-1784460
  misc_feature 1..1139: note = Hyper
  source 1..1139: mol_type = genomic DNA
tccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaagggctgctgggaaaaaggcggatttcaaaggagaagcagctaaggaaaagctctggaaagggccaacggagcggatattcccggagcccctctgcgagccacgcgcccctctgggaagcccgcttccccctgcagacaggcgctgtgacacgcttgcgccccggtcgaacaggcgaagaggccgaggcccagagcggcgcagggcgagcctggaggctgcgccccagacctggaccagccacggacgccgctcccgccgctccctccgctccgctgcgctccgcacgctggcgccggctccccgaggccccgggcgccccggccgcacgcctgggtaaaaggtcccgaggagtccgcagaagcgcgcccacgcccgagacggccgtttccgccggcctgggaaaggggcggagaagggggtcgcccgggccgcagcgtgccggtccccgccggccgagccgtgtttggggccagtccccgcaccccgcttcttccccacctggggagcggggcgccgcggtaggggcactggagcgcacgatgcaccccgccaacgagtcctttctgcagacggggttcctgttttcatgcaaatgcctttgttagcgcaccgggaaccagggggacggaactgcagctgacgcgggctgcgcgccgcttttccgccttcgcttgattcggcctcaacgacttaaacgcgcc

SEQ ID NO: 119133 - DNA, 165 bp, Homo sapiens; identical to SEQ ID NO: 87141
  misc_feature 1..165: note = chr20:1856228-1856393
  misc_feature 1..165: note = Hypo
  source 1..165: mol_type = genomic DNA

SEQ ID NO: 119134 - DNA, 32 bp, Homo sapiens; identical to SEQ ID NO: 87155
  misc_feature 1..32: note = chr20:2002327-2002359
  misc_feature 1..32: note = Hypo
  source 1..32: mol_type = genomic DNA

SEQ ID NO: 119135 - DNA, 120 bp, Homo sapiens; identical to SEQ ID NO: 87168
  misc_feature 1..120: note = chr20:2058784-2058904
  misc_feature 1..120: note = Hypo
  source 1..120: mol_type = genomic DNA

SEQ ID NO: 119136 - DNA, 147 bp, Homo sapiens; identical to SEQ ID NO: 5237
  misc_feature 1..147: note = chr20:2113428-2113575
  misc_feature 1..147: note = Hypo
  source 1..147: mol_type = genomic DNA

SEQ ID NO: 119137 - DNA, 323 bp, Homo sapiens; identical to SEQ ID NO: 87233
  misc_feature 1..323: note = chr20:2187713-2188036
  misc_feature 1..323: note = Hyper
  source 1..323: mol_type = genomic DNA

SEQ ID NO: 119138 - DNA, 30 bp, Homo sapiens; identical to SEQ ID NO: 87263
  misc_feature 1..30: note = chr20:2398195-2398225
  misc_feature 1..30: note = Hypo
  source 1..30: mol_type = genomic DNA

SEQ ID NO: 119139 - DNA, 41 bp, Homo sapiens; identical to SEQ ID NO: 46074
  misc_feature 1..41: note = chr20:2444391-2444432
  misc_feature 1..41: note = Hypo
  source 1..41: mol_type = genomic DNA

SEQ ID NO: 119140 - DNA, 505 bp, Homo sapiens
  misc_feature 1..505: note = chr20:2539304-2539809
  misc_feature 1..505: note = Hyper
  source 1..505: mol_type = genomic DNA
gagggcaggagaaagcgcgacgagagggcctccttccaggagcggacagcagccccaaagagggaaaaggagattccgaggagggaggagaagtcgaagcggcagaagaaacccaggtgtgttgtggctccgattctgggcattcgctccgcgcgctcccgctccttcgcggcccttccccttcccccgtgagggactgatgcccccctccccggggagaggcagcccgtgccctcgctctggcttccgtgcctcccagcccttaccactgccccactctgcggtgggttcttcatcccagaaccgggatgaagatcgcgggtccgcgcgggggagtggccgcgggctctccactccagcgcctcgtggcacccggtgaggcggggcgcgggtggagaggtggcggggcgcgggtggagaggtgacagggcagcgggtgggacacgatcccgcgtcccctgaactccagctggtgactcaccccggctctcgaagaggaggagct

SEQ ID NO: 119141 - DNA, 246 bp, Homo sapiens; identical to SEQ ID NO: 87312
  misc_feature 1..246: note = chr20:2583218-2583464
  misc_feature 1..246: note = Hypo
  source 1..246: mol_type = genomic DNA

SEQ ID NO: 119142 - DNA, 23 bp, Homo sapiens
  misc_feature 1..23: note = chr20:2645508-2645531
  misc_feature 1..23: note = Hypo
  source 1..23: mol_type = genomic DNA
aacatagggagacctcgactcta

SEQ ID NO: 119143 - DNA, 30 bp, Homo sapiens; identical to SEQ ID NO: 87321
  misc_feature 1..30: note = chr20:2646617-2646647
  misc_feature 1..30: note = Hypo
  source 1..30: mol_type = genomic DNA

SEQ ID NO: 119144 - DNA, 158 bp, Homo sapiens; identical to SEQ ID NO: 87322
  misc_feature 1..158: note = chr20:2668770-2668928
  misc_feature 1..158: note = Hyper
  source 1..158: mol_type = genomic DNA

SEQ ID NO: 119145 - DNA, 282 bp, Homo sapiens
  misc_feature 1..282: note = chr20:2672952-2673234
  misc_feature 1..282: note = Hyper
  source 1..282: mol_type = genomic DNA
gcgaaagctcggaggcgtcaaaatgagcagcaagtccaggcacaaggcgtcgggcgcggagagtacggcgggtgccgggggagggagatgaggccgcgaagacgccggggcttcgtccggcggcgacggggaggccgcggaggttcccgagcgcagcggggcgcgcacctcccgctcgggccgggctccctcgccgcgcggccccggatcctccctgcgcgggtttccgtggcccccgccgggctcttccgttccctcccgcggcctcgaccaggccgcagc

SEQ ID NO: 119146 - DNA, 313 bp, Homo sapiens
  misc_feature 1..313: note = chr20:2674135-2674448
  misc_feature 1..313: note = Hyper
  source 1..313: mol_type = genomic DNA
ggagcgcccaagaggcgagcgcgcactgagccacccggactcggcgctgcgctgctggaggcgcctggtgccgtcgggtcgggctgagctagacgcccgcagcctcagcgggaccggatccggggcggcgggggcgctcactcaccgcgcgccctcatgttccctgcgcaggacgctctgccccgcagcgggctgaacctgaaggaggagccgctgctgcccgccggcctgggctcagtgcgctcctggatgcagggcgcgggcatcctggacgccagcaccgcggcgcagaggtaagcgctcggaccggacc

SEQ ID NO: 119147 - DNA, 30 bp, Homo sapiens; identical to SEQ ID NO: 87326
  misc_feature 1..30: note = chr20:2718301-2718331
  misc_feature 1..30: note = Hypo
  source 1..30: mol_type = genomic DNA

SEQ ID NO: 119148 - DNA, 209 bp, Homo sapiens; identical to SEQ ID NO: 87327
  misc_feature 1..209: note = chr20:2728381-2728590
  misc_feature 1..209: note = Hypo
  source 1..209: mol_type = genomic DNA

SEQ ID NO: 119149 - DNA, 135 bp, Homo sapiens
  misc_feature 1..135: note = chr20:2731229-2731364
  misc_feature 1..135: note = Hyper
  source 1..135: mol_type = genomic DNA
tcctctccaccccaccgcagtccccaccatcgcgcagccccccgcaccgatgctcatcgagcccttcgagggacactcggtagtgaccctacttagcctccccggagctccagtctaacgcggaaaggctgagca

SEQ ID NO: 119150 - DNA, 59 bp, Homo sapiens; identical to SEQ ID NO: 37876
  misc_feature 1..59: note = chr20:2731616-2731675
  misc_feature 1..59: note = Hyper
  source 1..59: mol_type = genomic DNA

SEQ ID NO: 119151 - DNA, 148 bp, Homo sapiens; identical to SEQ ID NO: 87331
  misc_feature 1..148: note = chr20:2774812-2774960
  misc_feature 1..148: note = Hypo
  source 1..148: mol_type = genomic DNA

SEQ ID NO: 119152 - DNA, 212 bp, Homo sapiens; identical to SEQ ID NO: 87332
  misc_feature 1..212: note = chr20:2775721-2775933
  misc_feature 1..212: note = Hypo
  source 1..212: mol_type = genomic DNA

SEQ ID NO: 119153 - DNA, 114 bp, Homo sapiens; identical to SEQ ID NO: 87333
  misc_feature 1..114: note = chr20:2777098-2777212
  misc_feature 1..114: note = Hypo
  source 1..114: mol_type = genomic DNA

SEQ ID NO: 119154 - DNA, 83 bp, Homo sapiens; identical to SEQ ID NO: 87334
  misc_feature 1..83: note = chr20:2780664-2780747
  misc_feature 1..83: note = Hyper
  source 1..83: mol_type = genomic DNA

SEQ ID NO: 119155 - DNA, 1103 bp, Homo sapiens
  misc_feature 1..1103: note = chr20:2780867-2781970
  misc_feature 1..1103: note = Hyper
  source 1..1103: mol_type = genomic DNA
tgtgtgagtgcgcgcgcgtgtgtgcgcgtgagtgcgagtgtgcgtgcggggtgagtgtgcatgactgtgagtgtgcgtgggtgtgcgtgtgcccgcgtgttagggagggatcgccccacggggcaggagagccgggcagtcggcttgcgggggagcggaccgtcggtcggggaactcaccgttagctgtctccgccggcggctgtgccgggctgctatgcagggccggggtcgagcctgggaccttggtggtcccgggctgcgcgaggcccagcaccgagttcctgggcgcccccagagccgggccgacggccggcgcgaaggcggccagggcgagcaggagcccccacatggcggggattgagtgccaggggcgcgcgggctacggcgggtggcgggtcggtctcttcctgccgagtgcgccgagccccccgccccttcctgccccccgcccctccgcagcctcctgcccgcccacagcccgctgcccgcctcggacctcggagaggaggagagggccgggaggagcgagcggggctgacctccaaggggccgccccaagtctcaggaccgccgactctgcccttcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatcaaggcaccaaaatatcgacaaatgtaaccatttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccacttcccggttccggagctctgacacc

SEQ ID NO: 119156 - DNA, 513 bp, Homo sapiens
  misc_feature 1..513: note = chr20:2785576-2786089
  misc_feature 1..513: note = Hyper
  source 1..513: mol_type = genomic DNA
gggcccaagaagaggcggcacggcggcgcttcccaccaccaccatcaccaagcccggccctgcccctcctctcctttcccttccctcccctactccttcgctcactcacccggctgccacgtcccgtcccggggttacataacccggagagagaagcctgagcgatagcctgcgggctggggctgcggtggaggagccaagggttgatgcactgcctgacctgccctccggctcctcgcccccagcccgtattctcctcggggagccggcagccctgggtctgcccagatccggagatgcccttcccgccctccctccaagaccccctttggatcctgcattcctggtcatctctccagaaggaaggaaacgcgtccagcggtgtgcctttggccggcgcttggcctttgcaaagggctctccagggagatgctcccatccccacgaggagcgatgcccagaagtggcccgcaatcctctggcgtaagcggggccctgcgcaaatgttttttg

SEQ ID NO: 119157 - DNA, 40 bp, Homo sapiens
  misc_feature 1..40: note = chr20:2801775-2801815
  misc_feature 1..40: note = Hyper
  source 1..40: mol_type = genomic DNA
gcagctgctctgaggcgggggaaggcgtggtggggggtcc

SEQ ID NO: 119158 - DNA, 147 bp, Homo sapiens; identical to SEQ ID NO: 87339
  misc_feature 1..147: note = chr20:2820440-2820587
  misc_feature 1..147: note = Hypo
  source 1..147: mol_type = genomic DNA

SEQ ID NO: 119159 - DNA, 135 bp, Homo sapiens; identical to SEQ ID NO: 87340
  misc_feature 1..135: note = chr20:2820726-2820861
  misc_feature 1..135: note = Hyper
  source 1..135: mol_type = genomic DNA

SEQ ID NO: 119160 - DNA, 399 bp, Homo sapiens; identical to SEQ ID NO: 87341
  misc_feature 1..399: note = chr20:2852724-2853123
  misc_feature 1..399: note = Hyper
  source 1..399: mol_type = genomic DNA

SEQ ID NO: 119161 - DNA, 30 bp, Homo sapiens; identical to SEQ ID NO: 46076
  misc_feature 1..30: note = chr20:3001373-3001403
  misc_feature 1..30: note = Hypo
  source 1..30: mol_type = genomic DNA

SEQ ID NO: 119162 - DNA, 22 bp, Homo sapiens
  misc_feature 1..22: note = chr20:3027758-3027780
  misc_feature 1..22: note = Hypo
  source 1..22: mol_type = genomic DNA
aagggtggctgggagcggtggt

SEQ ID NO: 119163 - DNA, 597 bp, Homo sapiens
  misc_feature 1..597: note = chr20:3052519-3053116
  misc_feature 1..597: note = Hyper
  source 1..597: mol_type = genomic DNA
ctgagcggattttgacgccccgcccttgaccgcggtcgaggcccccacggcgccccagcgcgtctcagccccgctgtcccgcccgaactccgaaccccggaccccagcatccttgcccggcgcaccccggccggcctcgcagggtcctccgagcgagtccccagcgccgccccggctcccgctcaccccgcccgtccccgcagtgcctcccctgcggccccgggggcaaaggccgctgcttcgggcccaatatctgctgcgcggaagagctgggctgcttcgtgggcaccgccgaagcgctgcgctgccaggaggagaactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagc

SEQ ID NO: 119164 - DNA, 266 bp, Homo sapiens; identical to SEQ ID NO: 37885
  misc_feature 1..266: note = chr20:3063125-3063391
  misc_feature 1..266: note = Hyper
  source 1..266: mol_type = genomic DNA

SEQ ID NO: 119165 - DNA, 229 bp, Homo sapiens; identical to SEQ ID NO: 87374
  misc_feature 1..229: note = chr20:3063597-3063826
  misc_feature 1..229: note = Hyper
  source 1..229: mol_type = genomic DNA

SEQ ID NO: 119166 - DNA, 777 bp, Homo sapiens
  misc_feature 1..777: note = chr20:3073251-3074028
  misc_feature 1..777: note = Hyper
  source 1..777: mol_type = genomic DNA
ccgtgttccaagtgacgtggcctgtcgcacccgccggggacaatgactgcggccctggggtcccacagacgttccctttgctagacttaaggaagagctaggcctgtccgcgctcccagcccccacgcagccagacacccgcgggtgctgagatgaagagtgaagtcaccaggagagacaggaaacagcgcgggcctcggggacccgagggcgcggaagctcgggggccggggtcgagcacagattgggaggcgcagcgctgggcgcacgtccccgtcggcccggcggcccctaatgaggcgcgctgtgcgcagactgctaagagcagcatgagcacggctccggcggcccccagggccccgcgggtcggcgccaccccggagcgcggtgcccggaatcacttagcgccatcagccgggcggctgggagggggaagcggccgatccgggcggctgggagggggaagcggccgatccaggcggcagcggagggggctgcagcggaggcggccccggcttgcacgctcgcccttccgcctgcccggcagggccccgtctgagccccaggccccaggcccagcggcgccgctcgccggtgaaggaaaccagcgcagagaggccgcgctgccaggcgcgtggtggtccgggggtccacgtgtgagcctcgccctaggctgccaattgagagttccacctccgcccagagagaccccacctcacccctccaacctggggcgcgcgggccggcggaggggtcctggggcgagtgggcaggata

SEQ ID NO: 119167 - DNA, 79 bp, Homo sapiens; identical to SEQ ID NO: 87400
  misc_feature 1..79: note = chr20:3154916-3154995
  misc_feature 1..79: note = Hyper
  source 1..79: mol_type = genomic DNA

SEQ ID NO: 119168 - DNA, 100 bp, Homo sapiens; identical to SEQ ID NO: 87410
  misc_feature 1..100: note = chr20:3202053-3202153
  misc_feature 1..100: note = Hypo
  source 1..100: mol_type = genomic DNA

SEQ ID NO: 119169 - DNA, 91 bp, Homo sapiens; identical to SEQ ID NO: 16562
  misc_feature 1..91: note = chr20:3202418-3202509
  misc_feature 1..91: note = Hypo
  source 1..91: mol_type = genomic DNA

SEQ ID NO: 119170 - DNA, 39 bp, Homo sapiens; identical to SEQ ID NO: 87412
  misc_feature 1..39: note = chr20:3203262-3203301
  misc_feature 1..39: note = Hypo
  source 1..39: mol_type = genomic DNA

SEQ ID NO: 119171 - DNA, 30 bp, Homo sapiens; identical to SEQ ID NO: 87413
  misc_feature 1..30: note = chr20:3204581-3204611
  misc_feature 1..30: note = Hypo
  source 1..30: mol_type = genomic DNA

SEQ ID NO: 119172 - DNA, 105 bp, Homo sapiens; identical to SEQ ID NO: 87414
  misc_feature 1..105: note = chr20:3204870-3204975
  misc_feature 1..105: note = Hypo
  source 1..105: mol_type = genomic DNA

SEQ ID NO: 119173 - DNA, 307 bp, Homo sapiens; identical to SEQ ID NO: 87416
  misc_feature 1..307: note = chr20:3218629-3218936
  misc_feature 1..307: note = Hyper
  source 1..307: mol_type = genomic DNA

SEQ ID NO: 119174 - DNA, 480 bp, Homo sapiens; identical to SEQ ID NO: 87417
  misc_feature 1..480: note = chr20:3220549-3221029
  misc_feature 1..480: note = Hyper
  source 1..480: mol_type = genomic DNA

SEQ ID NO: 119175 - DNA, 73 bp, Homo sapiens; identical to SEQ ID NO: 87419
  misc_feature 1..73: note = chr20:3229253-3229326
  misc_feature 1..73: note = Hyper
  source 1..73: mol_type = genomic DNA

SEQ ID NO: 119176 - DNA, 102 bp, Homo sapiens; identical to SEQ ID NO: 87420
  misc_feature 1..102: note = chr20:3229557-3229659
  misc_feature 1..102: note = Hyper
  source 1..102: mol_type = genomic DNA

SEQ ID NO: 119177 - DNA, 30 bp, Homo sapiens; identical to SEQ ID NO: 87431
  misc_feature 1..30: note = chr20:3274373-3274403
  misc_feature 1..30: note = Hypo
  source 1..30: mol_type = genomic DNA

SEQ ID NO: 119178 - DNA, 180 bp, Homo sapiens; identical to SEQ ID NO: 87450
  misc_feature 1..180: note = chr20:3388001-3388181
  misc_feature 1..180: note = Hyper
  source 1..180: mol_type = genomic DNA

SEQ ID NO: 119179 - DNA, 90 bp, Homo sapiens; identical to SEQ ID NO: 87451
  misc_feature 1..90: note = chr20:3388444-3388534
  misc_feature 1..90: note = Hyper
  source 1..90: mol_type = genomic DNA

SEQ ID NO: 119180 - DNA, 83 bp, Homo sapiens; identical to SEQ ID NO: 87452
  misc_feature 1..83: note = chr20:3388884-3388967
  misc_feature 1..83: note = Hyper
  source 1..83: mol_type = genomic DNA

SEQ ID NO: 119181 - DNA, 784 bp, Homo sapiens
  misc_feature 1..784: note = chr20:3641207-3641991
  misc_feature 1..784: note = Hyper
  source 1..784: mol_type = genomic DNA
gcttcgcagtcctcacgccggttcccgctggctccgcagtcgcaccagggcgccacgcgcgcgctcacgttgtccacgtagttaggggtgacggcggtgcctgcggggaccctgagggcgaagtcatcggcccacccgggcggagatatcccctggagaacccccgccctcgcccggatcccggccgcgcgtacccacgaggcccgcgtaggcgcgcaggcagcgggcgccctggtccagcaggcagccgtcgggggcgctgggcgctggggtgcacgagacctgaaaggccaggaggcgaggcctgcgcggcgggagggcggtgagccggagagaggccccgtccccaccctcgccacggccccgccgccgcccgcgcgcacctgcagacccggctgcgctcgcagaagtttaagggctcaaggcaggagggcggcgcggggccgggccccgaaaaggcgcaggagggcacgaaggtctggcgccgacgctcggcgcacgcggggcccgcgcacgggcagaagagcagtgcgtgggtgagcgcgggcggcccgcgggcgaagaagcggcgcagggcccggcggcagcgggcgcggggacagcccccctgcgcagcccggcccaggcactgcgccacatactcggagcgcaaacgctggcaccgcgcgtccgccgtgcaggcttcggccgcgtccacacatcggttccctccgaccgagctcgccgaccctgggaaaggcgcggggaggctgcaggtctcagtgcgccccgcatgcacacttca

SEQ ID NO: 119182 - DNA, 35 bp, Homo sapiens
  misc_feature 1..35: note = chr20:3653294-3653329
  misc_feature 1..35: note = Hyper
  source 1..35: mol_type = genomic DNA
gggcccaggtgagggcgcagcgccccagacctgag

SEQ ID NO: 119183 - DNA, 893 bp, Homo sapiens; identical to SEQ ID NO: 87490
  misc_feature 1..893: note = chr20:3662307-3663200
  misc_feature 1..893: note = Hyper
  source 1..893: mol_type = genomic DNA

SEQ ID NO: 119184 - DNA, 188 bp, Homo sapiens; identical to SEQ ID NO: 87502
  misc_feature 1..188: note = chr20:3713295-3713483
  misc_feature 1..188: note = Hyper
  source 1..188: mol_type = genomic DNA

SEQ ID NO: 119185 - DNA, 74 bp, Homo sapiens; identical to SEQ ID NO: 87506
  misc_feature 1..74: note = chr20:3729991-3730065
  misc_feature 1..74: note = Hypo
  source 1..74: mol_type = genomic DNA

SEQ ID NO: 119186 - DNA, 1009 bp, Homo sapiens; identical to SEQ ID NO: 87524
  misc_feature 1..1009: note = chr20:3758173-3759182
  misc_feature 1..1009: note = Hyper
  source 1..1009: mol_type = genomic DNA

SEQ ID NO: 119187 - DNA, 37 bp, Homo sapiens; identical to SEQ ID NO: 87525
  misc_feature 1..37: note = chr20:3763466-3763503
  misc_feature 1..37: note = Hypo
  source 1..37: mol_type = genomic DNA

SEQ ID NO: 119188 - DNA, 119 bp, Homo sapiens; identical to SEQ ID NO: 87526
  misc_feature 1..119: note = chr20:3764967-3765086
  misc_feature 1..119: note = Hypo
  source 1..119: mol_type = genomic DNA

SEQ ID NO: 119189 - DNA, 85 bp, Homo sapiens; identical to SEQ ID NO: 87527
  misc_feature 1..85: note = chr20:3766966-3767051
  misc_feature 1..85: note = Hyper
  source 1..85: mol_type = genomic DNA

SEQ ID NO: 119190 - DNA, 30 bp, Homo sapiens; identical to SEQ ID NO: 87529
  misc_feature 1..30: note = chr20:3802377-3802407
  misc_feature 1..30: note = Hypo
  source 1..30: mol_type = genomic DNA

SEQ ID NO: 119191 - DNA, 120 bp, Homo sapiens; identical to SEQ ID NO: 87532
  misc_feature 1..120: note = chr20:3820930-3821050
  misc_feature 1..120: note = Hypo
  source 1..120: mol_type = genomic DNA

SEQ ID NO: 119192 - DNA, 17 bp, Homo sapiens
  misc_feature 1..17: note = chr20:3826486-3826503
  misc_feature 1..17: note = Hypo
  source 1..17: mol_type = genomic DNA
gggcgtagtggctcacg

SEQ ID NO: 119193 - DNA, 41 bp, Homo sapiens; identical to SEQ ID NO: 87549
  misc_feature 1..41: note = chr20:4010137-4010178
  misc_feature 1..41: note = Hypo
  source 1..41: mol_type = genomic DNA

SEQ ID NO: 119194 - DNA, 17 bp, Homo sapiens
  misc_feature 1..17: note = chr20:4066865-4066882
  misc_feature 1..17: note = Hypo
  source 1..17: mol_type = genomic DNA
ctcgtgtcttcagttcc

SEQ ID NO: 119195 - DNA, 89 bp, Homo sapiens; identical to SEQ ID NO: 87555
  misc_feature 1..89: note = chr20:4085057-4085146
  misc_feature 1..89: note = Hypo
  source 1..89: mol_type = genomic DNA

SEQ ID NO: 119196 - DNA, 35 bp, Homo sapiens; identical to SEQ ID NO: 87560
  misc_feature 1..35: note = chr20:4186660-4186695
  misc_feature 1..35: note = Hypo
  source 1..35: mol_type = genomic DNA

SEQ ID NO: 119197 - DNA, 273 bp, Homo sapiens; identical to SEQ ID NO: 87563
  misc_feature 1..273: note = chr20:4202505-4202778
  misc_feature 1..273: note = Hyper
  source 1..273: mol_type = genomic DNA

SEQ ID NO: 119198 - DNA, 1273 bp, Homo sapiens; identical to SEQ ID NO: 87569
  misc_feature 1..1273: note = chr20:4229327-4230600
  misc_feature 1..1273: note = Hyper
  source 1..1273: mol_type = genomic DNA

SEQ ID NO: 119199 - DNA, 30 bp, Homo sapiens; identical to SEQ ID NO: 87667
  misc_feature 1..30: note = chr20:4589710-4589740
  misc_feature 1..30: note = Hypo
  source 1..30: mol_type = genomic DNA

SEQ ID NO: 119200 - DNA, 30 bp, Homo sapiens; identical to SEQ ID NO: 87689
  misc_feature 1..30: note = chr20:4650709-4650739
  misc_feature 1..30: note = Hypo
  source 1..30: mol_type = genomic DNA

SEQ ID NO: 119201 - DNA, 24 bp, Homo sapiens
  misc_feature 1..24: note = chr20:4657791-4657815
  misc_feature 1..24: note = Hypo
  source 1..24: mol_type = genomic DNA
gcgaaactccgtctaaaaaaaaaa

SEQ ID NO: 119202 - DNA, 30 bp, Homo sapiens; identical to SEQ ID NO: 46086
  misc_feature 1..30: note = chr20:4677123-4677153
  misc_feature 1..30: note = Hypo
  source 1..30: mol_type = genomic DNA

SEQ ID NO: 119203 - DNA, 76 bp, Homo sapiens; identical to SEQ ID NO: 46087
  misc_feature 1..76: note = chr20:4690696-4690772
  misc_feature 1..76: note = Hypo
  source 1..76: mol_type = genomic DNA

SEQ ID NO: 119204 - DNA, 30 bp, Homo sapiens; identical to SEQ ID NO: 87707
  misc_feature 1..30: note = chr20:4720642-4720672
  misc_feature 1..30: note = Hypo
  source 1..30: mol_type = genomic DNA

SEQ ID NO: 119205 - DNA, 91 bp, Homo sapiens; identical to SEQ ID NO: 87729
  misc_feature 1..91: note = chr20:4749380-4749471
  misc_feature 1..91: note = Hypo
  source 1..91: mol_type = genomic DNA

SEQ ID NO: 119206 - DNA, 969 bp, Homo sapiens; identical to SEQ ID NO: 87737
  misc_feature 1..969: note = chr20:4802998-4803967
  misc_feature 1..969: note = Hyper
  source 1..969: mol_type = genomic DNA

SEQ ID NO: 119207 - DNA, 94 bp, Homo sapiens; identical to SEQ ID NO: 87799
  misc_feature 1..94: note = chr20:4981307-4981401
  misc_feature 1..94: note = Hyper
  source 1..94: mol_type = genomic DNA

SEQ ID NO: 119208 - DNA, 20 bp, Homo sapiens
  misc_feature 1..20: note = chr20:5025098-5025118
  misc_feature 1..20: note = Hypo
  source 1..20: mol_type = genomic DNA
tttgagacagagttgcgctc

SEQ ID NO: 119209 - DNA, 37 bp, Homo sapiens; identical to SEQ ID NO: 87829
  misc_feature 1..37: note = chr20:5203282-5203319
  misc_feature 1..37: note = Hypo
  source 1..37: mol_type = genomic DNA

SEQ ID NO: 119210 - DNA, 30 bp, Homo sapiens; identical to SEQ ID NO: 87838
  misc_feature 1..30: note = chr20:5261671-5261701
  misc_feature 1..30: note = Hypo
  source 1..30: mol_type = genomic DNA

SEQ ID NO: 119211 - DNA, 1584 bp, Homo sapiens
  misc_feature 1..1584: note = chr20:5296172-5297756
  misc_feature 1..1584: note = Hyper
  source 1..1584: mol_type = genomic DNA
cagcacacctggaaacgactccacatgtgggcgccgcgggatgctgggtagcaaggagatgacccagctgaacaatgcatttggtccactcctgcgaggggaggagaacgccgagggacaggaactgcgcgccagcaaaagacaccctaacctggggtgcgcccgccagctgctttcccaaggtgaaaacctccaagaggcgagatgcaaatcccagtggcgtccacacccggaggtgtcttctctccaggtcgcccctccgtctcatgcgacaccccaatccccgcagcctctgctcagcgtgggaccaagaatggggagtcctacccctcctcggctttccagccccctaacccaagacaagagggcgcgcgcccgggctgggacaggtcccagccgcattttcgtagattgcactccccgcccgggagcgacccgttccagcagcccccttcccgccccatcaacgcggccgcactgtcggcgtctagaggcgacatcctggcaaagacaggaatcaagtcagaaattcaggctctagaagcaaaggctgcggtgcctcctggctggaagaaaacggcgggtgggtggaggatgcggtgcgcgggaatttccccacggacgcttgctgtttcctgctcacctttcaggaaggtgcccctctacctgcaccctcccctgcaatttggagctcgtccgcgagctcagctacccgctggctccctctgcccgcgcccgcacaccacagactccgcttaccgtaccctacccggtcctagagggcccagaggggatctcctgaaaccaactcgcctgcttggagccagccccgacgcatatctcgagagtggcgggaggcaaagcagccggaatgcccgagaaaaaagtgggcgtcagaggcccttgtcctagcgactcccccaccgcaccgactgagtcccgggactgcagggatctaagcccttacctgtctcggcgcctcctttctgtgcgctctgctgctccggaagccggatcgagagtcacagtgtggttgggcgcaggcgggccgctcggttttcacctcgaggacccggacttgcacttgcagagccgctgcgtgggggatgtccctcttttttcctcgccccggcgggctcctccggcgtgtcagggtctctgggttccagctggagttggcgctccggccccacagctctttccagcgtctcggacctgtgcgccccgccccgcgctggactccgccccggggtccccgcctgcctcctagtccaggccaagggtggatgcccagctcccccaccccaccgcgtgctctcgggctggtgcgtccagggcgcgggcaccgtagctccggccgcgctgacgcgagtccccggcagcgggggcagcctctcgcacggatttcagcgccttcgcatcccgtctgaatcggaccacacagtagccgggtttctaccgtgcgcttgggaacagtgagcaccgccctctgccgccagtcgtggcaccgcacccgggtcgcgcgcgcaggaggggagagtcctgtcttccggaggtgcccagtgccagcgtccgcgcccacta

SEQ ID NO: 119212 - DNA, 30 bp, Homo sapiens; identical to SEQ ID NO: 87933
  misc_feature 1..30: note = chr20:5658367-5658397
  misc_feature 1..30: note = Hypo
  source 1..30: mol_type = genomic DNA

SEQ ID NO: 119213 - DNA, 21 bp, Homo sapiens
  misc_feature 1..21: note = chr20:5732235-5732256
  misc_feature 1..21: note = Hypo
  source 1..21: mol_type = genomic DNA
ccaccacgcccggctatcttc

SEQ ID NO: 119214 - DNA, 23 bp, Homo sapiens
  misc_feature 1..23: note = chr20:5761884-5761907
  misc_feature 1..23: note = Hypo
  source 1..23: mol_type = genomic DNA
agggcttcctgagagcgagtgca

SEQ ID NO: 119215 - DNA, 48 bp, Homo sapiens; identical to SEQ ID NO: 46089
  misc_feature 1..48: note = chr20:5762556-5762604
  misc_feature 1..48: note = Hypo
  source 1..48: mol_type = genomic DNA

SEQ ID NO: 119216 - DNA, 354 bp, Homo sapiens; identical to SEQ ID NO: 88002
  misc_feature 1..354: note = chr20:5891915-5892269
  misc_feature 1..354: note = Hyper
  source 1..354: mol_type = genomic DNA

SEQ ID NO: 119217 - DNA, 54 bp, Homo sapiens; identical to SEQ ID NO: 88067
  misc_feature 1..54: note = chr20:6022905-6022959
  misc_feature 1..54: note = Hypo
  source 1..54: mol_type = genomic DNA

SEQ ID NO: 119218 - DNA, 800 bp, Homo sapiens
  misc_feature 1..800: note = chr20:6032685-6033485
  misc_feature 1..800: note = Hyper
  source 1..800: mol_type = genomic DNA
acccgggtcacccctcgaggaagaacgcagccctgccccccggagcgcacgcgcagcctggctctgcgctcaggccggctgaaaacgcggggcgcccggactcaccccgttcaaggaacgtgccgctgagatccaggacttcgagcgtgaccaggggcgcgccatcctctccagcgaacgccgcctcggcgatgcccccctgggctccgcgacccagcgcggtgcaggagaggttgaggagctgcagcgcggggaagcaggcgaaggcccggggctgcagcgcccgcagcggattcccggcgagcgccagggcgcggaggctgctcagcgcgggcccggtgcacggcggcagagcggccagctggttgtagctgaggtccagggtgtgcagccccgccggcccacccgggccccagcgcagcgcggcgatgcggttgtggcgcagggtcagcacctgcagctgctccaggtggccgagctcggaagtgctcagggcgcgcagcaggttgtggctggcgtcgaggctgcgcagtgtgcgcggtaggcagccgggcaggcgctccaggttgcggttcgccagggtcaaggccgtcgcatccgcggcgggcagcccctcgcagggcgagtcggtggcgttgctgccactgctcccccaggggccctgctgagtgacccggaagagcgggaccttctcctggggagggtctgcccagctggggcgcagcaccgtcagcagcagcagcggtagggtttgccgcatggcgtctggggagagaacagcaggacgcccatcaaatcca

SEQ ID NO: 119219 - DNA, 128 bp, Homo sapiens; identical to SEQ ID NO: 88176
  misc_feature 1..128: note = chr20:6103795-6103923
  misc_feature 1..128: note = Hyper
  source 1..128: mol_type = genomic DNA

SEQ ID NO: 119220 - DNA, 47 bp, Homo sapiens; identical to SEQ ID NO: 88460
  misc_feature 1..47: note = chr20:6748423-6748470
  misc_feature 1..47: note = Hyper
  source 1..47: mol_type = genomic DNA

SEQ ID NO: 119221 - DNA, 300 bp, Homo sapiens; identical to SEQ ID NO: 88461
  misc_feature 1..300: note = chr20:6748763-6749063
  misc_feature 1..300: note = Hyper
  source 1..300: mol_type = genomic DNA

SEQ ID NO: 119222 - DNA, 30 bp, Homo sapiens; identical to SEQ ID NO: 88466
  misc_feature 1..30: note = chr20:7958418-7958448
  misc_feature 1..30: note = Hypo
  source 1..30: mol_type = genomic DNA

SEQ ID NO: 119223 - DNA, 1765 bp, Homo sapiens; identical to SEQ ID NO: 88470
  misc_feature 1..1765: note = chr20:8112233-8113998
  misc_feature 1..1765: note = Hyper
  source 1..1765: mol_type = genomic DNA

SEQ ID NO: 119224 - DNA, 37 bp, Homo sapiens; identical to SEQ ID NO: 88473
  misc_feature 1..37: note = chr20:9048495-9048532
  misc_feature 1..37: note = Hyper
  source 1..37: mol_type = genomic DNA

SEQ ID NO: 119225 - DNA, 75 bp, Homo sapiens; identical to SEQ ID NO: 88474
  misc_feature 1..75: note = chr20:9049163-9049238
  misc_feature 1..75: note = Hyper
  source 1..75: mol_type = genomic DNA

SEQ ID NO: 119226 - DNA, 203 bp, Homo sapiens; identical to SEQ ID NO: 88475
  misc_feature 1..203: note = chr20:9049467-9049670
  misc_feature 1..203: note = Hyper
  source 1..203: mol_type = genomic DNA

SEQ ID NO: 119227 - DNA, 30 bp, Homo sapiens; identical to SEQ ID NO: 88476
  misc_feature 1..30: note = chr20:9376224-9376254
  misc_feature 1..30: note = Hypo
  source 1..30: mol_type = genomic DNA

SEQ ID NO: 119228 - DNA, 851 bp, Homo sapiens
  misc_feature 1..851: note = chr20:9487096-9487947
  misc_feature 1..851: note = Hyper
  source 1..851: mol_type = genomic DNA
ctccaaactggttggcgtggcacggggttggcccttggcttcgcagtgcccggaggttcggagcgagcactggaccagagcccaagttcccaagttcccattccacggggagatgcggactttaggtggacccggaatggaaggagggtttttgctgcccgcatgcccccagggctctttccgggaaatagaagggcgagtcctttgcttccgcagcgtccggtgggaaaagatgccacgtggcgcggtgcgggcggactcagaggccccaggcgcccccgggaactgccacttactcagggcccgcggtccctggcgaaaacgggcgtggcgccagtgctcagaccgtgaagtggaaaaacggatcataacctcgcgttaaggggaaattcaggtttttttctctgagaaatgtatccttccctaaccaaaatccagcacctagggccacccatccctcggtccctgagcccaccctctccctgcaggcacagctatcccaggttccggcccatcaagttgggaaatgagacgatccatcagtgccaggctcccgggagctgcagctggctccaagtgcgtggccggaggcgtcccccatctgcacgagtccccagagtcacccgggaataactgcgccgccgccgcctccgccgcctgggctcccgacctccgcgcgacccgcgttagctcgcgttgcctgctgtggctttgctgctctgggctacaaggccgggccggcttgggttgagactcccgaggctgcaggcgaggcggtgggtacaaacttccgtagatcctgctgtttctctgaagaagaagaaaaacattggccccggagaattagataa

SEQ ID NO: 119229 - DNA, 218 bp, Homo sapiens
  misc_feature 1..218: note = chr20:9488294-9488512
  misc_feature 1..218: note = Hyper
  source 1..218: mol_type = genomic DNA
cgggatcttacatcccgcctgcggcgtcgggcagcgcacctggcgggctggaccgggacagggggcggtgcgcaccggggctcccaagcagccttagcggtggagaccttccgaggggaggcgagcctgcggtttgtctcccgttaaggtggaagactggatttttcctccagttccgatctagggtgaagtcccttctcccgcgccctcatgcccag

SEQ ID NO: 119230 - DNA, 446 bp, Homo sapiens; identical to SEQ ID NO: 88481
  misc_feature 1..446: note = chr20:9488726-9489172
  misc_feature 1..446: note = Hyper
  source 1..446: mol_type = genomic DNA

SEQ ID NO: 119231 - DNA, 261 bp, Homo sapiens; identical to SEQ ID NO: 88482
  misc_feature 1..261: note = chr20:9489455-9489716
  misc_feature 1..261: note = Hyper
  source 1..261: mol_type = genomic DNA

SEQ ID NO: 119232 - DNA, 507 bp, Homo sapiens
  misc_feature 1..507: note = chr20:9495183-9495690
  misc_feature 1..507: note = Hyper
  source 1..507: mol_type = genomic DNA
atctcattggccctccgcacaagccaagccacagccactcctgccacacaatcggattgctttcagcactcgcagccgtggaccgccgtgcggtcctttcctccgcagtgagccgatttgctctgccagcagctgtcggtgccgcgctcgacaccgagtcctagctaggcgctcacagaatacgcgctccctccctcccccttctctgtcccccgcctctcgctcaccccggcccactccagcggcgactttgagggattccctctctggcggcctctgcagcagcacagccggcctcattcggggcactgcgagtatggatctccaaggaagaggggtccccagcatcgacagacttcgagttctcctgatgttgttccgtgagtagcgatttggcgactgggagagaggacgggcactctttgcagagaacagagccggcaaagtaaagtcaattagcttgagataaaaaatatggcccttaatgttttgcggtgttttttcttt

SEQ ID NO: 119233 - DNA, 956 bp, Homo sapiens
  misc_feature 1..956: note = chr20:9496026-9496982
  misc_feature 1..956: note = Hyper
  source 1..956: mol_type = genomic DNA
gtctccccaccctagcgcccgagacgcgtgggctgagccctgaactgatggaattgttttgtttgttccgcagatacaatggctcaaatcatggcagaacaagaagtggaaaatctctcaggcctttccactaaccctgaaaaagatatatttgtggtgcgggaaaatgggacgacgtgtctcatggcagagtttgcagccaaatttattgtaccttatgatgtgtgggccagcaactacgtagatgtaaggaatctttcccccccctcagcttgctcctagggctccagggcgaagggcacccttcctcaaggctcttcgaagacctgggttgcccgccttctttcccacaccccggcaggctgctcccgaatgctgcatggggattccagcttgtaatgccttctgttcccctgcctgctttgaaagtaaacccccttctctccgcttccctatcggggctgcacgtagagcatctaaccgcatgttcccggaacctgggatgcgcgcgcgcaaaggagcgcccaagcgtgcaacccagagtttggacgcgccgccctttacagcccccgccccggggccgggcgagctgagggggcgcggggcgtctgtgttcccagctgatcacagaacaggccgatatcgcattgacccggggagctgaggtgaagggccgctgtggccacagccagtcggagctgcaagtgttctgggtggatcgcgcatatgcactcaaaatgctctttgtaaaggtaactccgagcccagcgggcagaggggccgcaggctccgcgtgggtgtgggaagtggcggcccctaggtttaagaacccagacgctgcggggacgattgaagcgcacctccccggctcaacaggaaagccacaacatgtccaagggacctgaggcgacttggaggctgagcaaagtgcagtttgtctacgactcctcggagaa

SEQ ID NO: 119234 - DNA, 30 bp, Homo sapiens; identical to SEQ ID NO: 88487
  misc_feature 1..30: note = chr20:9497348-9497378
  misc_feature 1..30: note = Hyper
  source 1..30: mol_type = genomic DNA

SEQ ID NO: 119235 - DNA, 685 bp, Homo sapiens
  misc_feature 1..685: note = chr20:9819189-9819874
  misc_feature 1..685: note = Hyper
  source 1..685: mol_type = genomic DNA
tgggttgagggtgggcggtcccctatccctaccctccaggcagcaggtccctagcctttgcatctcctaggagatgcaggatcgcgctgtcacagtggtcctcttcgcatcctctcccggcaaagagagatgctccggttaccagcggcgcgcatccccgcaggcgcctctcctctcgccgatacccacccaggcagtcccgacaggcgcgcctgcctacctggtggccggctgtcagcgaagcggcggtgcctcagccccttctcagctgctacagcgctcccagcgccatgttcccggtctccccgggcgcacgctggggaactactactggctgggtaggggcaaggggggcgggggccagcgggagggggtgagaggcagagccacagctttctactctccacccaaacctcccccagctactgagcatgcccagctgcccggcttcgcccctcggaggactgtccatgagcgtacgcagctgctccgggttttcgtggcagccggcgggaggcaggctgtagcggcggccgggggtggaggtgagggggagggtcggggggcgtgtctacactcagggtgcaggagccaggagccgggagctggagcaggcgaccaatccaatcacgtttactcccagtcgtccccggcgggggcagctcctgcacgccctctcccccaa

SEQ ID NO: 119236 - DNA, 34 bp, Homo sapiens; identical to SEQ ID NO: 88493
  misc_feature 1..34: note = chr20:9981583-9981617
  misc_feature 1..34: note = Hypo
  source 1..34: mol_type = genomic DNA

SEQ ID NO: 119237 - DNA, 828 bp, Homo sapiens
  misc_feature 1..828: note = chr20:10198127-10198955
  misc_feature 1..828: note = Hyper
  source 1..828: mol_type = genomic DNA
taacattgcgaggcacgacttctaatcgcatccttcccggaaaagtacaaacagttcctcagacgaggtcccccacctcccacgcgctccccagccctccctccctgcggagagccccgcgacagcctccccaacacctgtgaatcatccgggaggctgccaccgccgagcgatccgcgcaccacccccttcccgggcccgggcacggccagggaggacagttagggttgttgctttataattatcacttttaatctctaatacgaccagcacaagtagcctttgtctccccgccctgatttgagcatccgagggccccccgaggcagcctgcacgggtaccccggggtttgcgcactgagtgaacccccagattcggccgtgtcccagccgtccttgctctgaatcccccacctcctcccggccgtttggacggttccctcggggcgtctgtgcctccgtggggtacccctaagacacccagcatgaaaccccagcaccgactgcaaattccaccgaaagcagagtcatccgtttttgccctcggcaaacaactcaacttcaagcctcgagtccttgcaaacccacgctggctgggctaactccgcttcccttctccttcccccgactcctgcaacagctcagagagcctggctctgacgtagttcaaaataacgtgcgccagcctcgctgcccggctgaccacagcaacgagagccacaagccctcgacgctgcttcgataacatgaagcaatcactcataaaaatagcaacccacgtagcctggccatatatggagctggcgagggtggacggggatgcccctac

SEQ ID NO: 119238 - DNA, 453 bp, Homo sapiens; identical to SEQ ID NO: 87091
  misc_feature 1..453: note = chr20:10199315-10199768
  misc_feature 1..453: note = Hyper
  source 1..453: mol_type = genomic DNA

SEQ ID NO: 119239 - DNA, 123 bp, Homo sapiens
  misc_feature 1..123: note = chr20:10200073-10200196
  misc_feature 1..123: note = Hyper
  source 1..123: mol_type = genomic DNA
gaaagggggagttcccgccccgggcaagctgagctgctgcagcgacagcagcctccatgccccgcggacttgatttatgccgcctgctccacgtcaactgcaggctggcgggaggcgggcggg

SEQ ID NO: 119240 - DNA, 202 bp, Homo sapiens; identical to SEQ ID NO: 87094
  misc_feature 1..202: note = chr20:10640930-10641132
  misc_feature 1..202: note = Hypo
  source 1..202: mol_type = genomic DNA

SEQ ID NO: 119241 - DNA, 30 bp, Homo sapiens; identical to SEQ ID NO: 87095
  misc_feature 1..30: note = chr20:10686912-10686942
  misc_feature 1..30: note = Hypo
  source 1..30: mol_type = genomic DNA

SEQ ID NO: 119242 - DNA, 30 bp, Homo sapiens; identical to SEQ ID NO: 87096
  misc_feature 1..30: note = chr20:10774557-10774587
  misc_feature 1..30: note = Hypo
  source 1..30: mol_type = genomic DNA

SEQ ID NO: 119243 - DNA, 166 bp, Homo sapiens; identical to SEQ ID NO: 87097
  misc_feature 1..166: note = chr20:11589587-11589753
  misc_feature 1..166: note = Hypo
  source 1..166: mol_type = genomic DNA

SEQ ID NO: 119244 - DNA, 72 bp, Homo sapiens; identical to SEQ ID NO: 87099
  misc_feature 1..72: note = chr20:11667745-11667817
  misc_feature 1..72: note = Hyper
  source 1..72: mol_type = genomic DNA

SEQ ID NO: 119245 - DNA, 30 bp, Homo sapiens; identical to SEQ ID NO: 87101
  misc_feature 1..30: note = chr20:11872354-11872384
  misc_feature 1..30: note = Hyper
  source 1..30: mol_type = genomic DNA

SEQ ID NO: 119246 - DNA, 227 bp, Homo sapiens; identical to SEQ ID NO: 87104
  misc_feature 1..227: note = chr20:13200556-13200783
  misc_feature 1..227: note = Hyper
  source 1..227: mol_type = genomic DNA

SEQ ID NO: 119247 - DNA, 437 bp, Homo sapiens; identical to SEQ ID NO: 87105
  misc_feature 1..437: note = chr20:13201128-13201565
  misc_feature 1..437: note = Hyper
  source 1..437: mol_type = genomic DNA

SEQ ID NO: 119248 - DNA, 563 bp, Homo sapiens; identical to SEQ ID NO: 87106
  misc_feature 1..563: note = chr20:13201961-13202524
  misc_feature 1..563: note = Hyper
  source 1..563: mol_type = genomic DNA

SEQ ID NO: 119249 - DNA, 45 bp, Homo sapiens; identical to SEQ ID NO: 87107
  misc_feature 1..45: note = chr20:13202742-13202787
  misc_feature 1..45: note = Hyper
  source 1..45: mol_type = genomic DNA

SEQ ID NO: 119250 - DNA, 207 bp, Homo sapiens; identical to SEQ ID NO: 46091
  misc_feature 1..207: note = chr20:13243380-13243587
  misc_feature 1..207: note = Hypo
  source 1..207: mol_type = genomic DNA

SEQ ID NO: 119251 - DNA, 30 bp, Homo sapiens; identical to SEQ ID NO: 87110
  misc_feature 1..30: note = chr20:13641995-13642025
  misc_feature 1..30: note = Hypo
  source 1..30: mol_type = genomic DNA

SEQ ID NO: 119252 - DNA, 142 bp, Homo sapiens; identical to SEQ ID NO: 46092
  misc_feature 1..142: note = chr20:16554594-16554736
  misc_feature 1..142: note = Hypo
  source 1..142: mol_type = genomic DNA

SEQ ID NO: 119253 - DNA, 142 bp, Homo sapiens; identical to SEQ ID NO: 46093
  misc_feature 1..142: note = chr20:16555036-16555178
  misc_feature 1..142: note = Hypo
  source 1..142: mol_type = genomic DNA

SEQ ID NO: 119254 - DNA, 180 bp, Homo sapiens; identical to SEQ ID NO: 87115
  misc_feature 1..180: note = chr20:16954966-16955146
  misc_feature 1..180: note = Hypo
  source 1..180: mol_type = genomic DNA

SEQ ID NO: 119255 - DNA, 38 bp, Homo sapiens; identical to SEQ ID NO: 87116
  misc_feature 1..38: note = chr20:17141814-17141852
  misc_feature 1..38: note = Hypo
  source 1..38: mol_type = genomic DNA

SEQ ID NO: 119256 - DNA, 500 bp, Homo sapiens; identical to SEQ ID NO: 87117
  misc_feature 1..500: note = chr20:17206513-17207013
  misc_feature 1..500: note = Hyper
  source 1..500: mol_type = genomic DNA

SEQ ID NO: 119257 - DNA, 863 bp, Homo sapiens; identical to SEQ ID NO: 87118
  misc_feature 1..863: note = chr20:17207260-17208123
  misc_feature 1..863: note = Hyper
  source 1..863: mol_type = genomic DNA

SEQ ID NO: 119258 - DNA, 414 bp, Homo sapiens
  misc_feature 1..414: note = chr20:17208389-17208803
  misc_feature 1..414: note = Hyper
  source 1..414: mol_type = genomic DNA
caggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcggtgtttctcccaccccgcgccgggaggacttccctcccagggacttcggtccctgctcctctccgggaacaacggcttcctgactctagatttggaaagaaactggtctctaaaatcggggcggaacttctgcgccctcacccccgcccacgaccgcccacccctggagcgcacttctggttggctccctagttctcaactcccggctacaggagctg

SEQ ID NO: 119259 - DNA, 340 bp, Homo sapiens; identical to SEQ ID NO: 87121
  misc_feature 1..340: note = chr20:17209295-17209635
  misc_feature 1..340: note = Hyper
  source 1..340: mol_type = genomic DNA

SEQ ID NO: 119260 - DNA, 194 bp, Homo sapiens; identical to SEQ ID NO: 87122
  misc_feature 1..194: note = chr20:17482549-17482743
  misc_feature 1..194: note = Hypo
  source 1..194: mol_type = genomic DNA

SEQ ID NO: 119261 - DNA, 32 bp, Homo sapiens; identical to SEQ ID NO: 87123
  misc_feature 1..32: note = chr20:17511525-17511557
  misc_feature 1..32: note = Hyper
  source 1..32: mol_type = genomic DNA

SEQ ID NO: 119262 - DNA, 30 bp, Homo sapiens; identical to SEQ ID NO: 87124
  misc_feature 1..30: note = chr20:17598565-17598595
  misc_feature 1..30: note = Hypo
  source 1..30: mol_type = genomic DNA

SEQ ID NO: 119263 - DNA, 30 bp, Homo sapiens; identical to SEQ ID NO: 87125
  misc_feature 1..30: note = chr20:17674659-17674689
  misc_feature 1..30: note = Hypo
  source 1..30: mol_type = genomic DNA

SEQ ID NO: 119264 - DNA, 30 bp, Homo sapiens; identical to SEQ ID NO: 46095
  misc_feature 1..30: note = chr20:17702368-17702398
  misc_feature 1..30: note = Hypo
  source 1..30: mol_type = genomic DNA

SEQ ID NO: 119265 - DNA, 39 bp, Homo sapiens; identical to SEQ ID NO: 37945
  misc_feature 1..39: note = chr20:17919829-17919868
  misc_feature 1..39: note = Hyper
  source 1..39: mol_type = genomic DNA

SEQ ID NO: 119266 - DNA, 18 bp, Homo sapiens
  misc_feature 1..18: note = chr20:17971912-17971930
  misc_feature 1..18: note = Hypo
  source 1..18: mol_type = genomic DNA
gggcgcagtggctcacgc

SEQ ID NO: 119267 - DNA, 77 bp, Homo sapiens; identical to SEQ ID NO: 87130
  misc_feature 1..77: note = chr20:17972170-17972247
  misc_feature 1..77: note = Hypo
  source 1..77: mol_type = genomic DNA

SEQ ID NO: 119268 - DNA, 93 bp, Homo sapiens; identical to SEQ ID NO: 87131
  misc_feature 1..93: note = chr20:18037359-18037452
  misc_feature 1..93: note = Hyper
  source 1..93: mol_type = genomic DNA

SEQ ID NO: 119269 - DNA, 109 bp, Homo sapiens; identical to SEQ ID NO: 87132
  misc_feature 1..109: note = chr20:18038494-18038603
  misc_feature 1..109: note = Hyper
  source 1..109: mol_type = genomic DNA

SEQ ID NO: 119270 - DNA, 289 bp, Homo sapiens; identical to SEQ ID NO: 37946
  misc_feature 1..289: note = chr20:18039647-18039936
  misc_feature 1..289: note = Hyper
  source 1..289: mol_type = genomic DNA

SEQ ID NO: 119271 - DNA, 175 bp, Homo sapiens; identical to SEQ ID NO: 87134
  misc_feature 1..175: note = chr20:18051230-18051405
  misc_feature 1..175: note = Hypo
  source 1..175: mol_type = genomic DNA

SEQ ID NO: 119272 - DNA, 76 bp, Homo sapiens; identical to SEQ ID NO: 87135
  misc_feature 1..76: note = chr20:18073083-18073159
  misc_feature 1..76: note = Hypo
  source 1..76: mol_type = genomic DNA

SEQ ID NO: 119273 - DNA, 30 bp, Homo sapiens; identical to SEQ ID NO: 87136
  misc_feature 1..30: note = chr20:18174471-18174501
  misc_feature 1..30: note = Hypo
  source 1..30: mol_type = genomic DNA

SEQ ID NO: 119274 - DNA, 30 bp, Homo sapiens; identical to SEQ ID NO: 87137
  misc_feature 1..30: note = chr20:18178355-18178385
  misc_feature 1..30: note = Hypo
  source 1..30: mol_type = genomic DNA

SEQ ID NO: 119275 - DNA, 217 bp, Homo sapiens; identical to SEQ ID NO: 87138
  misc_feature 1..217: note = chr20:18233341-18233558
  misc_feature 1..217: note = Hypo
  source 1..217: mol_type = genomic DNA

SEQ ID NO: 119276 - DNA, 30 bp, Homo sapiens; identical to SEQ ID NO: 87139
  misc_feature 1..30: note = chr20:18270495-18270525
  misc_feature 1..30: note = Hypo
  source 1..30: mol_type = genomic DNA

SEQ ID NO: 119277 - DNA, 208 bp, Homo sapiens; identical to SEQ ID NO: 46097
  misc_feature 1..208: note = chr20:18489646-18489854
  misc_feature 1..208: note = Hypo
  source 1..208: mol_type = genomic DNA

SEQ ID NO: 119278 - DNA, 197 bp, Homo sapiens; identical to SEQ ID NO: 46098
  misc_feature 1..197: note = chr20:19080645-19080842
  misc_feature 1..197: note = Hypo
  source 1..197: mol_type = genomic DNA

SEQ ID NO: 119279 - DNA, 59 bp, Homo sapiens; identical to SEQ ID NO: 87143
  misc_feature 1..59: note = chr20:19186737-19186796
  misc_feature 1..59: note = Hyper
  source 1..59: mol_type = genomic DNA

SEQ ID NO: 119280 - DNA, 957 bp, Homo sapiens; identical to SEQ ID NO: 87144
  misc_feature 1..957: note = chr20:19192659-19193616
  misc_feature 1..957: note = Hyper
  source 1..957: mol_type = genomic DNA

SEQ ID NO: 119281 - DNA, 32 bp, Homo sapiens; identical to SEQ ID NO: 87145
  misc_feature 1..32: note = chr20:19193883-19193915
  misc_feature 1..32: note = Hyper
  source 1..32: mol_type = genomic DNA

SEQ ID NO: 119282 - DNA, 30 bp, Homo sapiens; identical to SEQ ID NO: 87146
  misc_feature 1..30: note = chr20:19402623-19402653
  misc_feature 1..30: note = Hypo
  source 1..30: mol_type = genomic DNA

SEQ ID NO: 119283 - DNA, 51 bp, Homo sapiens; identical to SEQ ID NO: 87147
  misc_feature 1..51: note = chr20:19579962-19580013
  misc_feature 1..51: note = Hypo
  source 1..51: mol_type = genomic DNA

SEQ ID NO: 119284 - DNA, 40 bp, Homo sapiens; identical to SEQ ID NO: 46099
  misc_feature 1..40: note = chr20:19674013-19674053
  misc_feature 1..40: note = Hypo
  source 1..40: mol_type = genomic DNA

SEQ ID NO: 119285 - DNA, 182 bp, Homo sapiens; identical to SEQ ID NO: 87149
  misc_feature 1..182: note = chr20:19738199-19738381
  misc_feature 1..182: note = Hyper
  source 1..182: mol_type = genomic DNA

SEQ ID NO: 119286 - DNA, 151 bp, Homo sapiens; identical to SEQ ID NO: 87150
  misc_feature 1..151: note = chr20:19739010-19739161
  misc_feature 1..151: note = Hyper
  source 1..151: mol_type = genomic DNA

SEQ ID NO: 119287 - DNA, 370 bp, Homo sapiens
  misc_feature 1..370: note = chr20:19739416-19739786
  misc_feature 1..370: note = Hyper
  source 1..370: mol_type = genomic DNA
ccctgcgcctgagcgcgcgggtcagacccggtgtcgcacagctttgatccccagcgcggaccccactggtgagtccagccagtgtgcagggcagatgctccgaccggagatttcctcccccgggtggaaaagcaggagggttgttgtgtccgggcagggggcacttgggctgtcgcggtgattgatggctgcgcagcgggcggaggaggagccccggattcctgccgggaagggacggggccactttcccactttgaggcctccccgcccccttctgggcttggcctccacccttggcctgggctcccaccagctcggcgtccacccaccggcggtggcgcgcccctcgaccgcgcggggacagcaggat

SEQ ID NO: 119288 - DNA, 47 bp, Homo sapiens; identical to SEQ ID NO: 87153
  misc_feature 1..47: note = chr20:19928306-19928353
  misc_feature 1..47: note = Hypo
  source 1..47: mol_type = genomic DNA

SEQ ID NO: 119289 - DNA, 30 bp, Homo sapiens; identical to SEQ ID NO: 46101
  misc_feature 1..30: note = chr20:19961658-19961688
  misc_feature 1..30: note = Hypo
  source 1..30: mol_type = genomic DNA

SEQ ID NO: 119290 - DNA, 30 bp, Homo sapiens; identical to SEQ ID NO: 87156
  misc_feature 1..30: note = chr20:20321098-20321128
  misc_feature 1..30: note = Hypo
  source 1..30: mol_type = genomic DNA

SEQ ID NO: 119291 - DNA, 99 bp, Homo sapiens; identical to SEQ ID NO: 87157
  misc_feature 1..99: note = chr20:20321680-20321779
  misc_feature 1..99: note = Hypo
  source 1..99: mol_type = genomic DNA

SEQ ID NO: 119292 - DNA, 30 bp, Homo sapiens; identical to SEQ ID NO: 87158
  misc_feature 1..30: note = chr20:20343755-20343785
  misc_feature 1..30: note = Hyper
  source 1..30: mol_type = genomic DNA

SEQ ID NO: 119293 - DNA, 1914 bp, Homo sapiens
  misc_feature 1..1914: note = chr20:20344329-20346243
  misc_feature 1..1914: note = Hyper
  source 1..1914: mol_type = genomic DNA
accccatagcaagaacgctcgccagggtagaaagtatgcccttgtggaccccaggagtctggctgcctcttcgtcctcctgcggcaggcgaggcggggtgcaggtgtgagtggggtgggaggaaggggaaaggatcggggtcgccgcagcctttctggtcagtttcgctgggttttgtcagttccgtttgagaccgaggcgcacggactagcggccgccagcacctcacaggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcgataccctctgcggggtgagaatgcgggcccgcccggctcctcccgtgaggccagggcctcctgttctcctagacaccccaaggagccaactcctccgcagaagttccccgcttctgctcttatttccaagcttcgcgctttctacaaactccctgttgccttgactttgatttccagccgtggtgagggtcagagtgaaccccggcgcgctccccgacggcatccccgcacaccaggataggagaaattggagggcctggggcctcgggctccgcagtcgtcggaggaagaacccaccgcggggtccgcaagggaaagtgaagaggcccgggatttttccaaagcgctggccaggaccccgaaggaaggggaggagtcacctgaagccggggaaggccccttgggtgctctgccttggatccttatgttcactgactttcgcgaagcccccctggaggggggcaaatccgcgctgtttcccccaacttaacttcacgcggcccattctccgaatcgcgtgcgccaaggccggcgtcgggggcgcactgtgatggcgctttgctcttcccaggcgaagacaaatatctcgacccgatgtccccatgcatgcgggtgcacaggttctgagaaaatcacgcagaaggcggctgcgatccacggcccgggctgggctacacctgcttggaggtcgctggtgtgtgcgtgcgcgcgtgcgcagcctaactccttccagccccgggtggtgaaattagtttccaatactagtacctttcaagtttccatttattttgactgtacccgtctgaaagcagat

SEQ ID NO: 119294 - DNA, 3504 bp, Homo sapiens
  misc_feature 1..3504: note = chr20:20347246-20350750
  misc_feature 1..3504: note = Hyper
  source 1..3504: mol_type = genomic DNA
ccttttgtgtttcctcggggctgggctggacagaggatggaggcaggcggcccagtctgggtccaaacggaacggcagcggaggtgggggtgggggtgggggcggggggaatcttcgctgttgtctcttcctggtggcacaggggaggcggcttgtcctctcggaggcctcagcctgcctcagagtacagattgccccccctccccccgtccagcacgcgtctcttttgcgtccagattggccgcgaccggagctcaatagcaggaggttaatttccttcacaaaggtgaagggggcacggctccgtgggggctgcgcccagacaggcagcccctttatttcgcagcgccttgattggagcccttgatttagcatctgatgtcaaccggcaaacaaaatgcccgctcggaatgaaaatgcatgaggccgcgcggggaggagaaagccaacttcactggggcgcacgaggccgaccgcgcgtttcgggcttcggccaactcgacccggattaaccgagccttggaccacgcggaagctccgggcggcctgggtcgggccccgccaaagatgccattcccaagcctccaagaacccaaaagttcagaaattcacgttcctctgggaacccagcccagcccgcccgcgctccaatcccgcgctttcgggagactgagaaggccgtgccaattccttctcaaactcgaaagaaaccttctctagccccgtgggcgcgcggaggctgcgagcacaaacatcgccctcggccactgccagaaggccgggccccctgtccacacttggaaccccggggaacccttttgcttggcctcttgggtccagcggcccatccgtccaaggtccgggcggaggccgtccggaccctgctgctctctcggattcttgtttatttcccaaacaccacgcggagccactgcgcctccgcaacgatctcccccgcaccgccccggcgcgcccccgcccccacccaatcagcgcgcacaacttccccctcggctccggctcgcggattgaaccctcctgacatatttggggccattcttctcctttgttgctattttgctagcgacccgcgggtaatccccgcgcgggaggggggcgtgcattgtcgcgctgatggacgggcccatttggcggctccgcgccccccggaggagagacacaaagcccaggcacgtgcgcctccccatagagaagcagcagaccgtgaagggaggcggggccgggcgtgtgcctggaccgggcggggcggcggcgccgggcggggcgaccaggggcgcgcgcgggggccccgcgccctcaggtacatctgccgcacctaccgggcgacccccgagtcccggcccccttttggccgccccatcgccctcccaccctgccaggctgaggagctgcggacgcgctgattggctccaggggaagcgggaggcgagaacaatggccccctccccccgttaaaagggagcggctgccgggcccggggacagggacgcgcgtgcagggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgcagggcccgcgggccgcgcacttcggcaaccccgaggctgcgcaccccgcgccgctctacagtcccacgcggcccgtgagccgcgagcacgagaagcacaagtacttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaagaagcccaaggccatccgcaagctgcacttcgaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcctcgcccccgcccccaccgggtgaaagtgtcgtctccgcttctctcggtgtggcgtgacggtaaccccatactctccttttgactccttttggaacccccacttttacgttgtgtccctccgcctcccccatggcgcaacaggagtcagtctctttctgtacaagggagaaaagctgtacgcgtttgtctcgtggttggaagcct

SEQ ID NO: 119295 - DNA, 202 bp, Homo sapiens; identical to SEQ ID NO: 87164
  misc_feature 1..202: note = chr20:20367287-20367489
  misc_feature 1..202: note = Hypo
  source 1..202: mol_type = genomic DNA

SEQ ID NO: 119296 - DNA, 142 bp, Homo sapiens; identical to SEQ ID NO: 87165
  misc_feature 1..142: note = chr20:20376831-20376973
  misc_feature 1..142: note = Hypo
  source 1..142: mol_type = genomic DNA

SEQ ID NO: 119297 - DNA, 191 bp, Homo sapiens; identical to SEQ ID NO: 87166
  misc_feature 1..191: note = chr20:20377191-20377382
  misc_feature 1..191: note = Hypo
  source 1..191: mol_type = genomic DNA

SEQ ID NO: 119298 - DNA, 80 bp, Homo sapiens; identical to SEQ ID NO: 87167
  misc_feature 1..80: note = chr20:20421118-20421198
  misc_feature 1..80: note = Hypo
  source 1..80: mol_type = genomic DNA

SEQ ID NO: 119299 - DNA, 32 bp, Homo sapiens; identical to SEQ ID NO: 46105
  misc_feature 1..32: note = chr20:20914015-20914047
  misc_feature 1..32: note = Hypo
  source 1..32: mol_type = genomic DNA

SEQ ID NO: 119300 - DNA, 30 bp, Homo sapiens; identical to SEQ ID NO: 87170
  misc_feature 1..30: note = chr20:20952267-20952297
  misc_feature 1..30: note = Hypo
  source 1..30: mol_type = genomic DNA

SEQ ID NO: 119301 - DNA, 3908 bp, Homo sapiens
  misc_feature 1..3908: note = chr20:21080562-21084470
  misc_feature 1..3908: note = Hyper
  source 1..3908: mol_type = genomic DNA
cccctctctggcagccgcggagacaaaggtctccaggaataattggagatgtgcatggaatattaaattaatttactgctcttaattcttatgcaaattctgacctccgatggcgcctatcaattaccccgcccgcagtgaaagcgaaagcgacagtttcttctcttcgcttttttttcttttttaagaactcgaaaaaggaaatatttgcaataagcaggcggtagtagcacttcgtagctggaattatttaattgaatcttcaagtttttagggatgcccgtagaggataaaaccccagtgctcagcggagagggtgggaggggtacagggggcggaggaatctgttggtttgactgtacacctgcgggcggcggcaaaatacagccacgagccgggaccagtaatgtcaaataaaacattggcttgtagacggacgcgggccttgggaatcgcgcgagcccagcgttagcccggggtttcaccgaagccggcgattcgaagggagtggcgtttccgcaaactgcatcgctaggggcccggcgtggaagcgcctctgcgcaactttcctccaccgctgcctacaagggaggctctggcttccgtttacttattttttaggagttttaacctttggttcctgcttttacaaccgctaaccccaaaaacattttttttttctttttgttctttgtaaaaccaaaccactatgctgtgcgttcatgttcaactctgttgaaatcccgggtgggccgaaataagatttaattgtctcctgcgtggagaagtgacacccactttttcccctgaattgagcaaacaccagggctttgtctgagcttgtggcttaaacgccgggcggtttctgcacccagttggtgggttgtaagacaggaggtttccaagtctttcatcatgtttctaacaaggaaaaccaaatcgggcccataatgtcatcagccccggcccgacctcgccgggacctcggcagcccgatgatgtcgctagcggccccggcgcagccacgacgcgccgcctttcagctcctcgcagtccccacaaaagccagacaacaatatcaattaatcatgcagcgggcaaacaaggagatttatcccgcgacaaacagccccaccgagagccgctgaatgggcgtgattagcatgtgaaaaggcgagcaaaactccgcggttcaacagctaaagagcaatttgatggggctgggatggggaaattacttgattagcgtccatcggaggagaacacggttacagcccctcggccgggaatccgacaggggaacaaaacgcgctggtaaacgcggcgacgtacagggagcgcgagcgagggagggagcgccggcgagggagggagcgcgggggccgacatcgagaggcaatcggggtgggggcagaaataggggctgacccgctagcccccgccaaaccgcgaccaccctcacctagggctcccgggcggactcaagacttcacccagcgctggaggtcgaccttaatttagagcgctgccccggctctggcccggaaagagagtgacagaggcgcgtgcgggggaaaggcccacccacgctgtccctggagtcccctccagtgtccccagggacgcagtccgcggccgccagctccaggggctcgggccccaggttggagtagccacgctagcggctaggccgttccaccgggtagctccgcccttccttttgctcaggcagctaactttggagccgggcaagacgtgttttcccgctccttcgaatttaaccgcccagtgcctgcctcctggaaaagctgtcacgattgggcttgggcttgggcttggccttggtcaagaaaggtttcctcggctgcgccaccgtggggatggaggtgggagttggaacacagccccctagctgagtgcaggggccagaggctggcgggggcacgcgggggtggttgggggcggagtgcggcgaggggtgagggcgcgaccgccttggggcaggggcggcgatggagtagctccgggctctccacggactcgattggacagccccaggccggctttggatccttggaggcggatacgcaaggccagacctggtggcgtggccagttgggcatcgcggtatcttccccaggcctggagggcagtgctgaaggcccgcggccgaggttttgctttaagtatacttgggcctcgcaactcagctgtttgcgaacagagacctggcgaatcgccgaggagcggcgcggctccgcgtccccacttcaaggccaagtggagagtgaggacacgctgaggccccctgctacctatcatgccatcttaagcgggcaccgactccttacccagaaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatcctgccccttggcacagaagaacggagaaccaaggagttaattcctattttataagaaaaaaaaaaaaaaaaaggagggggagagaggaagggagtggatggcccccactgagcggaacaattgtcactcagttgaacagtgtcaattaacaaaccgcagctctggcagacttcaaaaggcttgattctttttgaaatgtctgtggtgatgggtgtgcagcgaaccccagctcgccggtggccgctcaccccgctcgcctctctctccctctggactcggtgctgaagccccagtgcagctcgctcctccttctgtcagcagctggacccggaagccctgactcccggcttggcgcctgtgctgagagcggagaaggacgtcgcgaccggcaggcctggagggcgcattggtgtgcagagtgtagcggctggtctggccctgggaaccccagacccgcgaagctggagggcgcactccccggcctcagagccccaaaccggaggcgctgtccaaacgcgccaacgctgcaagcaatgtggcagggcacaccgaaatgcgtgtctcgcacacctgcccatctttccctgctcaacacgaaagcgccttgtggctctaagcgcttccttggggtggctggggctgtgcattttaattccaaagtcaagaggttgaaccatctcaaagttggcgggtggagggggcggtggcagggaactagatggctggatgcctttgcctgcggggtggcagggctgtccctaccaatagccacggctcggggctggctttgtagttatttttccaagttctgcccggtgcccatcatattgccctgaaaagcaaaagaggccgatgcaatttattccaatgggcggtttttaagaagctggcaatttgaaccggctgggtgttatttagtgcaatatgaaatcaaatgatcctatttctcaaataacagtgtctgtgaggagaagtgaatcctctgaaagggtaattgtctgctgatggtgtttcccattatacccgatcttggcctaaatggtgttcggcagcggggcggagagcgaggggtgaaatcaatgtgcgccaactcgcgctctggagacaggaaaaggtagcaccgctggcgtcctggcacgtcgagcgaacaatgccaccccacgcgtcactgatcgactcatcttgcag

SEQ ID NO: 119302 - DNA, 1014 bp, Homo sapiens
  misc_feature 1..1014: note = chr20:21085668-21086682
  misc_feature 1..1014: note = Hyper
  source 1..1014: mol_type = genomic DNA
tctaggaggaaggttcggccactgcacctggagcccgaagcaccggacaccaggcgcgccgttctggcgctctgcagggcctctctgggtgaaggaaagcgggcagcctgggttcagcccaccgggtcccctttcgaatgccatttcccagctgaaaatccagccagcacagcctggacgccgagccctctggagccctggtcaggacgctttaattttcaccctcccgctctgggtctgaacaacccccccgtcccccgccccccaccccaaggtgttgtttcctagggtcttctggggacatccctacctgtcgagggcctgccctcctcgggctaaaagttcagcccttcgacagagccatggaataagaggcgactctccctgtgtcccgcaagtggtttctcgaggtacccctctgaggctgcagcccccggagcagacctggctctgcatagcagcaaaagcaaccgcctacctgggccggggcaggactgtgccgcggcggcagggacagtgtgagcgccgccggccccctcacccggcgagggccctgcgctcacacttcttccaggggaaggagtggccacgcctgagcccccctaaacgacctcttcaggagaaaagagtgccggccaggagtccctccagtaacctcagtttagatcgggttttcgcgcctcccctaggaatccggctggaaaccccggagactctgcgcctagagttttgcgggcgtctctctgcctccccgcagcttccggctctcgcaggcttcatccactccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatccagagagagactcagaggggcgccccttccccccaggggtctccgaatcctagggact

SEQ ID NO: 119303 - DNA, 282 bp, Homo sapiens; identical to SEQ ID NO: 37964
  misc_feature 1..282: note = chr20:21086906-21087188
  misc_feature 1..282: note = Hyper
  source 1..282: mol_type = genomic DNA

SEQ ID NO: 119304 - DNA, 649 bp, Homo sapiens
  misc_feature 1..649: note = chr20:21372082-21372731
  misc_feature 1..649: note = Hyper
  source 1..649: mol_type = genomic DNA
cgggccgggtgaggccggggtccctgcactcctttgctgggcgcgcctggaccgaactgaagggcccgggcgccgcgacctcgcagccgggggcgggatggtggcggcgcccgggccccgcgtgctactcagagctcaggtcctaggtgcttggctcaactttctcccagcggggtcgggaagcgccaggccctcggtgcacgtggggcacgcgcccggcgcctgggtctcccctgcggctcgctagtcgcccggcccagcccgcagaccccgcggctggccctcccgggagccccgcgagccggccgcacgcacaggatgggcgcggaaagccccttcctctaccctcgggcgcaccctccttcctcgtccgcggcgccgcagcttctcaacctgccgctgcatctcaactccctgcaagcagcagagctgtagaataccagaaatggtcttccttccgaggctgccgttttaagttccaagtgtgaaagtaaccgaattttgctatgcttagaaatctaaaatctggacattccctgaagagtcaacttagagtccccagtttctcgatctggctccgtcccactgactgacgcctcctgcccaccccgaaaggatcctggagctgcgatctcgccagactctattc

SEQ ID NO: 119305 - DNA, 2450 bp, Homo sapiens
  misc_feature 1..2450: note = chr20:21376207-21378657
  misc_feature 1..2450: note = Hyper
  source 1..2450: mol_type = genomic DNA
ttttatagttacaaacgccaacaaagtttccaactttgagagctgtagttaagaatgccgtgtgaacttctccaccttttcgcgtcatttaagaacttctaggaggagaaaatcaccacctcaaagcctcgtggcataatgttacactactcggtttccgggctgtcgctgtcccccgcccccagcaagaggttcacagcctgctcctctctgagaccggttcgttttgaatcgcagtttacacgcgcgagtcggttttcgcatgcctcccccatccgttctagcagtttcttgcagacccttcgggtgcaccaggacctagccccggggcgccctcgctgtcaccacgtcctgccatagagcaggttggcgcccaggacgccgccgctgtactccccggcggccgcgtccagggccgccaggccgccccccgggccgtgcagcgcgggtgggctgggcgacagctcctccagctcaggtgctggcgtcggggccggcggctgcggaccggcctggccgggggtgggcgtgctggcgccgttctggcacggcttgccgtccttgaccagcacaggcaccgccacgcggcgcggggacggcggcggaggcggcggcgggcccaggccgccctcctgctgcagctgctgcgccgccttgtccttggcctgccgtttcatcttgtaccggtggttctggaaccagatcttgacctgcgtgggcgtcaggtggatcatgctggccaggtgctcgcgctcgggcgccgacaggtacttctgctgcttgaagcgccgctccagctcgtagacctgcgcctgcgagaagagcacgcggcgcttccttcgcggagcggctgccgccgccgccgcgtgcagcgggcccagcgacttggcggcgtccgcgatgccggtcagcgaccccatgccggccacattcacgcccgccgacggccccatgaacctggagactggggaagagtcccaagggggaaggcgagtgagctccaggcccgccgggagccggtccagccgccgctctcttcacgccgcggccgcgacgccgccgggccctcgctgaatcccaagaccccctgaccgccgcggcctccggccccagcacgccccgcgcgccctcggcgggtcccagagcaccacgccctcaacgggtcccaggacgccgcgcgcgttcccggtcaggtcccaggaccccccgcgcgcccagggtccccagaaaccccgcgcgtcccgggccgcgtcccaggacgccccgcgcgcccgctcggccccaggacctcctaagccgcgcgcaccccgtcccgcgcccccgcgcccctcggctgtggcgggaaacgcctgagccgcccgcagccccgcgctcctggcccctctcacttgacgagtagcgtgggtccgggttggcgccgtaccagccggtggccgcgccgccccgcatgccgtccgtgtaggcgggcagctcgcccatgttgcccaggccgccgttgcagtagctgcccatggcgccgtgcgggaactgcgagacgccgggcggcatgtggtaggtggcggccgccgccgccgcagctgctgccgccgccgccgcggccgccgcgttgtgacccgccatggcgtgagaaggctgcatgcccgccacggtcgccgcctgcgaggagggcccaggtggcggcgcgcggtaggcggccgcggcccccaggggcgcccccaggccgggtggcgcgccgtccatggcgccgctgaacttcttgtaggtctcctcgatggggctcaggatgtcggacacggagaagggcgtcgtgtgctttgggctcaacgacatggctcggcgggcagccaggtaggggggcctggggcgcgcgccggcaggacgcggcggccgctcgtcgccgccacctcggccgcggcagctgagcctgtgacgaggagtcggcggctcggcgagccccccgggctgcgggatctggggtttattttagtccggcgccaggtttacgacagactcggggggcggagcaacatcccaaacgagcaaacaatggtcattgacatctttttctctcgcccccccaacccccgccccataatggaggcaaaaaaaggtaaaaggggcagttgggtgtttcttggaaagatcactccccgttgcttttcccatctttgcttttcccatcctttgcttttcccatccttcgctcctccatccgcggccgttaccccagccctcgagcaccagaaatagaaactcggaggctggcgtcgaggctagacatggactccgcgcctggccccttccagatcccagttttctaaagtgacttcgcaccaaagtccggtataattgcggaatggggaacgtgctgctaagtttggggggagggtgttgcgggggcttgcttcgtcctctccagttatcagcccctcattcgctccatcacctaa

SEQ ID NO: 119306 - DNA, 1359 bp, Homo sapiens
  misc_feature 1..1359: note = chr20:21485917-21487276
  misc_feature 1..1359: note = Hyper
  source 1..1359: mol_type = genomic DNA
gtgtagaggacacctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgccctgctgtgtgtggggcgttcttgcctcccgggccctgaccccacggtctgggtcggcgaggcgtctctccctggcgtctggactgtgcgcctgccccgcttccaggcgacgaacggcaggagccgggggtccggcgggacccggatccagggcgggcggaaggcgagggtctctccttcccggaacccccgccccggaaacctgcaaccaaaccgggtccctcctccgcatcgctcccgcgctcccgggccgcctccccacgcgggcacccactctccgggccctcgcagcaccgccctctccgcgtccacccgcgcggccgacgccgccaggggccctgagatcgcggagacagcgcgccctggcgcctggtggggccctcccagtggccagagcgctcctggaccagtcggctgtggtctgtgcccaaacacgatggaaaccggggctgggacgggcggtggtacgcacgtggaggagaagaggcatggcgggaaaaccacagccgaacacaggtcgactcgcacctcccaggcacccgccgccgtctgactcgcggctctccccaaggttccgactcgccgccacctcttggcaccactcaccgggctccgacccgggccgcgagtccgctgatgcgcagctgcctccggcggctcccgggctctgcccggacccgcgcgcagagacgctcgggaacgctgggctcgggcgcctcctggcggcggcagcacgcggcacacgctcggttctccggcccgagggggcgcgtggagcgtacgcgggatccgcgcgcgggcctgggctgctggcccacatttccccgcttgctcggatggcggcgctgaggcctattcgcctctttattaataacgatgcctcgggagggaaaaaatagagc

SEQ ID NO: 119307 - DNA, 338 bp, Homo sapiens; identical to SEQ ID NO: 87190
  misc_feature 1..338: note = chr20:21487336-21487674
  misc_feature 1..338: note = Hyper
  source 1..338: mol_type = genomic DNA

SEQ ID NO: 119308 - DNA, 639 bp, Homo sapiens
  misc_feature 1..639: note = chr20:21488158-21488797
  misc_feature 1..639: note = Hyper
  source 1..639: mol_type = genomic DNA
gacccaaattatttccgactgcctcgcgccaatttggaccgcttagaggaggcaaaaaatgggcaaattccttggaagccctgctgtgtctccctggtactgaattttgtaagcacgcgatacaggagacattgaaaattaaagaggaagtatctccctcctccaacatggggagagacgctgttggaagaagtttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcccgggactgagcggcacccttggcctctcagaacctttctcgcggtgagtggaagggcggctccgcgcgcgggcgcttcggggccggtcggttgcgaaatcagggggtggattttcatctacccaggagccgctaagcccgtaggggaccgagcatcacccaggccctgggtaccctgagttgcctcctgagccccaggacggtccgatggtgcagagctcccaggcagaagttagtttcctgatacacacacagcagtgagcaaagtgcgcacaagtgagcca

SEQ ID NO: 119309 - DNA, 778 bp, Homo sapiens
  misc_feature 1..778: note = chr20:21488998-21489776
  misc_feature 1..778: note = Hyper
  source 1..778: mol_type = genomic DNA
caactttcagtgtcacggggcctaggcggggcaagcgccctccgaagccatcaaagacaggggtggctttttctcccctcctccagcctcctccccaatagatatagcacgaatttttaatgcgtcttcctttcacagacaacaatacagggtttgaaagccggacacaatttaggttttgtgcgggtccctcctcgcgctccctcggcccagctggccatatggaatccagcatggagcccgtggatgacaaagggacccagtgacaggcccaacaaaaccccaaggagacttctgcctgactccgggattcactgccggcgataagcgcgctgaatggtgcggggtggggcggggggtggggggcgggccccttctccttcttcccctctctctgtccccgcgatcctttctctgtccctttttaatatgcacgcctctaacatctccggctcccagctttcccattgtgcggttttgtaccgcccgctgtagattgggcgaagatagactgctgaagcggaccccgcgccgggtgcgctcccagggcgctggggttagggccacacagggctccgcaggcgcttttattgactccatggggacccgaggacagagagaggcgggcgccgggtccacctcccgggctcccggccggccacaggagcgcacacccagattgcaggcccgcggtcctggccacagctccaaatttgtcctcaatgagcaagtggtggaagcctgccagggtgaggaccttccacgcttcccccttcct

SEQ ID NO: 119310 - DNA, 1585 bp, Homo sapiens
  misc_feature 1..1585: note = chr20:21490175-21491760
  misc_feature 1..1585: note = Hyper
  source 1..1585: mol_type = genomic DNA
tcaattatccaggggcggtgtggaacgcgggaataaagtgtcatcgcgtccctgggctgctgcgcagagtgctatcgacgcacagatttggtcgcacggataatcatgtttgctttagatattgaattaaacctgatcatcaactacagggagcgagaaagtcagctgggaccgctccttttgcccggcctcctcactgccacccaaccccccagccttgatggtgcagcttcggagagaacagagatacaatttccaaatgcgccgacgttcagtccctcagcgtctgcagcacccgctgggctctgagctagagtcccaagtatttttagaaacccgcgagatagaggagaaaggctcatcctccagttggccaggcttcctaagacgctcccccgcgtggccaagtgtgcgccagcatctgccaaggagatcttcctccagcaacaagggtgggacggaatccgttccccgccggaaagatggatgcgcccttcccgggcgtgcccggggctgtgtgcccacttcccatccggggagctcaccccacccccaaacctctacttcctagcaatccacccagttccacgctcaagggctgacctggggggaccgcacaccctggttcggaccgccgaacgctggagggaaggaggcccgggatccagtccccggagagaggcctggaagcccggaaaggatgggagcgtaagggaagggagaggcatggtttgctgggattgccaaagattctcgctccctggcttcctggggccaaagatcctagggagggctgcagtatcccctccctcccccgagcccagaaccccgcgtacttcccccaagccccctaagccaaagcctcgcgcgccctgaccgttcccacccccagccttagcggtctcctaggtcagcaccagcccgcagattttgaaaaggagtggggagtggggagaaggcagccagtcttaacctcagacccccacccacccactttcttagcgtgaggtaagtcaaatgtaacaaagtgaaagtcatcgagtgtagtggcttcaacagcttctcaggctgaaggagccactcatagatttgggccagcgaggggggtttgctctcctcgcctttgcggctcccgaagtcacttttcctcccgtagccggacgctgccgcccggggttcagacagcgcgcgagaccaggggagatgcgggggagggtgggcggccctgggcttccggccgaccgctcgcaggccggaggccgagcgttctcctccccgccccaatcctaggcgcggggtgcagcctgtggtcggaggggcctgcaccgggagccccgcccgccccagggccccggtacccccggcctccccgcccgagaggaaccgcctgtgggagccccgcgggcggccgggcccggctcccaggcccaggcctccggcccggcgcagtaggacaaacgggagggcagggattttttctttttttcttttttaaacacaggatttttattaaaattcttatttaaaaaatcgaaagctttctgcgcccggcgctgttggggaaccgcgccgaatagctgagctc

SEQ ID NO: 119311 - DNA, 2962 bp, Homo sapiens
  misc_feature 1..2962: note = chr20:21492293-21495255
  misc_feature 1..2962: note = Hyper
  source 1..2962: mol_type = genomic DNA
aacattctgtaaacacggcgtagagttcagccctctcccaaggttcagaaggagaggcatgggcagagctgggtgggtggaatctgccactccaaggagacgcaggcaacctcccggcgcctccctagtggagccgagagtcaactcgactccataataataattataataataataataaccaccataaggaccgaggcctcctcgccgccaccgccgccggggtggggcctgggcctggggccgcgagtctcgttggggcggcgctcaccaagtccactgctgggcctggaccagggggtgtgctgtcgggtactggggggtgctggccgagctgtactgggcgttgtactgcatgtgctgcagcgactgcgcgctgtaggcagaaaagggaatgcccgcctggaaggtggcggctgccaggtcctgggctttgagcgcgtgacatggtttgccgtccctgaccaagacgggcacggccacccggcgcggcgagggcaggggcgtcacctccatacctttctcggcccgggcgcgcttcatcttgtagcggtggttctggaaccagatcttgacctgcgtgggcgtgaggcggatgaggctggccaggtgttcgcgctcgggcgccgacaggtaccgctgctgccgaaagcgccgctccagctcgtaggtctgcgccttggagaaaagcactcgccgctttcgcttcttgccggcgtcccccccgccgcccggggtctccttgtcattgtccggtgactcgtcggccgagggctccggggacttggagcttgagtcctgagggggcgccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagggtaaagagggaaatccgtaggagtgggggctaggggctcgcctttcaaggggctcacatagtgtgggtgagaatttggggggggaagtggcactgaagatcatcgcgggttaagggctccggcgcccttaagcggtttcctctccggcgagacgtgggcagatttttaaaagaaataccccacaatcccagcattgatcggctcggccatttaaggcaggtttttgggggctttcgtttctgctttcgggccttctagacaccccctgcactgcacaaagcgtcctctatgatcgcgcagggggcagggtgagctatttatacccgggccacccgaagcctccccaccctccacccgtacccggacgaggctcgctggctacctccagggcgccaggccagtccctcccagcggccggagtccgggggctgcggctggagccatcggtccgggttgacatcatataccagcccctgggaggtatagcccttctccctctttctccttaacttctcgcattgaaaaaaattttggagaccaagttctttcccggaactaaggaggcttgaagaggagggcagaggacatcctatacaggtgttaaaaatctttctacggatccgagtgagggggtccgggcttacatggccccttcccctttcactcccagcgtccaacccgggctgcggctgcaggaatggaggggaccacggcctcggcagccaagttttgctacttacgggagtactgaaggccctcggtgctggccagccagcgcgtgtacgggttgtcgctgctgtcgtagaaggggttcttcaggggcaggctctgcaccgcgtccagggcgccctgccccagcggcccggccctcttggctggctcgggcccctcgttctcttcctccggaccttcggccacagagccctcctcatcgttggtgtccggcaggtctaagatgtccttgaccgaaaaccccgtctttgtgttggtcagcgacatggttcgagaccccaaaatttatgtcgcaaagttgtagcttcacttggtcaattcgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctgtcttctttgaaagcacgcggaaatggacgcaggaagccgggcggcctgcgcgccgagcgccgcgggccccggccttagtttctaactccaggaggggtgccaaggcggcgtcagctcgggctccggcggccgctcggcgcgcggtggcggctggtggcgaggaaaaaatgggccattgcccgagcgatcagtccatataaggctgggctccactcacgaacctggggaggcggggagagggggagaaagagagggagggagggaaagaaagagggagggagggggagcgagagagggagcgggagaagggtggaaaaaagggggaagagacattaaaaacgcaaaggttggccacgtgtgggcgggtcttgggagtcaagtggatgaagacagtatttgcagatgtgaaattgtgggttttggggagctccgcgctcccagccaacggccctctagagcaagatgagaggtgtaacgtgtcaattaattgcaaagacggggcgagcctttttttttttaaacccagtatttacatacaaagggccaccgcgtcgctcgcgagtccacacacttgaaagggccgttttaacaaattgcatcttaaaaaaggtgggggtggggaggaggaggggagaaaacaaaacagaaaccaggaggagggaaaaaatcctctttaacattcaccggttcctacctccccgcccccgcgcgcccacccccggca

SEQ ID NO: 119312 - DNA, 3353 bp, Homo sapiens
  misc_feature 1..3353: note = chr20:21495662-21499015
  misc_feature 1..3353: note = Hyper
  source 1..3353: mol_type = genomic DNA
tcactttctgctttgcgggcggtcccggggagggcggggtaagagtgaggagctccaacttcgtctggggtcggaccctggccctgctgcctctgggctctgcgggcctctttccccgggtggaggaaagggcagacggccctgctctttcctgccctctattatccctccctctccggccccctccctctccagcctctggctagaggtggagcagcgggaaggcggcggggcgggattgcgggggtgggggtgggggttgtgtctccagcctgggtgaagacccagaaagctgcgggggaggggggtcgctgggtggcccgacgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagattggctacctgatgctcgttcgccccagaggagtgtcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccagcgctgggtgagggcacctctccccgagccgctcggcggctttctgcagccctagctgcctcgcccccagtatgtgacgtgggtgacaatggcccaggttagagcaagcccctcgtcggcgcgtcctgggtggtcggacccgggcaaacacaaatacaaaccgattgctaagctgcggacaatgagcgaaatgtagacaaatgtcccgctcccgttggaagcctttgtcccggctcggtttttgcatttatttcagtggcgaaataatacatgattgacgctctctttcaatgtgtcctaactgtttggaataaatctaaggttgttcctagttgtcatggcattcaacccttttcaatggactatctcttcattcatttctgaatccgtccacaatattaaggaaaccccttcatgtcgacgctccccgattcctctttctcctcctactttttcttttctcctttctccccctccttccccccttttttcccctggaagaattagaaacttgtttgaatcgtcttcctcgaacccattacttttcgtgctttttttttttttttgctcgctttccgtctctgtctttctcagcgccccccctcctccgccctttcacgtgggagctcgtcgctctgccccgtcggaggagggaagttggttctccaggagtcggggaagcgtcgagtttggatccaggggcgggagtgggcctgccactgctattgttactcagctgctaaataaataactggagagaaaaaaagttcctcaacccaagcgttgcagcaaagaccctccttttgttcctcctcttattcctcagtcctaagggggtggaggctgtcttggggtccagggcagccactaggttggggacccagaataggatctggttgggccaggcaaattcttgggtcaggtggcaaaggggtctttggcagcaagtgtcgtttctcgcatatccccagagccctcttaggtgggggagtgcccgcagaggcctcccaaagcgtgttcatttcttcagctgggaaccacctcgctgaagttccatgtagttcccaacttctctcccccttccccagcatagtgaccctttcttctcaggatctaaatcagcaccgctgctattgatcaagtcccctcccctcacccgtgggagcctgcaaggtccgcagagcgcctgagagaggattgctttcctaggggaatcctggctcctggaattaatcacggggagggagtgctgccataggcgcctagagaaggaggccctcagcccagttctcaaaggtcgggtttgcctttgcgcctgccccttagcctcaatgaccagccgaatccttctgggtctcagcttgcggtgtcctcttgtcggagcacctgaggcgcccacttcccctgccctcgcaggacgcctcctggactccggcccctcctacactttcaccccagcgagtcttccagtttttatttcccctggcctgggggcagctgggcagggagggagagaattggagagagcttcggccttgcctcctccgcgatcggtgcttccgggtccacagcactcagcctctcccgggacctcgagactcatttccccatcacttctcgtccgtgtggttcccgcgtccatttccagagcgttaacatttgcaattgaaaaggcgctgggagaccgctgggaggtccgtaattgaaggggagaaactgggcttgttagtggaagatcataaaatgcaagtcccccaggagcggcctgtggacgccgggaggcctgcgcaggcccagctggcggccagggcaagtccggtgcccagagcacagtccagtgtctcctcaatttcttgggcccggcttgcgcccaaagagcctaggggccaggcgccaaacgcaccttttctgtcccaattaaacaggtgattgcatcctgaggactccccaagaggcctccccgagagtaccacagctaggccttctagagcccaggagctttggttctctgcgatcccgcacacccgcaggctgagaggccctgccccgctcccttccccctccggagggttcttcagtaagggcccaccactcccaccctgtcagcgtctgcctgcaccagtttcagctcctggtctcccccactcggcattctttagtaaattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatcagcattggggctccagattccgtacacatctctagctctattcattcttcctaggttgagaacggacgcattgggagtcct

SEQ ID NO: 119313 - DNA, 374 bp, Homo sapiens; identical to SEQ ID NO: 87207
  misc_feature 1..374: note = chr20:21499224-21499598
  misc_feature 1..374: note = Hyper
  source 1..374: mol_type = genomic DNA

SEQ ID NO: 119314 - DNA, 247 bp, Homo sapiens; identical to SEQ ID NO: 37992
  misc_feature 1..247: note = chr20:21500104-21500351
  misc_feature 1..247: note = Hyper
  source 1..247: mol_type = genomic DNA

SEQ ID NO: 119315 - DNA, 1864 bp, Homo sapiens
  misc_feature 1..1864: note = chr20:21501381-21503245
  misc_feature 1..1864: note = Hyper
  source 1..1864: mol_type = genomic DNA
ctccttggctttattcgttcgcgctgctctaatgactaaatatgttacaatgagattacgcatcgtcagtgttgccttcaggaacgttctttcagccaagcccgaccttccccggatgagggcgatttcaatacgggagatctgggtttctccaggaaacacgcgctgaaagcactctcttatctgaatttacttcttaacacgtgacaaaatcattaccacaagactttggaaaacaagcggctctcctaacgggttgcattcagcacttaaagctgggtcgggcaggctgatgtgaaaagtagttgtcggtggcgcggagaaggcacgctcttagctggagctaagggctggttccgggaaggacagggaatgcacccttgggccctcgggcacagagagggggttcctagggctctgtctctctctctccaatgtgagccccagaggttcacaaccttcccctagacgcaacgtcccctttccacccccaagagccactaaagtcgagaaggcgccagaggagctccaaagggcctcctggtagtgtgtgcgtgtgtgttgtgggaggaggttggggcggagggggcgcccctcggagacaaggaccccaccgaggttcatttctgatcctctggcgatctctactgacacaaacgagaactgtccggcgccgggcgcggcccaggcgacactcgcctcccaaactccagtcttcagtcgcctctccagagacctcagtccactgcgcgggccctcagccccggctcctcctgtctgcgactcccaccacttgccctcgtgctcatcaccaccgtcccctcacgtcccagttccgtctgaggagaagcccctgtctccactgggcgccatctccaaattaccttcgggacttctgcctctgtttcaatccccgatcccgagctccctgcgacgcacagggggcgacttacccggtggaggtgggtgcagcggccgccccttcctcaccgcggccccgccagccgaggcgcaaccggccccgggcaatcgggagggagctagccaggcgctccgcgcgcccgctccgccttctactcccggagctgcggcgacagccccgccgcatttcaaggcgcgtctttatctagtactccacctacccggacccccctcgctctgcgcccttcccccaccgcgcgccctaccaggcggggctcaggggaccgcaggcggggaccgccgcgggtgccgcgcccctccctcctcctccgcctcccagccccgcaccttcccagcccctgggacagtcccgctttccctgaccgcaccggaaagtgcgcagcggcgggatcacctggcctcggcggctggtaaaacttttcctgactgcaggcgcgacagaggggccctgcccgtcctcgagtgctcgccactcctgccgtgatccgcaaagtcggggagaacttcggaggcccgcacttgcccacctgctgcgtccggactacgcggcttggggatcgagccgagtcaggacccgggagagcgaggggctcataaccggggtccgccgtgaacccgagctccggcgccgctcggcggcgacgacggtgccccgagacccctctctgctggcaggccgcggtgaccgtgcccggagcgcgttcccgcgccgggcggctgtggcaggaggaccagacagtcagcgcctggcagcgagggcgacgccgggcttcctccatcgccaccgccgggctccgctgcggctcccgggctccgccgggtgccccgcgccatccccatcccgcgttcaccggaaacgcgtgcgagctggaggctcacctggagcgcgactgcgccgctggagcctcggctgggcgagcgc

SEQ ID NO: 119316 - DNA, 430 bp, Homo sapiens
  misc_feature 1..430: note = chr20:21503574-21504004
  misc_feature 1..430: note = Hyper
  source 1..430: mol_type = genomic DNA
acatggtaggctttgcggggagggggcttccaccccgcctcggccccctgcccccaaacgcgcgggtagattccctccctcctgcgcccctctgagcaggagatctgggaccccaggtttctcctgaccctcgcccctcctccgtccccagcagtgccttggactccgcagctcctggcgagcccggactgctggttaacaaggtcgccatctataaattgctcggtcgctaagacgccataaaaccaaagggccagatgtggcacgttatttatgtgtgaaaccgcgtttacactagatacgcggatccaaggccgatagcacgacttcgcgggaggtcacagacctctcgccccggctccaggctcctcccccagcacgatctcctctccaggttgaggggtgtcggtcttgccgggaaagggattca

SEQ ID NO: 119317 - DNA, 30 bp, Homo sapiens; identical to SEQ ID NO: 87214
  misc_feature 1..30: note = chr20:21504416-21504446
  misc_feature 1..30: note = Hyper
  source 1..30: mol_type = genomic DNA

SEQ ID NO: 119318 - DNA, 17 bp, Homo sapiens
  misc_feature 1..17: note = chr20:21651132-21651149
  misc_feature 1..17: note = Hypo
  source 1..17: mol_type = genomic DNA
aaaccagctgcaggccg

SEQ ID NO: 119319 - DNA, 264 bp, Homo sapiens
  misc_feature 1..264: note = chr20:21682255-21682519
  misc_feature 1..264: note = Hyper
  source 1..264: mol_type = genomic DNA
gacgctctgaccttgcgctccgaggcggcgctcacaggcgccaattcagaatctagtcttcctctccccttcctcgctccctccttccaccgccgcagtcattccccgcggagtttcgttgtgttgttacacaagccagcttttggtttgttagttgttcgcattcccccagggtttgcagctccccgatctggctcagctcttcttcccatagtttctttgcagctagcagctcctcatttctcttttcgtcaattttcttct

SEQ ID NO: 119320 - DNA, 46 bp, Homo sapiens; identical to SEQ ID NO: 87218
  misc_feature 1..46: note = chr20:21682946-21682992
  misc_feature 1..46: note = Hyper
  source 1..46: mol_type = genomic DNA

SEQ ID NO: 119321 - DNA, 1122 bp, Homo sapiens
  misc_feature 1..1122: note = chr20:21683311-21684433
  misc_feature 1..1122: note = Hyper
  source 1..1122: mol_type = genomic DNA
ctcctttttgactcccgctttcggcaaagagtttacctctctttcttttcctgccttgggaaaactgggcgagggcccgaagcctctggggtaccctcagatccatcctctgccctgctaggagtccagccccaggcggaggagttttgccccaggtttctgagtgcgccctcagctaacaggctcccgcgaccctggaagcggaactttgttgcactccgcttccagaggacgctgaaatacggtgccaaacccagccaagcaaaaacgcagaatccgcgagctctttacctctgtgcgctcagcgctgactagtagctgtccccgggccatggagagggctaagctgcctccttgggaggtgggagagacgtttcttttccttctgcaatctcatcttagggccatctctcaccaagcctagcctgcagctcgggaacccgcgatacccggccgggggacgacagggggcgacaaactgtaaggttttccctatgcccgaccgtgcagaaggctgcagcgagggctgtgtgctcccgatcgcgcacagctggctgcgggaaaggggccaggattgagacgaaggctcgcggactctgctaccggggagaaccaccccctctcatcgtgcgcaatccccagactcacccctctacagtagcccccagccacgggcggccttcacggggacgggggcggagttttgtcctggactgcgactccttgccacttttccaagctcggcagcagaggtggggtggacgttcccctgaaagggtagttgggcgaaccagctctcacggtgtcacgaccggctttatttcctcgtctttagagtgtgcctgttgactcctcacctactggggggaagaagcggctttagctgcttttccggatcacgagtatccactggactgaggcagggatgtggcgttcctttatctcagagactccaaggtctggaaatcaacctttcttggtatctcgcgcccgacgaagctagcagattccgcaatggagagcactgggcagggtgcgtccccactccccgcacccccggagccccgagcatactgtgcgtgcttagtcctctcttcgctgccttcgcggaactcctggctt

SEQ ID NO: 119322 - DNA, 30 bp, Homo sapiens; identical to SEQ ID NO: 38003
  misc_feature 1..30: note = chr20:21685666-21685696
  misc_feature 1..30: note = Hyper
  source 1..30: mol_type = genomic DNA

SEQ ID NO: 119323 - DNA, 558 bp, Homo sapiens
  misc_feature 1..558: note = chr20:21686184-21686742
  misc_feature 1..558: note = Hyper
  source 1..558: mol_type = genomic DNA
ggtagagtttcagggcggggaggggggcgctggggcgcagtgacgggaaccaatgagctgccaactcgcgcgtctccggcgtgactgccgagattgacgtggaggacacgtcaaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatgggtaaggggcgggcgacaggcagggctcgggagggctgatgaggtgggtcgggtccgcctgcctcccttccctctcgtccgctttccctgggcgacccagtcctggg

SEQ ID NO: 119324 - DNA, 848 bp, Homo sapiens
  misc_feature 1..848: note = chr20:21686963-21687811
  misc_feature 1..848: note = Hyper
  source 1..848: mol_type = genomic DNA
tcacctttggaagtgcgcctgggtgcagtccctcgctccgcgtggggacccttggctaacccgccgggtgttttctccccctccggctcactcttgtctggcgcatccgcagagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggtcagttgtggcggcctccgtagccttctattaaggggcagaacctggggcgggcaggcttgcaggagaggactcacactcgctctcctcccgggaccggttctgg

SEQ ID NO: 119325 - DNA, 30 bp, Homo sapiens; identical to SEQ ID NO: 87227
  misc_feature 1..30: note = chr20:21689196-21689226
  misc_feature 1..30: note = Hyper
  source 1..30: mol_type = genomic DNA

SEQ ID NO: 119326 - DNA, 149 bp, Homo sapiens; identical to SEQ ID NO: 38008
  misc_feature 1..149: note = chr20:21689912-21690061
  misc_feature 1..149: note = Hyper
  source 1..149: mol_type = genomic DNA

SEQ ID NO: 119327 - DNA, 45 bp, Homo sapiens; identical to SEQ ID NO: 87229
  misc_feature 1..45: note = chr20:21693467-21693512
  misc_feature 1..45: note = Hyper
  source 1..45: mol_type = genomic DNA

SEQ ID NO: 119328 - DNA, 141 bp, Homo sapiens; identical to SEQ ID NO: 38010
  misc_feature 1..141: note = chr20:21694434-21694575
  misc_feature 1..141: note = Hyper
  source 1..141: mol_type = genomic DNA

SEQ ID NO: 119329 - DNA, 337 bp, Homo sapiens
  misc_feature 1..337: note = chr20:21694952-21695289
  misc_feature 1..337: note = Hyper
  source 1..337: mol_type = genomic DNA
ggggtctctggagagcgcgagtctctgcttcactcttccagagccttcaagggttgagcgctcacgacctcgctctgcaggcgtcctgagtcccagtgcctctcgcactgcgcggcgctaggtagtgatccgacgcctctgtgcttcctcccgcagtggctgacaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgg

SEQ ID NO: 119330 - DNA, 261 bp, Homo sapiens; identical to SEQ ID NO: 87232
  misc_feature 1..261: note = chr20:21748255-21748516
  misc_feature 1..261: note = Hyper
  source 1..261: mol_type = genomic DNA

SEQ ID NO: 119331 - DNA, 233 bp, Homo sapiens; identical to SEQ ID NO: 87234
  misc_feature 1..233: note = chr20:22356457-22356690
  misc_feature 1..233: note = Hypo
  source 1..233: mol_type = genomic DNA

SEQ ID NO: 119332 - DNA, 887 bp, Homo sapiens; identical to SEQ ID NO: 87235
  misc_feature 1..887: note = chr20:22557396-22558283
  misc_feature 1..887: note = Hyper
  source 1..887: mol_type = genomic DNA

SEQ ID NO: 119333 - DNA, 155 bp, Homo sapiens; identical to SEQ ID NO: 87236
  misc_feature 1..155: note = chr20:22558541-22558696
  misc_feature 1..155: note = Hyper
  source 1..155: mol_type = genomic DNA

SEQ ID NO: 119334 - DNA, 187 bp, Homo sapiens; identical to SEQ ID NO: 87237
  misc_feature 1..187: note = chr20:22559055-22559242
  misc_feature 1..187: note = Hyper
  source 1..187: mol_type = genomic DNA

SEQ ID NO: 119335 - DNA, 150 bp, Homo sapiens
  misc_feature 1..150: note = chr20:22559622-22559772
  misc_feature 1..150: note = Hyper
  source 1..150: mol_type = genomic DNA
tagagttggggaaagcgcgcagtggcgatttgtgagctcgttatctcggaacccgggctaggggagggatttaagcgggaggggggcgtgaaagacacaagaagcacagaaaagcctccgaaagcgcctgctccccgacatcctttttat

SEQ ID NO: 119336 - DNA, 169 bp, Homo sapiens; identical to SEQ ID NO: 38018
  misc_feature 1..169: note = chr20:22559973-22560142
  misc_feature 1..169: note = Hyper
  source 1..169: mol_type = genomic DNA

SEQ ID NO: 119337 - DNA, 171 bp, Homo sapiens; identical to SEQ ID NO: 87241
  misc_feature 1..171: note = chr20:22560380-22560551
  misc_feature 1..171: note = Hyper
  source 1..171: mol_type = genomic DNA

SEQ ID NO: 119338 - DNA, 339 bp, Homo sapiens
  misc_feature 1..339: note = chr20:22562562-22562901
  misc_feature 1..339: note = Hyper
  source 1..339: mol_type = genomic DNA
caggcccgttttgttcgtgaccgggcccatggccaagctgccaggcatgggggaaccgtagccggggtagtgcatcacctgttcgtaggccttgaggtccattttgtggggttggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgctgctgcccgggagagggcgccggctctggggggctcagcgccgcagccggcgtccccttcagctc

SEQ ID NO: 119339 - DNA, 30 bp, Homo sapiens; identical to SEQ ID NO: 87243
  misc_feature 1..30: note = chr20:22563764-22563794
  misc_feature 1..30: note = Hyper
  source 1..30: mol_type = genomic DNA

SEQ ID NO: 119340 - DNA, 34 bp, Homo sapiens; identical to SEQ ID NO: 87244
  misc_feature 1..34: note = chr20:22564154-22564188
  misc_feature 1..34: note = Hyper
  source 1..34: mol_type = genomic DNA

SEQ ID NO: 119341 - DNA, 30 bp, Homo sapiens; identical to SEQ ID NO: 87245
  misc_feature 1..30: note = chr20:22565429-22565459
  misc_feature 1..30: note = Hyper
  source 1..30: mol_type = genomic DNA

SEQ ID NO: 119342 - DNA, 254 bp, Homo sapiens; identical to SEQ ID NO: 87246
  misc_feature 1..254: note = chr20:22565952-22566206
  misc_feature 1..254: note = Hyper
  source 1..254: mol_type = genomic DNA

SEQ ID NO: 119343 - DNA, 414 bp, Homo sapiens
  misc_feature 1..414: note = chr20:22567354-22567768
  misc_feature 1..414: note = Hyper
  source 1..414: mol_type = genomic DNA
cgcaggagaagggggcgctacacttccaaggagcggactttggaagcccccacctccaccacagcactattggtggccggggtcagggacaccagagagcgctcggcgggggcttccacagtgacagggcgccccctgtcggccgccaggcccgcgggaccgacccgagtcctcatttacccccgcgatcccaaccccgcagctccggcaccggagcaccttctcccccgctctcccagtctctccgaaaacgccttcggggggactcggcctttttggagccccaacccctaggttctgcgcgaacccaaaacggcctcctgcaccctggcgaggttctgggagctccggtagggtagggctggatgacgcctcctagagtctcggagcagccgctcccgcaccctcccggca

SEQ ID NO: 119344 - DNA, 73 bp, Homo sapiens; identical to SEQ ID NO: 87249
  misc_feature 1..73: note = chr20:22634183-22634256
  misc_feature 1..73: note = Hypo
  source 1..73: mol_type = genomic DNA

SEQ ID NO: 119345 - DNA, 23 bp, Homo sapiens
  misc_feature 1..23: note = chr20:22656661-22656684
  misc_feature 1..23: note = Hypo
  source 1..23: mol_type = genomic DNA
gcgcccggcgggtctggccatgc

SEQ ID NO: 119346 - DNA, 30 bp, Homo sapiens; identical to SEQ ID NO: 87251
  misc_feature 1..30: note = chr20:23015837-23015867
  misc_feature 1..30: note = Hyper
  source 1..30: mol_type = genomic DNA

SEQ ID NO: 119347 - DNA, 1483 bp, Homo sapiens
  misc_feature 1..1483: note = chr20:23029003-23030486
  misc_feature 1..1483: note = Hyper
  source 1..1483: mol_type = genomic DNA
gctggcactggtactcgcagttggctctgaagcacgggtccacgggctccacacactcgccgtccaccaggtcgtagttagggtagcagtggcactcgaagccaccctgtgtgttgacacagcgctgcggacacggactgggctccagtatgcagtcatccacgtcctcgcaccggtgttggtcggccgccagccggtagccggtctcgcacatgcacgagtaggagcccggctggtcggggttgggaacgcagaagtgctcgcagaggtcgttgcaggactgcgtcgcggatgcggtgcaggagcgcccgtctgcctgcagggcggcgccggctgggcactggcagcggggagccccagggatcgcattgcacgcgtgctcgcagccgccgttctccacgctgcagtcccaagcgcccggcgcctccctggcccagtgcccctggaccgctccgggcggcgcggtgcacattagctgtaagccgaggggagccaccgcggcggagctgcccaccggcagcgcctggaagtccgctccgcgggccgcgaacggggtgccgtaggtgatcgagacggcggcagccgcggcgccgggctccacagccagtggcctgcaggtggctgggaagtggaactcgcagaggaagccatcggccttcacttcgcactgctgctcctcccagatcggctcgctgggcacagtggcctcagcagcggagacagcgacgcacaacgggccgcagaggggagccccattgaggtcgagccgtgcccacctgctatagctggtgttgttgtctcccgtaacccactggaagccgcgcaggggcccgaggcgcttggggtcgccgcagccgggtggcagctgcaggccgatccagaggcgccggcggccaacgccgccgtcgccgttcagtagcaaggaaatgacatcggcagccaccgaggagcgcactgtcattaggtggccccgcagtccgtcgcagatctgactggcattgaggaaggtcgcggggcccgggtagagcgcgaagcagtcgtgctcgacgcactggctgccacccggctgcggctctgcgggtgcggggaaccccaggccggccagggccagcgcgccaaggaccaggaccccaagcatgttacccaggcgcgccgcgtgcaggcgccggggaaagcgcgggcactgcgacagggccgtgccggagcagaggggcacaggacgccgatggcgacagcctctcctgtccgtcccagcccagacacttcttgccgctgcgcgcagcccctgcgaggcagcctctgacatgcggatcggccagggctcgagtttataagtgcccggccctccctccctggacgttcgggaaaaggaaggaagtgcctggtgggaagggctgatgccgcatactcggattgctgggttctctggccgcccttgcgcccgccctcgcgcatgggatcacctcgccgggatgagtaaacc

SEQ ID NO: 119348 - DNA, 888 bp, Homo sapiens; identical to SEQ ID NO: 87255
  misc_feature 1..888: note = chr20:23030745-23031633
  misc_feature 1..888: note = Hyper
  source 1..888: mol_type = genomic DNA

SEQ ID NO: 119349 - DNA, 30 bp, Homo sapiens; identical to SEQ ID NO: 87256
  misc_feature 1..30: note = chr20:23031922-23031952
  misc_feature 1..30: note = Hyper
  source 1..30: mol_type = genomic DNA

SEQ ID NO: 119350 - DNA, 45 bp, Homo sapiens; identical to SEQ ID NO: 87257
  misc_feature 1..45: note = chr20:23092381-23092426
  misc_feature 1..45: note = Hypo
  source 1..45: mol_type = genomic DNA

SEQ ID NO: 119351 - DNA, 17 bp, Homo sapiens
  misc_feature 1..17: note = chr20:23114731-23114748
  misc_feature 1..17: note = Hypo
  source 1..17: mol_type = genomic DNA
gggcgcggtggctcacg

SEQ ID NO: 119352 - DNA, 107 bp, Homo sapiens; identical to SEQ ID NO: 87259
  misc_feature 1..107: note = chr20:23117794-23117901
  misc_feature 1..107: note = Hypo
  source 1..107: mol_type = genomic DNA

SEQ ID NO: 119353 - DNA, 85 bp, Homo sapiens; identical to SEQ ID NO: 87260
  misc_feature 1..85: note = chr20:23138452-23138537
  misc_feature 1..85: note = Hypo
  source 1..85: mol_type = genomic DNA

SEQ ID NO: 119354 - DNA, 397 bp, Homo sapiens; identical to SEQ ID NO: 87261
  misc_feature 1..397: note = chr20:23618248-23618645
  misc_feature 1..397: note = Hyper
  source 1..397: mol_type = genomic DNA

SEQ ID NO: 119355 - DNA, 83 bp, Homo sapiens; identical to SEQ ID NO: 87262
  misc_feature 1..83: note = chr20:23969237-23969320
  misc_feature 1..83: note = Hypo
  source 1..83: mol_type = genomic DNA

SEQ ID NO: 119356 - DNA, 2584 bp, Homo sapiens
  misc_feature 1..2584: note = chr20:24449601-24452185
  misc_feature 1..2584: note = Hyper
  source 1..2584: mol_type = genomic DNA
ctggagtctgaactccgcgcccgcttgctcctccagggcttagctggtcaggacttgaacattcgccggatccataaattgggtcatttttaacctcaaaaccgaaccgcagcctggggaggcctttaggaccgaggggagccatcccttcctctagtcgggcagcaaattcctgtcctcctagtcccccgcagctatcccccgcccccagcctctgtggccctcacattgtcagacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagaggcgtggggagcagagcggcgctgaggggagggcagaggaggagagagcctggcagcggaggagcagaggcgggcgccgcaccgccccgcacgctcgctcgctcgggagagtcgcgggcggccgcttgggcgcacttgccgggtcaccttgtcccggaggtaagtccagacctcccggccgcgggggcgggcggaggggcccgcagtgggcggggtcgcggcaggggccgcgagctggcggcgggagctggaggctgccctgcgctggcgggtgtcctagtcctggctccgcctcggagcgcgcagacccggcggcggcgtggcgcccgcggtaagtccgggtggtcgccgcgacgagacttgggagacacggggtcgcagggcgggagggggagctgagccggcagagaaaatgcccaggaaggggtcgatgctggcctgggctgcaccttggtgccttgccaccccgggagacgcgaaggggctgctgtgcgaattcgatgggagctggtgagaccgagaactgagagcgtagcggagccaggctgcccagcagggccatgagggcgcgcggcgggccaaggctctgcgggttcgggctgcccctcggagtgacccgaaggagaccagccagggctggtgagccgggcggccacggagctggggacctaggtctgtttgggagtaggaagggaaacagactaattctccgagcggagcggcaggcaaggtgcaagcgcgcttgggatggggaatcccgacgggcgaccgtggcggaagcagagactcctggagcctctttcctctagccaggacaagacctgccttcaaaagctgtctggcccctggcagccgcgacagcctgcagccctgggagccacagccctggcgccgagatgggagcgagcacatacgcttttttggttccaatttgaatctcgctttttcctagtcgtgatttctgcctcttcatgtgcactctctgggcagtgaggaggaaggaatggctcactggatgagttgggcacttttcttagggaaggggctttgtccctatgcgctttttgcaagaccctactagagtggctctggcagccgagctttgaggaggcggccagaggggccgcttggcgtttctgaaagacgagaggaaggggtcttctggtagtcctgttttcctttgggggtttcgttgcacgcagaggcttgggcgcttggcacccagacttcaggtgcgcacagtcctcctgcgacgtcagatgcgctggcgccgcggcgctcctggctcggaccgatgcctgcgccttccctggccacgtcctggtgtttagtgcagcagacaccggccgaaggcttggctgattgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttggcggtggtgtggcccgttcttttggaggtccacaccacaggtatgaggcctgtgggccctgaggaagcgcgatccccttaattcctccctcccctctctctccaccgcccgcccctttgcaaggagcaagcctgacagtagctgatcggcgccctctctcaccc

SEQ ID NO: 119357 - DNA, 94 bp, Homo sapiens; identical to SEQ ID NO: 46108
  misc_feature 1..94: note = chr20:24467593-24467687
  misc_feature 1..94: note = Hypo
  source 1..94: mol_type = genomic DNA

SEQ ID NO: 119358 - DNA, 152 bp, Homo sapiens; identical to SEQ ID NO: 87271
  misc_feature 1..152: note = chr20:24485768-24485920
  misc_feature 1..152: note = Hypo
  source 1..152: mol_type = genomic DNA

SEQ ID NO: 119359 - DNA, 251 bp, Homo sapiens; identical to SEQ ID NO: 87272
  misc_feature 1..251: note = chr20:24523851-24524102
  misc_feature 1..251: note = Hypo
  source 1..251: mol_type = genomic DNA

SEQ ID NO: 119360 - DNA, 30 bp, Homo sapiens; identical to SEQ ID NO: 87273
  misc_feature 1..30: note = chr20:24557052-24557082
  misc_feature 1..30: note = Hypo
  source 1..30: mol_type = genomic DNA

SEQ ID NO: 119361 - DNA, 188 bp, Homo sapiens; identical to SEQ ID NO: 87274
  misc_feature 1..188: note = chr20:24570981-24571169
  misc_feature 1..188: note = Hypo
  source 1..188: mol_type = genomic DNA

SEQ ID NO: 119362 - DNA, 92 bp, Homo sapiens; identical to SEQ ID NO: 87275
  misc_feature 1..92: note = chr20:24571457-24571549
  misc_feature 1..92: note = Hypo
  source 1..92: mol_type = genomic DNA

SEQ ID NO: 119363 - DNA, 34 bp, Homo sapiens; identical to SEQ ID NO: 87276
  misc_feature 1..34: note = chr20:24577284-24577318
  misc_feature 1..34: note = Hypo
  source 1..34: mol_type = genomic DNA

SEQ ID NO: 119364 - DNA, 30 bp, Homo sapiens; identical to SEQ ID NO: 87277
  misc_feature 1..30: note = chr20:24591039-24591069
  misc_feature 1..30: note = Hypo
  source 1..30: mol_type = genomic DNA

SEQ ID NO: 119365 - DNA, 35 bp, Homo sapiens; identical to SEQ ID NO: 87278
  misc_feature 1..35: note = chr20:24646770-24646805
  misc_feature 1..35: note = Hypo
  source 1..35: mol_type = genomic DNA

SEQ ID NO: 119366 - DNA, 30 bp, Homo sapiens; identical to SEQ ID NO: 87279
  misc_feature 1..30: note = chr20:24710156-24710186
  misc_feature 1..30: note = Hypo
  source 1..30: mol_type = genomic DNA

SEQ ID NO: 119367 - DNA, 30 bp, Homo sapiens; identical to SEQ ID NO: 87280
  misc_feature 1..30: note = chr20:24710762-24710792
  misc_feature 1..30: note = Hypo
  source 1..30: mol_type = genomic DNA

SEQ ID NO: 119368 - DNA, 37 bp, Homo sapiens; identical to SEQ ID NO: 87281
  misc_feature 1..37: note = chr20:24859497-24859534
  misc_feature 1..37: note = Hypo
  source 1..37: mol_type = genomic DNA

SEQ ID NO: 119369 - DNA, 30 bp, Homo sapiens; identical to SEQ ID NO: 87282
  misc_feature 1..30: note = chr20:24872315-24872345
  misc_feature 1..30: note = Hypo
  source 1..30: mol_type = genomic DNA

SEQ ID NO: 119370 - DNA, 30 bp, Homo sapiens; identical to SEQ ID NO: 87283
  misc_feature 1..30: note = chr20:24872697-24872727
  misc_feature 1..30: note = Hypo
  source 1..30: mol_type = genomic DNA

SEQ ID NO: 119371 - DNA, 89 bp, Homo sapiens; identical to SEQ ID NO: 87284
  misc_feature 1..89: note = chr20:24872934-24873023
  misc_feature 1..89: note = Hypo
  source 1..89: mol_type = genomic DNA

SEQ ID NO: 119372 - DNA, 30 bp, Homo sapiens; identical to SEQ ID NO: 87285
  misc_feature 1..30: note = chr20:24873703-24873733
  misc_feature 1..30: note = Hypo
  source 1..30: mol_type = genomic DNA

SEQ ID NO: 119373 - DNA, 30 bp, Homo sapiens; identical to SEQ ID NO: 87286
  misc_feature 1..30: note = chr20:24947246-24947276
  misc_feature 1..30: note = Hypo
  source 1..30: mol_type = genomic DNA

SEQ ID NO: 119374 - DNA, 30 bp, Homo sapiens; identical to SEQ ID NO: 87287
  misc_feature 1..30: note = chr20:25003625-25003655
  misc_feature 1..30: note = Hypo
  source 1..30: mol_type = genomic DNA

SEQ ID NO: 119375 - DNA, 246 bp, Homo sapiens; identical to SEQ ID NO: 46113
  misc_feature 1..246: note = chr20:25028280-25028526
  misc_feature 1..246: note = Hypo
  source 1..246: mol_type = genomic DNA

SEQ ID NO: 119376 - DNA, 474 bp, Homo sapiens; identical to SEQ ID NO: 87289
  misc_feature 1..474: note = chr20:25058288-25058762
  misc_feature 1..474: note = Hyper
  source 1..474: mol_type = genomic DNA

SEQ ID NO: 119377 - DNA, 1542 bp, Homo sapiens
  misc_feature 1..1542: note = chr20:25061746-25063288
  misc_feature 1..1542: note = Hyper
  source 1..1542: mol_type = genomic DNA
aggggactgggaggacgctgcgccggcagaggagcgcggtacccgggactcccttttcagcaccccaaggggcggacagttccagggctcgaggccccgtactcttccaggacccgtcaatcattcgatcatttccgcccgcgtttccacctggtaccttgttcggtgctgctggtgaccaccacaggcccgggccttcccgacccacgcagctgccagaggcggagactggcgcctggcgctggggggaaaaatggccctctggagatggttgttgaagaccccagggtctcatcaaaaggttccacccggaaccaggtggtggcggtctcacatcgctgagggaacaggaccccggatgagaggcagggatttaggatgcagcaaggggcaggcggcgcagctccgcgaatgcccctcccgcgacggggcctcgctctgggctccccgcctagatctgggccgctggggccaggggtgcggtggggcgatggtctgtgacccctgcgcggctcagagcctaggggacaggggcaggagcggaaagcgcgggcctgattaccggacgtggagacgctgtcgctgcgcttctggcggccgagcgcaggcggcggacggctgggagccagcggggcagcgggctcggggcccctgggcggcaggaacggcacgtccgctaggagcaggcagggtgctcgagcggccgccggcggctgcgtgccgaagccacagaggaggccgagtcccagcggtagggccccacgcgccaggctggagccgtcaagccccgggcccgggcacggcgcgactgccggaccctcgcagccagatccctgtcctgggccagcgggcgccggcagctcggcctccaagcccagcaggtccgtgatggcgaagccccgggggcgcgagcccctaggggaaccgccaggcaccagcgccctgctgctagtgcgcccgtcggaaagcgagtcccggccggtcatggttccttagcaagcaaggcgcgagcctctctggatcccgtttgcggagggcccagcttagaggaagctttataggattgggctgccggtcgggcgcgggaggcctgaagggctccaatcagctgggcgcgggcgcgtcgccgttccggaccccgcgagatggggacgccaccagttcccctcccctcggttaccgcccacccagctgcagtcccctcagtcacctccttctcctcctctcttctgtccagcccaccccaccccaccccacccccattctaggagggaggggaggaaagaaggtaagggacagtgactccgctgtctgcctgtccctcgaaaagtcgcaagttctacatcctggcgtggccttctccttccttccagactctctgggtggaggccccactcccagctgccctgaagcttctttgatgcgacccaactgcctattaagacctaggaccccattcccaaccacaccccgatggctaccccatatatgtccccagccagccctccacctccgccgccggtgccacgaaggccttcctgt

SEQ ID NO: 119378 - DNA, 1828 bp, Homo sapiens
  misc_feature 1..1828: note = chr20:25063698-25065526
  misc_feature 1..1828: note = Hyper
  source 1..1828: mol_type = genomic DNA
agcacaccttttcatcggggcttacaatttattgtccaatttcacgattattcaaagaaagcctgattctttgaataatcagtgaaactctgatattcgctaaagttggccccaagcacgtgggtaagtaactactggttcgcgctttgaacccaaccagccctcatcgctcggagccctgcgtcccccgcttcccaatcccagaaccccggaagcagatctcctcagtcccactccctgagggtcctacagtccgaggtcccgcagcgagggaggagcaaacgcctgagctccgcgggaacccggcgcggctgcctgcgcgcacgcagggaccggagcccgagcctgggccctgcaaagtgggtctcccactcgctgcgcgttcgagtggggcctccgctaaacatgcagattaaacaaggggcttccgataaggataattacaggaggctgcgcattgactttccgttactaaaggaagacccaaatctcccccttgcaagctgttcccgggattaccaaaacaatcactttcttttgagatcattgtcttttgaaccactccagctcggggcagaacgctttagacgctggcgttgttttccgctccgcgaggaattttcccccagatttatctctgggtttagggaaggcgttgggcattcgggactgcgtagtcgtttgtaaatccgaatttggggtagcagttaagtgagatacctacgcttccacacagtttgtagcccgagaccagtcaggcaggcagggtagtcgattctaaggtggcccgaccggggtcgcccgcgaatggaaagcctaaggggcgagggcggacgcgggcgccgtgcctgcagccccgggtgccgaccaagtggcctcacctgggacaggtcttggggtctccctcccctaggtctccctggaaggtaggcgatcacgggagtgacagaccccgagtagatagccagtgatccaaagacaccaaaaggccaggcggtaggagcccagcctcagacactctctatagtgaccgcggcgcctcgggaaggatcgtcttaaactcattttgcaggtgagagcaactgggacttattaacccagtcacatcggacacagagacgtggcgagggcgacacagagcaggagactcaatcaaggagcccgtattggagctctaaggggactcagagatgcagaaggaacgaacttctaaggggtcttgcaattcctggactggggcgttcctaatgcatcccgggaccccaatgccagggaggggcctgcaggaccccagcggtgggcgagttgtgtcctgggtcaccttgtgtttcgcagcgtggcggtggcaggagcccagcgcgggaggacattttcatagcctcctacagtgagaaacgccccccacccgacgctgcgctcatctgtgtccccgctgttgccggggctctggtatccacttgcgcgccctatgtggtggggatccacccagagcccagcgtcaagttatacgggcgcttcactcagcgtcagccaagaccagggaagcgcttcttgccgtttaggagacgtctgcaagagataaaaagctagcccacgatccacccacaatcctcgtgtccccggggtgccctcgcagttgccaaacctacgggccgcgtttaggggaagcctccgcgtcctggcggccaaaagaatgggctccttccagcttccccctaccggataccacctgcaaatctattgccagaggcgcagctcccgcgaacgttcccgccccgggcggcccccaggagtcgttttgggtccctaaatccgttgagggttccga

SEQ ID NO: 119379 - DNA, 72 bp, Homo sapiens; identical to SEQ ID NO: 87298
  misc_feature 1..72: note = chr20:25065766-25065838
  misc_feature 1..72: note = Hyper
  source 1..72: mol_type = genomic DNA

SEQ ID NO: 119380 - DNA, 30 bp, Homo sapiens
  misc_feature 1..30: note = chr20:25129130-25129160
  misc_feature 1..30: note = Hyper
  source 1..30: mol_type = genomic DNA
ccccccaccccggggcgcccaccaccccgg

SEQ ID NO: 119381 - DNA, 59 bp, Homo sapiens
  misc_feature 1..59: note = chr20:25129434-25129493
  misc_feature 1..59: note = Hyper
  source 1..59: mol_type = genomic DNA
ctggctctttgctgtcgtcactcggttctccgcccatccccgtgcgcacgtgttcgctg

SEQ ID NO: 119382 - DNA, 161 bp, Homo sapiens; identical to SEQ ID NO: 87300
  misc_feature 1..161: note = chr20:25230352-25230513
  misc_feature 1..161: note = Hypo
  source 1..161: mol_type = genomic DNA

SEQ ID NO: 119383 - DNA, 220 bp, Homo sapiens; identical to SEQ ID NO: 87301
  misc_feature 1..220: note = chr20:25230753-25230973
  misc_feature 1..220: note = Hypo
  source 1..220: mol_type = genomic DNA

SEQ ID NO: 119384 - DNA, 97 bp, Homo sapiens; identical to SEQ ID NO: 46116
  misc_feature 1..97: note = chr20:25251463-25251560
  misc_feature 1..97: note = Hypo
  source 1..97: mol_type = genomic DNA

SEQ ID NO: 119385 - DNA, 30 bp, Homo sapiens; identical to SEQ ID NO: 87303
  misc_feature 1..30: note = chr20:25260377-25260407
  misc_feature 1..30: note = Hypo
  source 1..30: mol_type = genomic DNA

SEQ ID NO: 119386 - DNA, 30 bp, Homo sapiens; identical to SEQ ID NO: 87304
  misc_feature 1..30: note = chr20:25281398-25281428
  misc_feature 1..30: note = Hypo
  source 1..30: mol_type = genomic DNA

SEQ ID NO: 119387 - DNA, 30 bp, Homo sapiens; identical to SEQ ID NO: 87305
  misc_feature 1..30: note = chr20:25320569-25320599
  misc_feature 1..30: note = Hypo
  source 1..30: mol_type = genomic DNA

SEQ ID NO: 119388 - DNA, 23 bp, Homo sapiens
  misc_feature 1..23: note = chr20:25344133-25344156
  misc_feature 1..23: note = Hypo
  source 1..23: mol_type = genomic DNA
tgagtcaccgcacctggctgaca

SEQ ID NO: 119389 - DNA, 765 bp, Homo sapiens
  misc_feature 1..765: note = chr20:25565479-25566244
  misc_feature 1..765: note = Hyper
  source 1..765: mol_type = genomic DNA
tggtgtgtgtgactgcgcgcacaggcgggaggaaaggggcgaatctgcaaaacgagtacaacagataaaattcgcaacagacttctacaccctttcaatcaaccgtcccaagcgccacgaacgcgggtcccgctccgtggggggccgcagccacactggcaggagggaatcctgggcctcgaccagacgccggcggcgtcaggagaaacggcccgcgctgggcaggcggcgggcaccgcgtagctcattaccacggggggccccggccaaggccgcccgcctcaggccgagccttggggctgtgctggacccgggccctcgttcgcacggcgcccgcgccgccgccgtcgggaaaccgggttttcaagcgttcggcccagcgggcgctgtattttagggcgtgacccccgccccgccctcgagggcgaccggaagagcaggcaccacagcagatgcgccgagtctgcgccccgcaccgcgaggagcacccgaggccgcgctcccggagccgggtctggtgactaaggcgcgggtcgcgacgcaggggcggccccggactctcgaccccaccagccgcctgaatgtcccgccggacgcccgggccggctcacctgggaggcgcctccgccgtccgcccgcgcggggccaggagcgcggcaccacccccgtaccgccggccgctctttgtgtctggaggccgcgacgcaacactcctcccggcctcgaggcaccgccccctcggtgtcccggcgcagtgggcgaaca

SEQ ID NO: 119390 - DNA, 30 bp, Homo sapiens; identical to SEQ ID NO: 46117
  misc_feature 1..30: note = chr20:25603036-25603066
  misc_feature 1..30: note = Hypo
  source 1..30: mol_type = genomic DNA

SEQ ID NO: 119391 - DNA, 99 bp, Homo sapiens; identical to SEQ ID NO: 87313
  misc_feature 1..99: note = chr20:25968565-25968664
  misc_feature 1..99: note = Hypo
  source 1..99: mol_type = genomic DNA

SEQ ID NO: 119392 - DNA, 30 bp, Homo sapiens; identical to SEQ ID NO: 87314
  misc_feature 1..30: note = chr20:25972523-25972553
  misc_feature 1..30: note = Hypo
  source 1..30: mol_type = genomic DNA

SEQ ID NO: 119393 - DNA, 30 bp, Homo sapiens; identical to SEQ ID NO: 87315
  misc_feature 1..30: note = chr20:26116723-26116753
  misc_feature 1..30: note = Hypo
  source 1..30: mol_type = genomic DNA

SEQ ID NO: 119394 - DNA, 720 bp, Homo sapiens
  misc_feature 1..720: note = chr20:26188812-26189532
  misc_feature 1..720: note = Hyper
  source 1..720: mol_type = genomic DNA
aacctcaggcatggccgggccaccaggaaaacacggccgcgggatcccaccgccacagacacgagggcggtcccgcggcgccccgcctgggacgccggaaggccctcggcacccaccaagacctgcctcacgagcccctggtcccgccaccggggccccgaagcgaccacagccacaaactcaacgccagggccacatcgctcgtgattctcgtccatcctccgacccggtcccgctccgggagaccggcgcgcccccaccgtgggacgctttcccagggccaggcggcccgaccacgtgccacgcaaacgccgtcgtccgcaccggtcgcgactcggcaagggagcgggcggagagctgactcgcggcggaggggggtcactcgccggacggaacgctgcgcgcagccatcgctcgctgtcagccgcgtcccaacccgctaggacgctgggccctgccggcgggatcctccccttactcggaaaggggaggcgccggccacagtaggcgacgagccgcgctcggccaccaccgcggtggccggcggaaccctcgctctccccccgtcaccccgtcgagggggaagctgaggagggttcctctgcaagcgagtcgctactgcagcgctaccataacggagagagagacagaggcggcaggccgggggatcccgtaccccaaggcacacctcttggatcgctagagaaggctttctcaccg

SEQ ID NO: 119395 - DNA, 180 bp, Homo sapiens
  misc_feature 1..180: note = chr20:26189592-26189772
  misc_feature 1..180: note = Hyper
  source 1..180: mol_type = genomic DNA
ggcgctcagggaggcctggggaagggagggggcctgtggtaccaggaaaaacctgcgtgcggcaaccttgagcgttcgcggtcagggcggggaccggcaggtgcgagcgtgagcgcaactccacaagcccccgcctcccacccccccccccaccccgtccacccgcctcttttcttcaga

SEQ ID NO: 119396 - DNA, 518 bp, Homo sapiens
  misc_feature 1..518: note = chr20:26189832-26190350
  misc_feature 1..518: note = Hyper
  source 1..518: mol_type = genomic DNA
ggcggccggccggcgcacgcgtcaccagcccaagcccaccgcgatcgctcacagggcccgtgcgcacccgccagaggggagcaccggacgtgcgctcgccggaccaggcgggcgcccttccccgcgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgaggcagaaggcgggggcgggacagcgaggtcaggccggg

SEQ ID NO: 119397 - DNA, 30 bp, Homo sapiens; identical to SEQ ID NO: 87344
  misc_feature 1..30: note = chr20:29873905-29873935
  misc_feature 1..30: note = Hypo
  source 1..30: mol_type = genomic DNA

SEQ ID NO: 119398 - DNA, 30 bp, Homo sapiens; identical to SEQ ID NO: 87345
  misc_feature 1..30: note = chr20:29958799-29958829
  misc_feature 1..30: note = Hypo
  source 1..30: mol_type = genomic DNA

SEQ ID NO: 119399 - DNA, 30 bp, Homo sapiens; identical to SEQ ID NO: 46118
  misc_feature 1..30: note = chr20:30022593-30022623
  misc_feature 1..30: note = Hypo
  source 1..30: mol_type = genomic DNA

SEQ ID NO: 119400 - DNA, 591 bp, Homo sapiens
  misc_feature 1..591: note = chr20:30063043-30063634
  misc_feature 1..591: note = Hyper
  source 1..591: mol_type = genomic DNA
ctcccccggccgaggcggcgaggggaggggaactggcctgaggggctgctcactgaggcgggtggtacagcctggagcatccagccgctggagctgcgagggaccctggacccctcccacgccgaggtaaagccctgcgctacgcgccgccaacttgctcaagttggagcagagttcgccaggcgattgaagggggattcggcagcgttggcaggaataggggggcttcgaaaccgcgtccctagggtgagggtcttcagacctgggacccggagggctggatagccctggacaaagacccctccaaccccaggatgggggattcacacccgggatgccggctgagaaagctcggacccagactccaggaatggcacagcgttcccgggccctgtggtctgccctccccgtcccctgccaggaccctgtcctgtcacctaacctggggcctgaccggcggcagctcccgtccccaaaagcagttggaggccgtagcgccagccgctcctgaatttttcacacagggggcgggtcagacacgcggttcccatggcactagggcactcgggttacagtcgggttacccccata

SEQ ID NO: 119401 - DNA, 30 bp, Homo sapiens; identical to SEQ ID NO: 16575
  misc_feature 1..30: note = chr20:30101713-30101743
  misc_feature 1..30: note = Hypo
  source 1..30: mol_type = genomic DNA

SEQ ID NO: 119402 - DNA, 28 bp, Homo sapiens
  misc_feature 1..28: note = chr20:30134312-30134340
  misc_feature 1..28: note = Hypo
  source 1..28: mol_type = genomic DNA
ggaggctgaggcaggcggatgacttgag

SEQ ID NO: 119403 - DNA, 30 bp, Homo sapiens; identical to SEQ ID NO: 87352
  misc_feature 1..30: note = chr20:30151940-30151970
  misc_feature 1..30: note = Hypo
  source 1..30: mol_type = genomic DNA

SEQ ID NO: 119404 - DNA, 47 bp, Homo sapiens; identical to SEQ ID NO: 46121
  misc_feature 1..47: note = chr20:30153940-30153987
  misc_feature 1..47: note = Hypo
  source 1..47: mol_type = genomic DNA

SEQ ID NO: 119405 - DNA, 93 bp, Homo sapiens; identical to SEQ ID NO: 87354
  misc_feature 1..93: note = chr20:30175456-30175549
  misc_feature 1..93: note = Hyper
  source 1..93: mol_type = genomic DNA

SEQ ID NO: 119406 - DNA, 42 bp, Homo sapiens; identical to SEQ ID NO: 87355
  misc_feature 1..42: note = chr20:30175841-30175883
  misc_feature 1..42: note = Hyper
  source 1..42: mol_type = genomic DNA

SEQ ID NO: 119407 - DNA, 20 bp, Homo sapiens
  misc_feature 1..20: note = chr20:30181151-30181171
  misc_feature 1..20: note = Hypo
  source 1..20: mol_type = genomic DNA
cacatcgttgcttttgcatc

SEQ ID NO: 119408 - DNA, 44 bp, Homo sapiens; identical to SEQ ID NO: 87357
  misc_feature 1..44: note = chr20:30191611-30191655
  misc_feature 1..44: note = Hypo
  source 1..44: mol_type = genomic DNA

SEQ ID NO: 119409 - DNA, 136 bp, Homo sapiens
  misc_feature 1..136: note = chr20:30193856-30193992
  misc_feature 1..136: note = Hyper
  source 1..136: mol_type = genomic DNA
cggcatgcgttcctgcggacgatcgcatcttgtgtcgctgaagcgcctcccccagggaccggcggaccccagccatccagggggcaagaggaattacgtgctctgtgggtctcccccaacgcgcctcgccggatct

SEQ ID NO: 119410 - DNA, 30 bp, Homo sapiens; identical to SEQ ID NO: 87360
  misc_feature 1..30: note = chr20:30199446-30199476
  misc_feature 1..30: note = Hypo
  source 1..30: mol_type = genomic DNA

SEQ ID NO: 119411 - DNA, 37 bp, Homo sapiens; identical to SEQ ID NO: 87361
  misc_feature 1..37: note = chr20:30244648-30244685
  misc_feature 1..37: note = Hypo
  source 1..37: mol_type = genomic DNA

SEQ ID NO: 119412 - DNA, 30 bp, Homo sapiens; identical to SEQ ID NO: 87363
  misc_feature 1..30: note = chr20:30407129-30407159
  misc_feature 1..30: note = Hypo
  source 1..30: mol_type = genomic DNA

SEQ ID NO: 119413 - DNA, 215 bp, Homo sapiens; identical to SEQ ID NO: 87365
  misc_feature 1..215: note = chr20:30464460-30464675
  misc_feature 1..215: note = Hypo
  source 1..215: mol_type = genomic DNA

SEQ ID NO: 119414 - DNA, 39 bp, Homo sapiens; identical to SEQ ID NO: 87366
  misc_feature 1..39: note = chr20:30468269-30468308
  misc_feature 1..39: note = Hypo
  source 1..39: mol_type = genomic DNA

SEQ ID NO: 119415 - DNA, 517 bp, Homo sapiens; identical to SEQ ID NO: 87369
  misc_feature 1..517: note = chr20:30555886-30556403
  misc_feature 1..517: note = Hyper
  source 1..517: mol_type = genomic DNA

SEQ ID NO: 119416 - DNA, 275 bp, Homo sapiens; identical to SEQ ID NO: 87370
  misc_feature 1..275: note = chr20:30582750-30583025
  misc_feature 1..275: note = Hyper
  source 1..275: mol_type = genomic DNA

SEQ ID NO: 119417 - DNA, 57 bp, Homo sapiens; identical to SEQ ID NO: 87371
  misc_feature 1..57: note = chr20:30584443-30584500
  misc_feature 1..57: note = Hypo
  source 1..57: mol_type = genomic DNA

SEQ ID NO: 119418 - DNA, 51 bp, Homo sapiens; identical to SEQ ID NO: 46125
  misc_feature 1..51: note = chr20:30585053-30585104
  misc_feature 1..51: note = Hypo
  source 1..51: mol_type = genomic DNA

SEQ ID NO: 119419 - DNA, 389 bp, Homo sapiens; identical to SEQ ID NO: 87375
  misc_feature 1..389: note = chr20:30639105-30639494
  misc_feature 1..389: note = Hyper
  source 1..389: mol_type = genomic DNA

SEQ ID NO: 119420 - DNA, 1074 bp, Homo sapiens
  misc_feature 1..1074: note = chr20:30639695-30640769
  misc_feature 1..1074: note = Hyper
  source 1..1074: mol_type = genomic DNA
ttagacgggcgggttcgaatccctaggagtgggatttgggatcctttggagactggggtaggacgctgggcggtgggatggggaggtgttagggaaagtggagcggaagggatgggggttcgcatccttggtggacgcgttagaagcctcctatggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagctgcgaggatccgggctgcccgcgagacgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccgggggatgaggggtcgacagcgagtggagggtgccctagggaggggcggcactgttgcggactgctggattcccggggaaggggacgctcgggcccgtgcagtgactttatccaccacttctctgggccgtccaggttccccttcttgggggggggcggggattttttttttaatttaaaaaagaaaaagaaggaagggatggggcttcacagaacccgggaaggggaaggcccttacggttcccggtgggggccgggtcacgccgggttggcagccagcttggggaagggggtagttgggcggaggcgtgacgtgcgagccacacccagg

SEQ ID NO: 119421 - DNA, 42 bp, Homo sapiens; identical to SEQ ID NO: 87379
  misc_feature 1..42: note = chr20:30671697-30671739
  misc_feature 1..42: note = Hypo
  source 1..42: mol_type = genomic DNA

SEQ ID NO: 119422 - DNA, 30 bp, Homo sapiens; identical to SEQ ID NO: 87380
  misc_feature 1..30: note = chr20:30689127-30689157
  misc_feature 1..30: note = Hypo
  source 1..30: mol_type = genomic DNA

SEQ ID NO: 119423 - DNA, 30 bp, Homo sapiens; identical to SEQ ID NO: 87381
  misc_feature 1..30: note = chr20:30727301-30727331
  misc_feature 1..30: note = Hypo
  source 1..30: mol_type = genomic DNA

SEQ ID NO: 119424 - DNA, 30 bp, Homo sapiens; identical to SEQ ID NO: 46127
  misc_feature 1..30: note = chr20:30770464-30770494
  misc_feature 1..30: note = Hypo
  source 1..30: mol_type = genomic DNA

SEQ ID NO: 119425 - DNA, 412 bp, Homo sapiens; identical to SEQ ID NO: 87385
  misc_feature 1..412: note = chr20:30777833-30778245
  misc_feature 1..412: note = Hyper
  source 1..412: mol_type = genomic DNA

SEQ ID NO: 119426 - DNA, 89 bp, Homo sapiens; identical to SEQ ID NO: 87386
  misc_feature 1..89: note = chr20:30814945-30815034
  misc_feature 1..89: note = Hypo
  source 1..89: mol_type = genomic DNA

SEQ ID NO: 119427 - DNA, 138 bp, Homo sapiens; identical to SEQ ID NO: 87387
  misc_feature 1..138: note = chr20:30864881-30865019
  misc_feature 1..138: note = Hypo
  source 1..138: mol_type = genomic DNA

SEQ ID NO: 119428 - DNA, 48 bp, Homo sapiens; identical to SEQ ID NO: 46129
  misc_feature 1..48: note = chr20:31108565-31108613
  misc_feature 1..48: note = Hypo
  source 1..48: mol_type = genomic DNA

SEQ ID NO: 119429 - DNA, 213 bp, Homo sapiens; identical to SEQ ID NO: 46130
  misc_feature 1..213: note = chr20:31115617-31115830
  misc_feature 1..213: note = Hypo
  source 1..213: mol_type = genomic DNA

SEQ ID NO: 119430 - DNA, 33 bp, Homo sapiens; identical to SEQ ID NO: 87390
  source 1..33: mol_type = genomic DNA
  misc_feature 1..33: note = chr20:31129565-31129598
  misc_feature 1..33: note = Hypo

SEQ ID NO: 119431 - DNA, 30 bp, Homo sapiens; identical to SEQ ID NO: 87391
  misc_feature 1..30: note = chr20:31144605-31144635
  misc_feature 1..30: note = Hypo
  source 1..30: mol_type = genomic DNA

SEQ ID NO: 119432 - DNA, 30 bp, Homo sapiens; identical to SEQ ID NO: 46131
  misc_feature 1..30: note = chr20:31147343-31147373
  misc_feature 1..30: note = Hypo
  source 1..30: mol_type = genomic DNA

SEQ ID NO: 119433 - DNA, 420 bp, Homo sapiens; identical to SEQ ID NO: 87393
  misc_feature 1..420: note = chr20:31151587-31152007
  misc_feature 1..420: note = Hypo
  source 1..420: mol_type = genomic DNA

SEQ ID NO: 119434 - DNA, 149 bp, Homo sapiens; identical to SEQ ID NO: 87394
  misc_feature 1..149: note = chr20:31180087-31180236
  misc_feature 1..149: note = Hypo
  source 1..149: mol_type = genomic DNA

SEQ ID NO: 119435 - DNA, 49 bp, Homo sapiens; identical to SEQ ID NO: 87395
  misc_feature 1..49: note = chr20:31210079-31210128
  misc_feature 1..49: note = Hypo
  source 1..49: mol_type = genomic DNA

SEQ ID NO: 119436 - DNA, 174 bp, Homo sapiens; identical to SEQ ID NO: 87396
  misc_feature 1..174: note = chr20:31226649-31226823
  misc_feature 1..174: note = Hypo
  source 1..174: mol_type = genomic DNA

SEQ ID NO: 119437 - DNA, 181 bp, Homo sapiens; identical to SEQ ID NO: 87397
  misc_feature 1..181: note = chr20:31232544-31232725
  misc_feature 1..181: note = Hypo
  source 1..181: mol_type = genomic DNA

SEQ ID NO: 119438 - DNA, 71 bp, Homo sapiens; identical to SEQ ID NO: 87398
  misc_feature 1..71: note = chr20:31376743-31376814
  misc_feature 1..71: note = Hypo
  source 1..71: mol_type = genomic DNA

SEQ ID NO: 119439 - DNA, 41 bp, Homo sapiens; identical to SEQ ID NO: 87399
  misc_feature 1..41: note = chr20:31485187-31485228
  misc_feature 1..41: note = Hypo
  source 1..41: mol_type = genomic DNA

SEQ ID NO: 119440 - DNA, 30 bp, Homo sapiens; identical to SEQ ID NO: 46134
  misc_feature 1..30: note = chr20:31553994-31554024
  misc_feature 1..30: note = Hypo
  source 1..30: mol_type = genomic DNA

SEQ ID NO: 119441 - DNA, 30 bp, Homo sapiens; identical to SEQ ID NO: 87402
  misc_feature 1..30: note = chr20:31607353-31607383
  misc_feature 1..30: note = Hypo
  source 1..30: mol_type = genomic DNA

SEQ ID NO: 119442 - DNA, 123 bp, Homo sapiens; identical to SEQ ID NO: 87403
  misc_feature 1..123: note = chr20:31671342-31671465
  misc_feature 1..123: note = Hypo
  source 1..123: mol_type = genomic DNA

SEQ ID NO: 119443 - DNA, 30 bp, Homo sapiens; identical to SEQ ID NO: 87404
  misc_feature 1..30: note = chr20:31690556-31690586
  misc_feature 1..30: note = Hypo
  source 1..30: mol_type = genomic DNA

SEQ ID NO: 119444 - DNA, 30 bp, Homo sapiens; identical to SEQ ID NO: 87405
  misc_feature 1..30: note = chr20:31690858-31690888
  misc_feature 1..30: note = Hypo
  source 1..30: mol_type = genomic DNA

SEQ ID NO: 119445 - DNA, 188 bp, Homo sapiens; identical to SEQ ID NO: 87406
  misc_feature 1..188: note = chr20:31744494-31744682
  misc_feature 1..188: note = Hypo
  source 1..188: mol_type = genomic DNA

SEQ ID NO: 119446 - DNA, 157 bp, Homo sapiens; identical to SEQ ID NO: 87407
  misc_feature 1..157: note = chr20:31797604-31797761
  misc_feature 1..157: note = Hyper
  source 1..157: mol_type = genomic DNA

SEQ ID NO: 119447 - DNA, 36 bp, Homo sapiens; identical to SEQ ID NO: 87408
  misc_feature 1..36: note = chr20:31920935-31920971
  misc_feature 1..36: note = Hypo
  source 1..36: mol_type = genomic DNA

SEQ ID NO: 119448 - DNA, 30 bp, Homo sapiens; identical to SEQ ID NO: 46135
  misc_feature 1..30: note = chr20:31940171-31940201
  misc_feature 1..30: note = Hypo
  source 1..30: mol_type = genomic DNA

SEQ ID NO: 119449 - DNA, 30 bp, Homo sapiens; identical to SEQ ID NO: 87415
  misc_feature 1..30: note = chr20:32155248-32155278
  misc_feature 1..30: note = Hypo
  source 1..30: mol_type = genomic DNA

SEQ ID NO: 119450 - DNA, 258 bp, Homo sapiens; identical to SEQ ID NO: 87418
  misc_feature 1..258: note = chr20:32242529-32242787
  misc_feature 1..258: note = Hypo
  source 1..258: mol_type = genomic DNA

SEQ ID NO: 119451 - DNA, 30 bp, Homo sapiens; identical to SEQ ID NO: 87421
  misc_feature 1..30: note = chr20:32298233-32298263
  misc_feature 1..30: note = Hypo
  source 1..30: mol_type = genomic DNA

SEQ ID NO: 119452 - DNA, 69 bp, Homo sapiens; identical to SEQ ID NO: 46137
  misc_feature 1..69: note = chr20:32301884-32301953
  misc_feature 1..69: note = Hypo
  source 1..69: mol_type = genomic DNA

SEQ ID NO: 119453 - DNA, 76 bp, Homo sapiens; identical to SEQ ID NO: 87423
  misc_feature 1..76: note = chr20:32378890-32378966
  misc_feature 1..76: note = Hypo
  source 1..76: mol_type = genomic DNA

SEQ ID NO: 119454 - DNA, 30 bp, Homo sapiens; identical to SEQ ID NO: 87424
  misc_feature 1..30: note = chr20:32379308-32379338
  misc_feature 1..30: note = Hypo
  source 1..30: mol_type = genomic DNA

SEQ ID NO: 119455 - DNA, 30 bp, Homo sapiens; identical to SEQ ID NO: 46138
  misc_feature 1..30: note = chr20:32414088-32414118
  misc_feature 1..30: note = Hypo
  source 1..30: mol_type = genomic DNA

SEQ ID NO: 119456 - DNA, 201 bp, Homo sapiens; identical to SEQ ID NO: 87426
  misc_feature 1..201: note = chr20:32450357-32450558
  misc_feature 1..201: note = Hypo
  source 1..201: mol_type = genomic DNA

SEQ ID NO: 119457 - DNA, 38 bp, Homo sapiens; identical to SEQ ID NO: 46140
  misc_feature 1..38: note = chr20:32459722-32459760
  misc_feature 1..38: note = Hypo
  source 1..38: mol_type = genomic DNA

SEQ ID NO: 119458 - DNA, 30 bp, Homo sapiens; identical to SEQ ID NO: 16581
  misc_feature 1..30: note = chr20:32524318-32524348
  misc_feature 1..30: note = Hypo
  source 1..30: mol_type = genomic DNA

SEQ ID NO: 119459 - DNA, 150 bp, Homo sapiens; identical to SEQ ID NO: 87429
  misc_feature 1..150: note = chr20:32677281-32677431
  misc_feature 1..150: note = Hypo
  source 1..150: mol_type = genomic DNA

SEQ ID NO: 119460 - DNA, 30 bp, Homo sapiens; identical to SEQ ID NO: 87430
  misc_feature 1..30: note = chr20:32677661-32677691
  misc_feature 1..30: note = Hypo
  source 1..30: mol_type = genomic DNA

SEQ ID NO: 119461 - DNA, 26 bp, Homo sapiens
  misc_feature 1..26: note = chr20:32768436-32768462
  misc_feature 1..26: note = Hypo
  source 1..26: mol_type = genomic DNA
aaatattttctgggccgtgcgcggtg

SEQ ID NO: 119462 - DNA, 279 bp, Homo sapiens
  misc_feature 1..279: note = chr20:32803867-32804146
  misc_feature 1..279: note = Hyper
  source 1..279: mol_type = genomic DNA
ggccctcgtccttgtcgccgtagtcctctgccacgaccgcagcgccaacgccagagacggagttggccgggactgcacgcctctcgtcgctccgcgtcccctggcaccttctcttgagtggcaggcaagcaagcaagcaagcgggcggggtcagcgccccaagaagggaaagagcgcgagggccagctaacgccgccgccgccgtcgccgctgagtcagcgcgaagcgccctctccgagtaggtgccgcgcgggcgggcgctggcgccagcagtctcat

SEQ ID NO: 119463 - DNA, 69 bp, Homo sapiens; identical to SEQ ID NO: 87436
  misc_feature 1..69: note = chr20:32899446-32899515
  misc_feature 1..69: note = Hyper
  source 1..69: mol_type = genomic DNA

SEQ ID NO: 119464 - DNA, 224 bp, Homo sapiens; identical to SEQ ID NO: 87437
  misc_feature 1..224: note = chr20:32950057-32950281
  misc_feature 1..224: note = Hypo
  source 1..224: mol_type = genomic DNA

SEQ ID NO: 119465 - DNA, 30 bp, Homo sapiens; identical to SEQ ID NO: 87438
  misc_feature 1..30: note = chr20:33131612-33131642
  misc_feature 1..30: note = Hypo
  source 1..30: mol_type = genomic DNA

SEQ ID NO: 119466 - DNA, 251 bp, Homo sapiens; identical to SEQ ID NO: 87439
  misc_feature 1..251: note = chr20:33134788-33135039
  misc_feature 1..251: note = Hypo
  source 1..251: mol_type = genomic DNA

SEQ ID NO: 119467 - DNA, 30 bp, Homo sapiens; identical to SEQ ID NO: 46144
  misc_feature 1..30: note = chr20:33137930-33137960
  misc_feature 1..30: note = Hypo
  source 1..30: mol_type = genomic DNA

SEQ ID NO: 119468 - DNA, 426 bp, Homo sapiens; identical to SEQ ID NO: 87441
  misc_feature 1..426: note = chr20:33146323-33146749
  misc_feature 1..426: note = Hyper
  source 1..426: mol_type = genomic DNA

SEQ ID NO: 119469 - DNA, 29 bp, Homo sapiens
  misc_feature 1..29: note = chr20:33290324-33290353
  misc_feature 1..29: note = Hypo
  source 1..29: mol_type = genomic DNA
ttatcactagagtgccgggcacggtggct

SEQ ID NO: 119470 - DNA, 78 bp, Homo sapiens; identical to SEQ ID NO: 87443
  misc_feature 1..78: note = chr20:33547578-33547656
  misc_feature 1..78: note = Hypo
  source 1..78: mol_type = genomic DNA

SEQ ID NO: 119471 - DNA, 32 bp, Homo sapiens; identical to SEQ ID NO: 87444
  misc_feature 1..32: note = chr20:33572900-33572932
  misc_feature 1..32: note = Hypo
  source 1..32: mol_type = genomic DNA

SEQ ID NO: 119472 - DNA, 128 bp, Homo sapiens; identical to SEQ ID NO: 87445
  misc_feature 1..128: note = chr20:33574767-33574895
  misc_feature 1..128: note = Hypo
  source 1..128: mol_type = genomic DNA

SEQ ID NO: 119473 - DNA, 65 bp, Homo sapiens; identical to SEQ ID NO: 87446
  misc_feature 1..65: note = chr20:33834734-33834799
  misc_feature 1..65: note = Hypo
  source 1..65: mol_type = genomic DNA

SEQ ID NO: 119474 - DNA, 41 bp, Homo sapiens; identical to SEQ ID NO: 46149
  misc_feature 1..41: note = chr20:33855099-33855140
  misc_feature 1..41: note = Hypo
  source 1..41: mol_type = genomic DNA

SEQ ID NO: 119475 - DNA, 30 bp, Homo sapiens; identical to SEQ ID NO: 16584
  misc_feature 1..30: note = chr20:33866905-33866935
  misc_feature 1..30: note = Hypo
  source 1..30: mol_type = genomic DNA

SEQ ID NO: 119476 - DNA, 320 bp, Homo sapiens; identical to SEQ ID NO: 87449
  misc_feature 1..320: note = chr20:33879960-33880280
  misc_feature 1..320: note = Hypo
  source 1..320: mol_type = genomic DNA

SEQ ID NO: 119477 - DNA, 41 bp, Homo sapiens; identical to SEQ ID NO: 87453
  misc_feature 1..41: note = chr20:34041981-34042022
  misc_feature 1..41: note = Hypo
  source 1..41: mol_type = genomic DNA

SEQ ID NO: 119478 - DNA, 84 bp, Homo sapiens; identical to SEQ ID NO: 87454
  misc_feature 1..84: note = chr20:34044003-34044087
  misc_feature 1..84: note = Hypo
  source 1..84: mol_type = genomic DNA

SEQ ID NO: 119479 - DNA, 30 bp, Homo sapiens; identical to SEQ ID NO: 87455
  misc_feature 1..30: note = chr20:34119886-34119916
  misc_feature 1..30: note = Hypo
  source 1..30: mol_type = genomic DNA

SEQ ID NO: 119480 - DNA, 59 bp, Homo sapiens; identical to SEQ ID NO: 87456
  misc_feature 1..59: note = chr20:34147171-34147230
  misc_feature 1..59: note = Hypo
  source 1..59: mol_type = genomic DNA

SEQ ID NO: 119481 - DNA, 374 bp, Homo sapiens; identical to SEQ ID NO: 87457
  misc_feature 1..374: note = chr20:34147978-34148352
  misc_feature 1..374: note = Hypo
  source 1..374: mol_type = genomic DNA

SEQ ID NO: 119482 - DNA, 33 bp, Homo sapiens; identical to SEQ ID NO: 87458
  misc_feature 1..33: note = chr20:34183450-34183483
  misc_feature 1..33: note = Hypo
  source 1..33: mol_type = genomic DNA

SEQ ID NO: 119483 - DNA, 1507 bp, Homo sapiens
  misc_feature 1..1507: note = chr20:34188565-34190072
  misc_feature 1..1507: note = Hyper
  source 1..1507: mol_type = genomic DNA
caagtgctgcggaaccgcctttggggtctgatcccttctggctttctttttcttctttcgggtgagccgggacaacgtggacccctgctgggcctggggaggctcaggttcagctctcccttccaacacctgcatggacacagccagcagaaggcggccgcggaaccaaatgccttggccaacgccttcgttgagaccttgaagactatcccggagccccgcgccggggggcgagccatagaggggcacccaggccgggccgaaggtagggttaaaccccgctgtggggaacaagagaagcgtgttggaggggagcgtggggagggcgagtgctggtaaatctctgcacctcaccctgatctcctccaagtattcgggggtgagggcaggggaggggggctaagccgctctgaaacggaagaagttggccagcagctgcggacgcgccgctgtggaacacgacctggggcgcctccaaaacagctcagcgccccaaggagctggaaatcgcgggagcccggcctcgggggacgcagcctgagccctgggggcggggtcgggattggggcggagctacgggcgatcggccaggcctgggggtcggggaaaggagtggaccggcagtgtcagcgtgtgcacagctgtagaagggtgggactgggctggttactggacaggcggttgtggtcagaattttgccaacggagccaaaccgatggtggggttcacagtctgggggcggcttgaagcagtttgttttgcgggcggaccagccctcctaggcggagcggggtcgcgaggatggggcttgcggttgggaatgggccctatggagccctatggaccgaggcgagtgaggccagatttgccgcggccagaagcgctcacccgcgcggcccggatgggagatccgcctcaggtccggcacgtgcgtagcgagtgccgcgtcgaccaggggcgcgtcgtcccgcagctgcaggcggaggctgcgcgtcagcggcgggaagagctccacgaagctcagctgctcgttccattcgggcgccgccgcctcggcgctcaccgacgtctcgccctgaaggtggcgttaaagacaggagaagggagatcagcgcggagtcggggccggagccgcggcgccgtgggccccggagggacttacctcctgccccaggaaagacacccgcacatagggctccaccaggacgcgctggtcgtgcagggcgcggaccaggctgcccagcagccccaggcgcagcgcgggaagcccctcggcgcggtacaggcgcacgcggagccgcgcccatggcctctcggcgggcaccccgcgcggcaggagcaggttcctaggggagggggcaccgagcggggggggagaaactgggatctcggcccctccccttatccgcgccccacggccacccccggatccatgtcctcctccccacctcaccccggctcacttctcgatgtccgaacagtgccctggggccgggggtagcattgg

SEQ ID NO: 119484 - DNA, 30 bp, Homo sapiens; identical to SEQ ID NO: 87463
  misc_feature 1..30: note = chr20:34288804-34288834
  misc_feature 1..30: note = Hypo
  source 1..30: mol_type = genomic DNA

SEQ ID NO: 119485 - DNA, 116 bp, Homo sapiens; identical to SEQ ID NO: 87464
  misc_feature 1..116: note = chr20:34312502-34312618
  misc_feature 1..116: note = Hypo
  source 1..116: mol_type = genomic DNA

SEQ ID NO: 119486 - DNA, 30 bp, Homo sapiens; identical to SEQ ID NO: 87465
  misc_feature 1..30: note = chr20:34632854-34632884
  misc_feature 1..30: note = Hypo
  source 1..30: mol_type = genomic DNA

SEQ ID NO: 119487 - DNA, 30 bp, Homo sapiens; identical to SEQ ID NO: 87466
  misc_feature 1..30: note = chr20:34639308-34639338
  misc_feature 1..30: note = Hypo
  source 1..30: mol_type = genomic DNA

SEQ ID NO: 119488 - DNA, 215 bp, Homo sapiens; identical to SEQ ID NO: 87467
  misc_feature 1..215: note = chr20:34710563-34710778
  misc_feature 1..215: note = Hypo
  source 1..215: mol_type = genomic DNA

SEQ ID NO: 119489 - DNA, 162 bp, Homo sapiens
  misc_feature 1..162: note = chr20:35089026-35089188
  misc_feature 1..162: note = Hypo
  source 1..162: mol_type = genomic DNA
gacctaccacaggtgcggcctggagagatgaggcccacaaggcagcgacaggacctggattcagtgaggagaggggactcgcggggtagaagccaggaactgggaaggcgaggaggcgtgaaggcaccacctactgccaacccggctcgagctggtcacttt

SEQ ID NO: 119490 - DNA, 84 bp, Homo sapiens; identical to SEQ ID NO: 87469
  misc_feature 1..84: note = chr20:35201464-35201548
  misc_feature 1..84: note = Hyper
  source 1..84: mol_type = genomic DNA

SEQ ID NO: 119491 - DNA, 30 bp, Homo sapiens; identical to SEQ ID NO: 87470
  misc_feature 1..30: note = chr20:35441848-35441878
  misc_feature 1..30: note = Hypo
  source 1..30: mol_type = genomic DNA

SEQ ID NO: 119492 - DNA, 30 bp, Homo sapiens; identical to SEQ ID NO: 87471
  misc_feature 1..30: note = chr20:35444175-35444205
  misc_feature 1..30: note = Hypo
  source 1..30: mol_type = genomic DNA

SEQ ID NO: 119493 - DNA, 30 bp, Homo sapiens; identical to SEQ ID NO: 87472
  misc_feature 1..30: note = chr20:35464204-35464234
  misc_feature 1..30: note = Hyper
  source 1..30: mol_type = genomic DNA

SEQ ID NO: 119494 - DNA, 359 bp, Homo sapiens
  misc_feature 1..359: note = chr20:35491156-35491515
  misc_feature 1..359: note = Hyper
  source 1..359: mol_type = genomic DNA
aagcgaggcgctgagcggcaagcggctgctgcccaccgacgacgcggccaccgacggctcgtccggggaggcgggcggccgcgggggctgctgcgcggagggcgcgggctgggccggctgccccgtacggacccccgccgggcccccggccgcggactcggcgtcgctgctcagcgccagctccaggcccagcaggcgcgcctcctccgacgcgcagtccgacacctccgagctgctatccgtgaggctggggggcggcggtggcggtcgcggccccgcacccgagcgcggacggcccttggcacggaccccggtgcggaccccggccacccgcacacccgcaccgcgcgccccgggag

SEQ ID NO: 119495 - DNA, 111 bp, Homo sapiens; identical to SEQ ID NO: 87474
  misc_feature 1..111: note = chr20:35506436-35506547
  misc_feature 1..111: note = Hypo
  source 1..111: mol_type = genomic DNA

SEQ ID NO: 119496 - DNA, 146 bp, Homo sapiens; identical to SEQ ID NO: 87475
  misc_feature 1..146: note = chr20:35874090-35874236
  misc_feature 1..146: note = Hypo
  source 1..146: mol_type = genomic DNA

SEQ ID NO: 119497 - DNA, 282 bp, Homo sapiens; identical to SEQ ID NO: 87476
  misc_feature 1..282: note = chr20:35924130-35924412
  misc_feature 1..282: note = Hypo
  source 1..282: mol_type = genomic DNA

SEQ ID NO: 119498 - DNA, 403 bp, Homo sapiens
  misc_feature 1..403: note = chr20:36012895-36013298
  misc_feature 1..403: note = Hyper
  source 1..403: mol_type = genomic DNA
gcaggcccttcctctcgccaggggtagcgcccctgggtgacttgggtgtccggggggtgggggggcggccgtacacactgtgaagcgtccgcgccgccgccgctggctttggggtggagcaagcgcaaaagacacggggtgtggttaatgggttctaattggacgcttaagcccaagaagaagaagggcggcgcgggaccgggcctgttgctgccttggcgcccagtcctttttcgttgcctgggtccgcccagagatgagtcgggacgcgcggcccacgtgcggcggaggggcagctgggtcgctcggggaacggggcaccggatggccccggttgggcccgcgccaggatgcgcccctgcgccctctgctggcgctctgcggtcaccgcagccccggagag

SEQ ID NO: 119499 - DNA, 58 bp, Homo sapiens; identical to SEQ ID NO: 87478
  misc_feature 1..58: note = chr20:36043953-36044011
  misc_feature 1..58: note = Hypo
  source 1..58: mol_type = genomic DNA

SEQ ID NO: 119500 - DNA, 33 bp, Homo sapiens; identical to SEQ ID NO: 46158
  misc_feature 1..33: note = chr20:36049828-36049861
  misc_feature 1..33: note = Hypo
  source 1..33: mol_type = genomic DNA

SEQ ID NO: 119501 - DNA, 39 bp, Homo sapiens; identical to SEQ ID NO: 16588
  misc_feature 1..39: note = chr20:36151122-36151161
  misc_feature 1..39: note = Hypo
  source 1..39: mol_type = genomic DNA

SEQ ID NO: 119502 - DNA, 151 bp, Homo sapiens; identical to SEQ ID NO: 87481
  misc_feature 1..151: note = chr20:36192064-36192215
  misc_feature 1..151: note = Hypo
  source 1..151: mol_type = genomic DNA

SEQ ID NO: 119503 - DNA, 30 bp, Homo sapiens; identical to SEQ ID NO: 87482
  misc_feature 1..30: note = chr20:36296722-36296752
  misc_feature 1..30: note = Hypo
  source 1..30: mol_type = genomic DNA

SEQ ID NO: 119504 - DNA, 222 bp, Homo sapiens; identical to SEQ ID NO: 87486
  misc_feature 1..222: note = chr20:36526757-36526979
  misc_feature 1..222: note = Hypo
  source 1..222: mol_type = genomic DNA

SEQ ID NO: 119505 - DNA, 58 bp, Homo sapiens; identical to SEQ ID NO: 87487
  misc_feature 1..58: note = chr20:36530144-36530202
  misc_feature 1..58: note = Hyper
  source 1..58: mol_type = genomic DNA

SEQ ID NO: 119506 - DNA, 440 bp, Homo sapiens; identical to SEQ ID NO: 38073
  misc_feature 1..440: note = chr20:36531551-36531991
  misc_feature 1..440: note = Hyper
  source 1..440: mol_type = genomic DNA

SEQ ID NO: 119507 - DNA, 105 bp, Homo sapiens; identical to SEQ ID NO: 87489
  misc_feature 1..105: note = chr20:36571234-36571339
  misc_feature 1..105: note = Hypo
  source 1..105: mol_type = genomic DNA

SEQ ID NO: 119508 - DNA, 26 bp, Homo sapiens
  misc_feature 1..26: note = chr20:36666715-36666741
  misc_feature 1..26: note = Hypo
  source 1..26: mol_type = genomic DNA
tttttttttttgagacggagtctctt

SEQ ID NO: 119509 - DNA, 41 bp, Homo sapiens; identical to SEQ ID NO: 87492
  misc_feature 1..41: note = chr20:36760800-36760841
  misc_feature 1..41: note = Hypo
  source 1..41: mol_type = genomic DNA

SEQ ID NO: 119510 - DNA, 30 bp, Homo sapiens; identical to SEQ ID NO: 87493
  misc_feature 1..30: note = chr20:36764156-36764186
  misc_feature 1..30: note = Hypo
  source 1..30: mol_type = genomic DNA

SEQ ID NO: 119511 - DNA, 41 bp, Homo sapiens; identical to SEQ ID NO: 87494
  misc_feature 1..41: note = chr20:36767876-36767917
  misc_feature 1..41: note = Hypo
  source 1..41: mol_type = genomic DNA

SEQ ID NO: 119512 - DNA, 88 bp, Homo sapiens; identical to SEQ ID NO: 87495
  misc_feature 1..88: note = chr20:36775243-36775331
  misc_feature 1..88: note = Hypo
  source 1..88: mol_type = genomic DNA

SEQ ID NO: 119513 - DNA, 57 bp, Homo sapiens; identical to SEQ ID NO: 87496
  misc_feature 1..57: note = chr20:36780994-36781051
  misc_feature 1..57: note = Hyper
  source 1..57: mol_type = genomic DNA

SEQ ID NO: 119514 - DNA, 33 bp, Homo sapiens; identical to SEQ ID NO: 87497
  misc_feature 1..33: note = chr20:36781339-36781372
  misc_feature 1..33: note = Hyper
  source 1..33: mol_type = genomic DNA

SEQ ID NO: 119515 - DNA, 379 bp, Homo sapiens; identical to SEQ ID NO: 87498
  misc_feature 1..379: note = chr20:36888856-36889235
  misc_feature 1..379: note = Hyper
  source 1..379: mol_type = genomic DNA

SEQ ID NO: 119516 - DNA, 69 bp, Homo sapiens; identical to SEQ ID NO: 87499
  misc_feature 1..69: note = chr20:36978578-36978647
  misc_feature 1..69: note = Hypo
  source 1..69: mol_type = genomic DNA

SEQ ID NO: 119517 - DNA, 24 bp, Homo sapiens
  misc_feature 1..24: note = chr20:36990660-36990684
  misc_feature 1..24: note = Hypo
  source 1..24: mol_type = genomic DNA
gaggtcagggctgggcgcggtggc

SEQ ID NO: 119518 - DNA, 21 bp, Homo sapiens
  misc_feature 1..21: note = chr20:37088489-37088510
  misc_feature 1..21: note = Hypo
  source 1..21: mol_type = genomic DNA
aataaatgggctgggcgtggt

SEQ ID NO: 119519 - DNA, 177 bp, Homo sapiens; identical to SEQ ID NO: 87503
  misc_feature 1..177: note = chr20:37208085-37208262
  misc_feature 1..177: note = Hypo
  source 1..177: mol_type = genomic DNA

SEQ ID NO: 119520 - DNA, 38 bp, Homo sapiens; identical to SEQ ID NO: 87504
  misc_feature 1..38: note = chr20:37233304-37233342
  misc_feature 1..38: note = Hypo
  source 1..38: mol_type = genomic DNA

SEQ ID NO: 119521 - DNA, 30 bp, Homo sapiens; identical to SEQ ID NO: 38075
  misc_feature 1..30: note = chr20:37274701-37274731
  misc_feature 1..30: note = Hyper
  source 1..30: mol_type = genomic DNA

SEQ ID NO: 119522 - DNA, 999 bp, Homo sapiens; identical to SEQ ID NO: 87507
  misc_feature 1..999: note = chr20:37302402-37303401
  misc_feature 1..999: note = Hyper
  source 1..999: mol_type = genomic DNA

SEQ ID NO: 119523 - DNA, 6820 bp, Homo sapiens
  misc_feature 1..6820: note = chr20:37351422-37358242
  misc_feature 1..6820: note = Hyper
  source 1..6820: mol_type = genomic DNA
gagagaagcctcctccgggagactgggaggggcttgggatgggaggaggtggcaggaggcgggagggtgtagagagggaagcctgtcttgtcctggcagctccaactctctggccaaagccctcgggccgccctacttgtgcgctgacgtgagctaatctagaaatactgcagagaaagagtggctggggttcccagggagaaagggcctcgagagaggggagatggggagctgcttccttttttgtttccttcggtttttccgtccgcccccgcccccacttccagtcacagccgctacttctccattcaggctgggactgccaggtggagccctgcggtttactgctcaggaggagcccggccaggacatcagctggggacttacgcagggacccattcagagcagcggaccctcacggagactactacaaagggactaacacaggcacgaacgcaggcaaccccattcgggaacacatacgtaatccaacacactagctctggcacacacactggaatgcgcgcaaaaccacacagacacagaacacacgcggttaccaaacctcattctcagaggccacactgatccaacctcaagcagagtctgatacagcatcggtctttgtctctgggtctctcccttactcgcgctcacacacccgtaccccaatcaacacaaacagcccaagctttcacagcctggaggcggccgtcggagcagggccccagcgcaccgcgagcctctgcttcctccgccttgcagcgccgcgagcccttctttcctccgcgcctggccccgtctgcgcccctctcggcgtgggcattcgcagacccgctaggaggctgacgagaggtgtcctcatagagtcctgccttcttccagacccccaaacgaaaagaaagagaaaagccaacctttcgcctccattctgcacgcatttggagagcggctggtggcgagcgatccgcacaatcgcttccctcgcggcgtccctggacgggcggagagaacccgggtgactgagcctgaggctgagcttccttgggagcgatccatgccagccacttctaccttcaagggggactcgcggccgggtttacgcgcgaaggatgggtgccagggaaactgacttatagacgacccgctccgcgagagactgacaactcagtcctgcgggctttcggggcgcccagaccagtccttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccaggtaagcgcgggattcccagttctgcctgtcctcccccctcccagctcagcgtgccgggctctgcccccgacagtcgcccggtgatctcggcctggagaccccctcctgtacccaggaatctccctttctccatccctcccagccctgcgcggggacctacgcccccaggcggtgttttccgccctaacccacgctccctcccaacggcaccagctgcaagaccgctaggctgaagttcggtctgagacacctgtccggagacactgcaaaagtgaaggaaatggggggagggagcaggaagcgatgagaaagaaagaaaatcaggattggagggcacggtttggtcttggactctggaacggattcacagctgcatttttgggaggaaagaagaaggggaaatcgctgaggtcggagtctcctccccccgcacacacgcatagacacgcacacgtatataggcaggcacaccacatgcccacagccccccttcccacgaacaaaggcgcaggcacaggcgcacacgacatgtatctatatatagaccacagtactatccccaaatgcacctgcgtacacccctacagctccacaaacaaaagcatatacctgcacataccaaacacacgaatattcgtttgaacatatgcacacacacatgcacagatgcatgcagacaggaaccagcctgctcccttgggtgcggccctgttggagacatacaggtatacacacacgaaagcacacacatgctcccacacaaacacatttagtccgcaataatccagcattacctgtgcacagactcgcccctctcgcccgaaatcccggctgcaccgcaaagaggcggccagctcctccccgtgtgaccctggcgaagccctctccagaggctaagaatggcccctgctctctaggccctctccccttattcctaaccccccactccccaccaggcggcgcaggactcctacatagggagcaggtttggagtcttggcaacgacctccgagctagcaggggctggcaggccgcagctttctgggccgaaggagacttcagctctaggcaaccccggtcccttacagcttggccccgcggcgtccctggagcgcactatcactggggccacggaaggcaggttttctgggagcagaggcctcccaggggttgttccatgtatcggggtaagcaggactccaccgggccccgaacaccagatggcccgacccaaggcgctttccgctccggggcccggcgagacggccttgctggatcacggacccggggctgctcccgccttcgctgtgccccgcgacttcccggggcgtctttcaaggctccgtttgataggccccaagggaggccagggcaggaggctggaggctcgtaggcctccgggaccctggatttcgttagctcttagtccccgtgtggattctaaaccctacagccctgtccgcctgaccctgaagcttctggttctagactcttgctcggttcggctttctggcctccctggcgccttcccgccaagctcctcctcctgcttgcctccccagcctccacttagtccccttccttaggtctcgccctcgcctcactctaactccagccttgtcctaagactctcaatttccagccctgcttcctcctccccgcgcgctgctccccaagcgtcttcacattgtctctgttcttgcctcccaggggctttgccccaccttcagcccctctccctctctaccctatttccttttcgcctcacaactgcagcctttaacgtttcctcctctggtctgagcctgagacgcccgagttttcctctttagctcccgtgccccattccagccccaccacaaatcccgtgcccactctttccactggcccaggcccagctcactacctttcttagagcccctttccgactacgctcccttctgtcccttctcatctcctcccccaactcctcattctgttcctgtccccagaaaccatcccgaagtatctcccttccctcctgtggcttctccctattctcagccctctcccaccctagccctctcgctatcaccagccattagcgcacctttccttctcagatccgtccatacatccctccctctccatctctggctcgacacccgggctcactattagttcccctacatccaccccgcagcctgctcttaacctctcctccccggcggctcagacccaattctcagtgtccttagcgcccccttcgggccacagcgttaagccacgccccccgggcccctcatccgttgccaagttcgctgagcgtccgcgtctggttgcctctccgccccacagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggcttgcgcggcccggtgtcgggtttgtgtgttcgtaccagccgggatcccctggcgctgggaggcgtgggaactggctcccgccggctgaaaccggagatggtgagcagctgtggttaaagggtccggggagggctctagggagtacaaagattagttggcggcgaggaggctcctcaggtgtgaggaggaagctgaagacggagagtgctgtagcggccccctcagctg

SEQ ID NO: 119524 - DNA, 104 bp, Homo sapiens; identical to SEQ ID NO: 38084
  misc_feature 1..104: note = chr20:37359606-37359710
  misc_feature 1..104: note = Hyper
  source 1..104: mol_type = genomic DNA

SEQ ID NO: 119525 - DNA, 36 bp, Homo sapiens; identical to SEQ ID NO: 87515
  misc_feature 1..36: note = chr20:37367644-37367680
  misc_feature 1..36: note = Hypo
  source 1..36: mol_type = genomic DNA

SEQ ID NO: 119526 - DNA, 1820 bp, Homo sapiens
  misc_feature 1..1820: note = chr20:37434112-37435932
  misc_feature 1..1820: note = Hyper
  source 1..1820: mol_type = genomic DNA
tggaggagggggcagcgttaggaaaactattccgaagcctggccacgtcccaaccggtttcaacttcctgcagctcagaagaggggtccccacccgagagcgccgggaccctgtcccgcgctgcctcccaagccggatggggttgagcgcgcccaccccagtcccaggagctcaggccccgccttgggggaggagccgagaggcggcgcggaggctcgcggccgagcagagccagctctgtcgccgctggagcagctgcggctcggggacccacagacacagccggggtcgggagccgcccggggcagggctcgggagagcgggtgagttccccggcggcgccaccaccctccttgcgctctgcggcttcgcagggcgggggatgaggatggggcggggaggtggtcccagcctgctatcacctagctgggggccggggcgctttggccaagggacgatagcttgagataaatgggagtgtggggactctggaaagacgggtaccgagagcgctaggtccgggagtcgggctggaatgggggcgttctccccggcctcgcaattccttgacgaggccaggggagggggcgcattggcaggttgttggctgcggccgtcgtagaccgatcttggggcggggaggtggggtcctcggtctgttctggactcatggggccgccgtctgccgggggtgcaatgccgggcggcgggagccacagcggacaccaaacaacccccccccgcgcactctcccggccgggcatggtggtgccgccccctcgcgtggcggggcttggtcctggcgggcagcggcagggcgcagagagcgctcctgcccgggcgggaaagatccccaaggcaggcgcctccacctgcagacccgccccgcctcaggatccggctgacagcaccagccagcccggggagaccccgcgagtggtagttccccgggaggggcgcgcccggcctctcccagggccccgtgcgccggcggctgggtcccccgcgccaggagcgctcccctctgggcgactccggctcatcgattccggcccagaggagcgcccccgggcgccgaggatgggcggagacgtgcagccgcccctgagaggtcgcccagaggggtctccccaaggtcacccggagtgcccaggctgagctgcccagaccgccccgggtggagagccgggaggcaggcgctcgctgccctcctccttcccccatgtagactcccttcctccgctcccccaccccggcccggcctccagcttcactggagatgctgatgatgcagctcccagcccttggaggataattgagcctgggagagctttgaatctggccctcctgagaccccagggctgcgccgctgccgcgcgccaggcctgggtcccggtgctcccgggcacctcaggagcggagggagagggatgtggcttcatcagcgcttctaggaaccgaaaaccgagctgcctgcgcgcccatgtgattgcatttcacataaagggcccctgttttcactgtcagaagagccccccagctctccgcggctctggacaccaggtgccgcctctgaatcaccctctgtggaggacccggggcccggaggtacaggcgccctttcccgcagggctctccctggaaagggcctgccgatggcggcctcagtccgcaggggtacttccctgtgtaccctgccatttcctgcggctggtgaagcaccggagaaaaaccgtccatctaggaggcctcctccaaggctggtaataaagcttcttagcccagccagcgactagctgtctactcgtgggcaaggtact

SEQ ID NO: 119527 - DNA, 30 bp, Homo sapiens; identical to SEQ ID NO: 87522
  misc_feature 1..30: note = chr20:37536400-37536430
  misc_feature 1..30: note = Hypo
  source 1..30: mol_type = genomic DNA

SEQ ID NO: 119528 - DNA, 30 bp, Homo sapiens; identical to SEQ ID NO: 87523
  misc_feature 1..30: note = chr20:37549668-37549698
  misc_feature 1..30: note = Hypo
  source 1..30: mol_type = genomic DNA

SEQ ID NO: 119529 - DNA, 30 bp, Homo sapiens; identical to SEQ ID NO: 87528
  misc_feature 1..30: note = chr20:37799258-37799288
  misc_feature 1..30: note = Hypo
  source 1..30: mol_type = genomic DNA

SEQ ID NO: 119530 - DNA, 31 bp, Homo sapiens; identical to SEQ ID NO: 87530
  misc_feature 1..31: note = chr20:38134545-38134576
  misc_feature 1..31: note = Hypo
  source 1..31: mol_type = genomic DNA

SEQ ID NO: 119531 - DNA, 26 bp, Homo sapiens
  misc_feature 1..26: note = chr20:38186909-38186935
  misc_feature 1..26: note = Hypo
  source 1..26: mol_type = genomic DNA
cctcggcctcccgaagtgcacattga

SEQ ID NO: 119532 - DNA, 30 bp, Homo sapiens; identical to SEQ ID NO: 87533
  misc_feature 1..30: note = chr20:38244640-38244670
  misc_feature 1..30: note = Hypo
  source 1..30: mol_type = genomic DNA

SEQ ID NO: 119533 - DNA, 168 bp, Homo sapiens; identical to SEQ ID NO: 87535
  misc_feature 1..168: note = chr20:38808911-38809079
  misc_feature 1..168: note = Hypo
  source 1..168: mol_type = genomic DNA

SEQ ID NO: 119534 - DNA, 2133 bp, Homo sapiens
  misc_feature 1..2133: note = chr20:39315901-39318034
  misc_feature 1..2133: note = Hyper
  source 1..2133: mol_type = genomic DNA
atttttctatataatcgagcaggcaataaaactgatgagatttgggcgccgagcgtcctaactgaggcctgtgtctcagggctgagagccagtgttctccgaactctgacagacaggtccgtctgtccttccttctttcgctcagcctcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcgggactatgcctcgccgcccttcagcctggagagaagttactccgggacctcccaccctctcgtctctctctccggctctgctcgagtctaggaggcggcgctggcgtgcgctactctcgccttagccaaggtcccctgcccgcccgcgcacccgcccgtcgcccgcggcccgcgcgcccttcctccctctcgctcaagtcaaacaggtcaaggctggggccgcggcagggacagggtccggggtagtctgggactagggacgtgggacagggagtccgggccggggcaagggcgggggccaggaccggccacgactcacagaaagaactcgggagaggaggggctgtcgctggtggagcccgcctccctgaagccggagttggcgagtttctcgcacttgaccttgtaggcgtctctctcgcgggccagccgggacacctcctgcttaagctgctccacctgctgaatgagctgcgtcttctcattctccaggtggtgcttctgctggacgcgtttatacctgcaagactgggcgtagccccggttcttcagggtccgccgcttctgcttcaggcggatcacctcgtccttggtgaagccccgcaggtggcggttcagctcgcgcacggacatggacacgagctggtcgtcggagaagcggtcctccacgctgccgttgccgcccgccgccgtcgccgaggccgtcgcgtgcggcccgggcccggggtggctagtgggcagctgttgcgccgggctagcggcgctggacggcggcggcgacgcttggtgatgatggtgatggtgcgggtgagcgtgcgggcccagctcgtcgtgggccacgccggcgcccgggtacgcgtggtgcgggtgagggtggtggtgatggtggtggtggtgagcgccgcgaaagctgtcgaagctttgcagcggctgtggcactgggtgcgagccgatgagcgcttccaccgcgtcctcgggcgtcaggttgagcgcctcggggttcatctgctggtagttgctcgccatccagtacagatcctcgaggtgtgtcttctgttcggtcgggctgaagctgggcgacgagggcacggagctacacggagtgctgagcggtgtggaggacaccgagccggctggctgcaggcgtgtgcagggcctgcccggacgctccgcgcgccccagtggctccttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggggaggcggggagcgagggcgcagcgggccggggccgccggccaagcctttgtctggggacgcggcggcgcgccggagagtcccgaggctgcctgcaccgccccagagctctgggctgtgcccgcgcagggaccgggccgggtagagtcgggcggggtggagaggcaagcggagcgcgcggtggggctgaggggaggcgtggggcgagtgcccgttgctcgctctctagctctcttgctcttacgctctctcgctcgcagccgctcgcagctcggcggtgcagctgtgctggatccggcggcgccgcagccttttatcgcctcctgatgtcactggggtgcgggggcccgggcggcccggtgcgcgggccaatagctgcacggcctccgcggcccagcggcgcagggcggggcgcgcctgacagctcccccgccccccgcgtcag

SEQ ID NO: 119535 - DNA, 789 bp, Homo sapiens
  misc_feature 1..789: note = chr20:39318877-39319666
  misc_feature 1..789: note = Hyper
  source 1..789: mol_type = genomic DNA
gcttggacggcgcctcgtacccagccaggtctcccctacctggcccaacccaagccagcccagaacgcatactatgtgtgcaccagagcccaggacaggttcccctcgagcgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcctgggcggaggaaggccggtagccaaaagtggaagcgccacagtgaagcggcccagggccaccgggtgagaaacctccccggagggcagacggggagaccgaagcacaccgcactaggcatccagactgggcttgggagccgcgcaccctccctacccagatccaggatggctagaattaacgggttctttctgagacctcggctcaggcgccgaaaccggatagatcgcgaattcgctggacccggagacccgacccgcctcccgcgtcaccttcttctttctagctttgggcgcgcgcagcgaaaggcaggagaggcgcgcactgggtgagtgagtcccggccgctgtctgcgctggaccagcccgactgacctcgcgcgtaggggtcgcgtgagccacaccggtgcagacgcgcctagattatttttaaatgttagaaggtaaaatatttgcctccaattaatctgaaaactctctattctcttgcgccctcggagaggctggggtacggcgtggtattgggccgcctatttttaata

SEQ ID NO: 119536 - DNA, 30 bp, Homo sapiens; identical to SEQ ID NO: 87541
  misc_feature 1..30: note = chr20:39435965-39435995
  misc_feature 1..30: note = Hypo
  source 1..30: mol_type = genomic DNA

SEQ ID NO: 119537 - DNA, 40 bp, Homo sapiens; identical to SEQ ID NO: 46164
  misc_feature 1..40: note = chr20:39687444-39687484
  misc_feature 1..40: note = Hypo
  source 1..40: mol_type = genomic DNA

SEQ ID NO: 119538 - DNA, 30 bp, Homo sapiens; identical to SEQ ID NO: 87543
  misc_feature 1..30: note = chr20:39739532-39739562
  misc_feature 1..30: note = Hypo
  source 1..30: mol_type = genomic DNA

SEQ ID NO: 119539 - DNA, 1330 bp, Homo sapiens
  misc_feature 1..1330: note = chr20:39994530-39995860
  misc_feature 1..1330: note = Hyper
  source 1..1330: mol_type = genomic DNA
ctgcctggcataagccgaccgctgtggacggctgtgccacagcacaggcccggagccaggagcccgctctggctctgcagcccggccacgctggggctcccatggggttgctggggccaggctgactgcgagagggcagcggccgcccggatgcgcagctctatctcctacctggccgggccaggggagagaagggaggcccggggcgggggagccccgcgtgctcagcgcgcggaccgcctttcctcctctccctccacctggtccgctcgcccggagtctgcacacagcgcagctggaaaatgttacttcgctggaaaggtttccgctggcactgccaggatcccaagccgccgcgccaggccccctcggttcctttttcctcgccagccccgcaacctcccggagcgtagggcgctcgcctgggcaggggctcggccccgggcgccgccccctctgtgcagcggcctcggggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtcgtgtagagactgtagcgggaggcaccgggcggcgcaggccgcgccaggagcggggtgcccctggcctgcgcccccgagagcagcgccgcgacggcgcacagccagacgagcaggcggcggcggcccatagcggcccccgcgcctctgcccggccccgcgcggtgccccccgccgggtgtccgcctgcagcgccgcgccgcccccgccgctggtcggcccgggtcccgccccgagggtcccggggtccccttcggcccccgagctcgctggcccggccgcctggcgcttcgcggcggctgcgtcccgcggagtggccggcgctgctagcggctggggccgcggaggggaggcgggaggcgggctctttgcggattagcataaacttggggccgcgccgctcgccgccgccagcccctcgccccagctccgagcggacggccgaggagccgcctgcgaacaggaggttccaaagggagcagccccaggtggcaggggcgcaggccgccgcgccctgggaggccccccgagcacaccagccactctgtcgcctgcgggcacggggcgagacgcagagaagcggacccctgaggccagcctgggcgtggactttccaggagtcgtccaccctcaggatacgcttgtcttcagagtccgtgtgaacccgggaactgctctccagggctctggagccgagatggccgtgactgggggcac

SEQ ID NO: 119540 - DNA, 30 bp, Homo sapiens; identical to SEQ ID NO: 87548
  misc_feature 1..30: note = chr20:40020573-40020603
  misc_feature 1..30: note = Hypo
  source 1..30: mol_type = genomic DNA

SEQ ID NO: 119541 - DNA, 66 bp, Homo sapiens; identical to SEQ ID NO: 87551
  misc_feature 1..66: note = chr20:40321459-40321525
  misc_feature 1..66: note = Hyper
  source 1..66: mol_type = genomic DNA

SEQ ID NO: 119542 - DNA, 106 bp, Homo sapiens; identical to SEQ ID NO: 87552
  misc_feature 1..106: note = chr20:40457626-40457732
  misc_feature 1..106: note = Hypo
  source 1..106: mol_type = genomic DNA

SEQ ID NO: 119543 - DNA, 30 bp, Homo sapiens; identical to SEQ ID NO: 46165
  misc_feature 1..30: note = chr20:40715181-40715211
  misc_feature 1..30: note = Hypo
  source 1..30: mol_type = genomic DNA

SEQ ID NO: 119544 - DNA, 30 bp, Homo sapiens; identical to SEQ ID NO: 87556
  misc_feature 1..30: note = chr20:41607723-41607753
  misc_feature 1..30: note = Hypo
  source 1..30: mol_type = genomic DNA

SEQ ID NO: 119545 - DNA, 1977 bp, Homo sapiens
  misc_feature 1..1977: note = chr20:41817217-41819194
  misc_feature 1..1977: note = Hyper
  source 1..1977: mol_type = genomic DNA
accagcctgttcctgcgtcccacgggctgatctcagcctgtccccgcaatcccagccacctcaggccggcgtggttacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggagagcttcctgtatctccgaggaaaaaagaaaagccgccgccccggcagcctcggcctgctggggacctgtcctccccactaaaagcgcgcgctgcccgaggagctgcccgggagagaacgctccaccccgggcgtcggtgccgctcctcgtctcgccgccccaaacactcaagtggcagattccgacaagtgggaggcagcaagtggaaatattcgcaacaaccgcggaaagttactccagcccggggggccggcaggaaactgaagcggggaacttcgccaaacgcgggctgccgagggacgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggggcgggacgcggggggcggggggcggtgtcccccgagtcctaacgccgccgccgttgccgccgccgccgccgccgccgcccgcccgggcgctccgcctcggccgtgcacacaccctcacgcgcacgcccgcgcctggcacacgcccgcggctggcacacgcgggctcccccgcgcaccctctccggggccgaccagctcgggccgctggcacagtcacgcgcgtccacacatcacccccgcacccacacgccgggcagggtcctcgcctcttcgccccgcgccgcgccgcgcagccaagcatcgtctgccctgtgggggcgcaggtacgggggcggtgcggggaggaggaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccacaatcgtc

SEQ ID NO: 119546 - DNA, 90 bp, Homo sapiens; identical to SEQ ID NO: 87561
  misc_feature 1..90: note = chr20:41935531-41935621
  misc_feature 1..90: note = Hypo
  source 1..90: mol_type = genomic DNA

SEQ ID NO: 119547 - DNA, 124 bp, Homo sapiens; identical to SEQ ID NO: 87562
  misc_feature 1..124: note = chr20:42019051-42019175
  misc_feature 1..124: note = Hyper
  source 1..124: mol_type = genomic DNA

SEQ ID NO: 119548 - DNA, 134 bp, Homo sapiens; identical to SEQ ID NO: 87564
  misc_feature 1..134: note = chr20:42088631-42088765
  misc_feature 1..134: note = Hypo
  source 1..134: mol_type = genomic DNA

SEQ ID NO: 119549 - DNA, 691 bp, Homo sapiens; identical to SEQ ID NO: 87565
  misc_feature 1..691: note = chr20:42136052-42136743
  misc_feature 1..691: note = Hyper
  source 1..691: mol_type = genomic DNA

SEQ ID NO: 119550 - DNA, 172 bp, Homo sapiens; identical to SEQ ID NO: 87566
  misc_feature 1..172: note = chr20:42199155-42199327
  misc_feature 1..172: note = Hypo
  source 1..172: mol_type = genomic DNA

SEQ ID NO: 119551 - DNA, 102 bp, Homo sapiens; identical to SEQ ID NO: 1637
  misc_feature 1..102: note = chr20:42218592-42218694
  misc_feature 1..102: note = Hypo
  source 1..102: mol_type = genomic DNA

SEQ ID NO: 119552 - DNA, 16 bp, Homo sapiens
  misc_feature 1..16: note = chr20:42292357-42292373
  misc_feature 1..16: note = Hypo
  source 1..16: mol_type = genomic DNA
tctttttttgctgggc

SEQ ID NO: 119553 - DNA, 30 bp, Homo sapiens; identical to SEQ ID NO: 87570
  misc_feature 1..30: note = chr20:42346104-42346134
  misc_feature 1..30: note = Hypo
  source 1..30: mol_type = genomic DNA

SEQ ID NO: 119554 - DNA, 31 bp, Homo sapiens; identical to SEQ ID NO: 87571
  misc_feature 1..31: note = chr20:42402544-42402575
  misc_feature 1..31: note = Hypo
  source 1..31: mol_type = genomic DNA

SEQ ID NO: 119555 - DNA, 1954 bp, Homo sapiens
  misc_feature 1..1954: note = chr20:42543082-42545036
  misc_feature 1..1954: note = Hyper
  source 1..1954: mol_type = genomic DNA
ccttcctcttccccccgcacccacgccgcggggcggggactagcgccgcctcaaatatttagggcaagggagtgtcccacttctggggaggggtgccgttcgggcttctctcctcaccgtgggtggcgaaaggcgggacggaaaagcgccgtctggacaggcgcgcccccctcagggatgcagggccgggcgggggacccggcggcggcccagcccggaggaaggacctccacgccccggcccgggcccccgggcccccggccctaggcagcgcccgaggccggaacaatagcgcgcgcgggcggggcgggggcgggggcggggcgctcctctgggcaccgcccccggcccgccccccgcgctcgcagtcccgctcgcacactggctcccacccgccgcccgcccaggcactgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggctcacatcgatcccctcgcggccacgctcacgccctgagttgttgggatcgcgggcagaagtcatcccgacagccacccgtgcgacgacacagtggcccctcactcgcgtccccctgacagcctcgcagtcattcacaagccgtcacagtgacccacagccacacgcaggcggccaggcactgcttacacggtcccgccgtcccacgcaagtcaccctgacagtcacttatacacaacgacacgcaaccactcacccgcaaacagcctcaccgccacagacgagtcacccacagacgctccgatgccccacacaccgtgacatgcccccacccgctgtcacacccaggcacaacgggggacagtcacacaaagaagtcgcccgacagtcacactctcgcagccacaacgcctcacccaggcgcacgctgtcacacacagccacccccctggacggtgagcctcagacacagatcgtcctgacggccacacagtcacacgcggtcacacccagggacggccacacctcggtcatccacactcgcgcgtcgaggtttaacttctcagcgccgcagcacactaattgggcagtttactaattggccgtcactgcctggcggggcctcggattccgagtaggctgcggccaatcgaggcctgtgtcctcccgggagcggtgagccggcgtccctccaggctggggctgtagtgccggacaccctccctcctccatgtttccaggatctatccccccaccccagccaggtcccagctgcgctgcgccgggcgcattcccagtgatggaggcttgcgtgcctggaaccccgaacccgaggcgtcaggtcccactgccgggtctggcccagcctggatgggttgggtgcctctaagcagtccgcgtccccttcggtcgccggagagggaactttcaaacttagttaggaagccagactgtccgcgcgtccgccagtcggtgcgtcggtcccgggccggctggagccaagcgcgggttttcgtcactcggagcccggattgaacagcgcgcgtgggtttcccgcagccctggcgcagacgcgtgggctccgtggcgatgcggggtgagtgcgcgtccagtggctggatcggcgccccccagggtctctccccaacctcgcaggcttttcgtcaggcccctggtagtggggatgaggcaggagagaggcgtcccggcgcggatcccggggcctcccgggctgggcctccctgagtgcgccctcaggccccaggggagcggcttctggcaaag

SEQ ID NO: 119556 - DNA, 170 bp, Homo sapiens; identical to SEQ ID NO: 13811
  misc_feature 1..170: note = chr20:42587835-42588005
  misc_feature 1..170: note = Hyper
  source 1..170: mol_type = genomic DNA

SEQ ID NO: 119557 - DNA, 226 bp, Homo sapiens; identical to SEQ ID NO: 87575
  misc_feature 1..226: note = chr20:42721431-42721657
  misc_feature 1..226: note = Hypo
  source 1..226: mol_type = genomic DNA

SEQ ID NO: 119558 - DNA, 92 bp, Homo sapiens; identical to SEQ ID NO: 87576
  misc_feature 1..92: note = chr20:42777351-42777443
  misc_feature 1..92: note = Hypo
  source 1..92: mol_type = genomic DNA

SEQ ID NO: 119559 - DNA, 31 bp, Homo sapiens; identical to SEQ ID NO: 87577
  misc_feature 1..31: note = chr20:42777683-42777714
  misc_feature 1..31: note = Hypo
  source 1..31: mol_type = genomic DNA

SEQ ID NO: 119560 - DNA, 17 bp, Homo sapiens
  misc_feature 1..17: note = chr20:42823271-42823288
  misc_feature 1..17: note = Hypo
  source 1..17: mol_type = genomic DNA
attttatttttgagacg

SEQ ID NO: 119561 - DNA, 194 bp, Homo sapiens; identical to SEQ ID NO: 87579
  misc_feature 1..194: note = chr20:42840769-42840963
  misc_feature 1..194: note = Hypo
  source 1..194: mol_type = genomic DNA

SEQ ID NO: 119562 - DNA, 30 bp, Homo sapiens; identical to SEQ ID NO: 46169
  misc_feature 1..30: note = chr20:42853157-42853187
  misc_feature 1..30: note = Hypo
  source 1..30: mol_type = genomic DNA

SEQ ID NO: 119563 - DNA, 544 bp, Homo sapiens
  misc_feature 1..544: note = chr20:42875761-42876305
  misc_feature 1..544: note = Hyper
  source 1..544: mol_type = genomic DNA
tggcggcttttctggcgcgggccagggggaggaggagaaaggagctcccgggatcccctcgccccctcccccaactgcccggtgagtaatgacattcacggagcggggagggagggaggagaggggcaggctcggcgaggccatgtgatgctgggcgagagagagccgccgcgccggagcctccttctttcctgcctctgattccgggctgtcatggcgacccccaacaatctgacccccaccaactgcagctggtggcccatctccgcgctggagagcgatgcggccaagccagcggaggcccccgacgctcccgaggcggccagccccgcccattggcccagggagagcctggttctgtaccactggacccagtccttcagctcgcagaaggtagagccgggccgggagccgcctgcgccggtggccaggaagcttggggaggggagccccagggcttgagggatctgagggcggcgaaagactggaggggggaacctggggtttgggggtcccggaggtcgggggacgcaagggttccttc

SEQ ID NO: 119564 - DNA, 122 bp, Homo sapiens; identical to SEQ ID NO: 87582
  misc_feature 1..122: note = chr20:42876545-42876667
  misc_feature 1..122: note = Hyper
  source 1..122: mol_type = genomic DNA

SEQ ID NO: 119565 - DNA, 30 bp, Homo sapiens; identical to SEQ ID NO: 87583
  misc_feature 1..30: note = chr20:42931309-42931339
  misc_feature 1..30: note = Hypo
  source 1..30: mol_type = genomic DNA

SEQ ID NO: 119566 - DNA, 46 bp, Homo sapiens; identical to SEQ ID NO: 87584
  misc_feature 1..46: note = chr20:42955385-42955431
  misc_feature 1..46: note = Hyper
  source 1..46: mol_type = genomic DNA

SEQ ID NO: 119567 - DNA, 30 bp, Homo sapiens; identical to SEQ ID NO: 87585
  misc_feature 1..30: note = chr20:42979880-42979910
  misc_feature 1..30: note = Hypo
  source 1..30: mol_type = genomic DNA

SEQ ID NO: 119568 - DNA, 89 bp, Homo sapiens; identical to SEQ ID NO: 87586
  misc_feature 1..89: note = chr20:43017310-43017399
  misc_feature 1..89: note = Hyper
  source 1..89: mol_type = genomic DNA

SEQ ID NO: 119569 - DNA, 30 bp, Homo sapiens; identical to SEQ ID NO: 87587
  misc_feature 1..30: note = chr20:43048609-43048639
  misc_feature 1..30: note = Hypo
  source 1..30: mol_type = genomic DNA

SEQ ID NO: 119570 - DNA, 38 bp, Homo sapiens; identical to SEQ ID NO: 87588
  misc_feature 1..38: note = chr20:43052738-43052776
  misc_feature 1..38: note = Hypo
  source 1..38: mol_type = genomic DNA

SEQ ID NO: 119571 - DNA, 169 bp, Homo sapiens; identical to SEQ ID NO: 87589
  misc_feature 1..169: note = chr20:43065628-43065797
  misc_feature 1..169: note = Hypo
  source 1..169: mol_type = genomic DNA

SEQ ID NO: 119572 - DNA, 113 bp, Homo sapiens; identical to SEQ ID NO: 46171
  misc_feature 1..113: note = chr20:43276908-43277021
  misc_feature 1..113: note = Hypo
  source 1..113: mol_type = genomic DNA

SEQ ID NO: 119573 - DNA, 213 bp, Homo sapiens; identical to SEQ ID NO: 87591
  misc_feature 1..213: note = chr20:43295109-43295322
  misc_feature 1..213: note = Hypo
  source 1..213: mol_type = genomic DNA

SEQ ID NO: 119574 - DNA, 174 bp, Homo sapiens; identical to SEQ ID NO: 87592
  misc_feature 1..174: note = chr20:43379820-43379994
  misc_feature 1..174: note = Hypo
  source 1..174: mol_type = genomic DNA

SEQ ID NO: 119575 - DNA, 32 bp, Homo sapiens; identical to SEQ ID NO: 87593
  misc_feature 1..32: note = chr20:43382837-43382869
  misc_feature 1..32: note = Hypo
  source 1..32: mol_type = genomic DNA

SEQ ID NO: 119576 - DNA, 122 bp, Homo sapiens; identical to SEQ ID NO: 87594
  misc_feature 1..122: note = chr20:43385505-43385627
  misc_feature 1..122: note = Hypo
  source 1..122: mol_type = genomic DNA

SEQ ID NO: 119577 - DNA, 57 bp, Homo sapiens; identical to SEQ ID NO: 87595
  misc_feature 1..57: note = chr20:43416117-43416174
  misc_feature 1..57: note = Hypo
  source 1..57: mol_type = genomic DNA

SEQ ID NO: 119578 - DNA, 1549 bp, Homo sapiens
  misc_feature 1..1549: note = chr20:43438010-43439559
  misc_feature 1..1549: note = Hyper
  source 1..1549: mol_type = genomic DNA
cagctccccacccctcgctctggctgaggttgtgcgcaggcctgggaggaggaggttcaagccgctggctggtggccggcttcagcccaccaagaaaggcgactccagggacaagagcacctgaggtcaggggcacacaccagcgggcggacaagtgtagagttggcgccgccctacacctctctccgggaagagaggggaggaaaggccgtcacctggccggttcccctccgtctgccccaggcgtataagaagcaggagtctggagccccagcccatgagggaaggagaggagagataaatgggggcgctcaaggcctggggcgccgggcaggggtcttgggcagggatcctctggatgtggccaagacaaagatggagaggtaaggtctgcgcgccacctccaatggcggggggcgcgtcggagccccaggggtgggacggccaaagcccagggcttgaagagtgggcacattcaggagactcagggagggtggcaggtcggctccagggacgaggcaaggggcctccaataggcgcgggtgaggagggagatgggtcctggcgacccaaagggcccacctgcgggaaaggtgaatgcagacaatctcggggtccctgggggagaaggccagaaggtagcgcatcctggagaccctggggtcccgtgggtgcggaaggagaccctgggggcgccttcccaggggattgggggtggggaggagggcgcacgggtcggggagggggctaccggacctggatcccgggacaccccgggggtctggggggcgggccgcgcgcttacctgcgtcctcgtcgtcgaaggagttcatgcacgggaagtagatggcgagcgcctcgaaggaggcggacagactgaggcggctctgcgagcgctccatgcccgcgccggcgccgggcgcctcggccgcggcggcggcggcggcggcgggcggcttgggcagcttggccgccccattcttgacgcggagtacggcgcgcggcgtggtggcggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgaggcgggcttggagcggcgccgcagccaatccgtgccgccgggggagggggcgccgctgcggggcgtgggagcccggagggcgcgggctgcggcctcttctagcagcccccgggcccggcaggtgcgcgcggggaggcaggcgccgggcgaggttgtctgggccctggtccgagggctgttcccgaccccgcctcggcccccaccctcagccggccgacttgcggagaggccggcgtccagtccctcacccagacaggcctctcccagagacactggcgcgctcggaggggatgcgctcaaagggtcccgcccaggcgggtcggcactcggcctcccacacag

SEQ ID NO: 119579 - DNA, 364 bp, Homo sapiens
  misc_feature 1..364: note = chr20:43726504-43726868
  misc_feature 1..364: note = Hyper
  source 1..364: mol_type = genomic DNA
tggcagaagaagttgcgcgtactgggcgccagcaggaggcgcgacgacacctcgaagctgaaccaggcgatgcagaagtactcgaggcgtcgcagcaccgggtcgtcgcgcacgccttccgggctgcggcccgcggccaccgcagccacggcggccgccgcctcgcgggcctggtactcgggcaggctgtggatgcacatggcggcgatggaggcgagcaccacgctgatggagacgcagctgaagagcttgctcggcagcgagtagcccgggttctccatggtcagccagaggcggcggcgcaggcggccacagcgcgccgcgccatagcgcgccagttctcgctgcacgtcggagatctcgt

SEQ ID NO: 119580 - DNA, 207 bp, Homo sapiens
  misc_feature 1..207: note = chr20:43727096-43727303
  misc_feature 1..207: note = Hyper
  source 1..207: mol_type = genomic DNA
ggtcgaagtagaattcgcgcgccgcctcgtcgtagtcgtcgcacaggcgccgcgcctgctcctccgacgccgcggcctgcaggcggcccagccgcgtgcccgggaagcgcgccagggcgcgcgcgctcagctgccgccgcacgccacccacgttcacgcgcagcgcctcgtcgcttcgccgccagcggatcccggtgtcggggcccg

SEQ ID NO: 119581 - DNA, 179 bp, Homo sapiens
  misc_feature 1..179: note = chr20:43729562-43729741
  misc_feature 1..179: note = Hyper
  source 1..179: mol_type = genomic DNA
tgtggtggcacctcccgggcgcctcgcgtgtctgtcccaaagccaccgaggctgggagccgctggctatactcggtctcgcctctgccccgccggccccgccgagcctcctgctgcaggcggccccgctgccctctccttccttcttccttgcctagtcccccgcggctgaaggccgca

SEQ ID NO: 119582 - DNA, 372 bp, Homo sapiens; identical to SEQ ID NO: 87602
  misc_feature 1..372: note = chr20:43922168-43922540
  misc_feature 1..372: note = Hyper
  source 1..372: mol_type = genomic DNA

SEQ ID NO: 119583 - DNA, 171 bp, Homo sapiens; identical to SEQ ID NO: 87603
  misc_feature 1..171: note = chr20:43926590-43926761
  misc_feature 1..171: note = Hypo
  source 1..171: mol_type = genomic DNA

SEQ ID NO: 119584 - DNA, 21 bp, Homo sapiens
  misc_feature 1..21: note = chr20:43952338-43952359
  misc_feature 1..21: note = Hypo
  source 1..21: mol_type = genomic DNA
caggatcgtctcaatctcctg

SEQ ID NO: 119585 - DNA, 36 bp, Homo sapiens; identical to SEQ ID NO: 87605
  misc_feature 1..36: note = chr20:44006173-44006209
  misc_feature 1..36: note = Hypo
  source 1..36: mol_type = genomic DNA

SEQ ID NO: 119586 - DNA, 34 bp, Homo sapiens
  misc_feature 1..34: note = chr20:44099479-44099513
  misc_feature 1..34: note = Hyper
  source 1..34: mol_type = genomic DNA
gtttccttctcgaaccggccgaagcctgccctgc

SEQ ID NO: 119587 - DNA, 32 bp, Homo sapiens; identical to SEQ ID NO: 87606
  misc_feature 1..32: note = chr20:44420207-44420239
  misc_feature 1..32: note = Hypo
  source 1..32: mol_type = genomic DNA

SEQ ID NO: 119588 - DNA, 21 bp, Homo sapiens
  misc_feature 1..21: note = chr20:44421911-44421932
  misc_feature 1..21: note = Hypo
  source 1..21: mol_type = genomic DNA
acactttgggccgggcgcggt

SEQ ID NO: 119589 - DNA, 404 bp, Homo sapiens
  misc_feature 1..404: note = chr20:44452650-44453054
  misc_feature 1..404: note = Hyper
  source 1..404: mol_type = genomic DNA
cgttgttcttgtcgccgtctttcatcagagattcgatctcctcgtccgtcacgtgctccccggaggccctgaaaatctcagccagctcctccgggtcgatgtagccgtctgcattccttcaggtccgagggacagggcagggctcagggccggggcgagctgccctggccaccacactcgacgccccgcttccgcactcccaacacggggaagcttccagcgctgccggccgggttctgactgctaagcccctccctcggctcccgggcccccagcgcacctgtcgaagatgcggaagcactcggccagctcctcctcgctcttccctttcgcgtcctctttcatctggcgcaccatcatgaccaagaactcctcgaagtcgatggtgccgctgcctgcgggca

SEQ ID NO: 119590 - DNA, 135 bp, Homo sapiens; identical to SEQ ID NO: 87609
  misc_feature 1..135: note = chr20:44462871-44463006
  misc_feature 1..135: note = Hyper
  source 1..135: mol_type = genomic DNA

SEQ ID NO: 119591 - DNA, 40 bp, Homo sapiens; identical to SEQ ID NO: 46174
  misc_feature 1..40: note = chr20:44477901-44477941
  misc_feature 1..40: note = Hypo
  source 1..40: mol_type = genomic DNA

SEQ ID NO: 119592 - DNA, 23 bp, Homo sapiens
  misc_feature 1..23: note = chr20:44509241-44509264
  misc_feature 1..23: note = Hypo
  source 1..23: mol_type = genomic DNA
acccgcggtggctcacgcctgta

SEQ ID NO: 119593 - DNA, 336 bp, Homo sapiens; identical to SEQ ID NO: 87612
  misc_feature 1..336: note = chr20:44518882-44519218
  misc_feature 1..336: note = Hyper
  source 1..336: mol_type = genomic DNA

SEQ ID NO: 119594 - DNA, 48 bp, Homo sapiens; identical to SEQ ID NO: 87613
  misc_feature 1..48: note = chr20:44540105-44540153
  misc_feature 1..48: note = Hyper
  source 1..48: mol_type = genomic DNA

SEQ ID NO: 119595 - DNA, 383 bp, Homo sapiens; identical to SEQ ID NO: 87614
  misc_feature 1..383: note = chr20:44540444-44540827
  misc_feature 1..383: note = Hyper
  source 1..383: mol_type = genomic DNA

SEQ ID NO: 119596 - DNA, 30 bp, Homo sapiens; identical to SEQ ID NO: 46175
  misc_feature 1..30: note = chr20:44562147-44562177
  misc_feature 1..30: note = Hypo
  source 1..30: mol_type = genomic DNA

SEQ ID NO: 119597 - DNA, 46 bp, Homo sapiens; identical to SEQ ID NO: 87616
  misc_feature 1..46: note = chr20:44569195-44569241
  misc_feature 1..46: note = Hypo
  source 1..46: mol_type = genomic DNA

SEQ ID NO: 119598 - DNA, 23 bp, Homo sapiens
  misc_feature 1..23: note = chr20:44601506-44601529
  misc_feature 1..23: note = Hypo
  source 1..23: mol_type = genomic DNA
taatagagctgaggccgggcgct

SEQ ID NO: 119599 - DNA, 240 bp, Homo sapiens; identical to SEQ ID NO: 87618
  misc_feature 1..240: note = chr20:44601829-44602069
  misc_feature 1..240: note = Hypo
  source 1..240: mol_type = genomic DNA

SEQ ID NO: 119600 - DNA, 716 bp, Homo sapiens
  misc_feature 1..716: note = chr20:44639138-44639854
  misc_feature 1..716: note = Hyper
  source 1..716: mol_type = genomic DNA
aagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatctgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacccgccgccctaactccggtcccccctcctcctgcagtggttccaactcggtttggaaacgcagatggcgcggcctgccacttccccttcatcttcgagggccgctccta

SEQ ID NO: 119601 - DNA, 83 bp, Homo sapiens
  misc_feature 1..83: note = chr20:44640284-44640367
  misc_feature 1..83: note = Hyper
  source 1..83: mol_type = genomic DNA
actccgcctgcaccacggacggtcgctccgacggctaccgctggtgcgccaccaccgccaactacgaccgggacaagctcttc

SEQ ID NO: 119602 - DNA, 276 bp, Homo sapiens; identical to SEQ ID NO: 87623
  misc_feature 1..276: note = chr20:44640624-44640900
  misc_feature 1..276: note = Hyper
  source 1..276: mol_type = genomic DNA

SEQ ID NO: 119603 - DNA, 143 bp, Homo sapiens
  misc_feature 1..143: note = chr20:44642389-44642532
  misc_feature 1..143: note = Hyper
  source 1..143: mol_type = genomic DNA
tcggtctttgaggagcggctctccaagaagcttttcttcttctctggttagttacctactttccctcccccgcccggtcaatccccatcagtcaaggaggctcaagagaccatcgataacccacgaaacgtcttgtgcgtttt

SEQ ID NO: 119604 - DNA, 340 bp, Homo sapiens; identical to SEQ ID NO: 87625
  misc_feature 1..340: note = chr20:44650172-44650512
  misc_feature 1..340: note = Hyper
  source 1..340: mol_type = genomic DNA

SEQ ID NO: 119605 - DNA, 718 bp, Homo sapiens
  misc_feature 1..718: note = chr20:44657718-44658436
  misc_feature 1..718: note = Hyper
  source 1..718: mol_type = genomic DNA
ctccccccaaaaccccgccagtggctcacgcctcctgcatacgggatgaggtgagcagcgccgctgctgagagggggcgcgcgcgggtgtgagcgtgtgtccgtgtgcgagtgtgtgtgcgccgggcgggcgggcactgcagcttcttcctccgtggagcggagagcgagacagagctacagcgaacgagagagcggcgaaggcgggtagaggggcgcgggcgaggcggcgcagccatccccggaccaggggccgcgccgccaccatgctaaacaacctgacggactgcgaggacggcgatgggggagccaacccgggtaagctgtggtccgggggcggcgggggagggggcagcgaggagaggaggcagctctggggttagaggcggagcgggggccacctccttcagagaggaggctgggactgacccgggcggtgggcgccagttgcagcctggagctcagctccattggaatgctccgggcgctgtccaaggtgctggaatgcgccgcgcccgggggcagagctgcgggccgggggattatcgctgcccacggcttcgggctgacttgggttagctaaaccgaggaggcggtgggaaggggatagaagacctagaatgggctgatgtggagctcgacggcgggaggagggctcctttccccgacaggggaccccggcgtcctggcgcagagcaggcacccgtggagccgggggg

SEQ ID NO: 119606 - DNA, 171 bp, Homo sapiens; identical to SEQ ID NO: 38131
  misc_feature 1..171: note = chr20:44659126-44659297
  misc_feature 1..171: note = Hyper
  source 1..171: mol_type = genomic DNA

SEQ ID NO: 119607 - DNA, 30 bp, Homo sapiens; identical to SEQ ID NO: 87630
  misc_feature 1..30: note = chr20:44659623-44659653
  misc_feature 1..30: note = Hyper
  source 1..30: mol_type = genomic DNA

SEQ ID NO: 119608 - DNA, 30 bp, Homo sapiens; identical to SEQ ID NO: 38132
  misc_feature 1..30: note = chr20:44660307-44660337
  misc_feature 1..30: note = Hyper
  source 1..30: mol_type = genomic DNA

SEQ ID NO: 119609 - DNA, 356 bp, Homo sapiens; identical to SEQ ID NO: 87632
  misc_feature 1..356: note = chr20:44660605-44660961
  misc_feature 1..356: note = Hyper
  source 1..356: mol_type = genomic DNA

SEQ ID NO: 119610 - DNA, 30 bp, Homo sapiens; identical to SEQ ID NO: 87633
  misc_feature 1..30: note = chr20:44681660-44681690
  misc_feature 1..30: note = Hypo
  source 1..30: mol_type = genomic DNA

SEQ ID NO: 119611 - DNA, 946 bp, Homo sapiens
  misc_feature 1..946: note = chr20:44685860-44686806
  misc_feature 1..946: note = Hyper
  source 1..946: mol_type = genomic DNA
atcgtgaagaaatcccgggacgccaagcttgttttgctcaacatgcctgggcctccccgcaaccgcaatggtgatgaaaactgtatcctggaattaaaattgggggaaagagggaggtggacgtcagggaatctgggtcctgtccctgggatggaagagctgagctgttcctgcctccggatcagcacctcggacagggacacgggcgcgagaggtcccctggcagccgagcgcgaccccaatttcgtcgggagggaaggagaccgggtctttctccttgaccggctctcagacatggagtttctcgaggtcctcacagagcacctggaccgggtgatgctggtccgcggcggcggccgcgaggtcatcaccatctactcctgagaaccaggacctgccacccgggcccgagcgcgcccggcccgcggctccggagccctcgccgcgccccccgccgctgtcaccgtttacatacagaccctgtgcccgtgtcctggccccttaccccgctgcctgaagcccggaggccacgcctgttggggctgattcggagagggcgccccgccgcgcagagaccagagctcctcagtgccagtttggcccctgggtcttcgctgccctttttctaagcccggcctcgtctcgccggaggagacgctgcaataaaggttgggagaaggcgcggaaaggagaggagctggggccttggggacccccaggtagtccatgcggcccattcctccccttcccactcccgccgcggtcctcgctctgcgctcctccggcgctgctccctggctcccggcggcccggaggcccgcggggtgggaaggccgcgcttgccgtctccgccgccccttctcgccgagccgtggggcgcgggcggccgagcctatacatagtgtacaggagacatcgcgtgtatttttaacgtccccatatttat

SEQ ID NO: 119612 - DNA, 200 bp, Homo sapiens
  misc_feature 1..200: note = chr20:44687107-44687307
  misc_feature 1..200: note = Hyper
  source 1..200: mol_type = genomic DNA
ctgcggctgcagagacgcgagcaacctcttctcatcggctcttatgcaagttggggccaggataggggaggggtgctcctcaagaggaagaaaccgagaggcccgcgccccaccgaggaagccccgccccggtgccttcgctggggagcaggcgtctctcctcagtcggcttgtcgcctgctccccgtatcccatggctc

SEQ ID NO: 119613 - DNA, 42 bp, Homo sapiens; identical to SEQ ID NO: 87638
  misc_feature 1..42: note = chr20:44720305-44720347
  misc_feature 1..42: note = Hypo
  source 1..42: mol_type = genomic DNA

SEQ ID NO: 119614 - DNA, 18 bp, Homo sapiens
  misc_feature 1..18: note = chr20:44723384-44723402
  misc_feature 1..18: note = Hypo
  source 1..18: mol_type = genomic DNA
gcccggcccatgaagacc

SEQ ID NO: 119615 - DNA, 40 bp, Homo sapiens; identical to SEQ ID NO: 87640
  misc_feature 1..40: note = chr20:44747259-44747299
  misc_feature 1..40: note = Hyper
  source 1..40: mol_type = genomic DNA

SEQ ID NO: 119616 - DNA, 47 bp, Homo sapiens; identical to SEQ ID NO: 46179
  misc_feature 1..47: note = chr20:44756555-44756602
  misc_feature 1..47: note = Hypo
  source 1..47: mol_type = genomic DNA

SEQ ID NO: 119617 - DNA, 829 bp, Homo sapiens
  misc_feature 1..829: note = chr20:44802981-44803810
  misc_feature 1..829: note = Hyper
  source 1..829: mol_type = genomic DNA
aggaatggaagagtccgctcctagcaagtcccccctccgtccagccgccaagggagggttgggggagggcaggaaagggggtccgcgggggaaacgcgttgtcctggggccccggcgtgtgctgggcgggtgagcagccgcgccccgacggcagggcgaggggctaggaggcctgggcctcgtcgtccccgcggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagggggcaactgagggccaagcccctcccagggcattagaaggaccctctaccccatctcctcccgcctcccacccagc

SEQ ID NO: 119618 - DNA, 85 bp, Homo sapiens; identical to SEQ ID NO: 87644
  misc_feature 1..85: note = chr20:44845479-44845564
  misc_feature 1..85: note = Hypo
  source 1..85: mol_type = genomic DNA

SEQ ID NO: 119619 - DNA, 224 bp, Homo sapiens
  misc_feature 1..224: note = chr20:44875187-44875411
  misc_feature 1..224: note = Hyper
  source 1..224: mol_type = genomic DNA
tttgagggtgggtgtcgtgagaaggttcggggagaggtgggccagggttgccaatgggggcagggccgcggaaggagctgtttgtgtggggccttggcgacaaccgcggggcccagcggttcctgtgggtgctgacaggagcctggcggtgagtgatggaggaggcggttgtaaaataggttaccgtcgggcgcccggggttcactctgcggatggtgctgttg

SEQ ID NO: 119620 - DNA, 570 bp, Homo sapiens
  misc_feature 1..570: note = chr20:44879731-44880301
  misc_feature 1..570: note = Hyper
  source 1..570: mol_type = genomic DNA
ggttccacacccagccgcgtttgacgcggccggctcccagcgcgccgtcctgccgagctccgggcgccgacggcgagggtgtgcccgctgcccacaggcgccccagcagcgtcggcggcggcggcagcagcagcagcagcagtagcgcgggggacagcgcgactcccgcccggagccccctaccttcgggcctcggcctcatccttggcctgcgcggggctggggcccaggagcatggacgagaggcaccagggcgccgctgcttggtcgcacaacgatgcggcgccgtgtcacatggtggcctcagcgcggccgccgggatgtcgcccccgacggggcacccggacgggcccgcggccctgaacgccgcccagccgcgggggtacccggctggagggggagggggcgcggccgcatccggggcatggacagcccccggggtgcccgcccgcgcccccgtcgccgcgtcgcgtgcggatcaccaggcagcacctggacagctccagagtcggggaagcgccatggttcctgcgcagaaaggatgcgggttggggccggcagatcctgcca

SEQ ID NO: 119621 - DNA, 145 bp, Homo sapiens; identical to SEQ ID NO: 87648
  misc_feature 1..145: note = chr20:44893551-44893696
  misc_feature 1..145: note = Hypo
  source 1..145: mol_type = genomic DNA

SEQ ID NO: 119622 - DNA, 1286 bp, Homo sapiens
  misc_feature 1..1286: note = chr20:44936006-44937292
  misc_feature 1..1286: note = Hyper
  source 1..1286: mol_type = genomic DNA
ccacccagggctgcccggcaccccgcgcgcccacgcagtccactcttcacagtaaacgccgcggcccccgagggttagccctaagtggcgctctctttggacgttaggctgtcgggggccccgtccttcttccccagcggggacggtgtctccggagtcgggtcctaaggaagagagcagcgctggctctcgctcaccgccagcccgcccgacggccatagggcagggggggtcgcgccggtggggccggcaggggtccctgtgggccgcctccccggctcagaggggaccagaaccgtgcgtgtcgccgcggctggagtcagcctccgggtgtccccggacgcggcacgacctcgcacacacacaccgcgcgcacacgctcgcgccgtgcggtattttcccggccccggaccccgcctctgggaggggccggggagccgagccccgctagcagggttgggggaccgggaacgcctgggtcccagccctcgcgtcagggctgtgcgccaccttcccagccccttttggcgcgccggctcggcccctggcgctgccacccctcggcccgcgggggtcccggaggctcccgggcgcgcggcggacgaggttgtggggacgggtgggagctgcgggcttcgggccgagaggcggctcggctccgcgccggggaaagtttggacgtgggaaactccctccccgccctcccggccgagaggagggggcgcgcagggccgggcgcaggcaccccggctcctcctgcggctggaggctcgccccccgcgccgcctgcccggccgctcccgccggccagggggctccctccctgccgggcagcctcccctcggcggcgatccggccgctcctcccgcggcaccccgcgctcttacctcggggagcggcccggggctccccctagtcctgccgcctcgggacgctgcgtggggcgggagccccggcgcgggcagcgggcgagtccggagccccgcggccgcccgcaggagccggagggagagcgggagcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcggagaatgcagggcccgccgggcaggagccgcgcagcgccaagccgcaggcggccgccggcccggacccccgcagccggggaaccccagcc

SEQ ID NO: 119623 - DNA, 101 bp, Homo sapiens; identical to SEQ ID NO: 87652
  misc_feature 1..101: note = chr20:44937542-44937643
  misc_feature 1..101: note = Hyper
  source 1..101: mol_type = genomic DNA

SEQ ID NO: 119624 - DNA, 281 bp, Homo sapiens; identical to SEQ ID NO: 87653
  misc_feature 1..281: note = chr20:44941380-44941661
  misc_feature 1..281: note = Hyper
  source 1..281: mol_type = genomic DNA

SEQ ID NO: 119625 - DNA, 47 bp, Homo sapiens; identical to SEQ ID NO: 87654
  misc_feature 1..47: note = chr20:44993202-44993249
  misc_feature 1..47: note = Hyper
  source 1..47: mol_type = genomic DNA

SEQ ID NO: 119626 - DNA, 30 bp, Homo sapiens; identical to SEQ ID NO: 87655
  misc_feature 1..30: note = chr20:45096840-45096870
  misc_feature 1..30: note = Hypo
  source 1..30: mol_type = genomic DNA

SEQ ID NO: 119627 - DNA, 394 bp, Homo sapiens
  misc_feature 1..394: note = chr20:45141834-45142228
  misc_feature 1..394: note = Hyper
  source 1..394: mol_type = genomic DNA
ctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagagcgcgcgtccaccctccgcagacccgaggcccgctccgcccggccccaccgttccctccgacgcccgagtgctcagagctcgccgccagcccttcctataggttgtgggtgcacccgcttcgcctccagttcgcaccaggtccaagtctcggcgggaccagggattcacgggctgcaggaccctcacccggaagagcctggcgaaccggaagggcgtccaggtaaaaaa

SEQ ID NO: 119628 - DNA, 573 bp, Homo sapiens
  misc_feature 1..573: note = chr20:45279814-45280387
  misc_feature 1..573: note = Hyper
  source 1..573: mol_type = genomic DNA
gcaagggagggaaggcgagggggtctggtggagcctgtctacactgggacctcagcggtctcccaacttggaggcttgggagaagaggatcccgcctgtggttgaccgggggcgcacaggcggaggaggcgttaccttgggcgggagggcgaagaccaccggcagcagcgcgagcggcgtgaacagcagcaccagcagccgccgcgcgctccacaccttcttggccgctgctgccagcgccgccatcagcgcgatcgcctggcggtacgggccggcccgggactgccccgcctggccccggcgccggcttaaagcctgggggagggtcggggaggggactgcgctggggaacccgccctctccctgctcctcctggaggaaaagggtggtgcctgcgcccctgggaccgggtgaaagaggcccgggaacgttggagaaagttaggcactagaattagcaaacgggaccccagccgcagggcagtgtggccttgcctcttggcttcccagcaatgtggcctggggcagctggcttatcctctcctcgcctctgtttactcgcctgtgagatggc

SEQ ID NO: 119629 - DNA, 37 bp, Homo sapiens; identical to SEQ ID NO: 87660
  misc_feature 1..37: note = chr20:45316162-45316199
  misc_feature 1..37: note = Hypo
  source 1..37: mol_type = genomic DNA

SEQ ID NO: 119630 - DNA, 416 bp, Homo sapiens; identical to SEQ ID NO: 46181
  misc_feature 1..416: note = chr20:45337605-45338021
  misc_feature 1..416: note = Hypo
  source 1..416: mol_type = genomic DNA

SEQ ID NO: 119631 - DNA, 587 bp, Homo sapiens; identical to SEQ ID NO: 87662
  misc_feature 1..587: note = chr20:45338197-45338784
  misc_feature 1..587: note = Hyper
  source 1..587: mol_type = genomic DNA

SEQ ID NO: 119632 - DNA, 1458 bp, Homo sapiens; identical to SEQ ID NO: 87663
  misc_feature 1..1458: note = chr20:45523171-45524629
  misc_feature 1..1458: note = Hyper
  source 1..1458: mol_type = genomic DNA

SEQ ID NO: 119633 - DNA, 29 bp, Homo sapiens
  misc_feature 1..29: note = chr20:45833539-45833568
  misc_feature 1..29: note = Hypo
  source 1..29: mol_type = genomic DNA
ctgattatcgccactcgactgtatagttt

SEQ ID NO: 119634 - DNA, 30 bp, Homo sapiens; identical to SEQ ID NO: 46182
  misc_feature 1..30: note = chr20:45834171-45834201
  misc_feature 1..30: note = Hypo
  source 1..30: mol_type = genomic DNA

SEQ ID NO: 119635 - DNA, 30 bp, Homo sapiens; identical to SEQ ID NO: 87666
  misc_feature 1..30: note = chr20:45871153-45871183
  misc_feature 1..30: note = Hypo
  source 1..30: mol_type = genomic DNA

SEQ ID NO: 119636 - DNA, 37 bp, Homo sapiens; identical to SEQ ID NO: 87668
  misc_feature 1..37: note = chr20:45941815-45941852
  misc_feature 1..37: note = Hypo
  source 1..37: mol_type = genomic DNA

SEQ ID NO: 119637 - DNA, 87 bp, Homo sapiens; identical to SEQ ID NO: 87669
  misc_feature 1..87: note = chr20:45949101-45949188
  misc_feature 1..87: note = Hypo
  source 1..87: mol_type = genomic DNA

SEQ ID NO: 119638 - DNA, 29 bp, Homo sapiens
  misc_feature 1..29: note = chr20:45951417-45951446
  misc_feature 1..29: note = Hypo
  source 1..29: mol_type = genomic DNA
gctgggattacaggcgtgagccaccacac

SEQ ID NO: 119639 - DNA, 47 bp, Homo sapiens; identical to SEQ ID NO: 87671
  misc_feature 1..47: note = chr20:45951653-45951700
  misc_feature 1..47: note = Hypo
  source 1..47: mol_type = genomic DNA

SEQ ID NO: 119640 - DNA, 146 bp, Homo sapiens; identical to SEQ ID NO: 46185
  misc_feature 1..146: note = chr20:46013515-46013661
  misc_feature 1..146: note = Hypo
  source 1..146: mol_type = genomic DNA

SEQ ID NO: 119641 - DNA, 25 bp, Homo sapiens
  misc_feature 1..25: note = chr20:46034351-46034376
  misc_feature 1..25: note = Hypo
  source 1..25: mol_type = genomic DNA
agtgagactccgtctcaaaacaaaa

SEQ ID NO: 119642 - DNA, 30 bp, Homo sapiens; identical to SEQ ID NO: 46186
  misc_feature 1..30: note = chr20:46175625-46175655
  misc_feature 1..30: note = Hypo
  source 1..30: mol_type = genomic DNA

SEQ ID NO: 119643 - DNA, 30 bp, Homo sapiens; identical to SEQ ID NO: 46187
  misc_feature 1..30: note = chr20:46315525-46315555
  misc_feature 1..30: note = Hypo
  source 1..30: mol_type = genomic DNA

SEQ ID NO: 119644 - DNA, 30 bp, Homo sapiens; identical to SEQ ID NO: 87676
  misc_feature 1..30: note = chr20:46354550-46354580
  misc_feature 1..30: note = Hypo
  source 1..30: mol_type = genomic DNA

SEQ ID NO: 119645 - DNA, 30 bp, Homo sapiens; identical to SEQ ID NO: 87677
  misc_feature 1..30: note = chr20:46365350-46365380
  misc_feature 1..30: note = Hypo
  source 1..30: mol_type = genomic DNA

SEQ ID NO: 119646 - DNA, 36 bp, Homo sapiens; identical to SEQ ID NO: 46188
  misc_feature 1..36: note = chr20:46365599-46365635
  misc_feature 1..36: note = Hypo
  source 1..36: mol_type = genomic DNA

SEQ ID NO: 119647 - DNA, 188 bp, Homo sapiens; identical to SEQ ID NO: 87679
  misc_feature 1..188: note = chr20:46386594-46386782
  misc_feature 1..188: note = Hypo
  source 1..188: mol_type = genomic DNA

SEQ ID NO: 119648 - DNA, 25 bp, Homo sapiens
  misc_feature 1..25: note = chr20:46390872-46390897
  misc_feature 1..25: note = Hypo
  source 1..25: mol_type = genomic DNA
ttatcagcagcgtgaaaacagacta

SEQ ID NO: 119649 - DNA, 293 bp, Homo sapiens; identical to SEQ ID NO: 87681
  misc_feature 1..293: note = chr20:46413326-46413619
  misc_feature 1..293: note = Hyper
  source 1..293: mol_type = genomic DNA

SEQ ID NO: 119650 - DNA, 128 bp, Homo sapiens; identical to SEQ ID NO: 87682
  misc_feature 1..128: note = chr20:46414099-46414227
  misc_feature 1..128: note = Hyper
  source 1..128: mol_type = genomic DNA

SEQ ID NO: 119651 - DNA, 279 bp, Homo sapiens; identical to SEQ ID NO: 38157
  misc_feature 1..279: note = chr20:46414635-46414914
  misc_feature 1..279: note = Hyper
  source 1..279: mol_type = genomic DNA

SEQ ID NO: 119652 - DNA, 383 bp, Homo sapiens; identical to SEQ ID NO: 87684
  misc_feature 1..383: note = chr20:46415137-46415520
  misc_feature 1..383: note = Hyper
  source 1..383: mol_type = genomic DNA

SEQ ID NO: 119653 - DNA, 30 bp, Homo sapiens; identical to SEQ ID NO: 87685
  misc_feature 1..30: note = chr20:46430501-46430531
  misc_feature 1..30: note = Hypo
  source 1..30: mol_type = genomic DNA

SEQ ID NO: 119654 - DNA, 30 bp, Homo sapiens; identical to SEQ ID NO: 87686
  misc_feature 1..30: note = chr20:46438115-46438145
  misc_feature 1..30: note = Hypo
  source 1..30: mol_type = genomic DNA

SEQ ID NO: 119655 - DNA, 30 bp, Homo sapiens; identical to SEQ ID NO: 87687
  misc_feature 1..30: note = chr20:46438350-46438380
  misc_feature 1..30: note = Hypo
  source 1..30: mol_type = genomic DNA

SEQ ID NO: 119656 - DNA, 30 bp, Homo sapiens; identical to SEQ ID NO: 87688
  misc_feature 1..30: note = chr20:46454708-46454738
  misc_feature 1..30: note = Hypo
  source 1..30: mol_type = genomic DNA

SEQ ID NO: 119657 - DNA, 30 bp, Homo sapiens; identical to SEQ ID NO: 87691
  misc_feature 1..30: note = chr20:46580194-46580224
  misc_feature 1..30: note = Hypo
  source 1..30: mol_type = genomic DNA

SEQ ID NO: 119658 - DNA, 30 bp, Homo sapiens; identical to SEQ ID NO: 46189
  misc_feature 1..30: note = chr20:46582135-46582165
  misc_feature 1..30: note = Hypo
  source 1..30: mol_type = genomic DNA

SEQ ID NO: 119659 - DNA, 70 bp, Homo sapiens; identical to SEQ ID NO: 87693
  misc_feature 1..70: note = chr20:46687876-46687946
  misc_feature 1..70: note = Hypo
  source 1..70: mol_type = genomic DNA

SEQ ID NO: 119660 - DNA, 196 bp, Homo sapiens; identical to SEQ ID NO: 87694
  misc_feature 1..196: note = chr20:46729505-46729701
  misc_feature 1..196: note = Hypo
  source 1..196: mol_type = genomic DNA

SEQ ID NO: 119661 - DNA, 198 bp, Homo sapiens; identical to SEQ ID NO: 87695
  misc_feature 1..198: note = chr20:46731680-46731878
  misc_feature 1..198: note = Hypo
  source 1..198: mol_type = genomic DNA

SEQ ID NO: 119662 - DNA, 30 bp, Homo sapiens; identical to SEQ ID NO: 87697
  misc_feature 1..30: note = chr20:46798520-46798550
  misc_feature 1..30: note = Hypo
  source 1..30: mol_type = genomic DNA

SEQ ID NO: 119663 - DNA, 220 bp, Homo sapiens; identical to SEQ ID NO: 87698
  misc_feature 1..220: note = chr20:46823363-46823583
  misc_feature 1..220: note = Hypo
  source 1..220: mol_type = genomic DNA

SEQ ID NO: 119664 - DNA, 182 bp, Homo sapiens; identical to SEQ ID NO: 87699
  misc_feature 1..182: note = chr20:46838294-46838476
  misc_feature 1..182: note = Hypo
  source 1..182: mol_type = genomic DNA

SEQ ID NO: 119665 - DNA, 30 bp, Homo sapiens; identical to SEQ ID NO: 87701
  misc_feature 1..30: note = chr20:46955145-46955175
  misc_feature 1..30: note = Hypo
  source 1..30: mol_type = genomic DNA

SEQ ID NO: 119666 - DNA, 61 bp, Homo sapiens; identical to SEQ ID NO: 87702
  misc_feature 1..61: note = chr20:46972040-46972101
  misc_feature 1..61: note = Hypo
  source 1..61: mol_type = genomic DNA

SEQ ID NO: 119667 - DNA, 30 bp, Homo sapiens; identical to SEQ ID NO: 87703
  misc_feature 1..30: note = chr20:47001190-47001220
  misc_feature 1..30: note = Hypo
  source 1..30: mol_type = genomic DNA

SEQ ID NO: 119668 - DNA, 36 bp, Homo sapiens; identical to SEQ ID NO: 87704
  misc_feature 1..36: note = chr20:47128746-47128782
  misc_feature 1..36: note = Hypo
  source 1..36: mol_type = genomic DNA

SEQ ID NO: 119669 - DNA, 30 bp, Homo sapiens; identical to SEQ ID NO: 87705
  misc_feature 1..30: note = chr20:47168941-47168971
  misc_feature 1..30: note = Hypo
  source 1..30: mol_type = genomic DNA

SEQ ID NO: 119670 - DNA, 36 bp, Homo sapiens; identical to SEQ ID NO: 87706
  misc_feature 1..36: note = chr20:47201897-47201933
  misc_feature 1..36: note = Hypo
  source 1..36: mol_type = genomic DNA

SEQ ID NO: 119671 - DNA, 30 bp, Homo sapiens; identical to SEQ ID NO: 87708
  misc_feature 1..30: note = chr20:47241898-47241928
  misc_feature 1..30: note = Hypo
  source 1..30: mol_type = genomic DNA

SEQ ID NO: 119672 - DNA, 112 bp, Homo sapiens; identical to SEQ ID NO: 87709
  misc_feature 1..112: note = chr20:47247201-47247313
  misc_feature 1..112: note = Hypo
  source 1..112: mol_type = genomic DNA

SEQ ID NO: 119673 - DNA, 258 bp, Homo sapiens; identical to SEQ ID NO: 87710
  misc_feature 1..258: note = chr20:47252924-47253182
  misc_feature 1..258: note = Hypo
  source 1..258: mol_type = genomic DNA

SEQ ID NO: 119674 - DNA, 30 bp, Homo sapiens; identical to SEQ ID NO: 87711
  misc_feature 1..30: note = chr20:47258562-47258592
  misc_feature 1..30: note = Hypo
  source 1..30: mol_type = genomic DNA

SEQ ID NO: 119675 - DNA, 20 bp, Homo sapiens
  misc_feature 1..20: note = chr20:47259758-47259778
  misc_feature 1..20: note = Hypo
  source 1..20: mol_type = genomic DNA
agcaatttgggaggccgggg

SEQ ID NO: 119676 - DNA, 36 bp, Homo sapiens; identical to SEQ ID NO: 46194
  misc_feature 1..36: note = chr20:47260725-47260761
  misc_feature 1..36: note = Hypo
  source 1..36: mol_type = genomic DNA

SEQ ID NO: 119677 - DNA, 30 bp, Homo sapiens; identical to SEQ ID NO: 87714
  misc_feature 1..30: note = chr20:47264965-47264995
  misc_feature 1..30: note = Hypo
  source 1..30: mol_type = genomic DNA

SEQ ID NO: 119678 - DNA, 30 bp, Homo sapiens; identical to SEQ ID NO: 87715
  misc_feature 1..30: note = chr20:47273573-47273603
  misc_feature 1..30: note = Hypo
  source 1..30: mol_type = genomic DNA

SEQ ID NO: 119679 - DNA, 182 bp, Homo sapiens; identical to SEQ ID NO: 46195
  misc_feature 1..182: note = chr20:47274120-47274302
  misc_feature 1..182: note = Hypo
  source 1..182: mol_type = genomic DNA

SEQ ID NO: 119680 - DNA, 30 bp, Homo sapiens; identical to SEQ ID NO: 46196
  misc_feature 1..30: note = chr20:47274646-47274676
  misc_feature 1..30: note = Hypo
  source 1..30: mol_type = genomic DNA

SEQ ID NO: 119681 - DNA, 342 bp, Homo sapiens; identical to SEQ ID NO: 87718
  misc_feature 1..342: note = chr20:47296022-47296364
  misc_feature 1..342: note = Hypo
  source 1..342: mol_type = genomic DNA

SEQ ID NO: 119682 - DNA, 30 bp, Homo sapiens; identical to SEQ ID NO: 87719
  misc_feature 1..30: note = chr20:47358665-47358695
  misc_feature 1..30: note = Hypo
  source 1..30: mol_type = genomic DNA

SEQ ID NO: 119683 - DNA, 30 bp, Homo sapiens; identical to SEQ ID NO: 87720
  misc_feature 1..30: note = chr20:47359750-47359780
  misc_feature 1..30: note = Hypo
  source 1..30: mol_type = genomic DNA

SEQ ID NO: 119684 - DNA, 86 bp, Homo sapiens; identical to SEQ ID NO: 87721
  misc_feature 1..86: note = chr20:47381385-47381471
  misc_feature 1..86: note = Hypo
  source 1..86: mol_type = genomic DNA

SEQ ID NO: 119685 - DNA, 184 bp, Homo sapiens; identical to SEQ ID NO: 16602
  misc_feature 1..184: note = chr20:47428537-47428721
  misc_feature 1..184: note = Hypo
  source 1..184: mol_type = genomic DNA

SEQ ID NO: 119686 - DNA, 1537 bp, Homo sapiens
  misc_feature 1..1537: note = chr20:47443678-47445215
  misc_feature 1..1537: note = Hyper
  source 1..1537: mol_type = genomic DNA
ggttctgtcaatccccgcccctcctctgagcttcaggttttatcctactccatcaacgcgcagggacgttgggctctggggctcctacggtatgtcctagatgagtggtgcaccgggcgcgtagttattcctgggaaaaagacgcaggagcgccagctcccggcgccgccggggtccccaagcccctgcatcgcggatgtaactaattttaaaactatttgaaaggcggggacggggaagaaaagacaaaagggcagcgcgcgccgcggggaagtggagtgcgggagagccccggtcggagcaggaccgtgcgccggccagggagggaggcgacgcgacagctctggaggagctcggatcccccccgctttccgcgcgccctgcggggcgcccccgaggcaattctccacccacggggaccacggccacaggttgtggggaccgcagcggggcgagcggctggagggaaagctgtccccaagctcccgagcgacactcaccgactgcaagaagcgcaaggtgcccacgtagtccctctcggtgcccaagatctcgttgaggacgcagaggcggaggcgcagctggcgctcggactcccgggcggccgcgcacgggccggggccggagctgggcgccgcggcgccaggggcccgggggtccgggtgggcgcagtccccggccccgtcgccgccgggctcgctgccgctgggcgcctccattctagcgcggccgcgcggcgccggctccttccgtcgcgccgagcggcaactcaggcgtccaggcgccccatcccggacggggcgcgccggcgggccgggctcagcggcgggccgggctcccggcgcggcgggcgggactgggggccgggcggctgggccgggggcggaggcagcgcgcgggggccgggcgaggggcgggagggggcggccctcggggctcccagacggctggccccccgcccccgcgccagggaccgtctgccaagtgccacgccgcgctcggccgcagaggcgctctgcgcgtgcacggggcccctggggacgcggcgcggcgctcggcgcctccgtcggaagctcgggggtcgggcgggagcctccggaagggccccgcggagccgggagtccgaggccgcgcgcacgccgaaccgagcgtaccaactccgcgcccggacgcgtggcgcccccccaacccgcagtcaccgcgggctacgccactcccacccggcacacgcgacacccgccgcgcgcaggctcctgcttgcaggtccggccgctgctcgggccaagtaaacaccgggctgggaaagctcgctgcggagccgctcgggggcaagccagccccgccacgcgcgcctccgcggccccgggaagtcaggggcgaccgctgcctgggcagtgacggcccctctctgggcagtgacggcccctcccgggaacgccgggccctcgcggtgccctcggtgctaccacgaccttgggaaggaacatgcgtggcgcgcgctcgctctcacttttctctttcccgtttcctttcccat

SEQ ID NO: 119687 - DNA, 30 bp, Homo sapiens; identical to SEQ ID NO: 87730
  misc_feature 1..30: note = chr20:47830069-47830099
  misc_feature 1..30: note = Hypo
  source 1..30: mol_type = genomic DNA

SEQ ID NO: 119688 - DNA, 204 bp, Homo sapiens; identical to SEQ ID NO: 87731
  misc_feature 1..204: note = chr20:47837002-47837206
  misc_feature 1..204: note = Hypo
  source 1..204: mol_type = genomic DNA

SEQ ID NO: 119689 - DNA, 253 bp, Homo sapiens; identical to SEQ ID NO: 46200
  misc_feature 1..253: note = chr20:47905350-47905603
  misc_feature 1..253: note = Hypo
  source 1..253: mol_type = genomic DNA

SEQ ID NO: 119690 - DNA, 1248 bp, Homo sapiens
  misc_feature 1..1248: note = chr20:47934824-47936072
  misc_feature 1..1248: note = Hyper
  source 1..1248: mol_type = genomic DNA
cacaagatctgtctccgttggcgtcccggtacctagcttgagcccgaccatgggcatgcgtggcgtggcgcgaatcctgtccctgtcgctcgtcctggccgcggtggccacgggggcctgggagcgggggccgctgggcgtgctcttgccctggcagggctccgccgcgctgggccgctgctgtcctggccgtgacccgatgtttgtcgcccgcgggcccccgcgctgcttctgcgaccaagcgtgcggcgcggcgcggcgcgggactgctgcgcagactatacgcgggtctgcccaggtgcacccggggaaaggcaaggcactagcggaacgctcggagcggaggggagctggggcgggggatgagcggaggaagggagcccagcacctagggggctctgggcttggaggggtcacacgagccgagggcggggcgcggcgcttggggactggaagggtgcgccgcggggcagacgggacgtgcagggggtcgcgcgggcaaggagggacgcagacactcaggacctaaaggggaagcactggctgtggagctgcgagccgagaaagacgcgcaggttatgaacctgggtgcgttcatctcgggggacctgaaggagagggactcgtggagagttgaggggtgtttcggaggaggggcgcaaggactgctcacaggacttgaagggcggcaggaaggtggaggattcggcccaggtgcgggacgcaggcggtggaagggaaatgagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggggttgcaagcttctttcgggcggaggggtcacaaggcgaatggagaaggtgacaaggagcatggagaaaccaagaaaagggctaacgcttggagagcaaggatggaaagacgctcaaagcggaggcggaacggtctgagtgattc

SEQ ID NO: 119691 - DNA, 30 bp, Homo sapiens; identical to SEQ ID NO: 87735
  misc_feature 1..30: note = chr20:47949637-47949667
  misc_feature 1..30: note = Hypo
  source 1..30: mol_type = genomic DNA

SEQ ID NO: 119692 - DNA, 34 bp, Homo sapiens; identical to SEQ ID NO: 87736
  misc_feature 1..34: note = chr20:48001223-48001257
  misc_feature 1..34: note = Hyper
  source 1..34: mol_type = genomic DNA

SEQ ID NO: 119693 - DNA, 449 bp, Homo sapiens
  misc_feature 1..449: note = chr20:48099124-48099573
  misc_feature 1..449: note = Hyper
  source 1..449: mol_type = genomic DNA
gggtgcagggggccccgcgggcgcgcgtcacggccgtcttctcacctccatcccgacggctgcgaggcagaaagcgaaagcggacgcgggtcagcaaacggggagctgggcatgctgtccccccgccccccacctctccaccaggctcccagccggccttgaccttcccccgcgcttaagcggctcagtggggtaggacggatggtcgctgtccctcccgccggtgctgaagtccgccgcaccccatggatggagggaggggccgcccctcggggcggggagagggccccaagagatgcccctggagcccgggaggccccaccctgggcttctgcggcccaggcgcgacccagccgcccggggcgctgtccgccccttagagtgctgaaactctcttcattatgggtctcccgatcgagtcccgaacctggccccgccatggggagaga

SEQ ID NO: 119694 - DNA, 30 bp, Homo sapiens; identical to SEQ ID NO: 87740
  misc_feature 1..30: note = chr20:48099861-48099891
  misc_feature 1..30: note = Hyper
  source 1..30: mol_type = genomic DNA

SEQ ID NO: 119695 - DNA, 335 bp, Homo sapiens; identical to SEQ ID NO: 87741
  misc_feature 1..335: note = chr20:48100170-48100505
  misc_feature 1..335: note = Hyper
  source 1..335: mol_type = genomic DNA

SEQ ID NO: 119696 - DNA, 440 bp, Homo sapiens
  misc_feature 1..440: note = chr20:48184239-48184679
  misc_feature 1..440: note = Hyper
  source 1..440: mol_type = genomic DNA
ccacccacaaaccctcggtcctcacctgaaaccccctcctaggtccctgccgtcgcgctaagggccagactcggacttgtcgcggtgggcgattcgccccgggggacctaccggaccccgcaccttcccaccttgcaccttcttggcagggggagcacggcctggccccctcacccacgtgcggggccccgggactcccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcgcggggctggcggggctggcggggc

SEQ ID NO: 119697 - DNA, 86 bp, Homo sapiens; identical to SEQ ID NO: 87744
  misc_feature 1..86: note = chr20:48252895-48252981
  misc_feature 1..86: note = Hypo
  source 1..86: mol_type = genomic DNA

SEQ ID NO: 119698 - DNA, 30 bp, Homo sapiens; identical to SEQ ID NO: 87745
  misc_feature 1..30: note = chr20:48403614-48403644
  misc_feature 1..30: note = Hypo
  source 1..30: mol_type = genomic DNA

SEQ ID NO: 119699 - DNA, 30 bp, Homo sapiens; identical to SEQ ID NO: 16604
  misc_feature 1..30: note = chr20:48477511-48477541
  misc_feature 1..30: note = Hypo
  source 1..30: mol_type = genomic DNA

SEQ ID NO: 119700 - DNA, 30 bp, Homo sapiens; identical to SEQ ID NO: 87747
  misc_feature 1..30: note = chr20:48517671-48517701
  misc_feature 1..30: note = Hypo
  source 1..30: mol_type = genomic DNA

SEQ ID NO: 119701 - DNA, 54 bp, Homo sapiens; identical to SEQ ID NO: 87748
  misc_feature 1..54: note = chr20:48524764-48524818
  misc_feature 1..54: note = Hypo
  source 1..54: mol_type = genomic DNA

SEQ ID NO: 119702 - DNA, 88 bp, Homo sapiens; identical to SEQ ID NO: 46203
  misc_feature 1..88: note = chr20:48673896-48673984
  misc_feature 1..88: note = Hypo
  source 1..88: mol_type = genomic DNA

SEQ ID NO: 119703 - DNA, 78 bp, Homo sapiens; identical to SEQ ID NO: 87750
  misc_feature 1..78: note = chr20:48695412-48695490
  misc_feature 1..78: note = Hypo
  source 1..78: mol_type = genomic DNA

SEQ ID NO: 119704 - DNA, 82 bp, Homo sapiens; identical to SEQ ID NO: 87751
  misc_feature 1..82: note = chr20:48720255-48720337
  misc_feature 1..82: note = Hypo
  source 1..82: mol_type = genomic DNA

SEQ ID NO: 119705 - DNA, 21 bp, Homo sapiens
  misc_feature 1..21: note = chr20:48720805-48720826
  misc_feature 1..21: note = Hypo
  source 1..21: mol_type = genomic DNA
agactccgtctcaaaaaaaaa

SEQ ID NO: 119706 - DNA, 154 bp, Homo sapiens; identical to SEQ ID NO: 46205
  misc_feature 1..154: note = chr20:48767027-48767181
  misc_feature 1..154: note = Hypo
  source 1..154: mol_type = genomic DNA

SEQ ID NO: 119707 - DNA, 30 bp, Homo sapiens; identical to SEQ ID NO: 87754
  misc_feature 1..30: note = chr20:48768053-48768083
  misc_feature 1..30: note = Hypo
  source 1..30: mol_type = genomic DNA

SEQ ID NO: 119708 - DNA, 25 bp, Homo sapiens
  misc_feature 1..25: note = chr20:48771341-48771366
  misc_feature 1..25: note = Hypo
  source 1..25: mol_type = genomic DNA
ttccatacaggcagccgggcgcggt

SEQ ID NO: 119709 - DNA, 281 bp, Homo sapiens; identical to SEQ ID NO: 87756
  misc_feature 1..281: note = chr20:48788892-48789173
  misc_feature 1..281: note = Hyper
  source 1..281: mol_type = genomic DNA

SEQ ID NO: 119710 - DNA, 246 bp, Homo sapiens; identical to SEQ ID NO: 87757
  misc_feature 1..246: note = chr20:48863456-48863702
  misc_feature 1..246: note = Hypo
  source 1..246: mol_type = genomic DNA

SEQ ID NO: 119711 - DNA, 30 bp, Homo sapiens; identical to SEQ ID NO: 87758
  misc_feature 1..30: note = chr20:48971286-48971316
  misc_feature 1..30: note = Hypo
  source 1..30: mol_type = genomic DNA

SEQ ID NO: 119712 - DNA, 155 bp, Homo sapiens; identical to SEQ ID NO: 87759
  misc_feature 1..155: note = chr20:49047009-49047164
  misc_feature 1..155: note = Hypo
  source 1..155: mol_type = genomic DNA

SEQ ID NO: 119713 - DNA, 251 bp, Homo sapiens; identical to SEQ ID NO: 87760
  misc_feature 1..251: note = chr20:49194287-49194538
  misc_feature 1..251: note = Hypo
  source 1..251: mol_type = genomic DNA

SEQ ID NO: 119714 - DNA, 146 bp, Homo sapiens; identical to SEQ ID NO: 87761
  misc_feature 1..146: note = chr20:49200439-49200585
  misc_feature 1..146: note = Hypo
  source 1..146: mol_type = genomic DNA

SEQ ID NO: 119715 - DNA, 42 bp, Homo sapiens; identical to SEQ ID NO: 87762
  misc_feature 1..42: note = chr20:49203345-49203387
  misc_feature 1..42: note = Hypo
  source 1..42: mol_type = genomic DNA

SEQ ID NO: 119716 - DNA, 30 bp, Homo sapiens; identical to SEQ ID NO: 87763
  misc_feature 1..30: note = chr20:49203615-49203645
  misc_feature 1..30: note = Hypo
  source 1..30: mol_type = genomic DNA

SEQ ID NO: 119717 - DNA, 270 bp, Homo sapiens; identical to SEQ ID NO: 46211
  misc_feature 1..270: note = chr20:49204179-49204449
  misc_feature 1..270: note = Hypo
  source 1..270: mol_type = genomic DNA

SEQ ID NO: 119718 - DNA, 30 bp, Homo sapiens; identical to SEQ ID NO: 87765
  misc_feature 1..30: note = chr20:49210458-49210488
  misc_feature 1..30: note = Hypo
  source 1..30: mol_type = genomic DNA

SEQ ID NO: 119719 - DNA, 328 bp, Homo sapiens; identical to SEQ ID NO: 87766
  misc_feature 1..328: note = chr20:49218480-49218808
  misc_feature 1..328: note = Hypo
  source 1..328: mol_type = genomic DNA

SEQ ID NO: 119720 - DNA, 32 bp, Homo sapiens; identical to SEQ ID NO: 87767
  misc_feature 1..32: note = chr20:49250792-49250824
  misc_feature 1..32: note = Hypo
  source 1..32: mol_type = genomic DNA

SEQ ID NO: 119721 - DNA, 406 bp, Homo sapiens; identical to SEQ ID NO: 87768
  misc_feature 1..406: note = chr20:49261761-49262167
  misc_feature 1..406: note = Hypo
  source 1..406: mol_type = genomic DNA

SEQ ID NO: 119722 - DNA, 152 bp, Homo sapiens; identical to SEQ ID NO: 87769
  misc_feature 1..152: note = chr20:49286742-49286894
  misc_feature 1..152: note = Hypo
  source 1..152: mol_type = genomic DNA

SEQ ID NO: 119723 - DNA, 20 bp, Homo sapiens
  misc_feature 1..20: note = chr20:49323846-49323866
  misc_feature 1..20: note = Hypo
  source 1..20: mol_type = genomic DNA
gggcaaggtggctcacgcct

SEQ ID NO: 119724 - DNA, 19 bp, Homo sapiens
  misc_feature 1..19: note = chr20:49324106-49324125
  misc_feature 1..19: note = Hypo
  source 1..19: mol_type = genomic DNA
agagcgagactccaccaaa

SEQ ID NO: 119725 - DNA, 56 bp, Homo sapiens; identical to SEQ ID NO: 46218
  misc_feature 1..56: note = chr20:49345671-49345727
  misc_feature 1..56: note = Hypo
  source 1..56: mol_type = genomic DNA

SEQ ID NO: 119726 - DNA, 339 bp, Homo sapiens; identical to SEQ ID NO: 87773
  misc_feature 1..339: note = chr20:49346420-49346759
  misc_feature 1..339: note = Hypo
  source 1..339: mol_type = genomic DNA

SEQ ID NO: 119727 - DNA, 26 bp, Homo sapiens
  misc_feature 1..26: note = chr20:49350870-49350896
  misc_feature 1..26: note = Hypo
  source 1..26: mol_type = genomic DNA
aactaggtagtgtgccggtccttttt

SEQ ID NO: 119728 - DNA, 95 bp, Homo sapiens; identical to SEQ ID NO: 87775
  misc_feature 1..95: note = chr20:49358027-49358122
  misc_feature 1..95: note = Hypo
  source 1..95: mol_type = genomic DNA

SEQ ID NO: 119729 - DNA, 34 bp, Homo sapiens; identical to SEQ ID NO: 87776
  misc_feature 1..34: note = chr20:49358362-49358396
  misc_feature 1..34: note = Hypo
  source 1..34: mol_type = genomic DNA

SEQ ID NO: 119730 - DNA, 17 bp, Homo sapiens
  misc_feature 1..17: note = chr20:49364856-49364873
  misc_feature 1..17: note = Hypo
  source 1..17: mol_type = genomic DNA
gacgacagagcgagact

SEQ ID NO: 119731 - DNA, 160 bp, Homo sapiens; identical to SEQ ID NO: 87778
  misc_feature 1..160: note = chr20:49377911-49378071
  misc_feature 1..160: note = Hypo
  source 1..160: mol_type = genomic DNA

SEQ ID NO: 119732 - DNA, 204 bp, Homo sapiens; identical to SEQ ID NO: 87779
  misc_feature 1..204: note = chr20:49380667-49380871
  misc_feature 1..204: note = Hypo
  source 1..204: mol_type = genomic DNA

SEQ ID NO: 119733 - DNA, 90 bp, Homo sapiens; identical to SEQ ID NO: 87780
  misc_feature 1..90: note = chr20:49381176-49381266
  misc_feature 1..90: note = Hypo
  source 1..90: mol_type = genomic DNA

SEQ ID NO: 119734 - DNA, 30 bp, Homo sapiens; identical to SEQ ID NO: 87781
  misc_feature 1..30: note = chr20:49411040-49411070
  misc_feature 1..30: note = Hyper
  source 1..30: mol_type = genomic DNA

SEQ ID NO: 119735 - DNA, 129 bp, Homo sapiens; identical to SEQ ID NO: 38174
  misc_feature 1..129: note = chr20:49435030-49435159
  misc_feature 1..129: note = Hyper
  source 1..129: mol_type = genomic DNA

SEQ ID NO: 119736 - DNA, 30 bp, Homo sapiens; identical to SEQ ID NO: 46224
  misc_feature 1..30: note = chr20:49502935-49502965
  misc_feature 1..30: note = Hypo
  source 1..30: mol_type = genomic DNA

SEQ ID NO: 119737 - DNA, 75 bp, Homo sapiens; identical to SEQ ID NO: 87784
  misc_feature 1..75: note = chr20:49548179-49548254
  misc_feature 1..75: note = Hyper
  source 1..75: mol_type = genomic DNA

SEQ ID NO: 119738 - DNA, 116 bp, Homo sapiens; identical to SEQ ID NO: 87785
  misc_feature 1..116: note = chr20:49548468-49548584
  misc_feature 1..116: note = Hyper
  source 1..116: mol_type = genomic DNA

SEQ ID NO: 119739 - DNA, 32 bp, Homo sapiens; identical to SEQ ID NO: 87786
  misc_feature 1..32: note = chr20:49572072-49572104
  misc_feature 1..32: note = Hypo
  source 1..32: mol_type = genomic DNA

SEQ ID NO: 119740 - DNA, 43 bp, Homo sapiens; identical to SEQ ID NO: 87787
  misc_feature 1..43: note = chr20:49572791-49572834
  misc_feature 1..43: note = Hypo
  source 1..43: mol_type = genomic DNA

SEQ ID NO: 119741 - DNA, 109 bp, Homo sapiens; identical to SEQ ID NO: 87788
  misc_feature 1..109: note = chr20:49575733-49575842
  misc_feature 1..109: note = Hyper
  source 1..109: mol_type = genomic DNA

SEQ ID NO: 119742 - DNA, 42 bp, Homo sapiens; identical to SEQ ID NO: 87789
  misc_feature 1..42: note = chr20:49576086-49576128
  misc_feature 1..42: note = Hyper
  source 1..42: mol_type = genomic DNA

SEQ ID NO: 119743 - DNA, 186 bp, Homo sapiens; identical to SEQ ID NO: 87790
  misc_feature 1..186: note = chr20:49598367-49598553
  misc_feature 1..186: note = Hypo
  source 1..186: mol_type = genomic DNA

SEQ ID NO: 119744 - DNA, 1300 bp, Homo sapiens
  misc_feature 1..1300: note = chr20:49638951-49640251
  misc_feature 1..1300: note = Hyper
  source 1..1300: mol_type = genomic DNA
actcaatcaggcccacggtgggggtgaaggggggctccatactgtgcctaaggatacagtgaatgagcaagtgacacacactcccccaccccaatccctaactctccttcctcccaggatcgggggagaaacctcggcccacagccgggatgcgcccccgccggggtcaccgcggcggcgaacgtcccggacttcgcatcccggtgaccccttgggatgaaccgaagccggacccgcaccttggccgtaacaagcgcgctccacgccgccacgcaccagcggtgactcccgagtcctctgtcgccctggcctccccgcaggcgggtttcgaggcccccgcagggagttcagggccacggccacgtgcagccgcccccgagcccgagtttgcaggctcggggtccggttcgcgctttggtggcgcccggcgaggctgcagcgcgcaaagttcccacctcaagttcccgtcgcggcgtccccgcctcggagttggcccggccgcggcttccgttccccccggctgcccacgggtccggggcgaggacgcgagaggggcctggaagtcgcccggggagcccgctctgcctcccggagccgccgccaaacttcggtcccggggcccggctcagctcccgccctcggagccacggccgccccgtctctgcctcccggtccccgccgggctccgagtgcgccgggagcgcggcgcagcagccgccgagggagggagcgaggcaggaggcgggacggagggaggggactgagcgcggggcggggagaaggggcgggcagccgaaagcgcagcgcctggcctcgcctcgcttcgggacagtggcagcggcgccaccgtcacggggcgtccaggcgcccaatcgggaccccgcaccttggatccgggggccctggcgcgcctgctggattgcgctcctcgcggccagttcctgagcccgcgtccgggactgctcgcgctacgccctccctcccgttgccttcttccccgtctgctctcccaggagcgaccaccctgcggccccttcgcctgcacgcgacagccttcaaggtccccgcgctccgctgccctggagcttcacgcaccaggcggcgcggcagcctcctagggtcgcgcgccctgtcagctttccccgcggtgcaagtgctccggtggtcccgggtccgcgcccctagcagcaccgccccagggtctacatgtgctagatattaaaaccccactctccgctgccccggggccgcgctccacgcgcttacacatcctgggaaccacatgcgccatgtctcctgc

SEQ ID NO: 119745 - DNA, 172 bp, Homo sapiens; identical to SEQ ID NO: 87796
  misc_feature 1..172: note = chr20:49708478-49708650
  misc_feature 1..172: note = Hyper
  source 1..172: mol_type = genomic DNA

SEQ ID NO: 119746 - DNA, 51 bp, Homo sapiens; identical to SEQ ID NO: 87797
  misc_feature 1..51: note = chr20:49742709-49742760
  misc_feature 1..51: note = Hypo
  source 1..51: mol_type = genomic DNA

SEQ ID NO: 119747 - DNA, 30 bp, Homo sapiens; identical to SEQ ID NO: 87798
  misc_feature 1..30: note = chr20:49778368-49778398
  misc_feature 1..30: note = Hypo
  source 1..30: mol_type = genomic DNA

SEQ ID NO: 119748 - DNA, 132 bp, Homo sapiens; identical to SEQ ID NO: 87800
  misc_feature 1..132: note = chr20:49836904-49837036
  misc_feature 1..132: note = Hyper
  source 1..132: mol_type = genomic DNA

SEQ ID NO: 119749 - DNA, 30 bp, Homo sapiens; identical to SEQ ID NO: 87801
  misc_feature 1..30: note = chr20:49948303-49948333
  misc_feature 1..30: note = Hypo
  source 1..30: mol_type = genomic DNA

SEQ ID NO: 119750 - DNA, 30 bp, Homo sapiens; identical to SEQ ID NO: 87802
  misc_feature 1..30: note = chr20:49999712-49999742
  misc_feature 1..30: note = Hypo
  source 1..30: mol_type = genomic DNA

SEQ ID NO: 119751 - DNA, 97 bp, Homo sapiens; identical to SEQ ID NO: 87803
  misc_feature 1..97: note = chr20:50052184-50052281
  misc_feature 1..97: note = Hypo
  source 1..97: mol_type = genomic DNA

SEQ ID NO: 119752 - DNA, 31 bp, Homo sapiens; identical to SEQ ID NO: 87804
  misc_feature 1..31: note = chr20:50116003-50116034
  misc_feature 1..31: note = Hypo
  source 1..31: mol_type = genomic DNA

SEQ ID NO: 119753 - DNA, 376 bp, Homo sapiens; identical to SEQ ID NO: 87805
  misc_feature 1..376: note = chr20:50157663-50158039
  misc_feature 1..376: note = Hyper
  source 1..376: mol_type = genomic DNA

SEQ ID NO: 119754 - DNA, 65 bp, Homo sapiens; identical to SEQ ID NO: 38186
  misc_feature 1..65: note = chr20:50158354-50158419
  misc_feature 1..65: note = Hyper
  source 1..65: mol_type = genomic DNA

SEQ ID NO: 119755 - DNA, 182 bp, Homo sapiens; identical to SEQ ID NO: 87807
  misc_feature 1..182: note = chr20:50178954-50179136
  misc_feature 1..182: note = Hyper
  source 1..182: mol_type = genomic DNA

SEQ ID NO: 119756 - DNA, 30 bp, Homo sapiens; identical to SEQ ID NO: 87808
  misc_feature 1..30: note = chr20:50184172-50184202
  misc_feature 1..30: note = Hypo
  source 1..30: mol_type = genomic DNA

SEQ ID NO: 119757 - DNA, 30 bp, Homo sapiens; identical to SEQ ID NO: 87810
  misc_feature 1..30: note = chr20:50378432-50378462
  misc_feature 1..30: note = Hypo
  source 1..30: mol_type = genomic DNA

SEQ ID NO: 119758 - DNA, 25 bp, Homo sapiens
  misc_feature 1..25: note = chr20:50383398-50383423
  misc_feature 1..25: note = Hypo
  source 1..25: mol_type = genomic DNA
taataataaacgcaaaacagagaag

SEQ ID NO: 119759 - DNA, 155 bp, Homo sapiens; identical to SEQ ID NO: 87812
  misc_feature 1..155: note = chr20:50384245-50384400
  misc_feature 1..155: note = Hyper
  source 1..155: mol_type = genomic DNA

SEQ ID NO: 119760 - DNA, 279 bp, Homo sapiens; identical to SEQ ID NO: 87813
  misc_feature 1..279: note = chr20:50384649-50384928
  misc_feature 1..279: note = Hyper
  source 1..279: mol_type = genomic DNA

SEQ ID NO: 119761 - DNA, 59 bp, Homo sapiens; identical to SEQ ID NO: 87814
  misc_feature 1..59: note = chr20:50385171-50385230
  misc_feature 1..59: note = Hyper
  source 1..59: mol_type = genomic DNA

SEQ ID NO: 119762 - DNA, 767 bp, Homo sapiens; identical to SEQ ID NO: 87815
  misc_feature 1..767: note = chr20:50417309-50418076
  misc_feature 1..767: note = Hyper
  source 1..767: mol_type = genomic DNA

SEQ ID NO: 119763 - DNA, 156 bp, Homo sapiens; identical to SEQ ID NO: 87816
  misc_feature 1..156: note = chr20:50419232-50419388
  misc_feature 1..156: note = Hypo
  source 1..156: mol_type = genomic DNA

SEQ ID NO: 119764 - DNA, 19 bp, Homo sapiens
  misc_feature 1..19: note = chr20:50470085-50470104
  misc_feature 1..19: note = Hypo
  source 1..19: mol_type = genomic DNA
tttgagacagggtctcgct

SEQ ID NO: 119765 - DNA, 30 bp, Homo sapiens; identical to SEQ ID NO: 87818
  misc_feature 1..30: note = chr20:50583692-50583722
  misc_feature 1..30: note = Hypo
  source 1..30: mol_type = genomic DNA

SEQ ID NO: 119766 - DNA, 27 bp, Homo sapiens
  misc_feature 1..27: note = chr20:50602104-50602131
  misc_feature 1..27: note = Hypo
  source 1..27: mol_type = genomic DNA
tttgagatggagtctcgctctgtcgcc

SEQ ID NO: 119767 - DNA, 1661 bp, Homo sapiens
  misc_feature 1..1661: note = chr20:50720360-50722021
  misc_feature 1..1661: note = Hyper
  source 1..1661: mol_type = genomic DNA
tatggtagctccactcgagcaagctttattttaacatataagctattcgtttagtggaggcttcattaaactactcccctccaccaccacctcgggaagttgtggtcaaaacccaccagaccgactgtggtggaagttgatgcggaagctggagagcccgcggctctggaggggtgagccgccccggagaggggacccatcctcctttccgcgcccggaaagagcgggggagaagaggaagtccagttacaactcctttcctcagccccttaaaggaaaggtatcagctaaccacggggagctggcagcctaagagaaagtaggaacctacaatctcttaatctaagcacaagataagcaaaaagggaagcgccttagaaatgcagattccccaaccccacccctgagattccagtggaggcgggggatggggggatccctaacttgcaggaagaatttggcgagcgagaaaaggtcccctcccgcaggctcttctgaagcggaggatcccgggacgagaaatgctgcccggggggcttaaggtagccgacgatctccttgctacatcctgtgtccacgtggcagccgaggagggggtgtgggggccgcctgttaagtgcgacagcatcactgctctatccccaccacggctcccacttcgctcagataaaatgcagagctcttaccaaggctcacggccgtcccccgccccccaccgtctgcccccatcacctctcgggcctccggtgacctctcgggctacagcagcgctgacgccctgggtccctgcgcttctgttccctcggcctggaatgctcttcccccgggtacctgcacagctcgctccctcccatccttcgggtcttcgctcgaacgtccgctcctcggtgaggccttccctggacaacgcatttgaaacgtaaccccaaggcaagaagccaccttccaggcgcgcagccgaagcccagtgccaaggaggccggagactcgggtgcccgcgcatcccgaaaacagcctctgaggggtcctctgagcatccttccagcgtgtttgggaggcaaactcgttgactagctcttgagaggagtggctagaggaatccaggcggggaaggggacggtggactccaggagagtgtaatttacaaaggcggggggcggggacgcccaggtccgagtcccaggactctgcgccggacgcttcgcccgccctttcaggtcccctgcccggtcctcgtacccgcgcgggtccggagaacctctgagcaccggcccccagcccccgggcggggctccagcggcgctactcacccggctcccccgccacctgcggggccacctccgcacactcccggcgcgcaggccgcggctcctcggagttgaggtgctggggcttggcctgcttgcgccgcgacatggcgcgaggaccgggctccccgcgcgtccctaggagtggcctacttcacacaacgaattcccggagttcggaaattaccccccttcggccggaacgcgcatgtcccggcaattctgctcatcagccgagcagggcgatttatcaagagtcctgacggctgattggcctggagccaagaccccaggagtcccgcggacttgcggtccgctcccgggcagcccgcgccacctgggagctcgttagaa

SEQ ID NO: 119768 - DNA, 120 bp, Homo sapiens; identical to SEQ ID NO: 87823
  misc_feature 1..120: note = chr20:50722081-50722201
  misc_feature 1..120: note = Hyper
  source 1..120: mol_type = genomic DNA

SEQ ID NO: 119769 - DNA, 41 bp, Homo sapiens; identical to SEQ ID NO: 87824
  misc_feature 1..41: note = chr20:50722261-50722302
  misc_feature 1..41: note = Hyper
  source 1..41: mol_type = genomic DNA

SEQ ID NO: 119770 - DNA, 126 bp, Homo sapiens; identical to SEQ ID NO: 87825
  misc_feature 1..126: note = chr20:50722695-50722821
  misc_feature 1..126: note = Hyper
  source 1..126: mol_type = genomic DNA

SEQ ID NO: 119771 - DNA, 30 bp, Homo sapiens; identical to SEQ ID NO: 87826
  misc_feature 1..30: note = chr20:50723185-50723215
  misc_feature 1..30: note = Hypo
  source 1..30: mol_type = genomic DNA

SEQ ID NO: 119772 - DNA, 216 bp, Homo sapiens; identical to SEQ ID NO: 87827
  misc_feature 1..216: note = chr20:51589786-51590002
  misc_feature 1..216: note = Hyper
  source 1..216: mol_type = genomic DNA

SEQ ID NO: 119773 - DNA, 30 bp, Homo sapiens; identical to SEQ ID NO: 87828
  misc_feature 1..30: note = chr20:51796493-51796523
  misc_feature 1..30: note = Hypo
  source 1..30: mol_type = genomic DNA

SEQ ID NO: 119774 - DNA, 30 bp, Homo sapiens; identical to SEQ ID NO: 87830
  misc_feature 1..30: note = chr20:52130263-52130293
  misc_feature 1..30: note = Hypo
  source 1..30: mol_type = genomic DNA

SEQ ID NO: 119775 - DNA, 120 bp, Homo sapiens; identical to SEQ ID NO: 87831
  misc_feature 1..120: note = chr20:52275843-52275963
  misc_feature 1..120: note = Hypo
  source 1..120: mol_type = genomic DNA

SEQ ID NO: 119776 - DNA, 38 bp, Homo sapiens; identical to SEQ ID NO: 87832
  misc_feature 1..38: note = chr20:52285632-52285670
  misc_feature 1..38: note = Hypo
  source 1..38: mol_type = genomic DNA

SEQ ID NO: 119777 - DNA, 42 bp, Homo sapiens; identical to SEQ ID NO: 87833
  misc_feature 1..42: note = chr20:52311463-52311505
  misc_feature 1..42: note = Hypo
  source 1..42: mol_type = genomic DNA

SEQ ID NO: 119778 - DNA, 132 bp, Homo sapiens; identical to SEQ ID NO: 87834
  misc_feature 1..132: note = chr20:52341618-52341750
  misc_feature 1..132: note = Hypo
  source 1..132: mol_type = genomic DNA

SEQ ID NO: 119779 - DNA, 209 bp, Homo sapiens; identical to SEQ ID NO: 87835
  misc_feature 1..209: note = chr20:52385841-52386050
  misc_feature 1..209: note = Hypo
  source 1..209: mol_type = genomic DNA

SEQ ID NO: 119780 - DNA, 30 bp, Homo sapiens; identical to SEQ ID NO: 87836
  misc_feature 1..30: note = chr20:52403888-52403918
  misc_feature 1..30: note = Hypo
  source 1..30: mol_type = genomic DNA

SEQ ID NO: 119781 - DNA, 30 bp, Homo sapiens; identical to SEQ ID NO: 46227
  misc_feature 1..30: note = chr20:52484713-52484743
  misc_feature 1..30: note = Hypo
  source 1..30: mol_type = genomic DNA

SEQ ID NO: 119782 - DNA, 29 bp, Homo sapiens
  misc_feature 1..29: note = chr20:52693116-52693145
  misc_feature 1..29: note = Hypo
  source 1..29: mol_type = genomic DNA
agagagattaattttcgtcaccactattg

SEQ ID NO: 119783 - DNA, 89 bp, Homo sapiens; identical to SEQ ID NO: 87840
  misc_feature 1..89: note = chr20:52693385-52693474
  misc_feature 1..89: note = Hypo
  source 1..89: mol_type = genomic DNA

SEQ ID NO: 119784 - DNA, 30 bp, Homo sapiens; identical to SEQ ID NO: 46230
  misc_feature 1..30: note = chr20:52773951-52773981
  misc_feature 1..30: note = Hypo
  source 1..30: mol_type = genomic DNA

SEQ ID NO: 119785 - DNA, 809 bp, Homo sapiens
  misc_feature 1..809: note = chr20:52789401-52790210
  misc_feature 1..809: note = Hyper
  source 1..809: mol_type = genomic DNA
ctcatcaggtctggccgcatgcccaggtccctcggattggactcacaggatcagcagcccgtagccttctttgcggtagtcgcgataggccttccacggtttgatctccagccgctgcgggtacgcgctctcggtgcggtacagcgcttccagcaggcatggcgagcccaggtgcaccgactcaaaggaacccaacttcatgcggaaaatcttgccatacttcttgtggtactccacctgcagccggccgggcacagcgcggtgtcagcgcgcatcctccgccgtgcccgaagcgctttccctcctcccgcctccttcctcctaggggaccggggaccctccctgcccagacgccgaagcgcaccatgcgcccgaggcgcgcatgtcggggagggtttggagcgccactgggagggcggaagagggaggagagagtcaggggcgcgaaaaggggtttaccagggtgtcgtgctgtttcttgagaccccctttccagagaatctgcagcaggctgcccagcagtggccagctggtggggcccggcagggcggccgcgttctgagtctcgccaccagctgtcagcgggcagactggcacctctcgcggctgaggggacgtgtacgccgtagatgtcaccagtctcgggggctgcctcggactgcgcagctgctgcaggaaggcggcaagcgagcggctcttgctgatgggggagctcatggcagcgggggacaccggagcgcgggaaggcaggaggatggggtggggcgaggttggtacgaggtgctagtgggagtcggggcttaacgatt

SEQ ID NO: 119786 - DNA, 89 bp, Homo sapiens; identical to SEQ ID NO: 87844
  misc_feature 1..89: note = chr20:52790612-52790701
  misc_feature 1..89: note = Hyper
  source 1..89: mol_type = genomic DNA

SEQ ID NO: 119787 - DNA, 30 bp, Homo sapiens; identical to SEQ ID NO: 87845
  misc_feature 1..30: note = chr20:52824090-52824120
  misc_feature 1..30: note = Hypo
  source 1..30: mol_type = genomic DNA

SEQ ID NO: 119788 - DNA, 209 bp, Homo sapiens; identical to SEQ ID NO: 87846
  misc_feature 1..209: note = chr20:52867313-52867522
  misc_feature 1..209: note = Hypo
  source 1..209: mol_type = genomic DNA

SEQ ID NO: 119789 - DNA, 79 bp, Homo sapiens; identical to SEQ ID NO: 46232
  misc_feature 1..79: note = chr20:53051998-53052077
  misc_feature 1..79: note = Hypo
  source 1..79: mol_type = genomic DNA

SEQ ID NO: 119790 - DNA, 329 bp, Homo sapiens; identical to SEQ ID NO: 38199
  misc_feature 1..329: note = chr20:53091752-53092081
  misc_feature 1..329: note = Hyper
  source 1..329: mol_type = genomic DNA

SEQ ID NO: 119791 - DNA, 1108 bp, Homo sapiens
  misc_feature 1..1108: note = chr20:53092141-53093249
  misc_feature 1..1108: note = Hyper
  source 1..1108: mol_type = genomic DNA
tccttctcggccgggaggaggcagggctggatccctcagccgccgccgctcctcctcctggcaggccggccgcggagtcagctgacgccggcgctccagcctcgcctccccgcgccgcgctctgcgctccccgaaagtggctgcaagccggccgcccactgtcagggttggggggacagagaaagtgatgtgcgccttctaaagcctcgcccagcgccgccgaagcagcttcacctctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatccggagcagacgcctcggggtgagtatcgatcctctccgtgttgctgttcgccggttcgattgtctctctcttgagccagcatccctggagggtggacggagagtccccggccgcgcgccggagaattgcgcggtggctttctcagccgaaacccgcgtctccggggctgtcactgtaaggccagcgtctaggtatgtaatggatctatctttatctcttggatgacttggctttctgatggtggccgcgtgttgggcttcagtagcccctggagcccatctactcgaaataaatatttctcggtagccatggaagttggagctgagaagcccgggcgggggtgcctgccggatgcccccggttcccctcttttcccactcgccgccaacttaacttttccgggggatggatcggctggttgagaaagaggacacgcatactcggtgtgaacgaggtcacgaaccctctgaccccagggagagatttctgccaagcgtaaggtgtctttggatccccccacctctgtcccaggtgtcgtgtcaaaggcggtgcgggctggcctctggtcggggccaacttgggtagatacttgaatctggattttccgtggttcgaagccggggtggtggatttctgttgctggaatacaccctggaggtccacggaagggttatttacgtggaacctgatacctggcatagcgcaagtgctcccta

SEQ ID NO: 119792 - DNA, 159 bp, Homo sapiens; identical to SEQ ID NO: 87857
  misc_feature 1..159: note = chr20:53122859-53123018
  misc_feature 1..159: note = Hypo
  source 1..159: mol_type = genomic DNA

SEQ ID NO: 119793 - DNA, 24 bp, Homo sapiens
  misc_feature 1..24: note = chr20:53209356-53209380
  misc_feature 1..24: note = Hypo
  source 1..24: mol_type = genomic DNA
caccacgcccggccagataaattt

SEQ ID NO: 119794 - DNA, 30 bp, Homo sapiens; identical to SEQ ID NO: 87859
  misc_feature 1..30: note = chr20:53411711-53411741
  misc_feature 1..30: note = Hypo
  source 1..30: mol_type = genomic DNA

SEQ ID NO: 119795 - DNA, 40 bp, Homo sapiens; identical to SEQ ID NO: 87860
  misc_feature 1..40: note = chr20:53530458-53530498
  misc_feature 1..40: note = Hypo
  source 1..40: mol_type = genomic DNA

SEQ ID NO: 119796 - DNA, 23 bp, Homo sapiens
  misc_feature 1..23: note = chr20:53535735-53535758
  misc_feature 1..23: note = Hypo
  source 1..23: mol_type = genomic DNA
aaaaccaggaggggccgggcgcg

SEQ ID NO: 119797 - DNA, 30 bp, Homo sapiens; identical to SEQ ID NO: 87862
  misc_feature 1..30: note = chr20:53565997-53566027
  misc_feature 1..30: note = Hypo
  source 1..30: mol_type = genomic DNA

SEQ ID NO: 119798 - DNA, 90 bp, Homo sapiens; identical to SEQ ID NO: 87863
  misc_feature 1..90: note = chr20:53604671-53604761
  misc_feature 1..90: note = Hypo
  source 1..90: mol_type = genomic DNA

SEQ ID NO: 119799 - DNA, 103 bp, Homo sapiens; identical to SEQ ID NO: 87864
  misc_feature 1..103: note = chr20:53801909-53802012
  misc_feature 1..103: note = Hypo
  source 1..103: mol_type = genomic DNA

SEQ ID NO: 119800 - DNA, 138 bp, Homo sapiens; identical to SEQ ID NO: 87865
  misc_feature 1..138: note = chr20:53866697-53866835
  misc_feature 1..138: note = Hypo
  source 1..138: mol_type = genomic DNA

SEQ ID NO: 119801 - DNA, 33 bp, Homo sapiens; identical to SEQ ID NO: 87866
  misc_feature 1..33: note = chr20:53965510-53965543
  misc_feature 1..33: note = Hypo
  source 1..33: mol_type = genomic DNA

SEQ ID NO: 119802 - DNA, 26 bp, Homo sapiens
  misc_feature 1..26: note = chr20:54522665-54522691
  misc_feature 1..26: note = Hypo
  source 1..26: mol_type = genomic DNA
agaggagaactcgttgagttttatct

SEQ ID NO: 119803 - DNA, 716 bp, Homo sapiens; identical to SEQ ID NO: 87868
  misc_feature 1..716: note = chr20:54578078-54578794
  misc_feature 1..716: note = Hyper
  source 1..716: mol_type = genomic DNA

SEQ ID NO: 119804 - DNA, 67 bp, Homo sapiens
  misc_feature 1..67: note = chr20:54578998-54579065
  misc_feature 1..67: note = Hyper
  source 1..67: mol_type = genomic DNA
gcaccgccgagaaggcgaccttggagttggccgcccggaccgatatccccagcggggaggaagagga

SEQ ID NO: 119805 - DNA, 818 bp, Homo sapiens
  misc_feature 1..818: note = chr20:54579873-54580691
  misc_feature 1..818: note = Hyper
  source 1..818: mol_type = genomic DNA
gctagccaggtccctcgcaccgaaagcgcggattcgcaggatcaggtccagggcgccgggcgcagcgttcagggcggctggtccggcggggtcctctcctgcctggccgcccgcccccagtccctgcgcacaactttctcgtccctcgtgcagcccggagagcgcgaagcgggcacacgcgctctatttataggagcgcagcgtccggctgggttggcttatcgcgcaacccgcgggctccgagaaaagggggagaaggcgtctggtgaccccatctgagcagctctctcctgacgtttaacgcaccccaaagcaagcggggcgcacagcactggtgattggcaaggttcgaggcccctcagcccctgaaagcccgtggcgtaaaggatgcgtgcccagagaggagcccacggccctgcgctggccccagctccgcgcccactctctcctgctcgatctgagtccgcagaggaggcggctggtcccctcacccctcccagcgcggaactctgccgccgagtgccctccaagcggagcgcggcgctgccaggccgggtcgcgaaaaaggataagccgccgcggacccgcgctgcgcgctgccccgaacctggggaccggcgggcgtcccgaccgcgcctggccgggagcccgccccacacagccctggggcctggcgagctcagggaagccttggggcggaccagagcccgtgggggcggctgggaggaggtgcctgattccttccttccgctccgggaagatgagcctcagaagccgcaggggcgcgccttccccccacaccgcgaatcctccccagg

SEQ ID NO: 119806 - DNA, 18 bp, Homo sapiens
  misc_feature 1..18: note = chr20:54585945-54585963
  misc_feature 1..18: note = Hypo
  source 1..18: mol_type = genomic DNA
tttgaggtgcagtctcgc

SEQ ID NO: 119807 - DNA, 170 bp, Homo sapiens; identical to SEQ ID NO: 87873
  misc_feature 1..170: note = chr20:54618242-54618412
  misc_feature 1..170: note = Hypo
  source 1..170: mol_type = genomic DNA

SEQ ID NO: 119808 - DNA, 30 bp, Homo sapiens; identical to SEQ ID NO: 87874
  misc_feature 1..30: note = chr20:54880314-54880344
  misc_feature 1..30: note = Hypo
  source 1..30: mol_type = genomic DNA

SEQ ID NO: 119809 - DNA, 461 bp, Homo sapiens
  misc_feature 1..461: note = chr20:54918909-54919370
  misc_feature 1..461: note = Hyper
  source 1..461: mol_type = genomic DNA
tgtttagctctgcagcgcccaagcctgatgaatttacgacaagcttccaaaaaaggcaattgcggcttgcggagggtctagaggctcagttgcccgaggctgtcttgaggagctgcctttgggactccgcgaaacctcgaagtcttgggctgcgcctccccttgcgcggtcggagccttggcagagcctgcggcgccacctcgtgggcgaggccgcctggtgcaaggtcatccggtgccgggacccgctcctcgccccgccaggacccccgctcacctccaagctggacgcccgcggagccctgatcccctaacgcccgcttccgaggccgagctctgcagccccctgcaaccatcagatccagattgccttcctgcacgagcgcgcaactctcagcctcggagcgtgctggaaatgctgatgggaaccgtttgaatgaccgggcacgggtctgcaagaaa

SEQ ID NO: 119810 - DNA, 17 bp, Homo sapiens
  misc_feature 1..17: note = chr20:55112759-55112776
  misc_feature 1..17: note = Hypo
  source 1..17: mol_type = genomic DNA
tgcgtggctggagagaa

SEQ ID NO: 119811 - DNA, 3931 bp, Homo sapiens
  misc_feature 1..3931: note = chr20:55199898-55203829
  misc_feature 1..3931: note = Hyper
  source 1..3931: mol_type = genomic DNA
actgaagaagtcctacgtaccgcttgtcatatacatatgtaaagataatttaaaaccctagggtatacccttttcaaatgcagagtttatagtttccaaggggaggagggcaggggaggagtaaccaggacctttcctgccagtcttccaatcgcgatagctcgttttggctgtgaatttccccccttcccctccccctcccgttaattaaataaacgctggaagcgtgtgtttaccgcacacgactcggccctcggggaactctttttctacgtctctcctactcttaaactcctcaactcacagagggttggagagctggcaccatgagcttccagttcctacgggtgagaaaagaggtgtctgtgtggagggcaggtgcgaccccgggggctagcagagaggagaggctgcgggaggactcgctgcgaagggcgaggggtggcgctgggtgggacgggcgcctggggccgtgcagggtggctcctgggtgctgcccgggctgcctgtcgcccagtactggcgcaggaagacgggtccgcgcagcgtctggcaacagtggcctgctccacgcctggaggcgaccaagttctgagttaaaggcgccgggcttagccgggaagtgtatggcgacccagaacacggagcggagaaggcctcaggggacacgaggctaccgccttagtcctcgggcctgcgctccgagcggttagggtgcgtacggatgggctccgggatgttagtggagaggtgacaggagtctaccatcccacggccaagcgtgtgaggcctccggcgggcgggggtcccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtggacccgggccctcctcggaagcttgggaacctgtgagcccctcagctcctcgcctcactttgcctgtttgaaaaaaggagttgtttgagaggaagagttaaggctcaaaaggttctaaacgaagagcatgcggcctgacgcggagcgcaaagaagcgagcagtgaactgaatctggtgggactgagaccagaggcgtctgtatgcggcggccgcttcgcgccctattaaagcaatctgttatttacgataatcatttttgtaattattttggagtggctgtgacttgatgtctgtggtgccccagggcatgcccttactggacatagatacttcagggtgccctttgacgccagtgtcggtccagtgggtgccagtgccgcgaagggagggtggcgggcgtgaatgccccctcctcctgggtttgccgcaggccccggcctttccaccttgcttgatcctggcgggtctgccacttactgaggtccctaccggcgctcacgttgtcccgagaggcgggacaaacgtccggcgcgtggcgcggagtctgcgaaagcgctcgggggcctccatcttctgctcgggagtcccctccctggggcgggaagaggagtcgcagatctgcccgaatcttgctctacccgcctggccgccttcttccgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagtttaggctccctagggggcggtagaggggaacccccgacaaccttccatcctcttctccaggcggctgcgaggcctccggggttccagaggggtccccttctgccggtgccggctgtcttgagcgcggccacgcagtccgcgtcttcacgtgggcaaggggcggggacgttggagggaggctgtcttggatgctggagccttcggttcccggctctgctgagcagaaaagttgaagtcaaggaagggttgaggcttcctcacaagggcgcgcgcgtgcctgggtgccggcccagaagccgagaatgtgcgtattggggaagggtctcccgtgccgagaagacagaggatttgttctagctgccttccgtacagagggcgcggaggttgcgctccagttcgaacgcttacccattggaaagagggcagcgccggggtccagggaagctccttgggaatgaatggcctttgccaagcggttccggatcctctgggtcctttgggcccacggcacggtgctgcgcgagccctcagtgcccatcggctcccttcgcctcctgcgtagacgctcccaggcggggaggcatatcggttcctccgggcagctttggctagtgttgctgtgggaaaggagagccagggcctgggatgggggatgagcaccttcttgcccattccgggccccagcgtgcaggaggtaaacttgccagcacagacaagacagcttgttcaagctgcacctcaggccgggtcagagaataaaaccgagggctagaaggcccagaatgtcggacagcccagcggcacccgtcagggagtcccaggcgcccgaaagaggcgccgcacctctggcgagtctaggacccatcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccctgcagatatgcttggccgaaaagtctcagtggtttcaacttccagattttgttcccgcgtccggtcggaaaatcacctgggatttggctgctgtctaaggccgggggaaagtttcccttggaggacgcctattattattattttcttttaggcccacctgggtctaaataaatgctaaagttcaaacgaacccgagaaggaacagcgaggcagtggatgccgccattccgtggatgggagagtcatgtctactgcaggtgcggacaccgtactgataggcattgattattgcaaaatcgtattcagtatcaaatagaaatagtcttgtcctctaatccccacagaatgtttaaatccagcccagggagccagttggggcgtcccaacaaatacgccctcgagaattagcgatgttccccttacaatgaaagtcaattgctgcataataactgggccaaagaatttcgttagtttaaattttaaaaattagtattgcactttgctttcaagtttgggtggcaagtaccgaaggggagagggaagcagcgtttgtgtggaaggaagtttcgttttctgtctaaacatgtgggacctgggtgtctacctctccagtcgagagctctctgcaggctctctcccaacttcctgcacctcctcaccctcaccttacccgtggcgctcgggttttattcctgcccggcgcttctttcccagggcgagtagaggcttctgagtgaccggcccgccagaggcagctgcagagccggcgttccgcagggcagggcagggccgggccgctgggctggtccagtgcgcgcgggttccccctggcctcagccagccgcgggagatgccacttcgggcgacagcggcgagacgccgctgtccgcaactcctgggcgggtaggaccgtctgctgcctctgcggcccttggggcagactccccaggagtcccttcctctctcctcccgcccgggggccgggaccgcgctgtgcccacgga

SEQ ID NO: 119812 - DNA, 984 bp, Homo sapiens; identical to SEQ ID NO: 87885
  misc_feature 1..984: note = chr20:55204104-55205088
  misc_feature 1..984: note = Hyper
  source 1..984: mol_type = genomic DNA

SEQ ID NO: 119813 - DNA, 1152 bp, Homo sapiens
  misc_feature 1..1152: note = chr20:55205304-55206456
  misc_feature 1..1152: note = Hyper
  source 1..1152: mol_type = genomic DNA
cgggagcgcggagctcgggctacggactcgcgggagttcactgcgcctccgggccctggagggctgcccctgcccgcaggcccgggcgcttccgccaggaggcgacagcgccatgttcctccaggttcccggcgccccgagacccctgggcagatggggacgcatcctttagaaactgagtcgggccgcccaggggcgagggaacgtgcgcgggcaaggctgcccaatttccagggttcttcatgccccctctgcgccccgacgtgcgagaacactgcccttggcagtgcagggcgcccccacttattactcccctcggctgggcccggccagcagggagggccgccctgtgcgcgcgctccctcttcacttcccagggcggcgcagggtggcgggccctgctttccgagcgccgcccgctcggaggtctttgtcccgagggcgtggaagggagggtcccgggggcgggggaggtgcgcatttcccgcgccgcgcactctatccgcgcctgccgcgctgccacctccagcagtccctgcgtcatgggcgggctccacgagatagctctgcaccgggcgtccggctccttcgccccgggctctggctccttcgccccgggctccggccacggacttttctggcccaagacccagggttcggacttggcgcctccaagcgcctcgggcttgggagcagcgcctagaccttcgccgccgggctttgagaactcgttcccccaggtctttcaccagactctcctccctccccgcactctttgcttacaacgaaatcctcggggcgcattgcccccgggtaccttccgaccctgggcaagccccgccgggcggggtgcggttggtcccccggggccctctgcgtagcccggcgatgccggccagttcgcagtagcggggtttcgcactaacggggtctcctgtttttttttttccctccaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaag

SEQ ID NO: 119814 - DNA, 77 bp, Homo sapiens; identical to SEQ ID NO: 87888
  misc_feature 1..77: note = chr20:55378966-55379043
  misc_feature 1..77: note = Hypo
  source 1..77: mol_type = genomic DNA

SEQ ID NO: 119815 - DNA, 136 bp, Homo sapiens; identical to SEQ ID NO: 87889
  misc_feature 1..136: note = chr20:55379403-55379539
  misc_feature 1..136: note = Hypo
  source 1..136: mol_type = genomic DNA

SEQ ID NO: 119816 - DNA, 135 bp, Homo sapiens; identical to SEQ ID NO: 87890
  misc_feature 1..135: note = chr20:55405254-55405389
  misc_feature 1..135: note = Hyper
  source 1..135: mol_type = genomic DNA

SEQ ID NO: 119817 - DNA, 30 bp, Homo sapiens; identical to SEQ ID NO: 87891
  misc_feature 1..30: note = chr20:55405620-55405650
  misc_feature 1..30: note = Hyper
  source 1..30: mol_type = genomic DNA

SEQ ID NO: 119818 - DNA, 1695 bp, Homo sapiens
  misc_feature 1..1695: note = chr20:55499420-55501115
  misc_feature 1..1695: note = Hyper
  source 1..1695: mol_type = genomic DNA
ttaaggagagtatcacgtttatactttaaaaagcccaactgctctgtttaaagtggatctttcataaacttgcagtcaggagcaacaatgacgtccttcagggagtcaaacactttggaaagaaacgcgaactgaaaatgctattggaggacgcaagaaaaccgaaaacgctcggtcgagtttttctgtcaagccacgtttgaaattaaggaattcgtgtaaattgccatctttcgcatccgaagcaagaaacgtacacagtttccctgctatacggagttgttgtgacataagaaaacagaatctttttaaacctcgagtttaattaattcttttttaaaaaagaatttagcagcagcatgttaaaagggaaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctagataatgaagcctggtcgcggttattggcagaagggcccgggcgcgctgtgagaacgctgcaggctcactttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggccggagcggcggcgggcgcggggggcgacggcgcgcacaatgggcccggagcgcctcattagagacgcgtttgatgcgctcccgtgccccacgggggccctgggcgatgtcaatgggataattacgatgatctaatggccggctcttttgcatgcaggcccgcctgaatggggcgcctggaggctgcattgaggccgggctgtgtaaactgtagggtgcctcgccgactcggagccgcagagactggcggcgggtcaacttggaccactttgcattcacgctttgaataggcggagcgggaggcgtcctttcccgcggccgcctttcagccgagagagtgacagattggaggtcagcggctggcgggacggaagccctcgccgggcagatggacccgctccgggccgcgccggggacccccgccccgcgcacaggcgtgtctacgcggacgggctccgagcgcacccgcgtgtgcgaggcgatgggcagccgcccgtctcccgatgcagccaagagaacggtggttttgcattttttccaaacctcttcttgtcttaatgacaagagtcaaaccgtctcgcgcttggctcccctcccggcacctgtgcgtttccccagaagccgacttggccccggccaagggcacccgcagagcagcccctaccctccaatattttgcaggaggggagaagaggaaaaagagaactggatatttgatatgtcgaaagaatgatcgatgatgaggctgcaccgtaggagcttgccggtctccgaccgctgctggcctgcgaagccggcacgtttacaaggctca

SEQ ID NO: 119819 - DNA, 87 bp, Homo sapiens; identical to SEQ ID NO: 87896
  misc_feature 1..87: note = chr20:55531782-55531869
  misc_feature 1..87: note = Hypo
  source 1..87: mol_type = genomic DNA

SEQ ID NO: 119820 - DNA, 196 bp, Homo sapiens; identical to SEQ ID NO: 87897
  misc_feature 1..196: note = chr20:55532189-55532385
  misc_feature 1..196: note = Hyper
  source 1..196: mol_type = genomic DNA

SEQ ID NO: 119821 - DNA, 30 bp, Homo sapiens; identical to SEQ ID NO: 87898
  misc_feature 1..30: note = chr20:55533555-55533585
  misc_feature 1..30: note = Hypo
  source 1..30: mol_type = genomic DNA

SEQ ID NO: 119822 - DNA, 105 bp, Homo sapiens; identical to SEQ ID NO: 87899
  misc_feature 1..105: note = chr20:55588889-55588994
  misc_feature 1..105: note = Hyper
  source 1..105: mol_type = genomic DNA

SEQ ID NO: 119823 - DNA, 430 bp, Homo sapiens; identical to SEQ ID NO: 87900
  misc_feature 1..430: note = chr20:55685373-55685803
  misc_feature 1..430: note = Hypo
  source 1..430: mol_type = genomic DNA

SEQ ID NO: 119824 - DNA, 280 bp, Homo sapiens; identical to SEQ ID NO: 87901
  misc_feature 1..280: note = chr20:55693330-55693610
  misc_feature 1..280: note = Hypo
  source 1..280: mol_type = genomic DNA

SEQ ID NO: 119825 - DNA, 30 bp, Homo sapiens; identical to SEQ ID NO: 87902
  misc_feature 1..30: note = chr20:55766158-55766188
  misc_feature 1..30: note = Hypo
  source 1..30: mol_type = genomic DNA

SEQ ID NO: 119826 - DNA, 29 bp, Homo sapiens
  misc_feature 1..29: note = chr20:55772236-55772265
  misc_feature 1..29: note = Hypo
  source 1..29: mol_type = genomic DNA
tgagccaccgcacccggccctaatttttt

SEQ ID NO: 119827 - DNA, 176 bp, Homo sapiens
  misc_feature 1..176: note = chr20:55839603-55839779
  misc_feature 1..176: note = Hyper
  source 1..176: mol_type = genomic DNA
gccccaggctcgcgtcgccggggtcgtcgcggctccagtcggaaaccgggacccccagccgcccccgcggcgtcagctctgagatcccgcgcaacccaatcgccaaaacctgtggtttgcgcgccacacgtggtaaatgctgaaaatagattctgccggcccgggacctaccacta

SEQ ID NO: 119828 - DNA, 942 bp, Homo sapiens; identical to SEQ ID NO: 87906
  misc_feature 1..942: note = chr20:55840865-55841807
  misc_feature 1..942: note = Hyper
  source 1..942: mol_type = genomic DNA

SEQ ID NO: 119829 - DNA, 393 bp, Homo sapiens
  misc_feature 1..393: note = chr20:55842040-55842433
  misc_feature 1..393: note = Hyper
  source 1..393: mol_type = genomic DNA
aaggcttcctggaagcggtgacccttgagccggtcttgcccctcagtccctgtatccttttaagccagccacgctgacccctccgcgcctccctgaagccgttgccagcctgtctctgcgctcgccattccctccgcctggacctctccccactcaccacctcccgcccccatcagacgctgctttctcctcccagagacctccaagacctgccaagctgaggttgtttcctcgcctcgcccctcgcacgtttgttttctttcctgtagtttctcttgctgtctggaattgctgtttgagttactccgtgccttctttattgccttcttacccccgctagacacccagagcactggggcccggatcagcgatcttctccgcacctctggtacc

SEQ ID NO: 119830 - DNA, 30 bp, Homo sapiens; identical to SEQ ID NO: 87908
  misc_feature 1..30: note = chr20:55876620-55876650
  misc_feature 1..30: note = Hypo
  source 1..30: mol_type = genomic DNA

SEQ ID NO: 119831 - DNA, 175 bp, Homo sapiens; identical to SEQ ID NO: 87909
  misc_feature 1..175: note = chr20:55925381-55925556
  misc_feature 1..175: note = Hypo
  source 1..175: mol_type = genomic DNA

SEQ ID NO: 119832 - DNA, 206 bp, Homo sapiens; identical to SEQ ID NO: 87910
  misc_feature 1..206: note = chr20:55958990-55959196
  misc_feature 1..206: note = Hypo
  source 1..206: mol_type = genomic DNA

SEQ ID NO: 119833 - DNA, 205 bp, Homo sapiens; identical to SEQ ID NO: 87911
  misc_feature 1..205: note = chr20:55959376-55959581
  misc_feature 1..205: note = Hypo
  source 1..205: mol_type = genomic DNA

SEQ ID NO: 119834 - DNA, 42 bp, Homo sapiens; identical to SEQ ID NO: 87912
  misc_feature 1..42: note = chr20:55965005-55965047
  misc_feature 1..42: note = Hyper
  source 1..42: mol_type = genomic DNA

SEQ ID NO: 119835 - DNA, 138 bp, Homo sapiens; identical to SEQ ID NO: 87913
  misc_feature 1..138: note = chr20:55969837-55969975
  misc_feature 1..138: note = Hypo
  source 1..138: mol_type = genomic DNA

SEQ ID NO: 119836 - DNA, 30 bp, Homo sapiens; identical to SEQ ID NO: 87914
  misc_feature 1..30: note = chr20:55970272-55970302
  misc_feature 1..30: note = Hypo
  source 1..30: mol_type = genomic DNA

SEQ ID NO: 119837 - DNA, 30 bp, Homo sapiens; identical to SEQ ID NO: 87915
  misc_feature 1..30: note = chr20:55983462-55983492
  misc_feature 1..30: note = Hypo
  source 1..30: mol_type = genomic DNA

SEQ ID NO: 119838 - DNA, 35 bp, Homo sapiens; identical to SEQ ID NO: 46244
  misc_feature 1..35: note = chr20:55989687-55989722
  misc_feature 1..35: note = Hypo
  source 1..35: mol_type = genomic DNA

SEQ ID NO: 119839 - DNA, 30 bp, Homo sapiens; identical to SEQ ID NO: 87917
  misc_feature 1..30: note = chr20:56027674-56027704
  misc_feature 1..30: note = Hypo
  source 1..30: mol_type = genomic DNA

SEQ ID NO: 119840 - DNA, 51 bp, Homo sapiens; identical to SEQ ID NO: 87918
  misc_feature 1..51: note = chr20:56031247-56031298
  misc_feature 1..51: note = Hypo
  source 1..51: mol_type = genomic DNA

SEQ ID NO: 119841 - DNA, 35 bp, Homo sapiens; identical to SEQ ID NO: 87919
  misc_feature 1..35: note = chr20:56041897-56041932
  misc_feature 1..35: note = Hypo
  source 1..35: mol_type = genomic DNA

SEQ ID NO: 119842 - DNA, 23 bp, Homo sapiens
  misc_feature 1..23: note = chr20:56053945-56053968
  misc_feature 1..23: note = Hypo
  source 1..23: mol_type = genomic DNA
gttatccaaattagccgggcacg

SEQ ID NO: 119843 - DNA, 30 bp, Homo sapiens; identical to SEQ ID NO: 46247
  misc_feature 1..30: note = chr20:56065208-56065238
  misc_feature 1..30: note = Hypo
  source 1..30: mol_type = genomic DNA

SEQ ID NO: 119844 - DNA, 30 bp, Homo sapiens; identical to SEQ ID NO: 87922
  misc_feature 1..30: note = chr20:56066624-56066654
  misc_feature 1..30: note = Hypo
  source 1..30: mol_type = genomic DNA

SEQ ID NO: 119845 - DNA, 30 bp, Homo sapiens; identical to SEQ ID NO: 87923
  misc_feature 1..30: note = chr20:56075973-56076003
  misc_feature 1..30: note = Hypo
  source 1..30: mol_type = genomic DNA

SEQ ID NO: 119846 - DNA, 30 bp, Homo sapiens; identical to SEQ ID NO: 87924
  misc_feature 1..30: note = chr20:56155603-56155633
  misc_feature 1..30: note = Hypo
  source 1..30: mol_type = genomic DNA

SEQ ID NO: 119847 - DNA, 63 bp, Homo sapiens; identical to SEQ ID NO: 87925
  misc_feature 1..63: note = chr20:56240406-56240469
  misc_feature 1..63: note = Hypo
  source 1..63: mol_type = genomic DNA

SEQ ID NO: 119848 - DNA, 30 bp, Homo sapiens; identical to SEQ ID NO: 87926
  misc_feature 1..30: note = chr20:56245200-56245230
  misc_feature 1..30: note = Hypo
  source 1..30: mol_type = genomic DNA

SEQ ID NO: 119849 - DNA, 46 bp, Homo sapiens; identical to SEQ ID NO: 87927
  misc_feature 1..46: note = chr20:56265981-56266027
  misc_feature 1..46: note = Hypo
  source 1..46: mol_type = genomic DNA

SEQ ID NO: 119850 - DNA, 30 bp, Homo sapiens; identical to SEQ ID NO: 87928
  misc_feature 1..30: note = chr20:56267652-56267682
  misc_feature 1..30: note = Hypo
  source 1..30: mol_type = genomic DNA

SEQ ID NO: 119851 - DNA, 308 bp, Homo sapiens; identical to SEQ ID NO: 87929
  misc_feature 1..308: note = chr20:56271495-56271803
  misc_feature 1..308: note = Hypo
  source 1..308: mol_type = genomic DNA

SEQ ID NO: 119852 - DNA, 38 bp, Homo sapiens; identical to SEQ ID NO: 87930
  misc_feature 1..38: note = chr20:56272948-56272986
  misc_feature 1..38: note = Hypo
  source 1..38: mol_type = genomic DNA

SEQ ID NO: 119853 - DNA, 30 bp, Homo sapiens; identical to SEQ ID NO: 87931
  misc_feature 1..30: note = chr20:56296686-56296716
  misc_feature 1..30: note = Hypo
  source 1..30: mol_type = genomic DNA

SEQ ID NO: 119854 - DNA, 83 bp, Homo sapiens; identical to SEQ ID NO: 87932
  misc_feature 1..83: note = chr20:56385727-56385810
  misc_feature 1..83: note = Hypo
  source 1..83: mol_type = genomic DNA

SEQ ID NO: 119855 - DNA, 36 bp, Homo sapiens
  misc_feature 1..36: note = chr20:56725904-56725940
  misc_feature 1..36: note = Hyper
  source 1..36: mol_type = genomic DNA
gtgcagagccatttccgcctccgagtcctgcgttgc

SEQ ID NO: 119856 - DNA, 43 bp, Homo sapiens; identical to SEQ ID NO: 87935
  misc_feature 1..43: note = chr20:56766160-56766203
  misc_feature 1..43: note = Hypo
  source 1..43: mol_type = genomic DNA

SEQ ID NO: 119857 - DNA, 68 bp, Homo sapiens; identical to SEQ ID NO: 87936
  misc_feature 1..68: note = chr20:56770989-56771057
  misc_feature 1..68: note = Hypo
  source 1..68: mol_type = genomic DNA

SEQ ID NO: 119858 - DNA, 264 bp, Homo sapiens; identical to SEQ ID NO: 87937
  misc_feature 1..264: note = chr20:56771442-56771706
  misc_feature 1..264: note = Hypo
  source 1..264: mol_type = genomic DNA

SEQ ID NO: 119859 - DNA, 305 bp, Homo sapiens; identical to SEQ ID NO: 46253
  misc_feature 1..305: note = chr20:56771994-56772299
  misc_feature 1..305: note = Hypo
  source 1..305: mol_type = genomic DNA

SEQ ID NO: 119860 - DNA, 30 bp, Homo sapiens; identical to SEQ ID NO: 87939
  misc_feature 1..30: note = chr20:56780195-56780225
  misc_feature 1..30: note = Hypo
  source 1..30: mol_type = genomic DNA

SEQ ID NO: 119861 - DNA, 513 bp, Homo sapiens; identical to SEQ ID NO: 87940
  misc_feature 1..513: note = chr20:56780438-56780951
  misc_feature 1..513: note = Hypo
  source 1..513: mol_type = genomic DNA

SEQ ID NO: 119862 - DNA, 93 bp, Homo sapiens; identical to SEQ ID NO: 87941
  misc_feature 1..93: note = chr20:56781011-56781104
  misc_feature 1..93: note = Hypo
  source 1..93: mol_type = genomic DNA

SEQ ID NO: 119863 - DNA, 819 bp, Homo sapiens; identical to SEQ ID NO: 87942
  misc_feature 1..819: note = chr20:56803306-56804125
  misc_feature 1..819: note = Hyper
  source 1..819: mol_type = genomic DNA

SEQ ID NO: 119864 - DNA, 30 bp, Homo sapiens; identical to SEQ ID NO: 87943
  misc_feature 1..30: note = chr20:56821439-56821469
  misc_feature 1..30: note = Hypo
  source 1..30: mol_type = genomic DNA

SEQ ID NO: 119865 - DNA, 74 bp, Homo sapiens; identical to SEQ ID NO: 87944
  misc_feature 1..74: note = chr20:56839596-56839670
  misc_feature 1..74: note = Hypo
  source 1..74: mol_type = genomic DNA

SEQ ID NO: 119866 - DNA, 30 bp, Homo sapiens; identical to SEQ ID NO: 87945
  misc_feature 1..30: note = chr20:56947808-56947838
  misc_feature 1..30: note = Hypo
  source 1..30: mol_type = genomic DNA

SEQ ID NO: 119867 - DNA, 30 bp, Homo sapiens; identical to SEQ ID NO: 87946
  misc_feature 1..30: note = chr20:57009545-57009575
  misc_feature 1..30: note = Hypo
  source 1..30: mol_type = genomic DNA

SEQ ID NO: 119868 - DNA, 76 bp, Homo sapiens; identical to SEQ ID NO: 87947
  misc_feature 1..76: note = chr20:57041680-57041756
  misc_feature 1..76: note = Hypo
  source 1..76: mol_type = genomic DNA

SEQ ID NO: 119869 - DNA, 33 bp, Homo sapiens; identical to SEQ ID NO: 87948
  misc_feature 1..33: note = chr20:57047499-57047532
  misc_feature 1..33: note = Hypo
  source 1..33: mol_type = genomic DNA

SEQ ID NO: 119870 - DNA, 30 bp, Homo sapiens; identical to SEQ ID NO: 87949
  misc_feature 1..30: note = chr20:57056542-57056572
  misc_feature 1..30: note = Hyper
  source 1..30: mol_type = genomic DNA

SEQ ID NO: 119871 - DNA, 768 bp, Homo sapiens
  misc_feature 1..768: note = chr20:57089405-57090173
  misc_feature 1..768: note = Hyper
  source 1..768: mol_type = genomic DNA
cggtcccactgggcccggcacaaagggcagctctgggtacctacaggccaggccccgactggcgcagagagtgcagcggctctcatattgcgaggtgacgcgactccctcccgcaggccccaggaagctcctggaggcgcgcaggtgccggccaggtgagactggagaaaggcgcgcagggcgcagcatagcagccgcgtgggccgacccagggccgtagtccccaagggcccttaggggacattagacggcgagctccctcccttccgagctcagccagtttgccgggtgggggagggtggcacctacctcccaaaagcaccaggacgcaagcgtaggggagcatggctgcgggcatcccgtcggggctggcaggaccgcccgccgggcgctgccacggtgcgcaaggggaggcgcgggcgcagggctctcggacggctgcgggcgccggcggccaggctggagtcctgcgaagaagttgcgagggtcctgcgcccccctcggcgctcacacgcgctcagccttcccggctgttgatagttgtaagcggagctgcgcactcataggtccaacttgccagaagaggtggagacagcccccggcgaggcgcgcacacccgcgcagcgcgcacagccccctggtgcagctcctgccattcagacccccagccctcccccagatgtccgtcccctggccgtcgccttccccaaagtcttcgcagtgggcaaggaggcctcccccaagctctggtcccggccaaggcagagc

SEQ ID NO: 119872 - DNA, 47 bp, Homo sapiens; identical to SEQ ID NO: 87952
  misc_feature 1..47: note = chr20:57198958-57199005
  misc_feature 1..47: note = Hypo
  source 1..47: mol_type = genomic DNA

SEQ ID NO: 119873 - DNA, 863 bp, Homo sapiens
  misc_feature 1..863: note = chr20:57224603-57225466
  misc_feature 1..863: note = Hyper
  source 1..863: mol_type = genomic DNA
gctacgctaagcacacgggctccccgaatttccctccccagggcctctctgtctttggatggcctgtcagcaagtccctgcagcctccagcccggcccgcgcggcgacccagtcccctgtcgcccgaatcttccaccgctgcgaagcgtccccgggcgagcgccctgctctccgcgctgcgcggaagccagagccggtcctcacagtgaactcgcccagccctgctcgcggctctctcgattttatgtgggtttcgttggatgcattttgttatttgcctcaatggatgtttcacattaatttttagttgcacaacgaacgcgcgggaacattctccgtgagagaaaaagcacgggtggggggcggttaccggtgcttcccccggtcgcctgggggtcccgcacgcgccccgcgggtgccgctgtctggctggggtccctgggtgagccgcgggcaccggcttcgcgtctccccgggcgcgactccgctttgcaagcgctcagcacacgggaaaccctcggaaaacacacacgtgtgtaaagtttgttccacgcagaaacaaaggacgcgtgggggccgcttctggggcctcggtcctttgttggaaccccgcaccgcagcccggcccgcagcctcgccccgcaaggggaagccggccctgcacaggcccggggcccggaaggcgccgccgcacagctctgcgcccccgacccgctccggccgcgcgctgggccaggcccttggcctcaagcctcccgggcggctccgggccggacccgggtctccgtcgcgggacgccagcctgtttgtgggtgccgtgctcgggcccgggcggcccctgcccgacgcggccccacggagcc

SEQ ID NO: 119874 - DNA, 67 bp, Homo sapiens; identical to SEQ ID NO: 87955
  misc_feature 1..67: note = chr20:57268346-57268413
  misc_feature 1..67: note = Hyper
  source 1..67: mol_type = genomic DNA

SEQ ID NO: 119875 - DNA, 131 bp, Homo sapiens; identical to SEQ ID NO: 87956
  misc_feature 1..131: note = chr20:57268845-57268976
  misc_feature 1..131: note = Hypo
  source 1..131: mol_type = genomic DNA

SEQ ID NO: 119876 - DNA, 30 bp, Homo sapiens; identical to SEQ ID NO: 87958
  misc_feature 1..30: note = chr20:57385895-57385925
  misc_feature 1..30: note = Hypo
  source 1..30: mol_type = genomic DNA

SEQ ID NO: 119877 - DNA, 149 bp, Homo sapiens; identical to SEQ ID NO: 87959
  misc_feature 1..149: note = chr20:57392258-57392407
  misc_feature 1..149: note = Hypo
  source 1..149: mol_type = genomic DNA

SEQ ID NO: 119878 - DNA, 30 bp, Homo sapiens; identical to SEQ ID NO: 46260
  misc_feature 1..30: note = chr20:57398016-57398046
  misc_feature 1..30: note = Hypo
  source 1..30: mol_type = genomic DNA

SEQ ID NO: 119879 - DNA, 30 bp, Homo sapiens; identical to SEQ ID NO: 87961
  misc_feature 1..30: note = chr20:57465637-57465667
  misc_feature 1..30: note = Hyper
  source 1..30: mol_type = genomic DNA

SEQ ID NO: 119880 - DNA, 30 bp, Homo sapiens; identical to SEQ ID NO: 87962
  misc_feature 1..30: note = chr20:57541389-57541419
  misc_feature 1..30: note = Hypo
  source 1..30: mol_type = genomic DNA

SEQ ID NO: 119881 - DNA, 30 bp, Homo sapiens; identical to SEQ ID NO: 87963
  misc_feature 1..30: note = chr20:57555048-57555078
  misc_feature 1..30: note = Hypo
  source 1..30: mol_type = genomic DNA

SEQ ID NO: 119882 - DNA, 30 bp, Homo sapiens; identical to SEQ ID NO: 87964
  misc_feature 1..30: note = chr20:57616915-57616945
  misc_feature 1..30: note = Hypo
  source 1..30: mol_type = genomic DNA

SEQ ID NO: 119883 - DNA, 76 bp, Homo sapiens; identical to SEQ ID NO: 46261
  misc_feature 1..76: note = chr20:57622769-57622845
  misc_feature 1..76: note = Hypo
  source 1..76: mol_type = genomic DNA

SEQ ID NO: 119884 - DNA, 76 bp, Homo sapiens; identical to SEQ ID NO: 46262
  misc_feature 1..76: note = chr20:57622905-57622981
  misc_feature 1..76: note = Hypo
  source 1..76: mol_type = genomic DNA

SEQ ID NO: 119885 - DNA, 41 bp, Homo sapiens; identical to SEQ ID NO: 87969
  misc_feature 1..41: note = chr20:57674658-57674699
  misc_feature 1..41: note = Hypo
  source 1..41: mol_type = genomic DNA

SEQ ID NO: 119886 - DNA, 51 bp, Homo sapiens; identical to SEQ ID NO: 46263
  misc_feature 1..51: note = chr20:57699771-57699822
  misc_feature 1..51: note = Hypo
  source 1..51: mol_type = genomic DNA

SEQ ID NO: 119887 - DNA, 40 bp, Homo sapiens; identical to SEQ ID NO: 87971
  misc_feature 1..40: note = chr20:57723438-57723478
  misc_feature 1..40: note = Hypo
  source 1..40: mol_type = genomic DNA

SEQ ID NO: 119888 - DNA, 354 bp, Homo sapiens; identical to SEQ ID NO: 87972
  misc_feature 1..354: note = chr20:57767543-57767897
  misc_feature 1..354: note = Hypo
  source 1..354: mol_type = genomic DNA

SEQ ID NO: 119889 - DNA, 348 bp, Homo sapiens; identical to SEQ ID NO: 87973
  misc_feature 1..348: note = chr20:57875541-57875889
  misc_feature 1..348: note = Hyper
  source 1..348: mol_type = genomic DNA

SEQ ID NO: 119890 - DNA, 208 bp, Homo sapiens; identical to SEQ ID NO: 87974
  misc_feature 1..208: note = chr20:57929975-57930183
  misc_feature 1..208: note = Hypo
  source 1..208: mol_type = genomic DNA

SEQ ID NO: 119891 - DNA, 30 bp, Homo sapiens; identical to SEQ ID NO: 87975
  misc_feature 1..30: note = chr20:57935754-57935784
  misc_feature 1..30: note = Hypo
  source 1..30: mol_type = genomic DNA

SEQ ID NO: 119892 - DNA, 197 bp, Homo sapiens; identical to SEQ ID NO: 87976
  misc_feature 1..197: note = chr20:57966144-57966341
  misc_feature 1..197: note = Hypo
  source 1..197: mol_type = genomic DNA

SEQ ID NO: 119893 - DNA, 55 bp, Homo sapiens; identical to SEQ ID NO: 87977
  misc_feature 1..55: note = chr20:57978786-57978841
  misc_feature 1..55: note = Hyper
  source 1..55: mol_type = genomic DNA

SEQ ID NO: 119894 - DNA, 30 bp, Homo sapiens; identical to SEQ ID NO: 87978
  misc_feature 1..30: note = chr20:57994831-57994861
  misc_feature 1..30: note = Hypo
  source 1..30: mol_type = genomic DNA

SEQ ID NO: 119895 - DNA, 30 bp, Homo sapiens; identical to SEQ ID NO: 87979
  misc_feature 1..30: note = chr20:58100780-58100810
  misc_feature 1..30: note = Hyper
  source 1..30: mol_type = genomic DNA

SEQ ID NO: 119896 - DNA, 288 bp, Homo sapiens
  misc_feature 1..288: note = chr20:58152463-58152751
  misc_feature 1..288: note = Hyper
  source 1..288: mol_type = genomic DNA
gccggcctcgcgtggcggcgccgcccccggccctggtcccggtcccgccccgccggcgcctccccgcggccccggctccgctccgcggccctccggcgggatgcgtggccgtggcggggggcgcgcccgctgtcctgcgcccctgcgctcgctgctgggcgccttcggggcccgggacgctgccgccgccgcccgagatcctgcgcaaggtaagcgcgcgctgcggggaggggacgcgggacgtggggcccggggtgcccgccgggcacgaggcgctgggggacgact

SEQ ID NO: 119897 - DNA, 283 bp, Homo sapiens; identical to SEQ ID NO: 87981
  misc_feature 1..283: note = chr20:58179128-58179411
  misc_feature 1..283: note = Hyper
  source 1..283: mol_type = genomic DNA

SEQ ID NO: 119898 - DNA, 1010 bp, Homo sapiens
  misc_feature 1..1010: note = chr20:58179702-58180712
  misc_feature 1..1010: note = Hyper
  source 1..1010: mol_type = genomic DNA
cccctgccccaagcacgcaataaacactgacaagaaaaagtttttatttcctggttcaacttttttttttttccctggaatatagactgaagaatgggaataaacacgaataaataacaaagcgaggccgcgcacgccgggatgcgcctggctgcagccggcgaggctattgtctccccgccctgaagccagccccggcgtctttctccagctcgtttcctttcccggccttttttttttttttttttttttaattttcttttttaaaaagacgccccctccagccccctcgccggtgaccttggccgcctcggatgctctgattccacgcggctcgctctaacttgcccccgcgccggccgggcccatggccgcgtcggaggacgggagcggctgcctcgtgtcgcggggccgctcgcagagtgaccccagcgtcctcaccgactcctcggccacctcctccgcggacgccggggagaacccaggtaacgggctgggcgggggcggcgggcgggtcggggaggcccgaggcaggtggcgctgagagcaggaccccgcgaggctccgcgccccgcctgcattcggggagccgcggcaggaacccgcgctcggccccgcggttcctatccccagtctcgcagggctggggcgcctcggagccctttgtccataaaagagctgatttcctgggtagagccgggcgctgcagcttcccctcctctccggctggtgagctctgccgtcccctcgaaggaggcttcctttcctcgggtgctgaccggctgggggaagagaggcagacccgtggccgcctccgcccagcgccggttctgggccattccctccctccccactgccgggccccagctccggacgtccccgcttgggcatctgctcctggaaggcagcgctccgcagctgaggccaccgcgctgagggcttccaccaggcgcctgactccagcggggcctggcgcacctgggcgcgctagcccccggacaggtgtgctg

SEQ ID NO: 119899 - DNA, 197 bp, Homo sapiens; identical to SEQ ID NO: 46264
  misc_feature 1..197: note = chr20:58283870-58284067
  misc_feature 1..197: note = Hypo
  source 1..197: mol_type = genomic DNA

SEQ ID NO: 119900 - DNA, 188 bp, Homo sapiens; identical to SEQ ID NO: 87987
  misc_feature 1..188: note = chr20:58311568-58311756
  misc_feature 1..188: note = Hypo
  source 1..188: mol_type = genomic DNA

SEQ ID NO: 119901 - DNA, 56 bp, Homo sapiens; identical to SEQ ID NO: 87988
  misc_feature 1..56: note = chr20:58331425-58331481
  misc_feature 1..56: note = Hypo
  source 1..56: mol_type = genomic DNA

SEQ ID NO: 119902 - DNA, 30 bp, Homo sapiens; identical to SEQ ID NO: 87989
  misc_feature 1..30: note = chr20:58333983-58334013
  misc_feature 1..30: note = Hypo
  source 1..30: mol_type = genomic DNA

SEQ ID NO: 119903 - DNA, 101 bp, Homo sapiens; identical to SEQ ID NO: 87990
  misc_feature 1..101: note = chr20:58348371-58348472
  misc_feature 1..101: note = Hypo
  source 1..101: mol_type = genomic DNA

SEQ ID NO: 119904 - DNA, 334 bp, Homo sapiens; identical to SEQ ID NO: 87991
  misc_feature 1..334: note = chr20:58507729-58508063
  misc_feature 1..334: note = Hypo
  source 1..334: mol_type = genomic DNA

SEQ ID NO: 119905 - DNA, 214 bp, Homo sapiens; identical to SEQ ID NO: 87992
  misc_feature 1..214: note = chr20:58508688-58508902
  misc_feature 1..214: note = Hyper
  source 1..214: mol_type = genomic DNA

SEQ ID NO: 119906 - DNA, 303 bp, Homo sapiens; identical to SEQ ID NO: 46268
  misc_feature 1..303: note = chr20:58514097-58514400
  misc_feature 1..303: note = Hypo
  source 1..303: mol_type = genomic DNA

SEQ ID NO: 119907 - DNA, 119 bp, Homo sapiens; identical to SEQ ID NO: 87994
  misc_feature 1..119: note = chr20:58514726-58514845
  misc_feature 1..119: note = Hyper
  source 1..119: mol_type = genomic DNA

SEQ ID NO: 119908 - DNA, 33 bp, Homo sapiens; identical to SEQ ID NO: 87995
  misc_feature 1..33: note = chr20:58530899-58530932
  misc_feature 1..33: note = Hypo
  source 1..33: mol_type = genomic DNA

SEQ ID NO: 119909 - DNA, 30 bp, Homo sapiens; identical to SEQ ID NO: 87996
  misc_feature 1..30: note = chr20:58575987-58576017
  misc_feature 1..30: note = Hypo
  source 1..30: mol_type = genomic DNA

SEQ ID NO: 119910 - DNA, 30 bp, Homo sapiens; identical to SEQ ID NO: 87997
  misc_feature 1..30: note = chr20:58584637-58584667
  misc_feature 1..30: note = Hypo
  source 1..30: mol_type = genomic DNA

SEQ ID NO: 119911 - DNA, 177 bp, Homo sapiens; identical to SEQ ID NO: 87998
  misc_feature 1..177: note = chr20:58663181-58663358
  misc_feature 1..177: note = Hypo
  source 1..177: mol_type = genomic DNA

SEQ ID NO: 119912 - DNA, 30 bp, Homo sapiens; identical to SEQ ID NO: 46269
  misc_feature 1..30: note = chr20:58671797-58671827
  misc_feature 1..30: note = Hypo
  source 1..30: mol_type = genomic DNA

SEQ ID NO: 119913 - DNA, 139 bp, Homo sapiens; identical to SEQ ID NO: 88000
  misc_feature 1..139: note = chr20:58682833-58682972
  misc_feature 1..139: note = Hypo
  source 1..139: mol_type = genomic DNA

SEQ ID NO: 119914 - DNA, 161 bp, Homo sapiens; identical to SEQ ID NO: 88001
  misc_feature 1..161: note = chr20:58779025-58779186
  misc_feature 1..161: note = Hypo
  source 1..161: mol_type = genomic DNA

SEQ ID NO: 119915 - DNA, 30 bp, Homo sapiens; identical to SEQ ID NO: 88003
  misc_feature 1..30: note = chr20:58939020-58939050
  misc_feature 1..30: note = Hypo
  source 1..30: mol_type = genomic DNA

SEQ ID NO: 119916 - DNA, 175 bp, Homo sapiens; identical to SEQ ID NO: 88004
  misc_feature 1..175: note = chr20:59005702-59005877
  misc_feature 1..175: note = Hypo
  source 1..175: mol_type = genomic DNA

SEQ ID NO: 119917 - DNA, 30 bp, Homo sapiens; identical to SEQ ID NO: 88007
  misc_feature 1..30: note = chr20:59142135-59142165
  misc_feature 1..30: note = Hypo
  source 1..30: mol_type = genomic DNA

SEQ ID NO: 119918 - DNA, 30 bp, Homo sapiens; identical to SEQ ID NO: 88008
  misc_feature 1..30: note = chr20:59174643-59174673
  misc_feature 1..30: note = Hypo
  source 1..30: mol_type = genomic DNA

SEQ ID NO: 119919 - DNA, 31 bp, Homo sapiens; identical to SEQ ID NO: 46271
  misc_feature 1..31: note = chr20:59185805-59185836
  misc_feature 1..31: note = Hypo
  source 1..31: mol_type = genomic DNA

SEQ ID NO: 119920 - DNA, 162 bp, Homo sapiens; identical to SEQ ID NO: 88010
  misc_feature 1..162: note = chr20:59198071-59198233
  misc_feature 1..162: note = Hypo
  source 1..162: mol_type = genomic DNA

SEQ ID NO: 119921 - DNA, 193 bp, Homo sapiens; identical to SEQ ID NO: 88011
  misc_feature 1..193: note = chr20:59232938-59233131
  misc_feature 1..193: note = Hypo
  source 1..193: mol_type = genomic DNA

SEQ ID NO: 119922 - DNA, 33 bp, Homo sapiens; identical to SEQ ID NO: 88013
  misc_feature 1..33: note = chr20:59443920-59443953
  misc_feature 1..33: note = Hypo
  source 1..33: mol_type = genomic DNA

SEQ ID NO: 119923 - DNA, 30 bp, Homo sapiens; identical to SEQ ID NO: 88014
  misc_feature 1..30: note = chr20:59515105-59515135
  misc_feature 1..30: note = Hypo
  source 1..30: mol_type = genomic DNA

SEQ ID NO: 119924 - DNA, 30 bp, Homo sapiens; identical to SEQ ID NO: 88015
  misc_feature 1..30: note = chr20:59553124-59553154
  misc_feature 1..30: note = Hypo
  source 1..30: mol_type = genomic DNA

SEQ ID NO: 119925 - DNA, 30 bp, Homo sapiens; identical to SEQ ID NO: 88016
  misc_feature 1..30: note = chr20:59565753-59565783
  misc_feature 1..30: note = Hypo
  source 1..30: mol_type = genomic DNA

SEQ ID NO: 119926 - DNA, 267 bp, Homo sapiens; identical to SEQ ID NO: 88017
  misc_feature 1..267: note = chr20:59598638-59598905
  misc_feature 1..267: note = Hypo
  source 1..267: mol_type = genomic DNA

SEQ ID NO: 119927 - DNA, 19 bp, Homo sapiens
  misc_feature 1..19: note = chr20:59599221-59599240
  misc_feature 1..19: note = Hypo
  source 1..19: mol_type = genomic DNA
cactcgcagggagcccccc

SEQ ID NO: 119928 - DNA, 43 bp, Homo sapiens; identical to SEQ ID NO: 88019
  misc_feature 1..43: note = chr20:59640929-59640972
  misc_feature 1..43: note = Hypo
  source 1..43: mol_type = genomic DNA

SEQ ID NO: 119929 - DNA, 164 bp, Homo sapiens; identical to SEQ ID NO: 88020
  misc_feature 1..164: note = chr20:59643279-59643443
  misc_feature 1..164: note = Hypo
  source 1..164: mol_type = genomic DNA

SEQ ID NO: 119930 - DNA, 185 bp, Homo sapiens; identical to SEQ ID NO: 46274
  misc_feature 1..185: note = chr20:59708146-59708331
  misc_feature 1..185: note = Hypo
  source 1..185: mol_type = genomic DNA

SEQ ID NO: 119931 - DNA, 30 bp, Homo sapiens; identical to SEQ ID NO: 88022
  misc_feature 1..30: note = chr20:59715030-59715060
  misc_feature 1..30: note = Hypo
  source 1..30: mol_type = genomic DNA

SEQ ID NO: 119932 - DNA, 215 bp, Homo sapiens; identical to SEQ ID NO: 88023
  misc_feature 1..215: note = chr20:59801639-59801854
  misc_feature 1..215: note = Hypo
  source 1..215: mol_type = genomic DNA

SEQ ID NO: 119933 - DNA, 131 bp, Homo sapiens; identical to SEQ ID NO: 88024
  misc_feature 1..131: note = chr20:59804316-59804447
  misc_feature 1..131: note = Hyper
  source 1..131: mol_type = genomic DNA

SEQ ID NO: 119934 - DNA, 94 bp, Homo sapiens; identical to SEQ ID NO: 46275
  misc_feature 1..94: note = chr20:59821803-59821897
  misc_feature 1..94: note = Hypo
  source 1..94: mol_type = genomic DNA

SEQ ID NO: 119935 - DNA, 2397 bp, Homo sapiens
  misc_feature 1..2397: note = chr20:59826877-59829274
  misc_feature 1..2397: note = Hyper
  source 1..2397: mol_type = genomic DNA
cacccctgagctgcccgacctgggttcaagcccgggtcaggggagttagcaaggagacacctgaaaaataaaaggacagaatggaagtgcacactcccaccgcgggcccgggcgggaagtcggactaagaccgcggcgggaccgccccatccagaaagggtgccccgggtgtgggggcggaaaccccagcgctgtcttcagtctccacacccgcgcctttttcccctggaaaacgagcgtccttggcctcttcggccgcaaccgggcggctccagacgtccaggagggcagaggctgggctggtgcggcgcggggggcgcgggcgcgggctctgcgcctttaaggcccgcgtcggcagagcgagcgcaggggccgggcggcggggcggggcctcggcggggcggccgcggcttcacctgcagctccgagcgcgcggaacagaggcgcgggcggctgcgaggccggcggacgcaccggcccgagggaacgcgccgccggccggacttggcctggctcccggagccggggcggcgagcgcggcgggcgcagcggggctggaggctccgggcaggcgcgggggagcggcggcggcggcggcgatcggagcggcggcggtggtctcggcggcggcggcggcggcggcggcagggagcgggctcccggtgccgggcaccgggcgggcggcggggaagatgaccgcgggcgccggcgtgctccttctgctgctctcgctctccggcgcgctccgggtaagttgccgcctcccgcccccgccgttcggaagccccgggcagcgggaggtcgtccccggatcccgcggggcgctcacacacccggcggggctctcccgggctcccccgccgcgctccccgctgcatccagcccggcgcccgcgctcggcgaagctgcctgcggtcggcaggagcgggaagccgcctgggcagcggggagcggcggagcagggtgggagtggggctcggtggaggacccggggagctccgcctgcaccggacccgccgagcctccctcgaacgcccaaagcccgtagccgctacccggagctcggcttgcctgcatggggcaggcttccactggcggagccggcgcgccctccatcgcccgggagccgcgcgccgcgggagttgccgagcccagccccggccgtggctgaaggcgtggggcgcccggcggctgcgggccagggatccgcgagtgcggggcgcctgcccgacctctcctgcccaaggcctgggggtccgtctagcggcgccgctcagttctgtgggtgccggcaggacccgcgctgcgggtgggcggcggggtaggactgcggggcactctcacccccgagccctcggcggggctggagcctgcgtgtccggcggggccccgggggctgggagctgggccgggcttgggccgggaagccggacgccgggcgggcgcggcgcgggagggcgccccgggagggcgagcgggtctcccgctgcctctgcagagccccgcgggccggattgccagctttgctctgcgcctggcgaggtgcgcggcccgcgggggcagagagcgcggcggctccgggggcgcccctgggcggaggcggaggggcggcgggagttgcaggaaccccctctcgtggccgatcggcctcgctgccttctcccgggcagcgctgttgtaacctcggaaataaacaagtgccagcggcgggaggcccgctccgaggccgcggggcgctgggggacgcgctgggcacacgcttcgggcgggcggaaactttcctgggcgagttgagcctcccaccgggctgcgggtgcgatttggagcttcgtggccgatgaagaaagccgcggtttagagcttttcgtaaggaatgaccctgcgtcccgctctcctccctcggtgctgggggtagaggggcgccctccgcggtgccggcgtcgggaagcctggagctccgggctgggggcggcctccggagtcgaagcatgggcgggcgacggcagcgcgcggagctggaggaggcggcgggcgggaggcgccactgcccggtgcgggctgcacccgaggcttcctgcgctcgccggggagccaagcaccgctgtgctcctgctccttcagcggggctggcttcccgcttgcacacactgcctctccctccaccacctcctcctgcctgtcacgccccctcccagaagcttggtcggagggccctgtcgtccaccccatccttccctggccctgtgccatgggctctagacttccccactgagcaggaaaggcgagcgagctccggaggacaggaggagaccccctttccggtcagttaggggagccgtctccctgcctgggctggagatgggggctccgagggtgaaaatgcgggctgaagactag

SEQ ID NO: 119936 - DNA, 30 bp, Homo sapiens; identical to SEQ ID NO: 46276
  misc_feature 1..30: note = chr20:59855416-59855446
  misc_feature 1..30: note = Hypo
  source 1..30: mol_type = genomic DNA

SEQ ID NO: 119937 - DNA, 182 bp, Homo sapiens; identical to SEQ ID NO: 88031
  misc_feature 1..182: note = chr20:59874095-59874277
  misc_feature 1..182: note = Hypo
  source 1..182: mol_type = genomic DNA

SEQ ID NO: 119938 - DNA, 202 bp, Homo sapiens; identical to SEQ ID NO: 88032
  misc_feature 1..202: note = chr20:59880558-59880760
  misc_feature 1..202: note = Hypo
  source 1..202: mol_type = genomic DNA

SEQ ID NO: 119939 - DNA, 88 bp, Homo sapiens; identical to SEQ ID NO: 88033
  misc_feature 1..88: note = chr20:59892038-59892126
  misc_feature 1..88: note = Hypo
  source 1..88: mol_type = genomic DNA

SEQ ID NO: 119940 - DNA, 180 bp, Homo sapiens; identical to SEQ ID NO: 88034
  misc_feature 1..180: note = chr20:59910173-59910353
  misc_feature 1..180: note = Hypo
  source 1..180: mol_type = genomic DNA

SEQ ID NO: 119941 - DNA, 30 bp, Homo sapiens; identical to SEQ ID NO: 88035
  misc_feature 1..30: note = chr20:59960789-59960819
  misc_feature 1..30: note = Hypo
  source 1..30: mol_type = genomic DNA

SEQ ID NO: 119942 - DNA, 30 bp, Homo sapiens; identical to SEQ ID NO: 88036
  misc_feature 1..30: note = chr20:59967348-59967378
  misc_feature 1..30: note = Hypo
  source 1..30: mol_type = genomic DNA

SEQ ID NO: 119943 - DNA, 50 bp, Homo sapiens; identical to SEQ ID NO: 88037
  misc_feature 1..50: note = chr20:59967982-59968032
  misc_feature 1..50: note = Hypo
  source 1..50: mol_type = genomic DNA

SEQ ID NO: 119944 - DNA, 176 bp, Homo sapiens; identical to SEQ ID NO: 88038
  misc_feature 1..176: note = chr20:59971512-59971688
  misc_feature 1..176: note = Hypo
  source 1..176: mol_type = genomic DNA

SEQ ID NO: 119945 - DNA, 30 bp, Homo sapiens; identical to SEQ ID NO: 88039
  misc_feature 1..30: note = chr20:59972407-59972437
  misc_feature 1..30: note = Hypo
  source 1..30: mol_type = genomic DNA

SEQ ID NO: 119946 - DNA, 70 bp, Homo sapiens; identical to SEQ ID NO: 46279
  misc_feature 1..70: note = chr20:59973035-59973105
  misc_feature 1..70: note = Hypo
  source 1..70: mol_type = genomic DNA

SEQ ID NO: 119947 - DNA, 138 bp, Homo sapiens; identical to SEQ ID NO: 88041
  misc_feature 1..138: note = chr20:59981017-59981155
  misc_feature 1..138: note = Hypo
  source 1..138: mol_type = genomic DNA

SEQ ID NO: 119948 - DNA, 104 bp, Homo sapiens; identical to SEQ ID NO: 88042
  misc_feature 1..104: note = chr20:60000590-60000694
  misc_feature 1..104: note = Hypo
  source 1..104: mol_type = genomic DNA

SEQ ID NO: 119949 - DNA, 145 bp, Homo sapiens; identical to SEQ ID NO: 88043
  misc_feature 1..145: note = chr20:60029813-60029958
  misc_feature 1..145: note = Hypo
  source 1..145: mol_type = genomic DNA

SEQ ID NO: 119950 - DNA, 61 bp, Homo sapiens; identical to SEQ ID NO: 88044
  misc_feature 1..61: note = chr20:60055460-60055521
  misc_feature 1..61: note = Hypo
  source 1..61: mol_type = genomic DNA

SEQ ID NO: 119951 - DNA, 176 bp, Homo sapiens; identical to SEQ ID NO: 88045
  misc_feature 1..176: note = chr20:60093092-60093268
  misc_feature 1..176: note = Hypo
  source 1..176: mol_type = genomic DNA

SEQ ID NO: 119952 - DNA, 46 bp, Homo sapiens; identical to SEQ ID NO: 88046
  misc_feature 1..46: note = chr20:60098210-60098256
  misc_feature 1..46: note = Hypo
  source 1..46: mol_type = genomic DNA

SEQ ID NO: 119953 - DNA, 30 bp, Homo sapiens; identical to SEQ ID NO: 88047
  misc_feature 1..30: note = chr20:60108382-60108412
  misc_feature 1..30: note = Hypo
  source 1..30: mol_type = genomic DNA

SEQ ID NO: 119954 - DNA, 30 bp, Homo sapiens; identical to SEQ ID NO: 88048
  misc_feature 1..30: note = chr20:60114113-60114143
  misc_feature 1..30: note = Hypo
  source 1..30: mol_type = genomic DNA

SEQ ID NO: 119955 - DNA, 78 bp, Homo sapiens; identical to SEQ ID NO: 88049
  misc_feature 1..78: note = chr20:60119581-60119659
  misc_feature 1..78: note = Hypo
  source 1..78: mol_type = genomic DNA

SEQ ID NO: 119956 - DNA, 180 bp, Homo sapiens; identical to SEQ ID NO: 88050
  misc_feature 1..180: note = chr20:60120703-60120883
  misc_feature 1..180: note = Hypo
  source 1..180: mol_type = genomic DNA

SEQ ID NO: 119957 - DNA, 30 bp, Homo sapiens; identical to SEQ ID NO: 46281
  misc_feature 1..30: note = chr20:60121193-60121223
  misc_feature 1..30: note = Hypo
  source 1..30: mol_type = genomic DNA

SEQ ID NO: 119958 - DNA, 30 bp, Homo sapiens; identical to SEQ ID NO: 46282
  misc_feature 1..30: note = chr20:60122026-60122056
  misc_feature 1..30: note = Hypo
  source 1..30: mol_type = genomic DNA

SEQ ID NO: 119959 - DNA, 30 bp, Homo sapiens; identical to SEQ ID NO: 88053
  misc_feature 1..30: note = chr20:60146355-60146385
  misc_feature 1..30: note = Hypo
  source 1..30: mol_type = genomic DNA

SEQ ID NO: 119960 - DNA, 30 bp, Homo sapiens; identical to SEQ ID NO: 88054
  misc_feature 1..30: note = chr20:60154658-60154688
  misc_feature 1..30: note = Hypo
  source 1..30: mol_type = genomic DNA

SEQ ID NO: 119961 - DNA, 30 bp, Homo sapiens; identical to SEQ ID NO: 88055
  misc_feature 1..30: note = chr20:60155641-60155671
  misc_feature 1..30: note = Hypo
  source 1..30: mol_type = genomic DNA

SEQ ID NO: 119962 - DNA, 210 bp, Homo sapiens; identical to SEQ ID NO: 88056
  misc_feature 1..210: note = chr20:60162590-60162800
  misc_feature 1..210: note = Hypo
  source 1..210: mol_type = genomic DNA

SEQ ID NO: 119963 - DNA, 188 bp, Homo sapiens; identical to SEQ ID NO: 88057
  misc_feature 1..188: note = chr20:60170770-60170958
  misc_feature 1..188: note = Hypo
  source 1..188: mol_type = genomic DNA

SEQ ID NO: 119964 - DNA, 30 bp, Homo sapiens; identical to SEQ ID NO: 46284
  misc_feature 1..30: note = chr20:60174306-60174336
  misc_feature 1..30: note = Hypo
  source 1..30: mol_type = genomic DNA

SEQ ID NO: 119965 - DNA, 173 bp, Homo sapiens; identical to SEQ ID NO: 88059
  misc_feature 1..173: note = chr20:60175455-60175628
  misc_feature 1..173: note = Hypo
  source 1..173: mol_type = genomic DNA

SEQ ID NO: 119966 - DNA, 192 bp, Homo sapiens; identical to SEQ ID NO: 88060
  misc_feature 1..192: note = chr20:60176588-60176780
  misc_feature 1..192: note = Hypo
  source 1..192: mol_type = genomic DNA

SEQ ID NO: 119967 - DNA, 30 bp, Homo sapiens; identical to SEQ ID NO: 88061
  misc_feature 1..30: note = chr20:60194960-60194990
  misc_feature 1..30: note = Hypo
  source 1..30: mol_type = genomic DNA

SEQ ID NO: 119968 - DNA, 42 bp, Homo sapiens; identical to SEQ ID NO: 88062
  misc_feature 1..42: note = chr20:60202364-60202406
  misc_feature 1..42: note = Hypo
  source 1..42: mol_type = genomic DNA

SEQ ID NO: 119969 - DNA, 30 bp, Homo sapiens; identical to SEQ ID NO: 16635
  misc_feature 1..30: note = chr20:60202615-60202645
  misc_feature 1..30: note = Hypo
  source 1..30: mol_type = genomic DNA

SEQ ID NO: 119970 - DNA, 160 bp, Homo sapiens; identical to SEQ ID NO: 88064
  misc_feature 1..160: note = chr20:60210054-60210214
  misc_feature 1..160: note = Hypo
  source 1..160: mol_type = genomic DNA

SEQ ID NO: 119971 - DNA, 174 bp, Homo sapiens; identical to SEQ ID NO: 88065
  misc_feature 1..174: note = chr20:60225024-60225198
  misc_feature 1..174: note = Hypo
  source 1..174: mol_type = genomic DNA

SEQ ID NO: 119972 - DNA, 182 bp, Homo sapiens; identical to SEQ ID NO: 46291
  misc_feature 1..182: note = chr20:60227182-60227364
  misc_feature 1..182: note = Hypo
  source 1..182: mol_type = genomic DNA

SEQ ID NO: 119973 - DNA, 378 bp, Homo sapiens; identical to SEQ ID NO: 88068
  misc_feature 1..378: note = chr20:60235329-60235707
  misc_feature 1..378: note = Hypo
  source 1..378: mol_type = genomic DNA

SEQ ID NO: 119974 - DNA, 158 bp, Homo sapiens; identical to SEQ ID NO: 46293
  misc_feature 1..158: note = chr20:60237356-60237514
  misc_feature 1..158: note = Hypo
  source 1..158: mol_type = genomic DNA

SEQ ID NO: 119975 - DNA, 205 bp, Homo sapiens; identical to SEQ ID NO: 88070
  misc_feature 1..205: note = chr20:60238291-60238496
  misc_feature 1..205: note = Hypo
  source 1..205: mol_type = genomic DNA

SEQ ID NO: 119976 - DNA, 199 bp, Homo sapiens; identical to SEQ ID NO: 46295
  misc_feature 1..199: note = chr20:60238848-60239047
  misc_feature 1..199: note = Hypo
  source 1..199: mol_type = genomic DNA

SEQ ID NO: 119977 - DNA, 190 bp, Homo sapiens; identical to SEQ ID NO: 88072
  misc_feature 1..190: note = chr20:60243944-60244134
  misc_feature 1..190: note = Hypo
  source 1..190: mol_type = genomic DNA

SEQ ID NO: 119978 - DNA, 38 bp, Homo sapiens; identical to SEQ ID NO: 88073
  misc_feature 1..38: note = chr20:60261634-60261672
  misc_feature 1..38: note = Hypo
  source 1..38: mol_type = genomic DNA

SEQ ID NO: 119979 - DNA, 192 bp, Homo sapiens; identical to SEQ ID NO: 88074
  misc_feature 1..192: note = chr20:60272958-60273150
  misc_feature 1..192: note = Hypo
  source 1..192: mol_type = genomic DNA

SEQ ID NO: 119980 - DNA, 474 bp, Homo sapiens; identical to SEQ ID NO: 88075
  misc_feature 1..474: note = chr20:60281403-60281877
  misc_feature 1..474: note = Hypo
  source 1..474: mol_type = genomic DNA

SEQ ID NO: 119981 - DNA, 52 bp, Homo sapiens; identical to SEQ ID NO: 88076
  misc_feature 1..52: note = chr20:60299388-60299440
  misc_feature 1..52: note = Hypo
  source 1..52: mol_type = genomic DNA

SEQ ID NO: 119982 - DNA, 183 bp, Homo sapiens; identical to SEQ ID NO: 46299
  misc_feature 1..183: note = chr20:60304145-60304328
  misc_feature 1..183: note = Hypo
  source 1..183: mol_type = genomic DNA

SEQ ID NO: 119983 - DNA, 30 bp, Homo sapiens; identical to SEQ ID NO: 88078
  misc_feature 1..30: note = chr20:60306675-60306705
  misc_feature 1..30: note = Hypo
  source 1..30: mol_type = genomic DNA

SEQ ID NO: 119984 - DNA, 166 bp, Homo sapiens; identical to SEQ ID NO: 88079
  misc_feature 1..166: note = chr20:60312484-60312650
  misc_feature 1..166: note = Hypo
  source 1..166: mol_type = genomic DNA

SEQ ID NO: 119985 - DNA, 77 bp, Homo sapiens; identical to SEQ ID NO: 88081
  misc_feature 1..77: note = chr20:60329584-60329661
  misc_feature 1..77: note = Hypo
  source 1..77: mol_type = genomic DNA

SEQ ID NO: 119986 - DNA, 30 bp, Homo sapiens; identical to SEQ ID NO: 88083
  misc_feature 1..30: note = chr20:60334621-60334651
  misc_feature 1..30: note = Hypo
  source 1..30: mol_type = genomic DNA

SEQ ID NO: 119987 - DNA, 25 bp, Homo sapiens
  misc_feature 1..25: note = chr20:60352677-60352702
  misc_feature 1..25: note = Hypo
  source 1..25: mol_type = genomic DNA
gcatacaaaaacacacgtctacaca

SEQ ID NO: 119988 - DNA, 56 bp, Homo sapiens; identical to SEQ ID NO: 46301
  misc_feature 1..56: note = chr20:60355322-60355378
  misc_feature 1..56: note = Hypo
  source 1..56: mol_type = genomic DNA

SEQ ID NO: 119989 - DNA, 130 bp, Homo sapiens; identical to SEQ ID NO: 46302
  misc_feature 1..130: note = chr20:60359749-60359879
  misc_feature 1..130: note = Hypo
  source 1..130: mol_type = genomic DNA

SEQ ID NO: 119990 - DNA, 30 bp, Homo sapiens; identical to SEQ ID NO: 88087
  misc_feature 1..30: note = chr20:60373650-60373680
  misc_feature 1..30: note = Hypo
  source 1..30: mol_type = genomic DNA

SEQ ID NO: 119991 - DNA, 468 bp, Homo sapiens; identical to SEQ ID NO: 88088
  misc_feature 1..468: note = chr20:60374909-60375377
  misc_feature 1..468: note = Hypo
  source 1..468: mol_type = genomic DNA

SEQ ID NO: 119992 - DNA, 30 bp, Homo sapiens; identical to SEQ ID NO: 88089
  misc_feature 1..30: note = chr20:60377972-60378002
  misc_feature 1..30: note = Hypo
  source 1..30: mol_type = genomic DNA

SEQ ID NO: 119993 - DNA, 30 bp, Homo sapiens; identical to SEQ ID NO: 88090
  misc_feature 1..30: note = chr20:60382783-60382813
  misc_feature 1..30: note = Hypo
  source 1..30: mol_type = genomic DNA

SEQ ID NO: 119994 - DNA, 181 bp, Homo sapiens; identical to SEQ ID NO: 88091
  misc_feature 1..181: note = chr20:60385207-60385388
  misc_feature 1..181: note = Hypo
  source 1..181: mol_type = genomic DNA

SEQ ID NO: 119995 - DNA, 30 bp, Homo sapiens; identical to SEQ ID NO: 88092
  misc_feature 1..30: note = chr20:60394427-60394457
  misc_feature 1..30: note = Hypo
  source 1..30: mol_type = genomic DNA

SEQ ID NO: 119996 - DNA, 463 bp, Homo sapiens; identical to SEQ ID NO: 88093
  misc_feature 1..463: note = chr20:60415711-60416174
  misc_feature 1..463: note = Hypo
  source 1..463: mol_type = genomic DNA

SEQ ID NO: 119997 - DNA, 72 bp, Homo sapiens; identical to SEQ ID NO: 46306
  misc_feature 1..72: note = chr20:60428149-60428221
  misc_feature 1..72: note = Hypo
  source 1..72: mol_type = genomic DNA

SEQ ID NO: 119998 - DNA, 30 bp, Homo sapiens; identical to SEQ ID NO: 88095
  misc_feature 1..30: note = chr20:60433992-60434022
  misc_feature 1..30: note = Hypo
  source 1..30: mol_type = genomic DNA

SEQ ID NO: 119999 - DNA, 30 bp, Homo sapiens; identical to SEQ ID NO: 88096
  misc_feature 1..30: note = chr20:60434822-60434852
  misc_feature 1..30: note = Hypo
  source 1..30: mol_type = genomic DNA

SEQ ID NO: 120000 - DNA, 30 bp, Homo sapiens; identical to SEQ ID NO: 88097
  misc_feature 1..30: note = chr20:60436260-60436290
  misc_feature 1..30: note = Hypo
  source 1..30: mol_type = genomic DNA

SEQ ID NO: 120001 - DNA, 249 bp, Homo sapiens; identical to SEQ ID NO: 88098
  misc_feature 1..249: note = chr20:60439571-60439820
  misc_feature 1..249: note = Hypo
  source 1..249: mol_type = genomic DNA

SEQ ID NO: 120002 - DNA, 77 bp, Homo sapiens; identical to SEQ ID NO: 88099
  misc_feature 1..77: note = chr20:60447432-60447509
  misc_feature 1..77: note = Hypo
  source 1..77: mol_type = genomic DNA

SEQ ID NO: 120003 - DNA, 297 bp, Homo sapiens; identical to SEQ ID NO: 88100
  misc_feature 1..297: note = chr20:60448654-60448951
  misc_feature 1..297: note = Hypo
  source 1..297: mol_type = genomic DNA

SEQ ID NO: 120004 - DNA, 134 bp, Homo sapiens; identical to SEQ ID NO: 88101
  misc_feature 1..134: note = chr20:60449362-60449496
  misc_feature 1..134: note = Hypo
  source 1..134: mol_type = genomic DNA

SEQ ID NO: 120005 - DNA, 168 bp, Homo sapiens; identical to SEQ ID NO: 88102
  misc_feature 1..168: note = chr20:60452936-60453104
  misc_feature 1..168: note = Hypo
  source 1..168: mol_type = genomic DNA

SEQ ID NO: 120006 - DNA, 183 bp, Homo sapiens; identical to SEQ ID NO: 88103
  misc_feature 1..183: note = chr20:60453914-60454097
  misc_feature 1..183: note = Hypo
  source 1..183: mol_type = genomic DNA

SEQ ID NO: 120007 - DNA, 201 bp, Homo sapiens; identical to SEQ ID NO: 88104
  misc_feature 1..201: note = chr20:60454704-60454905
  misc_feature 1..201: note = Hypo
  source 1..201: mol_type = genomic DNA

SEQ ID NO: 120008 - DNA, 202 bp, Homo sapiens; identical to SEQ ID NO: 88105
  misc_feature 1..202: note = chr20:60457120-60457322
  misc_feature 1..202: note = Hypo
  source 1..202: mol_type = genomic DNA

SEQ ID NO: 120009 - DNA, 193 bp, Homo sapiens; identical to SEQ ID NO: 88106
  misc_feature 1..193: note = chr20:60460819-60461012
  misc_feature 1..193: note = Hypo
  source 1..193: mol_type = genomic DNA

SEQ ID NO: 120010 - DNA, 71 bp, Homo sapiens; identical to SEQ ID NO: 88107
  misc_feature 1..71: note = chr20:60470186-60470257
  misc_feature 1..71: note = Hypo
  source 1..71: mol_type = genomic DNA

SEQ ID NO: 120011 - DNA, 30 bp, Homo sapiens; identical to SEQ ID NO: 88108
  misc_feature 1..30: note = chr20:60473115-60473145
  misc_feature 1..30: note = Hypo
  source 1..30: mol_type = genomic DNA

SEQ ID NO: 120012 - DNA, 89 bp, Homo sapiens; identical to SEQ ID NO: 88109
  misc_feature 1..89: note = chr20:60476718-60476807
  misc_feature 1..89: note = Hypo
  source 1..89: mol_type = genomic DNA

SEQ ID NO: 120013 - DNA, 273 bp, Homo sapiens; identical to SEQ ID NO: 88110
  misc_feature 1..273: note = chr20:60477306-60477579
  misc_feature 1..273: note = Hypo
  source 1..273: mol_type = genomic DNA

SEQ ID NO: 120014 - DNA, 388 bp, Homo sapiens; identical to SEQ ID NO: 88111
  misc_feature 1..388: note = chr20:60485016-60485404
  misc_feature 1..388: note = Hypo
  source 1..388: mol_type = genomic DNA

SEQ ID NO: 120015 - DNA, 44 bp, Homo sapiens; identical to SEQ ID NO: 88112
  misc_feature 1..44: note = chr20:60489317-60489361
  misc_feature 1..44: note = Hypo
  source 1..44: mol_type = genomic DNA

SEQ ID NO: 120016 - DNA, 38 bp, Homo sapiens; identical to SEQ ID NO: 88113
  misc_feature 1..38: note = chr20:60492770-60492808
  misc_feature 1..38: note = Hypo
  source 1..38: mol_type = genomic DNA

SEQ ID NO: 120017 - DNA, 30 bp, Homo sapiens; identical to SEQ ID NO: 88114
  misc_feature 1..30: note = chr20:60493093-60493123
  misc_feature 1..30: note = Hypo
  source 1..30: mol_type = genomic DNA

SEQ ID NO: 120018 - DNA, 49 bp, Homo sapiens; identical to SEQ ID NO: 88115
  misc_feature 1..49: note = chr20:60495112-60495161
  misc_feature 1..49: note = Hypo
  source 1..49: mol_type = genomic DNA

SEQ ID NO: 120019 - DNA, 35 bp, Homo sapiens; identical to SEQ ID NO: 88116
  misc_feature 1..35: note = chr20:60495405-60495440
  misc_feature 1..35: note = Hypo
  source 1..35: mol_type = genomic DNA

SEQ ID NO: 120020 - DNA, 30 bp, Homo sapiens; identical to SEQ ID NO: 88117
  misc_feature 1..30: note = chr20:60497438-60497468
  misc_feature 1..30: note = Hypo
  source 1..30: mol_type = genomic DNA

SEQ ID NO: 120021 - DNA, 112 bp, Homo sapiens; identical to SEQ ID NO: 88118
  misc_feature 1..112: note = chr20:60498996-60499108
  misc_feature 1..112: note = Hypo
  source 1..112: mol_type = genomic DNA

SEQ ID NO: 120022 - DNA, 111 bp, Homo sapiens; identical to SEQ ID NO: 46318
  misc_feature 1..111: note = chr20:60502200-60502311
  misc_feature 1..111: note = Hypo
  source 1..111: mol_type = genomic DNA

SEQ ID NO: 120023 - DNA, 474 bp, Homo sapiens; identical to SEQ ID NO: 88120
  misc_feature 1..474: note = chr20:60502586-60503060
  misc_feature 1..474: note = Hypo
  source 1..474: mol_type = genomic DNA

SEQ ID NO: 120024 - DNA, 124 bp, Homo sapiens; identical to SEQ ID NO: 88121
  misc_feature 1..124: note = chr20:60508103-60508227
  misc_feature 1..124: note = Hypo
  source 1..124: mol_type = genomic DNA

SEQ ID NO: 120025 - DNA, 82 bp, Homo sapiens; identical to SEQ ID NO: 88122
  misc_feature 1..82: note = chr20:60509238-60509320
  misc_feature 1..82: note = Hypo
  source 1..82: mol_type = genomic DNA

SEQ ID NO: 120026 - DNA, 194 bp, Homo sapiens; identical to SEQ ID NO: 88123
  misc_feature 1..194: note = chr20:60515808-60516002
  misc_feature 1..194: note = Hypo
  source 1..194: mol_type = genomic DNA

SEQ ID NO: 120027 - DNA, 101 bp, Homo sapiens; identical to SEQ ID NO: 88124
  misc_feature 1..101: note = chr20:60541029-60541130
  misc_feature 1..101: note = Hyper
  source 1..101: mol_type = genomic DNA

SEQ ID NO: 120028 - DNA, 36 bp, Homo sapiens; identical to SEQ ID NO: 88125
  misc_feature 1..36: note = chr20:60543265-60543301
  misc_feature 1..36: note = Hypo
  source 1..36: mol_type = genomic DNA

SEQ ID NO: 120029 - DNA, 53 bp, Homo sapiens; identical to SEQ ID NO: 88126
  misc_feature 1..53: note = chr20:60545005-60545058
  misc_feature 1..53: note = Hypo
  source 1..53: mol_type = genomic DNA

SEQ ID NO: 120030 - DNA, 30 bp, Homo sapiens; identical to SEQ ID NO: 88127
  misc_feature 1..30: note = chr20:60545266-60545296
  misc_feature 1..30: note = Hypo
  source 1..30: mol_type = genomic DNA

SEQ ID NO: 120031 - DNA, 272 bp, Homo sapiens; identical to SEQ ID NO: 88128
  misc_feature 1..272: note = chr20:60552065-60552337
  misc_feature 1..272: note = Hypo
  source 1..272: mol_type = genomic DNA

SEQ ID NO: 120032 - DNA, 45 bp, Homo sapiens; identical to SEQ ID NO: 88129
  misc_feature 1..45: note = chr20:60559225-60559270
  misc_feature 1..45: note = Hypo
  source 1..45: mol_type = genomic DNA

SEQ ID NO: 120033 - DNA, 114 bp, Homo sapiens; identical to SEQ ID NO: 88130
  misc_feature 1..114: note = chr20:60578759-60578873
  misc_feature 1..114: note = Hypo
  source 1..114: mol_type = genomic DNA

SEQ ID NO: 120034 - DNA, 48 bp, Homo sapiens; identical to SEQ ID NO: 88131
  misc_feature 1..48: note = chr20:60587262-60587310
  misc_feature 1..48: note = Hypo
  source 1..48: mol_type = genomic DNA

SEQ ID NO: 120035 - DNA, 39 bp, Homo sapiens; identical to SEQ ID NO: 88132
  misc_feature 1..39: note = chr20:60616133-60616172
  misc_feature 1..39: note = Hypo
  source 1..39: mol_type = genomic DNA

SEQ ID NO: 120036 - DNA, 30 bp, Homo sapiens; identical to SEQ ID NO: 88133
  misc_feature 1..30: note = chr20:60620307-60620337
  misc_feature 1..30: note = Hypo
  source 1..30: mol_type = genomic DNA

SEQ ID NO: 120037 - DNA, 45 bp, Homo sapiens; identical to SEQ ID NO: 88134
  misc_feature 1..45: note = chr20:60624858-60624903
  misc_feature 1..45: note = Hypo
  source 1..45: mol_type = genomic DNA

SEQ ID NO: 120038 - DNA, 30 bp, Homo sapiens; identical to SEQ ID NO: 88135
  misc_feature 1..30: note = chr20:60635093-60635123
  misc_feature 1..30: note = Hypo
  source 1..30: mol_type = genomic DNA

SEQ ID NO: 120039 - DNA, 30 bp, Homo sapiens; identical to SEQ ID NO: 88136
  misc_feature 1..30: note = chr20:60639275-60639305
  misc_feature 1..30: note = Hypo
  source 1..30: mol_type = genomic DNA

SEQ ID NO: 120040 - DNA, 130 bp, Homo sapiens; identical to SEQ ID NO: 88137
  misc_feature 1..130: note = chr20:60662678-60662808
  misc_feature 1..130: note = Hypo
  source 1..130: mol_type = genomic DNA

SEQ ID NO: 120041 - DNA, 32 bp, Homo sapiens; identical to SEQ ID NO: 88138
  misc_feature 1..32: note = chr20:60731152-60731184
  misc_feature 1..32: note = Hypo
  source 1..32: mol_type = genomic DNA

SEQ ID NO: 120042 - DNA, 39 bp, Homo sapiens; identical to SEQ ID NO: 88139
  misc_feature 1..39: note = chr20:60756179-60756218
  misc_feature 1..39: note = Hypo
  source 1..39: mol_type = genomic DNA

SEQ ID NO: 120043 - DNA, 22 bp, Homo sapiens
  misc_feature 1..22: note = chr20:60759136-60759158
  misc_feature 1..22: note = Hypo
  source 1..22: mol_type = genomic DNA
gggcgcggtggctcacgcctgt

SEQ ID NO: 120044 - DNA, 47 bp, Homo sapiens; identical to SEQ ID NO: 88141
  misc_feature 1..47: note = chr20:60766706-60766753
  misc_feature 1..47: note = Hypo
  source 1..47: mol_type = genomic DNA

SEQ ID NO: 120045 - DNA, 835 bp, Homo sapiens; identical to SEQ ID NO: 88142
  misc_feature 1..835: note = chr20:60772977-60773812
  misc_feature 1..835: note = Hypo
  source 1..835: mol_type = genomic DNA

SEQ ID NO: 120046 - DNA, 278 bp, Homo sapiens; identical to SEQ ID NO: 88143
  misc_feature 1..278: note = chr20:60781289-60781567
  misc_feature 1..278: note = Hypo
  source 1..278: mol_type = genomic DNA

SEQ ID NO: 120047 - DNA, 285 bp, Homo sapiens; identical to SEQ ID NO: 88144
  misc_feature 1..285: note = chr20:60789915-60790200
  misc_feature 1..285: note = Hypo
  source 1..285: mol_type = genomic DNA

SEQ ID NO: 120048 - DNA, 345 bp, Homo sapiens; identical to SEQ ID NO: 88145
  misc_feature 1..345: note = chr20:60794701-60795046
  misc_feature 1..345: note = Hyper
  source 1..345: mol_type = genomic DNA

SEQ ID NO: 120049 - DNA, 112 bp, Homo sapiens; identical to SEQ ID NO: 88146
  misc_feature 1..112: note = chr20:60795944-60796056
  misc_feature 1..112: note = Hyper
  source 1..112: mol_type = genomic DNA

SEQ ID NO: 120050 - DNA, 47 bp, Homo sapiens; identical to SEQ ID NO: 88147
  misc_feature 1..47: note = chr20:60796491-60796538
  misc_feature 1..47: note = Hyper
  source 1..47: mol_type = genomic DNA

SEQ ID NO: 120051 - DNA, 34 bp, Homo sapiens; identical to SEQ ID NO: 46327
  misc_feature 1..34: note = chr20:60803825-60803859
  misc_feature 1..34: note = Hypo
  source 1..34: mol_type = genomic DNA

SEQ ID NO: 120052 - DNA, 27 bp, Homo sapiens
  misc_feature 1..27: note = chr20:60816241-60816268
  misc_feature 1..27: note = Hypo
  source 1..27: mol_type = genomic DNA
tttgagatggagtctcgctctgtcgcc

SEQ ID NO: 120053 - DNA, 30 bp, Homo sapiens; identical to SEQ ID NO: 88150
  misc_feature 1..30: note = chr20:60816656-60816686
  misc_feature 1..30: note = Hypo
  source 1..30: mol_type = genomic DNA

SEQ ID NO: 120054 - DNA, 30 bp, Homo sapiens; identical to SEQ ID NO: 88151
  misc_feature 1..30: note = chr20:60856371-60856401
  misc_feature 1..30: note = Hypo
  source 1..30: mol_type = genomic DNA

SEQ ID NO: 120055 - DNA, 30 bp, Homo sapiens; identical to SEQ ID NO: 88152
  misc_feature 1..30: note = chr20:60856862-60856892
  misc_feature 1..30: note = Hypo
  source 1..30: mol_type = genomic DNA

SEQ ID NO: 120056 - DNA, 30 bp, Homo sapiens; identical to SEQ ID NO: 88153
  misc_feature 1..30: note = chr20:60894037-60894067
  misc_feature 1..30: note = Hypo
  source 1..30: mol_type = genomic DNA

SEQ ID NO: 120057 - DNA, 30 bp, Homo sapiens; identical to SEQ ID NO: 88154
  misc_feature 1..30: note = chr20:60903333-60903363
  misc_feature 1..30: note = Hypo
  source 1..30: mol_type = genomic DNA

SEQ ID NO: 120058 - DNA, 59 bp, Homo sapiens; identical to SEQ ID NO: 88155
  misc_feature 1..59: note = chr20:60905951-60906010
  misc_feature 1..59: note = Hypo
  source 1..59: mol_type = genomic DNA

SEQ ID NO: 120059 - DNA, 40 bp, Homo sapiens; identical to SEQ ID NO: 88156
  misc_feature 1..40: note = chr20:60909496-60909536
  misc_feature 1..40: note = Hypo
  source 1..40: mol_type = genomic DNA

SEQ ID NO: 120060 - DNA, 153 bp, Homo sapiens; identical to SEQ ID NO: 88157
  misc_feature 1..153: note = chr20:60921151-60921304
  misc_feature 1..153: note = Hypo
  source 1..153: mol_type = genomic DNA

SEQ ID NO: 120061 - DNA, 498 bp, Homo sapiens; identical to SEQ ID NO: 88158
  misc_feature 1..498: note = chr20:60921525-60922023
  misc_feature 1..498: note = Hypo
  source 1..498: mol_type = genomic DNA

SEQ ID NO: 120062 - DNA, 154 bp, Homo sapiens; identical to SEQ ID NO: 88159
  misc_feature 1..154: note = chr20:60922248-60922402
  misc_feature 1..154: note = Hypo
  source 1..154: mol_type = genomic DNA

SEQ ID NO: 120063 - DNA, 260 bp, Homo sapiens; identical to SEQ ID NO: 46332
  misc_feature 1..260: note = chr20:60925281-60925541
  misc_feature 1..260: note = Hypo
  source 1..260: mol_type = genomic DNA

SEQ ID NO: 120064 - DNA, 224 bp, Homo sapiens; identical to SEQ ID NO: 88161
  misc_feature 1..224: note = chr20:60925825-60926049
  misc_feature 1..224: note = Hypo
  source 1..224: mol_type = genomic DNA

SEQ ID NO: 120065 - DNA, 37 bp, Homo sapiens; identical to SEQ ID NO: 88162
  misc_feature 1..37: note = chr20:60943163-60943200
  misc_feature 1..37: note = Hyper
  source 1..37: mol_type = genomic DNA

SEQ ID NO: 120066 - DNA, 30 bp, Homo sapiens; identical to SEQ ID NO: 88163
  misc_feature 1..30: note = chr20:60952466-60952496
  misc_feature 1..30: note = Hypo
  source 1..30: mol_type = genomic DNA

SEQ ID NO: 120067 - DNA, 527 bp, Homo sapiens; identical to SEQ ID NO: 88164
  misc_feature 1..527: note = chr20:60953118-60953645
  misc_feature 1..527: note = Hypo
  source 1..527: mol_type = genomic DNA

SEQ ID NO: 120068 - DNA, 180 bp, Homo sapiens; identical to SEQ ID NO: 88165
  misc_feature 1..180: note = chr20:60970803-60970983
  misc_feature 1..180: note = Hypo
  source 1..180: mol_type = genomic DNA

SEQ ID NO: 120069 - DNA, 106 bp, Homo sapiens; identical to SEQ ID NO: 88166
  misc_feature 1..106: note = chr20:60976672-60976778
  misc_feature 1..106: note = Hypo
  source 1..106: mol_type = genomic DNA

SEQ ID NO: 120070 - DNA, 67 bp, Homo sapiens; identical to SEQ ID NO: 88167
  misc_feature 1..67: note = chr20:60983219-60983286
  misc_feature 1..67: note = Hypo
  source 1..67: mol_type = genomic DNA

SEQ ID NO: 120071 - DNA, 271 bp, Homo sapiens; identical to SEQ ID NO: 46336
  misc_feature 1..271: note = chr20:60983859-60984130
  misc_feature 1..271: note = Hypo
  source 1..271: mol_type = genomic DNA

SEQ ID NO: 120072 - DNA, 80 bp, Homo sapiens; identical to SEQ ID NO: 88169
  misc_feature 1..80: note = chr20:60984435-60984515
  misc_feature 1..80: note = Hypo
  source 1..80: mol_type = genomic DNA

SEQ ID NO: 120073 - DNA, 30 bp, Homo sapiens; identical to SEQ ID NO: 88170
  misc_feature 1..30: note = chr20:60986667-60986697
  misc_feature 1..30: note = Hypo
  source 1..30: mol_type = genomic DNA

SEQ ID NO: 120074 - DNA, 103 bp, Homo sapiens; identical to SEQ ID NO: 88171
  misc_feature 1..103: note = chr20:60988390-60988493
  misc_feature 1..103: note = Hypo
  source 1..103: mol_type = genomic DNA

SEQ ID NO: 120075 - DNA, 43 bp, Homo sapiens; identical to SEQ ID NO: 88172
  misc_feature 1..43: note = chr20:60992738-60992781
  misc_feature 1..43: note = Hypo
  source 1..43: mol_type = genomic DNA

SEQ ID NO: 120076 - DNA, 30 bp, Homo sapiens; identical to SEQ ID NO: 88173
  misc_feature 1..30: note = chr20:61013248-61013278
  misc_feature 1..30: note = Hypo
  source 1..30: mol_type = genomic DNA

SEQ ID NO: 120077 - DNA, 115 bp, Homo sapiens; identical to SEQ ID NO: 88174
  misc_feature 1..115: note = chr20:61020493-61020608
  misc_feature 1..115: note = Hypo
  source 1..115: mol_type = genomic DNA

SEQ ID NO: 120078 - DNA, 30 bp, Homo sapiens; identical to SEQ ID NO: 88175
  misc_feature 1..30: note = chr20:61021131-61021161
  misc_feature 1..30: note = Hypo
  source 1..30: mol_type = genomic DNA

SEQ ID NO: 120079 - DNA, 30 bp, Homo sapiens; identical to SEQ ID NO: 88177
  misc_feature 1..30: note = chr20:61270288-61270318
  misc_feature 1..30: note = Hypo
  source 1..30: mol_type = genomic DNA

SEQ ID NO: 120080 - DNA, 30 bp, Homo sapiens; identical to SEQ ID NO: 88178
  misc_feature 1..30: note = chr20:61279729-61279759
  misc_feature 1..30: note = Hypo
  source 1..30: mol_type = genomic DNA

SEQ ID NO: 120081 - DNA, 55 bp, Homo sapiens; identical to SEQ ID NO: 88179
  misc_feature 1..55: note = chr20:61284426-61284481
  misc_feature 1..55: note = Hypo
  source 1..55: mol_type = genomic DNA

SEQ ID NO: 120082 - DNA, 575 bp, Homo sapiens; identical to SEQ ID NO: 88180
  misc_feature 1..575: note = chr20:61287982-61288557
  misc_feature 1..575: note = Hypo
  source 1..575: mol_type = genomic DNA

SEQ ID NO: 120083 - DNA, 319 bp, Homo sapiens; identical to SEQ ID NO: 46339
  misc_feature 1..319: note = chr20:61291131-61291450
  misc_feature 1..319: note = Hypo
  source 1..319: mol_type = genomic DNA

SEQ ID NO: 120084 - DNA, 135 bp, Homo sapiens; identical to SEQ ID NO: 88182
  misc_feature 1..135: note = chr20:61291658-61291793
  misc_feature 1..135: note = Hypo
  source 1..135: mol_type = genomic DNA

SEQ ID NO: 120085 - DNA, 170 bp, Homo sapiens; identical to SEQ ID NO: 88183
  misc_feature 1..170: note = chr20:61292611-61292781
  misc_feature 1..170: note = Hypo
  source 1..170: mol_type = genomic DNA

SEQ ID NO: 120086 - DNA, 373 bp, Homo sapiens; identical to SEQ ID NO: 88184
  misc_feature 1..373: note = chr20:61294499-61294872
  misc_feature 1..373: note = Hypo
  source 1..373: mol_type = genomic DNA

SEQ ID NO: 120087 - DNA, 172 bp, Homo sapiens; identical to SEQ ID NO: 88185
  misc_feature 1..172: note = chr20:61299541-61299713
  misc_feature 1..172: note = Hypo
  source 1..172: mol_type = genomic DNA

SEQ ID NO: 120088 - DNA, 427 bp, Homo sapiens; identical to SEQ ID NO: 88186
  misc_feature 1..427: note = chr20:61305557-61305984
  misc_feature 1..427: note = Hypo
  source 1..427: mol_type = genomic DNA

SEQ ID NO: 120089 - DNA, 65 bp, Homo sapiens; identical to SEQ ID NO: 88187
  misc_feature 1..65: note = chr20:61312710-61312775
  misc_feature 1..65: note = Hypo
  source 1..65: mol_type = genomic DNA

SEQ ID NO: 120090 - DNA, 458 bp, Homo sapiens; identical to SEQ ID NO: 88188
  misc_feature 1..458: note = chr20:61314248-61314706
  misc_feature 1..458: note = Hypo
  source 1..458: mol_type = genomic DNA

SEQ ID NO: 120091 - DNA, 150 bp, Homo sapiens; identical to SEQ ID NO: 88189
  misc_feature 1..150: note = chr20:61318633-61318783
  misc_feature 1..150: note = Hypo
  source 1..150: mol_type = genomic DNA

SEQ ID NO: 120092 - DNA, 108 bp, Homo sapiens; identical to SEQ ID NO: 88190
  misc_feature 1..108: note = chr20:61319024-61319132
  misc_feature 1..108: note = Hypo
  source 1..108: mol_type = genomic DNA

SEQ ID NO: 120093 - DNA, 115 bp, Homo sapiens; identical to SEQ ID NO: 46346
  misc_feature 1..115: note = chr20:61321299-61321414
  misc_feature 1..115: note = Hypo
  source 1..115: mol_type = genomic DNA

SEQ ID NO: 120094 - DNA, 182 bp, Homo sapiens; identical to SEQ ID NO: 88192
  misc_feature 1..182: note = chr20:61329166-61329348
  misc_feature 1..182: note = Hypo
  source 1..182: mol_type = genomic DNA

SEQ ID NO: 120095 - DNA, 189 bp, Homo sapiens; identical to SEQ ID NO: 88193
  misc_feature 1..189: note = chr20:61330920-61331109
  misc_feature 1..189: note = Hypo
  source 1..189: mol_type = genomic DNA

SEQ ID NO: 120096 - DNA, 1196 bp, Homo sapiens
  misc_feature 1..1196: note = chr20:61339542-61340738
  misc_feature 1..1196: note = Hyper
  source 1..1196: mol_type = genomic DNA
ttcacagaccaggcacgcccatgactgcggccagattttaaaaggaatcaccagaaatgtaatctccagtggtcctagagccccctgggcacccagcttctggcaccctgtggacacccaggagtgggggtcggcccaaccagctgcgcagccgcccagccctgccagcggggagcttcctccctccctgccctccggatacaccctcaccccaactgagcgagcccagggttgggggaggtgcatagttcccttcctagccggtgcgagaaattgcggagaacagggaagagggtggcaggaagggtctggtgcacgatacccgccgcgcccgctcggaatcctggttccctggagcgctcaccccagcccgccctgccccggggagcgcgagggggcgacccgccaggctgcacccgggcggggcggggatggcggcgggggctgcctccctcctccgccgccaccccccactgctgggcgcgccgcgcggccgccggctccgtggagacgcgcagagccgggagggcgcgggcgcggcgggaggtgtgcggggctggggtgcgcggagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacat

SEQ ID NO: 120097 - DNA, 64 bp, Homo sapiens; identical to SEQ ID NO: 88196
  misc_feature 1..64: note = chr20:61364412-61364476
  misc_feature 1..64: note = Hypo
  source 1..64: mol_type = genomic DNA

SEQ ID NO: 120098 - DNA, 30 bp, Homo sapiens; identical to SEQ ID NO: 46349
  misc_feature 1..30: note = chr20:61368079-61368109
  misc_feature 1..30: note = Hypo
  source 1..30: mol_type = genomic DNA

SEQ ID NO: 120099 - DNA, 190 bp, Homo sapiens; identical to SEQ ID NO: 88198
  misc_feature 1..190: note = chr20:61374409-61374599
  misc_feature 1..190: note = Hypo
  source 1..190: mol_type = genomic DNA

SEQ ID NO: 120100 - DNA, 285 bp, Homo sapiens; identical to SEQ ID NO: 88199
  misc_feature 1..285: note = chr20:61393765-61394050
  misc_feature 1..285: note = Hypo
  source 1..285: mol_type = genomic DNA

SEQ ID NO: 120101 - DNA, 22 bp, Homo sapiens
  misc_feature 1..22: note = chr20:61411096-61411118
  misc_feature 1..22: note = Hypo
  source 1..22: mol_type = genomic DNA
agttagaaagctcttcgttgtg

SEQ ID NO: 120102 - DNA, 168 bp, Homo sapiens; identical to SEQ ID NO: 88201
  misc_feature 1..168: note = chr20:61412187-61412355
  misc_feature 1..168: note = Hypo
  source 1..168: mol_type = genomic DNA

SEQ ID NO: 120103 - DNA, 413 bp, Homo sapiens; identical to SEQ ID NO: 88202
  misc_feature 1..413: note = chr20:61415908-61416321
  misc_feature 1..413: note = Hypo
  source 1..413: mol_type = genomic DNA

SEQ ID NO: 120104 - DNA, 136 bp, Homo sapiens; identical to SEQ ID NO: 88203
  misc_feature 1..136: note = chr20:61424061-61424197
  misc_feature 1..136: note = Hypo
  source 1..136: mol_type = genomic DNA

SEQ ID NO: 120105 - DNA, 388 bp, Homo sapiens; identical to SEQ ID NO: 88204
  misc_feature 1..388: note = chr20:61424743-61425131
  misc_feature 1..388: note = Hypo
  source 1..388: mol_type = genomic DNA

SEQ ID NO: 120106 - DNA, 93 bp, Homo sapiens; identical to SEQ ID NO: 88205
  misc_feature 1..93: note = chr20:61447670-61447763
  misc_feature 1..93: note = Hyper
  source 1..93: mol_type = genomic DNA

SEQ ID NO: 120107 - DNA, 680 bp, Homo sapiens; identical to SEQ ID NO: 88206
  misc_feature 1..680: note = chr20:61448109-61448789
  misc_feature 1..680: note = Hyper
  source 1..680: mol_type = genomic DNA

SEQ ID NO: 120108 - DNA, 30 bp, Homo sapiens; identical to SEQ ID NO: 88207
  misc_feature 1..30: note = chr20:61452912-61452942
  misc_feature 1..30: note = Hypo
  source 1..30: mol_type = genomic DNA

SEQ ID NO: 120109 - DNA, 30 bp, Homo sapiens; identical to SEQ ID NO: 88208
  misc_feature 1..30: note = chr20:61460276-61460306
  misc_feature 1..30: note = Hypo
  source 1..30: mol_type = genomic DNA

SEQ ID NO: 120110 - DNA, 30 bp, Homo sapiens; identical to SEQ ID NO: 88209
  misc_feature 1..30: note = chr20:61462692-61462722
  misc_feature 1..30: note = Hypo
  source 1..30: mol_type = genomic DNA

SEQ ID NO: 120111 - DNA, 30 bp, Homo sapiens; identical to SEQ ID NO: 88210
  misc_feature 1..30: note = chr20:61466999-61467029
  misc_feature 1..30: note = Hypo
  source 1..30: mol_type = genomic DNA

SEQ ID NO: 120112 - DNA, 290 bp, Homo sapiens; identical to SEQ ID NO: 88211
  misc_feature 1..290: note = chr20:61471909-61472199
  misc_feature 1..290: note = Hypo
  source 1..290: mol_type = genomic DNA

SEQ ID NO: 120113 - DNA, 685 bp, Homo sapiens; identical to SEQ ID NO: 46356
  misc_feature 1..685: note = chr20:61505851-61506536
  misc_feature 1..685: note = Hypo
  source 1..685: mol_type = genomic DNA

SEQ ID NO: 120114 - DNA, 30 bp, Homo sapiens; identical to SEQ ID NO: 88213
  misc_feature 1..30: note = chr20:61527484-61527514
  misc_feature 1..30: note = Hypo
  source 1..30: mol_type = genomic DNA

SEQ ID NO: 120115 - DNA, 30 bp, Homo sapiens; identical to SEQ ID NO: 88214
  misc_feature 1..30: note = chr20:61527715-61527745
  misc_feature 1..30: note = Hypo
  source 1..30: mol_type = genomic DNA

SEQ ID NO: 120116 - DNA, 120 bp, Homo sapiens; identical to SEQ ID NO: 88215
  misc_feature 1..120: note = chr20:61528027-61528147
  misc_feature 1..120: note = Hypo
  source 1..120: mol_type = genomic DNA

SEQ ID NO: 120117 - DNA, 265 bp, Homo sapiens; identical to SEQ ID NO: 88216
  misc_feature 1..265: note = chr20:61532464-61532729
  misc_feature 1..265: note = Hypo
  source 1..265: mol_type = genomic DNA

SEQ ID NO: 120118 - DNA, 69 bp, Homo sapiens; identical to SEQ ID NO: 88217
  misc_feature 1..69: note = chr20:61541112-61541181
  misc_feature 1..69: note = Hypo
  source 1..69: mol_type = genomic DNA

SEQ ID NO: 120119 - DNA, 30 bp, Homo sapiens; identical to SEQ ID NO: 88218
  misc_feature 1..30: note = chr20:61559777-61559807
  misc_feature 1..30: note = Hyper
  source 1..30: mol_type = genomic DNA

SEQ ID NO: 120120 - DNA, 682 bp, Homo sapiens
  misc_feature 1..682: note = chr20:61560285-61560967
  misc_feature 1..682: note = Hyper
  source 1..682: mol_type = genomic DNA
tttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggg

SEQ ID NO: 120121 - DNA, 92 bp, Homo sapiens; identical to SEQ ID NO: 88221
  misc_feature 1..92: note = chr20:61567398-61567490
  misc_feature 1..92: note = Hypo
  source 1..92: mol_type = genomic DNA

SEQ ID NO: 120122 - DNA, 348 bp, Homo sapiens; identical to SEQ ID NO: 88222
  misc_feature 1..348: note = chr20:61570543-61570891
  misc_feature 1..348: note = Hypo
  source 1..348: mol_type = genomic DNA

SEQ ID NO: 120123 - DNA, 30 bp, Homo sapiens; identical to SEQ ID NO: 46360
  misc_feature 1..30: note = chr20:61571213-61571243
  misc_feature 1..30: note = Hypo
  source 1..30: mol_type = genomic DNA

SEQ ID NO: 120124 - DNA, 30 bp, Homo sapiens; identical to SEQ ID NO: 88224
  misc_feature 1..30: note = chr20:61583985-61584015
  misc_feature 1..30: note = Hyper
  source 1..30: mol_type = genomic DNA

SEQ ID NO: 120125 - DNA, 448 bp, Homo sapiens
  misc_feature 1..448: note = chr20:61585299-61585747
  misc_feature 1..448: note = Hyper
  source 1..448: mol_type = genomic DNA
ttcatccaggcctgccgggcagggccagctccccagggattcagggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgagaacagagctggagggcggcacccacactctccggtttgctgctcgcctggcccggccccgcacagttcccttt

SEQ ID NO: 120126 - DNA, 30 bp, Homo sapiens
  misc_feature 1..30: note = chr20:61585974-61586004
  misc_feature 1..30: note = Hyper
  source 1..30: mol_type = genomic DNA
caggcctcaggtagccgactgtctgggcca

SEQ ID NO: 120127 - DNA, 80 bp, Homo sapiens; identical to SEQ ID NO: 88226
  misc_feature 1..80: note = chr20:61618954-61619034
  misc_feature 1..80: note = Hypo
  source 1..80: mol_type = genomic DNA

SEQ ID NO: 120128 - DNA, 2317 bp, Homo sapiens
  misc_feature 1..2317: note = chr20:61636751-61639068
  misc_feature 1..2317: note = Hyper
  source 1..2317: mol_type = genomic DNA
ggaaaaggccttccccggggtcttcctgcgcccgcggtccagctcctctgcagacggccatcgtgggctctccgcagggctgcggagtctcggagtcaccgaggtgggaggtgccggccacgcgcgtcctcaggaacagagcactgccctgcagtttagcacgaagggccggctggagcgggagcgcgaggcccactgcaagaggatcaggagccagtaagtccggcttttcttcgtctccacctttcgtgcgcccggggccaggaccgcctgtccggaatctgaccagtgcccgtcctcgccgtggccctgggaccccgcggtggtcttcttttggggacgaacggcagtgcccgaaggatgctctacccacccccgttcctagacttgctgggtcccgacaatacccagtgggtgccgcgagttcccgggcgcagagtccagcgtccggctctcgagctcaatcccgcgccccgacggccttggcgcttcccgctgcgctaaactgtccaccgcgcacaggctggaagcgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcagcgtggcgatcttggagagcttgcgcaccgacgggctgtgcgcgtaggggatgacggctcgcagcccgtccagcgcgtcgtttaggtcgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgccgtagccgcgggccgcttcgggttctcgcgccgccccgtaggcgagacccgcagccgccgccgcgtagccgtggcttagtgccaggtacgcgtcccccgacagcgacttgagctcggccatggccgcgccgcctgggctcgggggctcgccgggtgggcggatgctcatgtgggtgagcagcccccgaggccggcccgagcccgccgctgccgctgccgctgcgatgaggctcccggctctgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcccgcacactccctgctcggggcgccctgtggccaggcttgaggggcagagtgagagggagtttctagaacctgttgaaaaacgccacgagcgttgcaggccggggagggcgggaaggtggagggcagcgcggcctggggctccccgggggtgggaggggagctctgtgagctgcaggaccgcctcttccctgccagccgcttcctgggcatctatcagcgaaacgcgtgaggcttggtgggctttcccggagcctccgaacccctggggtc

SEQ ID NO: 120129 - DNA, 78 bp, Homo sapiens; identical to SEQ ID NO: 88234
  misc_feature 1..78: note = chr20:61650430-61650508
  misc_feature 1..78: note = Hypo
  source 1..78: mol_type = genomic DNA

SEQ ID NO: 120130 - DNA, 420 bp, Homo sapiens; identical to SEQ ID NO: 88235
  misc_feature 1..420: note = chr20:61655406-61655826
  misc_feature 1..420: note = Hypo
  source 1..420: mol_type = genomic DNA

SEQ ID NO: 120131 - DNA, 23 bp, Homo sapiens
  misc_feature 1..23: note = chr20:61662281-61662304
  misc_feature 1..23: note = Hypo
  source 1..23: mol_type = genomic DNA
agtcagtgctggggccgggcgcg

SEQ ID NO: 120132 - DNA, 124 bp, Homo sapiens; identical to SEQ ID NO: 88237
  misc_feature 1..124: note = chr20:61664446-61664570
  misc_feature 1..124: note = Hyper
  source 1..124: mol_type = genomic DNA

SEQ ID NO: 120133 - DNA, 113 bp, Homo sapiens; identical to SEQ ID NO: 88238
  misc_feature 1..113: note = chr20:61665862-61665975
  misc_feature 1..113: note = Hypo
  source 1..113: mol_type = genomic DNA

SEQ ID NO: 120134 - DNA, 45 bp, Homo sapiens; identical to SEQ ID NO: 88239
  misc_feature 1..45: note = chr20:61666827-61666872
  misc_feature 1..45: note = Hypo
  source 1..45: mol_type = genomic DNA

SEQ ID NO: 120135 - DNA, 59 bp, Homo sapiens; identical to SEQ ID NO: 88240
  misc_feature 1..59: note = chr20:61674697-61674756
  misc_feature 1..59: note = Hypo
  source 1..59: mol_type = genomic DNA

SEQ ID NO: 120136 - DNA, 376 bp, Homo sapiens; identical to SEQ ID NO: 88241
  misc_feature 1..376: note = chr20:61675324-61675700
  misc_feature 1..376: note = Hypo
  source 1..376: mol_type = genomic DNA

SEQ ID NO: 120137 - DNA, 30 bp, Homo sapiens; identical to SEQ ID NO: 88242
  misc_feature 1..30: note = chr20:61676232-61676262
  misc_feature 1..30: note = Hypo
  source 1..30: mol_type = genomic DNA

SEQ ID NO: 120138 - DNA, 30 bp, Homo sapiens; identical to SEQ ID NO: 88243
  misc_feature 1..30: note = chr20:61677586-61677616
  misc_feature 1..30: note = Hypo
  source 1..30: mol_type = genomic DNA

SEQ ID NO: 120139 - DNA, 50 bp, Homo sapiens; identical to SEQ ID NO: 88244
  misc_feature 1..50: note = chr20:61681372-61681422
  misc_feature 1..50: note = Hypo
  source 1..50: mol_type = genomic DNA

SEQ ID NO: 120140 - DNA, 30 bp, Homo sapiens; identical to SEQ ID NO: 88245
  misc_feature 1..30: note = chr20:61683138-61683168
  misc_feature 1..30: note = Hypo
  source 1..30: mol_type = genomic DNA

SEQ ID NO: 120141 - DNA, 321 bp, Homo sapiens; identical to SEQ ID NO: 88246
  misc_feature 1..321: note = chr20:61695617-61695938
  misc_feature 1..321: note = Hypo
  source 1..321: mol_type = genomic DNA

SEQ ID NO: 120142 - DNA, 807 bp, Homo sapiens
  misc_feature 1..807: note = chr20:61703300-61704107
  misc_feature 1..807: note = Hyper
  source 1..807: mol_type = genomic DNA
cccactctaaggacccgctcctccccgcccccgcccccaaagccgctcctctcacggcccccgaccccgcaggcaccgactgttctcagccccgcccctcgaggccccgccccgcggcttcccgccggggattgcggctgcgcctctgaccctccgctccgggctccgggctcaggtcccacacctgcccgcgcccccaggccccgccgtcccccagagcctgcagcgggcgccgcgcaggccgccgggctcctccgggtgggccgggctcgggcttttggagccgcgcgcccaccgacccctcccacgggcggcggggggagagcccacccagaggcgcagcggggccggtggtgtttcccgccctcccagggggccgcgggtccgggggcagcagcggggcgcggggcggagggaggcccggcgggaacgggcgccccctttgcacccacagccgtggaacgccgaggtctcagctcccctacggcgcgcgccccgagaccccgcaagggcagtgctggggacgcggggccgagactcgaggacgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctcagcaaagaggagcttggggcagcccactccccacagaggaagggaggggcccgctccacggaggacctggggg

SEQ ID NO: 120143 - DNA, 201 bp, Homo sapiens; identical to SEQ ID NO: 88250
  misc_feature 1..201: note = chr20:61714761-61714962
  misc_feature 1..201: note = Hypo
  source 1..201: mol_type = genomic DNA

SEQ ID NO: 120144 - DNA, 199 bp, Homo sapiens; identical to SEQ ID NO: 88251
  misc_feature 1..199: note = chr20:61725248-61725447
  misc_feature 1..199: note = Hypo
  source 1..199: mol_type = genomic DNA

SEQ ID NO: 120145 - DNA, 1274 bp, Homo sapiens
  misc_feature 1..1274: note = chr20:61733260-61734534
  misc_feature 1..1274: note = Hyper
  source 1..1274: mol_type = genomic DNA
cctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggcacggtgggcgcgagcgccgtgggctggggccggcctgggctttcagggcgagggctttccgcgccggccccagcccacccggccccgctgcgcgcccctcacgctgcagcctgggaacctgggccgggagctgcgggccgctccggggaagcgggcctgacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaa

SEQ ID NO: 120146 - DNA, 208 bp, Homo sapiens; identical to SEQ ID NO: 38267
  misc_feature 1..208: note = chr20:61747797-61748005
  misc_feature 1..208: note = Hyper
  source 1..208: mol_type = genomic DNA

SEQ ID NO: 120147 - DNA, 139 bp, Homo sapiens; identical to SEQ ID NO: 88255
  misc_feature 1..139: note = chr20:61748817-61748956
  misc_feature 1..139: note = Hypo
  source 1..139: mol_type = genomic DNA

SEQ ID NO: 120148 - DNA, 181 bp, Homo sapiens; identical to SEQ ID NO: 88256
  misc_feature 1..181: note = chr20:61749739-61749920
  misc_feature 1..181: note = Hypo
  source 1..181: mol_type = genomic DNA

SEQ ID NO: 120149 - DNA, 204 bp, Homo sapiens; identical to SEQ ID NO: 88257
  misc_feature 1..204: note = chr20:61751588-61751792
  misc_feature 1..204: note = Hypo
  source 1..204: mol_type = genomic DNA

SEQ ID NO: 120150 - DNA, 59 bp, Homo sapiens; identical to SEQ ID NO: 88258
  misc_feature 1..59: note = chr20:61753309-61753368
  misc_feature 1..59: note = Hypo
  source 1..59: mol_type = genomic DNA

SEQ ID NO: 120151 - DNA, 189 bp, Homo sapiens; identical to SEQ ID NO: 88259
  misc_feature 1..189: note = chr20:61763539-61763728
  misc_feature 1..189: note = Hypo
  source 1..189: mol_type = genomic DNA

SEQ ID NO: 120152 - DNA, 84 bp, Homo sapiens; identical to SEQ ID NO: 88260
  misc_feature 1..84: note = chr20:61764128-61764212
  misc_feature 1..84: note = Hypo
  source 1..84: mol_type = genomic DNA

SEQ ID NO: 120153 - DNA, 73 bp, Homo sapiens; identical to SEQ ID NO: 88261
  misc_feature 1..73: note = chr20:61765333-61765406
  misc_feature 1..73: note = Hypo
  source 1..73: mol_type = genomic DNA

SEQ ID NO: 120154 - DNA, 45 bp, Homo sapiens; identical to SEQ ID NO: 88262
  misc_feature 1..45: note = chr20:61765608-61765653
  misc_feature 1..45: note = Hypo
  source 1..45: mol_type = genomic DNA

SEQ ID NO: 120155 - DNA, 31 bp, Homo sapiens; identical to SEQ ID NO: 88263
  misc_feature 1..31: note = chr20:61767248-61767279
  misc_feature 1..31: note = Hypo
  source 1..31: mol_type = genomic DNA

SEQ ID NO: 120156 - DNA, 30 bp, Homo sapiens; identical to SEQ ID NO: 88264
  misc_feature 1..30: note = chr20:61771384-61771414
  misc_feature 1..30: note = Hypo
  source 1..30: mol_type = genomic DNA

SEQ ID NO: 120157 - DNA, 30 bp, Homo sapiens; identical to SEQ ID NO: 88265
  misc_feature 1..30: note = chr20:61772713-61772743
  misc_feature 1..30: note = Hypo
  source 1..30: mol_type = genomic DNA

SEQ ID NO: 120158 - DNA, 30 bp, Homo sapiens; identical to SEQ ID NO: 88266
  misc_feature 1..30: note = chr20:61782559-61782589
  misc_feature 1..30: note = Hypo
  source 1..30: mol_type = genomic DNA

SEQ ID NO: 120159 - DNA, 39 bp, Homo sapiens; identical to SEQ ID NO: 88267
  misc_feature 1..39: note = chr20:61790599-61790638
  misc_feature 1..39: note = Hypo
  source 1..39: mol_type = genomic DNA

SEQ ID NO: 120160 - DNA, 30 bp, Homo sapiens; identical to SEQ ID NO: 88268
  misc_feature 1..30: note = chr20:61798362-61798392
  misc_feature 1..30: note = Hypo
  source 1..30: mol_type = genomic DNA

SEQ ID NO: 120161 - DNA, 61 bp, Homo sapiens; identical to SEQ ID NO: 88269
  misc_feature 1..61: note = chr20:61799802-61799863
  misc_feature 1..61: note = Hypo
  source 1..61: mol_type = genomic DNA

SEQ ID NO: 120162 - DNA, 565 bp, Homo sapiens; identical to SEQ ID NO: 88270
  misc_feature 1..565: note = chr20:61806408-61806973
  misc_feature 1..565: note = Hyper
  source 1..565: mol_type = genomic DNA

SEQ ID NO: 120163 - DNA, 352 bp, Homo sapiens; identical to SEQ ID NO: 88271
  misc_feature 1..352: note = chr20:61807183-61807535
  misc_feature 1..352: note = Hyper
  source 1..352: mol_type = genomic DNA

SEQ ID NO: 120164 - DNA, 2535 bp, Homo sapiens
  misc_feature 1..2535: note = chr20:61807775-61810310
  misc_feature 1..2535: note = Hyper
  source 1..2535: mol_type = genomic DNA
gacacttgcgaagggcgaggaattgcggctgggaagggtcaggttgaagccgcaccaaagggggaggggcgtcctgatggttgaggaccggcggagtcggtgcgggcagaaccaacccgagttcctgccgcccttcctaaccggctgtccatgggctgggcagtgctggagagggtggaaaaggaaggaagcaggacctgctcccagggaggcccaggctctgctccgagggcagatggcgcaggggctgggttggccctaggaggaaggagatggggacagaggcctgccggccgcgccggcctgcgctccttgcagtctaaacaaaggccagcgggggaggctccggacggtgaggcttggggaagccactgatccctggccctagagggccagatcgggggcgccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccggcgggacccttgcctttctcaggactgagaggcttggaggaccgcggtgtgagctgcgcggcagagtgcgttctgcaggcgccagacaggagacgcgaacccgcggtcagggcccgagtgcgggtgcgtgtctgcgggtgccgctgggctgcgtgccggcgaggcgtgcgcgtggcgaggcgtgcgcgtggcggggtgtggctagaggtgtcaatgtgcagctggaggggctgcgcgcgtgggtgcaggagggccatgtgaggggctggagtgtgtgggagacaggcgtttccttgggtctccgtgtggccgccgggcgcagggcacggtcgagggcgctcgatggctgagtccgcgtgagccgaggagcgcgcggggcgggacgcggtgcgaatgcgcgggaggcacgaggcgcgcagtgcgtgtgtgcgcgtgtgcgcggcgcgcgtgccccgcagttctcaaggacacctcggggaggcagcggcggggccggtgtccgggtgacgtcaccgcgcgccccagtgataatcggccggtgccggagcggagcgcggatacgcgcggaggcaacggcgacggcggcggcggcggcgggcgcggggacagttgcatcggggccgggccgggctagcaggagctgggcgcctgcagcgtggaccccgtggacactcggctcgcagccggcctgcggcgctcggggacttgcctggctcccttctcggggttcccgcgcccttctccgcccagggcagcagcgcgcggggcccccgggagccgaagagcaggcgggaactggcggcggcgcgggaggcgcagggagcggaggcggcagcagcggctcccgccgggactggtaattacgctcggggccgggccggggcgagccgggcaagcggcctctctgggtctccccgtctttctctccacgaacagctcgagcgccttctcgcgggcccgctgcgcgcggagaggacgagctcgctgggttgtaaaaagagacgagttttcatctttgagcatcgagattcgttcttttaaccgcattcggtgcgcgctcctgggtcggcacgggcagggcgacggcaggggaaggcagctgcggaggagctcgcgccgcccagtcggagcggttctgcgcccctcggagccccgcgggaggcggccgggtgcgcacgcgctcaccacccccacccccggaatccgtcttcgcgattcccgggcgccccagctccaggaacgcccggagggacgcacttgggggcccactctctgccgcggaaaggggagaagtgtgggctcctccgagtcgggggcggactgggacagcacagtcggctgagcgcagcgcccccgccctgcccgccacgcggcgaagacgcctgagcgttcgcgcccctcgggcgaggaccccacgcaagcccgagccggtcccgaccctggccccgacgctcgccgcccgccccagccctgagggcccctctgcgtgttcacagcggaccttgatttaatgtctatacaattaaggcacgcggtgaatgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctggcgtcgcggggcgggtgggggcggccgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggc

SEQ ID NO: 120165 - DNA, 30 bp, Homo sapiens; identical to SEQ ID NO: 46371
  misc_feature 1..30: note = chr20:61820146-61820176
  misc_feature 1..30: note = Hypo
  source 1..30: mol_type = genomic DNA

SEQ ID NO: 120166 - DNA, 156 bp, Homo sapiens; identical to SEQ ID NO: 88280
  misc_feature 1..156: note = chr20:61823043-61823199
  misc_feature 1..156: note = Hypo
  source 1..156: mol_type = genomic DNA

SEQ ID NO: 120167 - DNA, 30 bp, Homo sapiens; identical to SEQ ID NO: 88281
  misc_feature 1..30: note = chr20:61830522-61830552
  misc_feature 1..30: note = Hypo
  source 1..30: mol_type = genomic DNA

SEQ ID NO: 120168 - DNA, 99 bp, Homo sapiens; identical to SEQ ID NO: 88282
  misc_feature 1..99: note = chr20:61838424-61838523
  misc_feature 1..99: note = Hypo
  source 1..99: mol_type = genomic DNA

SEQ ID NO: 120169 - DNA, 37 bp, Homo sapiens; identical to SEQ ID NO: 88283
  misc_feature 1..37: note = chr20:61857454-61857491
  misc_feature 1..37: note = Hypo
  source 1..37: mol_type = genomic DNA

SEQ ID NO: 120170 - DNA, 180 bp, Homo sapiens; identical to SEQ ID NO: 88284
  misc_feature 1..180: note = chr20:61862280-61862460
  misc_feature 1..180: note = Hyper
  source 1..180: mol_type = genomic DNA

SEQ ID NO: 120171 - DNA, 170 bp, Homo sapiens; identical to SEQ ID NO: 88285
  misc_feature 1..170: note = chr20:61883234-61883404
  misc_feature 1..170: note = Hypo
  source 1..170: mol_type = genomic DNA

SEQ ID NO: 120172 - DNA, 1698 bp, Homo sapiens
  misc_feature 1..1698: note = chr20:61884629-61886327
  misc_feature 1..1698: note = Hyper
  source 1..1698: mol_type = genomic DNA
acctcaggttatctccgcggccccagcgagcctcccaggaaagcgccggaagctccttccttcctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagcttccccagcctggacaggcgaggcctttgtttagccccctcccccgagggcaccgggctccgggaaagaatccgccccccaggcgtcccagggagcttcggactccggggcagaatggaaacttggccgagggagccccgaccaatcccgacaccgaagacgcccgcgctgcgccccgggcatcggctccagccccttctcgcctccgcgtagctccacgccgggcggaatggggggcggcgggggcgggcggggccggtttgctcgcgggtgggcaggacgttctcaccccccgccccctacactcgcaaactcgcaggcacagcctccgtcatcgccccacccgaatctcagaatcggaacttggccgctcactcggcgcccggggccggctgcgggaaacgctcgcacagacagagacaggcgcgcacccgggggcgcacccggggccacacacgcctccccaggcgatggggtccaggcggccccgcccgaaggcttccgtccggccagcccatccagccgctgccccgcacctgtccccgccgctccggacccgcggccgccccccgcgcacgcacaccggggacgggacccggcgccgcgactccccacgccccgcaggcgacgccaccttcggccgtagcagcccggggtccgaggcatcccccctcggagctggcgcgggacccagcgaacgggccccggggcggagggacgcttcgggaccccacagccgccgtgggtcgggcaccgggggctccaggaggctcgcggaggggtcgccactcaccagctgaaaagcgcagaggacgacgagcgcgcagcggccggagcaggagcccatggtgcccgcctatacaggaggcccccgggtgccccgcgctcggcccccgcccccgctccgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtagcgaggggcggcgccgcggccccaggacagacctgcagctgaggggagcccgccctggacgcggcagggatgaccggcgtccgccccctcctgcaggatgacctgcccagcacctgctcccgccgtgcgccctccggcgtgagatccccatcaaccttccccgtgtggggtctgagcgacccgcatccgcgaggcgttttctctgagagtctcagagattccttggcttggagaagtcctggacccgggtccagagctca

SEQ ID NO: 120173 - DNA, 30 bp, Homo sapiens; identical to SEQ ID NO: 38284
  misc_feature 1..30: note = chr20:61886725-61886755
  misc_feature 1..30: note = Hyper
  source 1..30: mol_type = genomic DNA

SEQ ID NO: 120174 - DNA, 157 bp, Homo sapiens; identical to SEQ ID NO: 88292
  misc_feature 1..157: note = chr20:61894135-61894292
  misc_feature 1..157: note = Hypo
  source 1..157: mol_type = genomic DNA

SEQ ID NO: 120175 - DNA, 30 bp, Homo sapiens; identical to SEQ ID NO: 88293
  misc_feature 1..30: note = chr20:61940064-61940094
  misc_feature 1..30: note = Hypo
  source 1..30: mol_type = genomic DNA

SEQ ID NO: 120176 - DNA, 33 bp, Homo sapiens; identical to SEQ ID NO: 46375
  misc_feature 1..33: note = chr20:61941734-61941767
  misc_feature 1..33: note = Hypo
  source 1..33: mol_type = genomic DNA

SEQ ID NO: 120177 - DNA, 144 bp, Homo sapiens; identical to SEQ ID NO: 88295
  misc_feature 1..144: note = chr20:61942831-61942975
  misc_feature 1..144: note = Hypo
  source 1..144: mol_type = genomic DNA

SEQ ID NO: 120178 - DNA, 74 bp, Homo sapiens; identical to SEQ ID NO: 88296
  misc_feature 1..74: note = chr20:61957937-61958011
  misc_feature 1..74: note = Hypo
  source 1..74: mol_type = genomic DNA

SEQ ID NO: 120179 - DNA, 118 bp, Homo sapiens; identical to SEQ ID NO: 88297
  misc_feature 1..118: note = chr20:61965232-61965350
  misc_feature 1..118: note = Hypo
  source 1..118: mol_type = genomic DNA

SEQ ID NO: 120180 - DNA, 584 bp, Homo sapiens; identical to SEQ ID NO: 88298
  misc_feature 1..584: note = chr20:61973825-61974409
  misc_feature 1..584: note = Hypo
  source 1..584: mol_type = genomic DNA

SEQ ID NO: 120181 - DNA, 69 bp, Homo sapiens; identical to SEQ ID NO: 88299
  misc_feature 1..69: note = chr20:61974643-61974712
  misc_feature 1..69: note = Hypo
  source 1..69: mol_type = genomic DNA

SEQ ID NO: 120182 - DNA, 30 bp, Homo sapiens; identical to SEQ ID NO: 88300
  misc_feature 1..30: note = chr20:61979634-61979664
  misc_feature 1..30: note = Hypo
  source 1..30: mol_type = genomic DNA

SEQ ID NO: 120183 - DNA, 135 bp, Homo sapiens; identical to SEQ ID NO: 88301
  misc_feature 1..135: note = chr20:61979961-61980096
  misc_feature 1..135: note = Hypo
  source 1..135: mol_type = genomic DNA

SEQ ID NO: 120184 - DNA, 911 bp, Homo sapiens; identical to SEQ ID NO: 88302
  misc_feature 1..911: note = chr20:61980587-61981498
  misc_feature 1..911: note = Hypo
  source 1..911: mol_type = genomic DNA

SEQ ID NO: 120185 - DNA, 751 bp, Homo sapiens; identical to SEQ ID NO: 88303
  misc_feature 1..751: note = chr20:61981745-61982496
  misc_feature 1..751: note = Hypo
  source 1..751: mol_type = genomic DNA

SEQ ID NO: 120186 - DNA, 31 bp, Homo sapiens; identical to SEQ ID NO: 88304
  misc_feature 1..31: note = chr20:61982616-61982647
  misc_feature 1..31: note = Hypo
  source 1..31: mol_type = genomic DNA

SEQ ID NO: 120187 - DNA, 30 bp, Homo sapiens; identical to SEQ ID NO: 88305
  misc_feature 1..30: note = chr20:61983281-61983311
  misc_feature 1..30: note = Hypo
  source 1..30: mol_type = genomic DNA

SEQ ID NO: 120188 - DNA, 57 bp, Homo sapiens; identical to SEQ ID NO: 88306
  misc_feature 1..57: note = chr20:61986049-61986106
  misc_feature 1..57: note = Hypo
  source 1..57: mol_type = genomic DNA

SEQ ID NO: 120189 - DNA, 165 bp, Homo sapiens; identical to SEQ ID NO: 88307
  misc_feature 1..165: note = chr20:61986524-61986689
  misc_feature 1..165: note = Hypo
  source 1..165: mol_type = genomic DNA

SEQ ID NO: 120190 - DNA, 30 bp, Homo sapiens; identical to SEQ ID NO: 88308
  misc_feature 1..30: note = chr20:61990604-61990634
  misc_feature 1..30: note = Hypo
  source 1..30: mol_type = genomic DNA

SEQ ID NO: 120191 - DNA, 226 bp, Homo sapiens; identical to SEQ ID NO: 88309
  misc_feature 1..226: note = chr20:61990843-61991069
  misc_feature 1..226: note = Hypo
  source 1..226: mol_type = genomic DNA

SEQ ID NO: 120192 - DNA, 92 bp, Homo sapiens; identical to SEQ ID NO: 88310
  misc_feature 1..92: note = chr20:62011877-62011969
  misc_feature 1..92: note = Hypo
  source 1..92: mol_type = genomic DNA

SEQ ID NO: 120193 - DNA, 30 bp, Homo sapiens; identical to SEQ ID NO: 88311
  misc_feature 1..30: note = chr20:62026530-62026560
  misc_feature 1..30: note = Hypo
  source 1..30: mol_type = genomic DNA

SEQ ID NO: 120194 - DNA, 229 bp, Homo sapiens; identical to SEQ ID NO: 88312
  misc_feature 1..229: note = chr20:62028677-62028906
  misc_feature 1..229: note = Hypo
  source 1..229: mol_type = genomic DNA

SEQ ID NO: 120195 - DNA, 262 bp, Homo sapiens; identical to SEQ ID NO: 88313
  misc_feature 1..262: note = chr20:62031112-62031374
  misc_feature 1..262: note = Hypo
  source 1..262: mol_type = genomic DNA

SEQ ID NO: 120196 - DNA, 146 bp, Homo sapiens; identical to SEQ ID NO: 88314
  misc_feature 1..146: note = chr20:62031607-62031753
  misc_feature 1..146: note = Hypo
  source 1..146: mol_type = genomic DNA

SEQ ID NO: 120197 - DNA, 482 bp, Homo sapiens; identical to SEQ ID NO: 88315
  misc_feature 1..482: note = chr20:62031973-62032455
  misc_feature 1..482: note = Hypo
  source 1..482: mol_type = genomic DNA

SEQ ID NO: 120198 - DNA, 159 bp, Homo sapiens; identical to SEQ ID NO: 46386
  misc_feature 1..159: note = chr20:62033495-62033654
  misc_feature 1..159: note = Hypo
  source 1..159: mol_type = genomic DNA

SEQ ID NO: 120199 - DNA, 209 bp, Homo sapiens; identical to SEQ ID NO: 46387
  misc_feature 1..209: note = chr20:62037523-62037732
  misc_feature 1..209: note = Hypo
  source 1..209: mol_type = genomic DNA

SEQ ID NO: 120200 - DNA, 665 bp, Homo sapiens; identical to SEQ ID NO: 88318
  misc_feature 1..665: note = chr20:62038025-62038690
  misc_feature 1..665: note = Hypo
  source 1..665: mol_type = genomic DNA

SEQ ID NO: 120201 - DNA, 150 bp, Homo sapiens; identical to SEQ ID NO: 88319
  misc_feature 1..150: note = chr20:62039576-62039726
  misc_feature 1..150: note = Hypo
  source 1..150: mol_type = genomic DNA

SEQ ID NO: 120202 - DNA, 30 bp, Homo sapiens; identical to SEQ ID NO: 88320
  misc_feature 1..30: note = chr20:62042564-62042594
  misc_feature 1..30: note = Hypo
  source 1..30: mol_type = genomic DNA

SEQ ID NO: 120203 - DNA, 395 bp, Homo sapiens; identical to SEQ ID NO: 88321
  misc_feature 1..395: note = chr20:62046201-62046596
  misc_feature 1..395: note = Hypo
  source 1..395: mol_type = genomic DNA

SEQ ID NO: 120204 - DNA, 84 bp, Homo sapiens; identical to SEQ ID NO: 88322
  misc_feature 1..84: note = chr20:62048313-62048397
  misc_feature 1..84: note = Hypo
  source 1..84: mol_type = genomic DNA

SEQ ID NO: 120205 - DNA, 101 bp, Homo sapiens; identical to SEQ ID NO: 88323
  misc_feature 1..101: note = chr20:62050926-62051027
  misc_feature 1..101: note = Hypo
  source 1..101: mol_type = genomic DNA

SEQ ID NO: 120206 - DNA, 40 bp, Homo sapiens; identical to SEQ ID NO: 88324
  misc_feature 1..40: note = chr20:62051926-62051966
  misc_feature 1..40: note = Hypo
  source 1..40: mol_type = genomic DNA

SEQ ID NO: 120207 - DNA, 118 bp, Homo sapiens; identical to SEQ ID NO: 88325
  misc_feature 1..118: note = chr20:62052467-62052585
  misc_feature 1..118: note = Hypo
  source 1..118: mol_type = genomic DNA

SEQ ID NO: 120208 - DNA, 157 bp, Homo sapiens; identical to SEQ ID NO: 88326
  misc_feature 1..157: note = chr20:62053182-62053339
  misc_feature 1..157: note = Hypo
  source 1..157: mol_type = genomic DNA

SEQ ID NO: 120209 - DNA, 175 bp, Homo sapiens; identical to SEQ ID NO: 88327
  misc_feature 1..175: note = chr20:62053798-62053973
  misc_feature 1..175: note = Hypo
  source 1..175: mol_type = genomic DNA

SEQ ID NO: 120210 - DNA, 215 bp, Homo sapiens; identical to SEQ ID NO: 88328
  misc_feature 1..215: note = chr20:62054221-62054436
  misc_feature 1..215: note = Hypo
  source 1..215: mol_type = genomic DNA

SEQ ID NO: 120211 - DNA, 30 bp, Homo sapiens; identical to SEQ ID NO: 88329
  misc_feature 1..30: note = chr20:62054771-62054801
  misc_feature 1..30: note = Hypo
  source 1..30: mol_type = genomic DNA

SEQ ID NO: 120212 - DNA, 30 bp, Homo sapiens; identical to SEQ ID NO: 88330
  misc_feature 1..30: note = chr20:62057304-62057334
  misc_feature 1..30: note = Hypo
  source 1..30: mol_type = genomic DNA

SEQ ID NO: 120213 - DNA, 42 bp, Homo sapiens; identical to SEQ ID NO: 46395
  misc_feature 1..42: note = chr20:62058718-62058760
  misc_feature 1..42: note = Hypo
  source 1..42: mol_type = genomic DNA

SEQ ID NO: 120214 - DNA, 85 bp, Homo sapiens; identical to SEQ ID NO: 88332
  misc_feature 1..85: note = chr20:62060772-62060857
  misc_feature 1..85: note = Hypo
  source 1..85: mol_type = genomic DNA

SEQ ID NO: 120215 - DNA, 30 bp, Homo sapiens; identical to SEQ ID NO: 88334
  misc_feature 1..30: note = chr20:62069071-62069101
  misc_feature 1..30: note = Hypo
  source 1..30: mol_type = genomic DNA

SEQ ID NO: 120216 - DNA, 30 bp, Homo sapiens; identical to SEQ ID NO: 88335
  misc_feature 1..30: note = chr20:62071331-62071361
  misc_feature 1..30: note = Hypo
  source 1..30: mol_type = genomic DNA

SEQ ID NO: 120217 - DNA, 43 bp, Homo sapiens; identical to SEQ ID NO: 88336
  misc_feature 1..43: note = chr20:62071788-62071831
  misc_feature 1..43: note = Hypo
  source 1..43: mol_type = genomic DNA

SEQ ID NO: 120218 - DNA, 30 bp, Homo sapiens; identical to SEQ ID NO: 88337
  misc_feature 1..30: note = chr20:62075804-62075834
  misc_feature 1..30: note = Hypo
  source 1..30: mol_type = genomic DNA

SEQ ID NO: 120219 - DNA, 34 bp, Homo sapiens; identical to SEQ ID NO: 88338
  misc_feature 1..34: note = chr20:62078339-62078373
  misc_feature 1..34: note = Hypo
  source 1..34: mol_type = genomic DNA

SEQ ID NO: 120220 - DNA, 570 bp, Homo sapiens; identical to SEQ ID NO: 88339
  misc_feature 1..570: note = chr20:62090078-62090648
  misc_feature 1..570: note = Hypo
  source 1..570: mol_type = genomic DNA

SEQ ID NO: 120221 - DNA, 32 bp, Homo sapiens; identical to SEQ ID NO: 88340
  misc_feature 1..32: note = chr20:62092270-62092302
  misc_feature 1..32: note = Hypo
  source 1..32: mol_type = genomic DNA

SEQ ID NO: 120222 - DNA, 181 bp, Homo sapiens; identical to SEQ ID NO: 88341
  misc_feature 1..181: note = chr20:62094124-62094305
  misc_feature 1..181: note = Hypo
  source 1..181: mol_type = genomic DNA

SEQ ID NO: 120223 - DNA, 30 bp, Homo sapiens; identical to SEQ ID NO: 88342
  misc_feature 1..30: note = chr20:62096894-62096924
  misc_feature 1..30: note = Hypo
  source 1..30: mol_type = genomic DNA

SEQ ID NO: 120224 - DNA, 128 bp, Homo sapiens; identical to SEQ ID NO: 88343
  misc_feature 1..128: note = chr20:62097848-62097976
  misc_feature 1..128: note = Hypo
  source 1..128: mol_type = genomic DNA

SEQ ID NO: 120225 - DNA, 1110 bp, Homo sapiens
  misc_feature 1..1110: note = chr20:62102787-62103897
  misc_feature 1..1110: note = Hyper
  source 1..1110: mol_type = genomic DNA
gggtcccaggtctgccgcagcccctcccccgggcctcgctctgccaaggaggggtcctgagcccgggatgtgcacgggggcggccggcggctgcagagatgggacagcgcaggagctgagcgcaggagctgagggggttcgcggggccagggaggggcgtcggcgccgagggggcaggacagacagctgcgctcagcccgggctggggtgggggggtcatgggagggcccctcccccatctcaggaacccagaagctcaccctagtctgagggagagcggctcgggaggatggcggaggacaggccagacccctcccccccgccctcgcttggtcgggcggccccagccccgcgggtccccgagagtcccggagagtccagacccagcgctgccgccgtccctccccggccggccctttgttcggcgcagaggccgcggggaggggcctcccaggctgaggagggggctggggcggccgcacgtctctgtcctgcgggcctggagcccccaccccgacctgagcggccccgaccccggaatccttcctgcccgcgcgctgtacaatcgctctccggtctcggcccagcactcccgccggggagcgccggccccggacccagacccaggggcagggagccaaacccgccgcagccagcctggccggggtcgccgatggggtcgccgatgggggtcgccatgggggtcgccacgggggccccgccggccactcacacgtaggcgtggtagatgaacgcccagccgcgcggccgctccagcacgttgtagaggaaattctgcagcttgcggtagaaggcgttgcgcttggggggcttcccggcgcccgcgccgcccgcgcgaggtttgctgaggatgctgccgcgcttgggggcctcggagccggcgatcagcagcgccccgtcccgggtggagtcgggcgcgccggggtccagccccacgaagcccaccttcagcttcttctccccgctcgggccggggtatacgccgccgttgcgcgacttctgcaccatggtgcctggcgggaggcgccccgggtcgggctcaggctcagcgggggcggagcgcggggggcggcgcgggccccagcccag

SEQ ID NO: 120226 - DNA, 163 bp, Homo sapiens; identical to SEQ ID NO: 46399
  misc_feature 1..163: note = chr20:62115182-62115345
  misc_feature 1..163: note = Hypo
  source 1..163: mol_type = genomic DNA

SEQ ID NO: 120227 - DNA, 44 bp, Homo sapiens; identical to SEQ ID NO: 88347
  misc_feature 1..44: note = chr20:62117912-62117956
  misc_feature 1..44: note = Hypo
  source 1..44: mol_type = genomic DNA

SEQ ID NO: 120228 - DNA, 858 bp, Homo sapiens
  misc_feature 1..858: note = chr20:62119313-62120171
  misc_feature 1..858: note = Hyper
  source 1..858: mol_type = genomic DNA
agggggtccggggggcgcggggcccaccccccagcagcaggcgcacacggctctggggtcgctcagtttattggtaaaacgggcactgagcgtggcgagcgctgggcgcggaagcctggggcgggggcgcctttcctcttgaagaacttccactggaccttgatggcgagcatccagtcgctgaccgagggcctctggcaagcggaggtgcagacatgcgcctggcgggggtgcggggcgccggaccggcgcgcggggcgggggcggggcgggggcccgggcccggggttcggagcgcggcaccgccggggagggtcgcgccgcgggcgcccgcgcttcacttgcccgccttctgcgccttctgcgccgacttggtgaccttgccggcgccgccgctcttcttctccacgttcttgatgacgcctacggccaccgtctgcctcatgtcgcgcacggcgaagcggcctggggggcggggggcggcgtgtgggcggggccggaggacttgaccccccccaaccccagggctctggccgggcgggggcgcaaccgcgtcgggaatgtcctcggaacacgcttagcgcagagcgcgcccctgtgaagacggccggcctcgcgggagtcctgcctgggcggctgctccacggtctgcggggcggccacggggcgggggcagccctaacgctgccactgggcgaccgcgggccttcctcactcgcggggcctccctcactttcggggcctcgtctgcacacagggcccaccccagctcgtctgggcagggtcacctgcactcagtgacacggaggccgtggctctcctgccatgctctgggccaagctccgcaggaaagggggc

SEQ ID NO: 120229 - DNA, 526 bp, Homo sapiens; identical to SEQ ID NO: 88350
  misc_feature 1..526: note = chr20:62126038-62126564
  misc_feature 1..526: note = Hypo
  source 1..526: mol_type = genomic DNA

SEQ ID NO: 120230 - DNA, 196 bp, Homo sapiens; identical to SEQ ID NO: 88351
  misc_feature 1..196: note = chr20:62131908-62132104
  misc_feature 1..196: note = Hypo
  source 1..196: mol_type = genomic DNA

SEQ ID NO: 120231 - DNA, 30 bp, Homo sapiens; identical to SEQ ID NO: 88352
  misc_feature 1..30: note = chr20:62137607-62137637
  misc_feature 1..30: note = Hypo
  source 1..30: mol_type = genomic DNA

SEQ ID NO: 120232 - DNA, 30 bp, Homo sapiens; identical to SEQ ID NO: 88353
  misc_feature 1..30: note = chr20:62141242-62141272
  misc_feature 1..30: note = Hypo
  source 1..30: mol_type = genomic DNA

SEQ ID NO: 120233 - DNA, 126 bp, Homo sapiens; identical to SEQ ID NO: 88354
  misc_feature 1..126: note = chr20:62149153-62149279
  misc_feature 1..126: note = Hypo
  source 1..126: mol_type = genomic DNA

SEQ ID NO: 120234 - DNA, 36 bp, Homo sapiens; identical to SEQ ID NO: 88355
  misc_feature 1..36: note = chr20:62149530-62149566
  misc_feature 1..36: note = Hypo
  source 1..36: mol_type = genomic DNA

SEQ ID NO: 120235 - DNA, 253 bp, Homo sapiens; identical to SEQ ID NO: 88356
  misc_feature 1..253: note = chr20:62153209-62153462
  misc_feature 1..253: note = Hypo
  source 1..253: mol_type = genomic DNA

SEQ ID NO: 120236 - DNA, 76 bp, Homo sapiens; identical to SEQ ID NO: 88357
  misc_feature 1..76: note = chr20:62157231-62157307
  misc_feature 1..76: note = Hypo
  source 1..76: mol_type = genomic DNA

SEQ ID NO: 120237 - DNA, 30 bp, Homo sapiens; identical to SEQ ID NO: 88358
  misc_feature 1..30: note = chr20:62163260-62163290
  misc_feature 1..30: note = Hypo
  source 1..30: mol_type = genomic DNA

SEQ ID NO: 120238 - DNA, 276 bp, Homo sapiens; identical to SEQ ID NO: 88359
  misc_feature 1..276: note = chr20:62165579-62165855
  misc_feature 1..276: note = Hypo
  source 1..276: mol_type = genomic DNA

SEQ ID NO: 120239 - DNA, 30 bp, Homo sapiens; identical to SEQ ID NO: 88360
  misc_feature 1..30: note = chr20:62166949-62166979
  misc_feature 1..30: note = Hypo
  source 1..30: mol_type = genomic DNA

SEQ ID NO: 120240 - DNA, 272 bp, Homo sapiens; identical to SEQ ID NO: 88361
  misc_feature 1..272: note = chr20:62167554-62167826
  misc_feature 1..272: note = Hypo
  source 1..272: mol_type = genomic DNA

SEQ ID NO: 120241 - DNA, 237 bp, Homo sapiens; identical to SEQ ID NO: 46405
  misc_feature 1..237: note = chr20:62168240-62168477
  misc_feature 1..237: note = Hypo
  source 1..237: mol_type = genomic DNA

SEQ ID NO: 120242 - DNA, 248 bp, Homo sapiens; identical to SEQ ID NO: 88363
  misc_feature 1..248: note = chr20:62170122-62170370
  misc_feature 1..248: note = Hypo
  source 1..248: mol_type = genomic DNA

SEQ ID NO: 120243 - DNA, 252 bp, Homo sapiens; identical to SEQ ID NO: 46407
  misc_feature 1..252: note = chr20:62172062-62172314
  misc_feature 1..252: note = Hypo
  source 1..252: mol_type = genomic DNA

SEQ ID NO: 120244 - DNA, 553 bp, Homo sapiens; identical to SEQ ID NO: 88365
  misc_feature 1..553: note = chr20:62172646-62173199
  misc_feature 1..553: note = Hypo
  source 1..553: mol_type = genomic DNA

SEQ ID NO: 120245 - DNA, 115 bp, Homo sapiens; identical to SEQ ID NO: 88366
  misc_feature 1..115: note = chr20:62181335-62181450
  misc_feature 1..115: note = Hypo
  source 1..115: mol_type = genomic DNA

SEQ ID NO: 120246 - DNA, 237 bp, Homo sapiens; identical to SEQ ID NO: 88367
  misc_feature 1..237: note = chr20:62185322-62185559
  misc_feature 1..237: note = Hyper
  source 1..237: mol_type = genomic DNA

SEQ ID NO: 120247 - DNA, 30 bp, Homo sapiens; identical to SEQ ID NO: 88368
  misc_feature 1..30: note = chr20:62197386-62197416
  misc_feature 1..30: note = Hypo
  source 1..30: mol_type = genomic DNA

SEQ ID NO: 120248 - DNA, 47 bp, Homo sapiens; identical to SEQ ID NO: 88369
  misc_feature 1..47: note = chr20:62200790-62200837
  misc_feature 1..47: note = Hypo
  source 1..47: mol_type = genomic DNA

SEQ ID NO: 120249 - DNA, 159 bp, Homo sapiens; identical to SEQ ID NO: 88370
  misc_feature 1..159: note = chr20:62204228-62204387
  misc_feature 1..159: note = Hypo
  source 1..159: mol_type = genomic DNA

SEQ ID NO: 120250 - DNA, 123 bp, Homo sapiens; identical to SEQ ID NO: 88371
  misc_feature 1..123: note = chr20:62221319-62221442
  misc_feature 1..123: note = Hypo
  source 1..123: mol_type = genomic DNA

SEQ ID NO: 120251 - DNA, 30 bp, Homo sapiens; identical to SEQ ID NO: 88372
  misc_feature 1..30: note = chr20:62250986-62251016
  misc_feature 1..30: note = Hypo
  source 1..30: mol_type = genomic DNA

SEQ ID NO: 120252 - DNA, 35 bp, Homo sapiens; identical to SEQ ID NO: 46411
  misc_feature 1..35: note = chr20:62274577-62274612
  misc_feature 1..35: note = Hypo
  source 1..35: mol_type = genomic DNA

SEQ ID NO: 120253 - DNA, 30 bp, Homo sapiens; identical to SEQ ID NO: 88374
  misc_feature 1..30: note = chr20:62275052-62275082
  misc_feature 1..30: note = Hypo
  source 1..30: mol_type = genomic DNA

SEQ ID NO: 120254 - DNA, 30 bp, Homo sapiens; identical to SEQ ID NO: 88375
  misc_feature 1..30: note = chr20:62276993-62277023
  misc_feature 1..30: note = Hypo
  source 1..30: mol_type = genomic DNA

SEQ ID NO: 120255 - DNA, 163 bp, Homo sapiens; identical to SEQ ID NO: 88376
  misc_feature 1..163: note = chr20:62281532-62281695
  misc_feature 1..163: note = Hypo
  source 1..163: mol_type = genomic DNA

SEQ ID NO: 120256 - DNA, 141 bp, Homo sapiens; identical to SEQ ID NO: 88377
  misc_feature 1..141: note = chr20:62283695-62283836
  misc_feature 1..141: note = Hyper
  source 1..141: mol_type = genomic DNA

SEQ ID NO: 120257 - DNA, 94 bp, Homo sapiens; identical to SEQ ID NO: 88378
  misc_feature 1..94: note = chr20:62290954-62291048
  misc_feature 1..94: note = Hypo
  source 1..94: mol_type = genomic DNA

SEQ ID NO: 120258 - DNA, 60 bp, Homo sapiens; identical to SEQ ID NO: 88379
  misc_feature 1..60: note = chr20:62310644-62310704
  misc_feature 1..60: note = Hypo
  source 1..60: mol_type = genomic DNA

SEQ ID NO: 120259 - DNA, 30 bp, Homo sapiens; identical to SEQ ID NO: 46414
  misc_feature 1..30: note = chr20:62311251-62311281
  misc_feature 1..30: note = Hypo
  source 1..30: mol_type = genomic DNA

SEQ ID NO: 120260 - DNA, 1111 bp, Homo sapiens; identical to SEQ ID NO: 88381
  misc_feature 1..1111: note = chr20:62320911-62322022
  misc_feature 1..1111: note = Hypo
  source 1..1111: mol_type = genomic DNA

SEQ ID NO: 120261 - DNA, 30 bp, Homo sapiens; identical to SEQ ID NO: 16693
  misc_feature 1..30: note = chr20:62329526-62329556
  misc_feature 1..30: note = Hypo
  source 1..30: mol_type = genomic DNA

SEQ ID NO: 120262 - DNA, 192 bp, Homo sapiens; identical to SEQ ID NO: 88383
  misc_feature 1..192: note = chr20:62331754-62331946
  misc_feature 1..192: note = Hypo
  source 1..192: mol_type = genomic DNA

SEQ ID NO: 120263 - DNA, 96 bp, Homo sapiens; identical to SEQ ID NO: 88384
  misc_feature 1..96: note = chr20:62340225-62340321
  misc_feature 1..96: note = Hypo
  source 1..96: mol_type = genomic DNA

SEQ ID NO: 120264 - DNA, 77 bp, Homo sapiens; identical to SEQ ID NO: 88385
  misc_feature 1..77: note = chr20:62340648-62340725
  misc_feature 1..77: note = Hypo
  source 1..77: mol_type = genomic DNA

SEQ ID NO: 120265 - DNA, 346 bp, Homo sapiens
  misc_feature 1..346: note = chr20:62369069-62369415
  misc_feature 1..346: note = Hyper
  source 1..346: mol_type = genomic DNA
ggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcaggggt

SEQ ID NO: 120266 - DNA, 33 bp, Homo sapiens; identical to SEQ ID NO: 88387
  misc_feature 1..33: note = chr20:62378380-62378413
  misc_feature 1..33: note = Hypo
  source 1..33: mol_type = genomic DNA

SEQ ID NO: 120267 - DNA, 1084 bp, Homo sapiens; identical to SEQ ID NO: 88388
  misc_feature 1..1084: note = chr20:62383131-62384215
  misc_feature 1..1084: note = Hypo
  source 1..1084: mol_type = genomic DNA

SEQ ID NO: 120268 - DNA, 42 bp, Homo sapiens; identical to SEQ ID NO: 88389
  misc_feature 1..42: note = chr20:62386430-62386472
  misc_feature 1..42: note = Hypo
  source 1..42: mol_type = genomic DNA

SEQ ID NO: 120269 - DNA, 495 bp, Homo sapiens; identical to SEQ ID NO: 88390
  misc_feature 1..495: note = chr20:62398454-62398949
  misc_feature 1..495: note = Hypo
  source 1..495: mol_type = genomic DNA

SEQ ID NO: 120270 - DNA, 198 bp, Homo sapiens; identical to SEQ ID NO: 88391
  misc_feature 1..198: note = chr20:62400759-62400957
  misc_feature 1..198: note = Hypo
  source 1..198: mol_type = genomic DNA

SEQ ID NO: 120271 - DNA, 30 bp, Homo sapiens; identical to SEQ ID NO: 88392
  misc_feature 1..30: note = chr20:62403252-62403282
  misc_feature 1..30: note = Hypo
  source 1..30: mol_type = genomic DNA

SEQ ID NO: 120272 - DNA, 163 bp, Homo sapiens; identical to SEQ ID NO: 88393
  misc_feature 1..163: note = chr20:62404995-62405158
  misc_feature 1..163: note = Hypo
  source 1..163: mol_type = genomic DNA

SEQ ID NO: 120273 - DNA, 77 bp, Homo sapiens; identical to SEQ ID NO: 88394
  misc_feature 1..77: note = chr20:62407078-62407155
  misc_feature 1..77: note = Hypo
  source 1..77: mol_type = genomic DNA

SEQ ID NO: 120274 - DNA, 320 bp, Homo sapiens; identical to SEQ ID NO: 88395
  misc_feature 1..320: note = chr20:62407384-62407704
  misc_feature 1..320: note = Hypo
  source 1..320: mol_type = genomic DNA

SEQ ID NO: 120275 - DNA, 47 bp, Homo sapiens; identical to SEQ ID NO: 88397
  misc_feature 1..47: note = chr20:62415068-62415115
  misc_feature 1..47: note = Hypo
  source 1..47: mol_type = genomic DNA

SEQ ID NO: 120276 - DNA, 30 bp, Homo sapiens; identical to SEQ ID NO: 88398
  misc_feature 1..30: note = chr20:62417499-62417529
  misc_feature 1..30: note = Hypo
  source 1..30: mol_type = genomic DNA

SEQ ID NO: 120277 - DNA, 74 bp, Homo sapiens; identical to SEQ ID NO: 88399
  misc_feature 1..74: note = chr20:62422247-62422321
  misc_feature 1..74: note = Hypo
  source 1..74: mol_type = genomic DNA

SEQ ID NO: 120278 - DNA, 267 bp, Homo sapiens; identical to SEQ ID NO: 88400
  misc_feature 1..267: note = chr20:62427164-62427431
  misc_feature 1..267: note = Hypo
  source 1..267: mol_type = genomic DNA

SEQ ID NO: 120279 - DNA, 30 bp, Homo sapiens; identical to SEQ ID NO: 88401
  misc_feature 1..30: note = chr20:62431319-62431349
  misc_feature 1..30: note = Hypo
  source 1..30: mol_type = genomic DNA

SEQ ID NO: 120280 - DNA, 30 bp, Homo sapiens; identical to SEQ ID NO: 88402
  misc_feature 1..30: note = chr20:62433257-62433287
  misc_feature 1..30: note = Hypo
  source 1..30: mol_type = genomic DNA

SEQ ID NO: 120281 - DNA, 96 bp, Homo sapiens; identical to SEQ ID NO: 88403
  misc_feature 1..96: note = chr20:62440444-62440540
  misc_feature 1..96: note = Hypo
  source 1..96: mol_type = genomic DNA

SEQ ID NO: 120282 - DNA, 348 bp, Homo sapiens; identical to SEQ ID NO: 88404
  misc_feature 1..348: note = chr20:62461291-62461639
  misc_feature 1..348: note = Hyper
  source 1..348: mol_type = genomic DNA

SEQ ID NO: 120283 - DNA, 166 bp, Homo sapiens; identical to SEQ ID NO: 88405
  misc_feature 1..166: note = chr20:62463049-62463215
  misc_feature 1..166: note = Hyper
  source 1..166: mol_type = genomic DNA

SEQ ID NO: 120284 - DNA, 378 bp, Homo sapiens
  misc_feature 1..378: note = chr20:62463430-62463808
  misc_feature 1..378: note = Hyper
  source 1..378: mol_type = genomic DNA
gttgtctgcgggggacgaatggctccgggagggggcgggaaccagcggcccgggcctcgccccagcccgtgtgcagccccgatccgaacggcctgggacgcgtctccaccactcggcgcccggactctgcgcgtcgcttctcgcctccgccgtcctcagccctcgggcgggtagagtgggaagcgcggccccgcattcctggccggcctgcgcaggggtaaaggccacctcgcttcctctccccgggcgcggcgggaagggaggtgagcctgtggccggcagccgcgcgagggagtcgagcccggcccggccaaccaatggggaggcgcccgggccgtccagcctgcctccctgcgggcccagcgcagcggattcctc

SEQ ID NO: 120285 - DNA, 99 bp, Homo sapiens; identical to SEQ ID NO: 88407
  misc_feature 1..99: note = chr20:62472040-62472139
  misc_feature 1..99: note = Hypo
  source 1..99: mol_type = genomic DNA

SEQ ID NO: 120286 - DNA, 30 bp, Homo sapiens; identical to SEQ ID NO: 88408
  misc_feature 1..30: note = chr20:62474624-62474654
  misc_feature 1..30: note = Hypo
  source 1..30: mol_type = genomic DNA

SEQ ID NO: 120287 - DNA, 212 bp, Homo sapiens; identical to SEQ ID NO: 46423
  misc_feature 1..212: note = chr20:62481430-62481642
  misc_feature 1..212: note = Hypo
  source 1..212: mol_type = genomic DNA

SEQ ID NO: 120288 - DNA, 147 bp, Homo sapiens; identical to SEQ ID NO: 88410
  misc_feature 1..147: note = chr20:62487806-62487953
  misc_feature 1..147: note = Hypo
  source 1..147: mol_type = genomic DNA

SEQ ID NO: 120289 - DNA, 506 bp, Homo sapiens; identical to SEQ ID NO: 88411
  misc_feature 1..506: note = chr20:62488253-62488759
  misc_feature 1..506: note = Hypo
  source 1..506: mol_type = genomic DNA

SEQ ID NO: 120290 - DNA, 74 bp, Homo sapiens; identical to SEQ ID NO: 88412
  misc_feature 1..74: note = chr20:62513823-62513897
  misc_feature 1..74: note = Hypo
  source 1..74: mol_type = genomic DNA

SEQ ID NO: 120291 - DNA, 20 bp, Homo sapiens
  misc_feature 1..20: note = chr20:62586346-62586366
  misc_feature 1..20: note = Hypo
  source 1..20: mol_type = genomic DNA
taatcccacggaggccgagg

SEQ ID NO: 120292 - DNA, 162 bp, Homo sapiens; identical to SEQ ID NO: 88414
  misc_feature 1..162: note = chr20:62600647-62600809
  misc_feature 1..162: note = Hyper
  source 1..162: mol_type = genomic DNA

SEQ ID NO: 120293 - DNA, 98 bp, Homo sapiens; identical to SEQ ID NO: 88415
  misc_feature 1..98: note = chr20:62607076-62607174
  misc_feature 1..98: note = Hypo
  source 1..98: mol_type = genomic DNA

SEQ ID NO: 120294 - DNA, 30 bp, Homo sapiens; identical to SEQ ID NO: 88416
  misc_feature 1..30: note = chr20:62632965-62632995
  misc_feature 1..30: note = Hypo
  source 1..30: mol_type = genomic DNA

SEQ ID NO: 120295 - DNA, 98 bp, Homo sapiens; identical to SEQ ID NO: 88417
  misc_feature 1..98: note = chr20:62662173-62662271
  misc_feature 1..98: note = Hypo
  source 1..98: mol_type = genomic DNA

SEQ ID NO: 120296 - DNA, 247 bp, Homo sapiens; identical to SEQ ID NO: 88418
  misc_feature 1..247: note = chr20:62673837-62674084
  misc_feature 1..247: note = Hyper
  source 1..247: mol_type = genomic DNA

SEQ ID NO: 120297 - DNA, 227 bp, Homo sapiens
  misc_feature 1..227: note = chr20:62680216-62680443
  misc_feature 1..227: note = Hyper
  source 1..227: mol_type = genomic DNA
tgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgcccc

SEQ ID NO: 120298 - DNA, 130 bp, Homo sapiens; identical to SEQ ID NO: 88421
  misc_feature 1..130: note = chr20:62680766-62680896
  misc_feature 1..130: note = Hyper
  source 1..130: mol_type = genomic DNA

SEQ ID NO: 120299 - DNA, 482 bp, Homo sapiens
  misc_feature 1..482: note = chr20:62694285-62694767
  misc_feature 1..482: note = Hyper
  source 1..482: mol_type = genomic DNA
ggggcccggtcgctccgggatgtctgagctctgggaggggcgtgcccggggcgcctccctcgcggggtattgtgggatcacgagtcactggcgacggtgggtcaggactacacttcccaggaggctgtgcgcgccgcgtggcgcctgggagttgtggtccagagcgcgggcgcggcgggcgcggcaggcgggcgcgtggactacgcatcctaggatgccgcgcgcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccggg

SEQ ID NO: 120300 - DNA, 30 bp, Homo sapiens; identical to SEQ ID NO: 88424
  misc_feature 1..30: note = chr20:62695018-62695048
  misc_feature 1..30: note = Hyper
  source 1..30: mol_type = genomic DNA

SEQ ID NO: 120301 - DNA, 30 bp, Homo sapiens; identical to SEQ ID NO: 88425
  misc_feature 1..30: note = chr20:62695315-62695345
  misc_feature 1..30: note = Hyper
  source 1..30: mol_type = genomic DNA

SEQ ID NO: 120302 - DNA, 30 bp, Homo sapiens; identical to SEQ ID NO: 88426
  misc_feature 1..30: note = chr20:62701901-62701931
  misc_feature 1..30: note = Hypo
  source 1..30: mol_type = genomic DNA

SEQ ID NO: 120303 - DNA, 30 bp, Homo sapiens; identical to SEQ ID NO: 88427
  misc_feature 1..30: note = chr20:62705558-62705588
  misc_feature 1..30: note = Hypo
  source 1..30: mol_type = genomic DNA

SEQ ID NO: 120304 - DNA, 201 bp, Homo sapiens; identical to SEQ ID NO: 88428
  misc_feature 1..201: note = chr20:62714665-62714866
  misc_feature 1..201: note = Hyper
  source 1..201: mol_type = genomic DNA

SEQ ID NO: 120305 - DNA, 450 bp, Homo sapiens; identical to SEQ ID NO: 88429
  misc_feature 1..450: note = chr20:62715171-62715621
  misc_feature 1..450: note = Hyper
  source 1..450: mol_type = genomic DNA

SEQ ID NO: 120306 - DNA, 214 bp, Homo sapiens; identical to SEQ ID NO: 88430
  misc_feature 1..214: note = chr20:62722733-62722947
  misc_feature 1..214: note = Hypo
  source 1..214: mol_type = genomic DNA

SEQ ID NO: 120307 - DNA, 101 bp, Homo sapiens; identical to SEQ ID NO: 88431
  misc_feature 1..101: note = chr20:62726693-62726794
  misc_feature 1..101: note = Hypo
  source 1..101: mol_type = genomic DNA

SEQ ID NO: 120308 - DNA, 954 bp, Homo sapiens
  misc_feature 1..954: note = chr20:62733381-62734335
  misc_feature 1..954: note = Hyper
  source 1..954: mol_type = genomic DNA
ggcttttctgagcctcggtttccttccgtgtgcaaaggggaccgcagaaccctctttgtggggttgtgggggaaggctggggcgcccgggagggtcccgggtcgcgtccgacctcaggaaggcggggcttcagcagcggcctcggaccctccctccagggggcgctgtgggctcacgcgggcccagccttgggccccggggcgctgcggcgggaaccgcggtgactagcggggtcttaaagcgggtggcggggccgggctctcctgggaccaggagcccagagcgtggagacgtggcgggctgagccgctcagtgcggcccctgccccgcgcccaccccgccccgtgtcaggaggtccgcggagcgggaggacccgcctcccggggagagctcgcccgcccctccctcccggctggccgcggggcggtctgcagaccctttggccgtgccggatctgcctggtccccggggagaagacgctgaggatcccattgctggtctgtggatggggacaggagacgcccgaggtaagaaggggtccgggttctttggaggaatcctggttggcgccttctctgcagcagagacgcccggctggggccggagggcaaactgggggcagggtgggagacctcggccctgagggctgtaggggctcttgcctgggcgctccttaagctcccccgccccctccgccccccaccccgcggtgctcactctcagtcctgccttgcgcacattcccacgcccgggcctctcctgcccgcccctcgttgttcacttgctcattacgcctcacacctggctctgccgcgggcttggagcgggtgtctgggaaacacagtctcacttgtctcctcaaggggctccggggcaccgtaacagcgtgcagagcgcagtcaggctgccgtgctgctgctttgcgaggtgtgactgcagcgcagccaggaaaca

SEQ ID NO: 120309 - DNA, 115 bp, Homo sapiens; identical to SEQ ID NO: 88434
  misc_feature 1..115: note = chr20:62736331-62736446
  misc_feature 1..115: note = Hypo
  source 1..115: mol_type = genomic DNA

SEQ ID NO: 120310 - DNA, 46 bp, Homo sapiens; identical to SEQ ID NO: 88435
  misc_feature 1..46: note = chr20:62737744-62737790
  misc_feature 1..46: note = Hypo
  source 1..46: mol_type = genomic DNA

SEQ ID NO: 120311 - DNA, 36 bp, Homo sapiens; identical to SEQ ID NO: 16700
  misc_feature 1..36: note = chr20:62762699-62762735
  misc_feature 1..36: note = Hypo
  source 1..36: mol_type = genomic DNA

SEQ ID NO: 120312 - DNA, 22 bp, Homo sapiens
  misc_feature 1..22: note = chr20:62766300-62766322
  misc_feature 1..22: note = Hypo
  source 1..22: mol_type = genomic DNA
cgaatcacaaacacacgctccc

SEQ ID NO: 120313 - DNA, 152 bp, Homo sapiens; identical to SEQ ID NO: 88438
  misc_feature 1..152: note = chr20:62767680-62767832
  misc_feature 1..152: note = Hypo
  source 1..152: mol_type = genomic DNA

SEQ ID NO: 120314 - DNA, 195 bp, Homo sapiens; identical to SEQ ID NO: 88439
  misc_feature 1..195: note = chr20:62784544-62784739
  misc_feature 1..195: note = Hypo
  source 1..195: mol_type = genomic DNA

SEQ ID NO: 120315 - DNA, 30 bp, Homo sapiens; identical to SEQ ID NO: 38302
  misc_feature 1..30: note = chr20:62793356-62793386
  misc_feature 1..30: note = Hyper
  source 1..30: mol_type = genomic DNA

SEQ ID NO: 120316 - DNA, 30 bp, Homo sapiens; identical to SEQ ID NO: 88441
  misc_feature 1..30: note = chr20:62796246-62796276
  misc_feature 1..30: note = Hypo
  source 1..30: mol_type = genomic DNA

SEQ ID NO: 120317 - DNA, 17 bp, Homo sapiens
  misc_feature 1..17: note = chr20:62815469-62815486
  misc_feature 1..17: note = Hypo
  source 1..17: mol_type = genomic DNA
gccgacagtgttatttt

SEQ ID NO: 120318 - DNA, 30 bp, Homo sapiens; identical to SEQ ID NO: 88443
  misc_feature 1..30: note = chr20:62819320-62819350
  misc_feature 1..30: note = Hypo
  source 1..30: mol_type = genomic DNA

SEQ ID NO: 120319 - DNA, 58 bp, Homo sapiens; identical to SEQ ID NO: 88444
  misc_feature 1..58: note = chr20:62832330-62832388
  misc_feature 1..58: note = Hypo
  source 1..58: mol_type = genomic DNA

SEQ ID NO: 120320 - DNA, 66 bp, Homo sapiens; identical to SEQ ID NO: 88445
  misc_feature 1..66: note = chr20:62839592-62839658
  misc_feature 1..66: note = Hypo
  source 1..66: mol_type = genomic DNA

SEQ ID NO: 120321 - DNA, 30 bp, Homo sapiens; identical to SEQ ID NO: 88446
  misc_feature 1..30: note = chr20:62863399-62863429
  misc_feature 1..30: note = Hypo
  source 1..30: mol_type = genomic DNA

SEQ ID NO: 120322 - DNA, 30 bp, Homo sapiens; identical to SEQ ID NO: 88447
  misc_feature 1..30: note = chr20:62863671-62863701
  misc_feature 1..30: note = Hypo
  source 1..30: mol_type = genomic DNA

SEQ ID NO: 120323 - DNA, 30 bp, Homo sapiens; identical to SEQ ID NO: 88448
  misc_feature 1..30: note = chr20:62868739-62868769
  misc_feature 1..30: note = Hypo
  source 1..30: mol_type = genomic DNA

SEQ ID NO: 120324 - DNA, 114 bp, Homo sapiens; identical to SEQ ID NO: 88449
  misc_feature 1..114: note = chr20:62871823-62871937
  misc_feature 1..114: note = Hypo
  source 1..114: mol_type = genomic DNA

SEQ ID NO: 120325 - DNA, 30 bp, Homo sapiens; identical to SEQ ID NO: 46431
  misc_feature 1..30: note = chr20:62873290-62873320
  misc_feature 1..30: note = Hypo
  source 1..30: mol_type = genomic DNA

SEQ ID NO: 120326 - DNA, 473 bp, Homo sapiens
  misc_feature 1..473: note = chr20:62947861-62948334
  misc_feature 1..473: note = Hyper
  source 1..473: mol_type = genomic DNA
cgcggaagccccttccgagccccctcgggccgggaacgcgggaggaggcggcgccctgcgccgggaggccccagacaccgtgggcgggcggctgtgcgcggccaggctgcgtgggagcgggcagcggcggcggggggcgctccgcgcgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcctcgccgccgcccccgcgaggaagtgcgaggctggacgctgggaggcgcgcgtgggccgggagattccttctcgcctgccggctaccagccggcccgcccacgccgccgagatcccgactccacgttccctccccacggaggagtcggggcagcgcacggaggcggaaaggc

SEQ ID NO: 120327 - DNA, 30 bp, Homo sapiens; identical to SEQ ID NO: 88494
  misc_feature 1..30: note = chr21:14752739-14752769
  misc_feature 1..30: note = Hypo
  source 1..30: mol_type = genomic DNA

SEQ ID NO: 120328 - DNA, 35 bp, Homo sapiens; identical to SEQ ID NO: 88495
  misc_feature 1..35: note = chr21:15309741-15309776
  misc_feature 1..35: note = Hypo
  source 1..35: mol_type = genomic DNA

SEQ ID NO: 120329 - DNA, 102 bp, Homo sapiens; identical to SEQ ID NO: 88496
  misc_feature 1..102: note = chr21:15383566-15383668
  misc_feature 1..102: note = Hypo
  source 1..102: mol_type = genomic DNA

SEQ ID NO: 120330 - DNA, 176 bp, Homo sapiens; identical to SEQ ID NO: 88497
  misc_feature 1..176: note = chr21:15442571-15442747
  misc_feature 1..176: note = Hypo
  source 1..176: mol_type = genomic DNA

SEQ ID NO: 120331 - DNA, 42 bp, Homo sapiens; identical to SEQ ID NO: 88498
  misc_feature 1..42: note = chr21:15442995-15443037
  misc_feature 1..42: note = Hypo
  source 1..42: mol_type = genomic DNA

SEQ ID NO: 120332 - DNA, 62 bp, Homo sapiens; identical to SEQ ID NO: 88499
  misc_feature 1..62: note = chr21:15443988-15444050
  misc_feature 1..62: note = Hypo
  source 1..62: mol_type = genomic DNA

SEQ ID NO: 120333 - DNA, 77 bp, Homo sapiens; identical to SEQ ID NO: 88500
  misc_feature 1..77: note = chr21:15444767-15444844
  misc_feature 1..77: note = Hypo
  source 1..77: mol_type = genomic DNA

SEQ ID NO: 120334 - DNA, 75 bp, Homo sapiens; identical to SEQ ID NO: 88501
  misc_feature 1..75: note = chr21:15446513-15446588
  misc_feature 1..75: note = Hypo
  source 1..75: mol_type = genomic DNA

SEQ ID NO: 120335 - DNA, 107 bp, Homo sapiens; identical to SEQ ID NO: 88502
  misc_feature 1..107: note = chr21:15455882-15455989
  misc_feature 1..107: note = Hypo
  source 1..107: mol_type = genomic DNA

SEQ ID NO: 120336 - DNA, 555 bp, Homo sapiens; identical to SEQ ID NO: 88503
  misc_feature 1..555: note = chr21:15588356-15588911
  misc_feature 1..555: note = Hyper
  source 1..555: mol_type = genomic DNA

SEQ ID NO: 120337 - DNA, 34 bp, Homo sapiens; identical to SEQ ID NO: 88504
  misc_feature 1..34: note = chr21:15693964-15693998
  misc_feature 1..34: note = Hypo
  source 1..34: mol_type = genomic DNA

SEQ ID NO: 120338 - DNA, 94 bp, Homo sapiens; identical to SEQ ID NO: 88505
  misc_feature 1..94: note = chr21:15694238-15694332
  misc_feature 1..94: note = Hypo
  source 1..94: mol_type = genomic DNA

SEQ ID NO: 120339 - DNA, 30 bp, Homo sapiens; identical to SEQ ID NO: 46436
  misc_feature 1..30: note = chr21:15762808-15762838
  misc_feature 1..30: note = Hypo
  source 1..30: mol_type = genomic DNA

SEQ ID NO: 120340 - DNA, 30 bp, Homo sapiens; identical to SEQ ID NO: 88507
  misc_feature 1..30: note = chr21:15955683-15955713
  misc_feature 1..30: note = Hypo
  source 1..30: mol_type = genomic DNA

SEQ ID NO: 120341 - DNA, 23 bp, Homo sapiens
  misc_feature 1..23: note = chr21:16033840-16033863
  misc_feature 1..23: note = Hypo
  source 1..23: mol_type = genomic DNA
ttgcgtctatgaattcgactttt

SEQ ID NO: 120342 - DNA, 179 bp, Homo sapiens; identical to SEQ ID NO: 88509
  misc_feature 1..179: note = chr21:16438535-16438714
  misc_feature 1..179: note = Hyper
  source 1..179: mol_type = genomic DNA

SEQ ID NO: 120343 - DNA, 211 bp, Homo sapiens; identical to SEQ ID NO: 88510
  misc_feature 1..211: note = chr21:18985471-18985682
  misc_feature 1..211: note = Hyper
  source 1..211: mol_type = genomic DNA

SEQ ID NO: 120344 - DNA, 85 bp, Homo sapiens; identical to SEQ ID NO: 88511
  misc_feature 1..85: note = chr21:19274379-19274464
  misc_feature 1..85: note = Hypo
  source 1..85: mol_type = genomic DNA

SEQ ID NO: 120345 - DNA, 96 bp, Homo sapiens; identical to SEQ ID NO: 88512
  misc_feature 1..96: note = chr21:19274828-19274924
  misc_feature 1..96: note = Hypo
  source 1..96: mol_type = genomic DNA

SEQ ID NO: 120346 - DNA, 42 bp, Homo sapiens; identical to SEQ ID NO: 88513
  misc_feature 1..42: note = chr21:19517459-19517501
  misc_feature 1..42: note = Hypo
  source 1..42: mol_type = genomic DNA

SEQ ID NO: 120347 - DNA, 30 bp, Homo sapiens; identical to SEQ ID NO: 38308
  misc_feature 1..30: note = chr21:19617785-19617815
  misc_feature 1..30: note = Hyper
  source 1..30: mol_type = genomic DNA

SEQ ID NO: 120348 - DNA, 30 bp, Homo sapiens
  misc_feature 1..30: note = chr21:19618035-19618065
  misc_feature 1..30: note = Hyper
  source 1..30: mol_type = genomic DNA
ctttggtcccagcaccgtgttcactcggat

SEQ ID NO: 120349 - DNA, 17 bp, Homo sapiens
  misc_feature 1..17: note = chr21:19668175-19668192
  misc_feature 1..17: note = Hypo
  source 1..17: mol_type = genomic DNA
agaatcagaataggccg

SEQ ID NO: 120350 - DNA, 172 bp, Homo sapiens; identical to SEQ ID NO: 46439
  misc_feature 1..172: note = chr21:20359980-20360152
  misc_feature 1..172: note = Hypo
  source 1..172: mol_type = genomic DNA

SEQ ID NO: 120351 - DNA, 40 bp, Homo sapiens; identical to SEQ ID NO: 88517
  misc_feature 1..40: note = chr21:20703497-20703537
  misc_feature 1..40: note = Hypo
  source 1..40: mol_type = genomic DNA

SEQ ID NO: 120352 - DNA, 104 bp, Homo sapiens; identical to SEQ ID NO: 88518
  misc_feature 1..104: note = chr21:21264013-21264117
  misc_feature 1..104: note = Hypo
  source 1..104: mol_type = genomic DNA

SEQ ID NO: 120353 - DNA, 35 bp, Homo sapiens; identical to SEQ ID NO: 88519
  misc_feature 1..35: note = chr21:22173764-22173799
  misc_feature 1..35: note = Hypo
  source 1..35: mol_type = genomic DNA

SEQ ID NO: 120354 - DNA, 1021 bp, Homo sapiens
  misc_feature 1..1021: note = chr21:22369922-22370943
  misc_feature 1..1021: note = Hyper
  source 1..1021: mol_type = genomic DNA
ccaacagcaatgggtcgagatgtagaggaaacactctgtacgttatttttccgcccaccctttagcgcctgaggagacagacagtgtagactttagggtacaattgcttcccctctgtcgcggcggggtggggagcgtgggaaggggacagccgcgcaaggggccagcctgctccaggtttgagcgagagagggagaaggaggtccacggagagacaagaatctccctcctcccacgcccaaaaggaataagctgcggggcacaccgcccgcctccagatcccccattcacgttgagccggggcgcgctcggggcggtcgcctgcagtatcagtatcagcatcagcatcagcatcagcatctgcatgagcatcagctcagctcagctcagctcagcatcagctcagctgtcctgaggcagccggcggctgtgaaggagctccaggctgcccccatccccacgcccttctcggctcagggcgtgcatgaacctgcggatggccggcgggcgagtggcgccttcgcgatcgcggccgcccctctaggcggaggcaccggggaccgaacccgtgacttcgagctccactgcggacgaatcccgggaccgcgcgcctcgcggaagagcggccgccgtgcagcgcggagggatacgcctcggccgcacctcccctcgccgcgcccccgcccccgccgccctccccgcccggctctgctgccgccgcggcggccgctgctgctgctgcttctgccgccgctgccgccgccgctgcctggatatagtgcggcaagagcggagcttgcagtcactttgcgaggaggagcgcgcgggctgcgggcggctggggcaccgcgggagcggcggcggcggctctagcagaggcggccggggcagcgaaaggttctctctccagggctggacttaataactttgaaactgtccaccggtgtcacgtcctgaacatgagcctcctcctctccttctacctgctggggttgcttgtcagtagcgggcaaggtaggag

SEQ ID NO: 120355 - DNA, 30 bp, Homo sapiens; identical to SEQ ID NO: 88525
  misc_feature 1..30: note = chr21:25159328-25159358
  misc_feature 1..30: note = Hypo
  source 1..30: mol_type = genomic DNA

SEQ ID NO: 120356 - DNA, 41 bp, Homo sapiens; identical to SEQ ID NO: 46441
  misc_feature 1..41: note = chr21:25338183-25338224
  misc_feature 1..41: note = Hypo
  source 1..41: mol_type = genomic DNA

SEQ ID NO: 120357 - DNA, 30 bp, Homo sapiens; identical to SEQ ID NO: 88527
  misc_feature 1..30: note = chr21:25540338-25540368
  misc_feature 1..30: note = Hypo
  source 1..30: mol_type = genomic DNA

SEQ ID NO: 120358 - DNA, 30 bp, Homo sapiens; identical to SEQ ID NO: 88528
  misc_feature 1..30: note = chr21:26734320-26734350
  misc_feature 1..30: note = Hypo
  source 1..30: mol_type = genomic DNA

SEQ ID NO: 120359 - DNA, 25 bp, Homo sapiens
  misc_feature 1..25: note = chr21:26737217-26737242
  misc_feature 1..25: note = Hypo
  source 1..25: mol_type = genomic DNA
tgcgcccggccgagggatttttttt

SEQ ID NO: 120360 - DNA, 30 bp, Homo sapiens; identical to SEQ ID NO: 88530
  misc_feature 1..30: note = chr21:26785920-26785950
  misc_feature 1..30: note = Hypo
  source 1..30: mol_type = genomic DNA

SEQ ID NO: 120361 - DNA, 659 bp, Homo sapiens; identical to SEQ ID NO: 88531
  misc_feature 1..659: note = chr21:26934159-26934818
  misc_feature 1..659: note = Hyper
  source 1..659: mol_type = genomic DNA

SEQ ID NO: 120362 - DNA, 67 bp, Homo sapiens; identical to SEQ ID NO: 88532
  misc_feature 1..67: note = chr21:27011420-27011487
  misc_feature 1..67: note = Hyper
  source 1..67: mol_type = genomic DNA

SEQ ID NO: 120363 - DNA, 30 bp, Homo sapiens; identical to SEQ ID NO: 88533
  misc_feature 1..30: note = chr21:27011609-27011639
  misc_feature 1..30: note = Hypo
  source 1..30: mol_type = genomic DNA

SEQ ID NO: 120364 - DNA, 953 bp, Homo sapiens
  misc_feature 1..953: note = chr21:27011772-27012725
  misc_feature 1..953: note = Hyper
  source 1..953: mol_type = genomic DNA
gtgggggcggagggacgacccgccggggctttcccgggcgctgctctcctcctgctgccccctcgctaggacccggcggacgcctcgtctggttttcacgccctctagcccctacccccacacccccaaaacagaacagacccccatccctgggctggaggacccgcctcttggcagccagctgagaaggcgccccggggagggggaaactgacatcccatctagagccgtccctcctcttcctcccctcccgactctctgctcctttcccgccccagaagttcaagggcccccggcctcctgcgctcctgccgccgggaccctcgacctcctcagagcagccggctgccgccccgggaagatggcgaggaggagccgccaccgcctcctcctgctgctgctgcgctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacgctgggagcaagggagcgcgaggtcgtgggtttcttgtgaattgcgtctgattttgtcagttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagcc

SEQ ID NO: 120365 - DNA, 30 bp, Homo sapiens; identical to SEQ ID NO: 88537
  misc_feature 1..30: note = chr21:27184709-27184739
  misc_feature 1..30: note = Hypo
  source 1..30: mol_type = genomic DNA

SEQ ID NO: 120366 - DNA, 62 bp, Homo sapiens; identical to SEQ ID NO: 88538
  misc_feature 1..62: note = chr21:27541809-27541871
  misc_feature 1..62: note = Hyper
  source 1..62: mol_type = genomic DNA

SEQ ID NO: 120367 - DNA, 75 bp, Homo sapiens; identical to SEQ ID NO: 88539
  misc_feature 1..75: note = chr21:27543433-27543508
  misc_feature 1..75: note = Hyper
  source 1..75: mol_type = genomic DNA

SEQ ID NO: 120368 - DNA, 809 bp, Homo sapiens
  misc_feature 1..809: note = chr21:27944913-27945722
  misc_feature 1..809: note = Hyper
  source 1..809: mol_type = genomic DNA
caaatcccctaaacacgagactgctatttccaaggtggaaagggaaagaaaagaaatgcaaaaggtaaaagttaaaggaaaaggaacaaaacaaaaccgcgtgcggctggaagtgcgcgggtttctgccgtcgcctcgcggaaaaggcagaagcgtctgcaaaggtccttctgcaaaggtcccggtccgtccagctcaacccacgttagcccggaccgtgacccaagggcagccccgagcctctgaccctctccgccgccctccgtcactgacctgcgtagacaaagagcaggaccaacttcggaagcaagacccctggacgcacgggtagcctcggagcgtccatccaagccggtggcctgaggcttggagcgaagggagagcccggaaccggagggaatggggaggatggagggcgatcagatggagagagcagcgctcctgagagccgggtggagcagagacccggccattgcctagggagccttccaagggagcccgggccgggcgcgtcccgggccagcgactgcgggactccgcggagctggggcgcccgtggcccgagacgggctgcgctgggggcccaggtctctttgtctcgccccactgcgctcaggcgcggggaaggcggccactccggcgtccttggccacccaggctcacatttcatctccgcgggtggcaacgactgcgggcagggggcgggggtggccccgactcctccccaagcccgggttcttccttctaaagagtgactaggggaccaagaaacttttcctaaccccttgctttggcgattgctatggagt

SEQ ID NO: 120369 - DNA, 55 bp, Homo sapiens; identical to SEQ ID NO: 88542
  misc_feature 1..55: note = chr21:28215942-28215997
  misc_feature 1..55: note = Hyper
  source 1..55: mol_type = genomic DNA

SEQ ID NO: 120370 - DNA, 1585 bp, Homo sapiens
  misc_feature 1..1585: note = chr21:28216223-28217808
  misc_feature 1..1585: note = Hyper
  source 1..1585: mol_type = genomic DNA
gcacaagctccaactcgctaaaggtggaaggagtcaggttacaaactctccctccccggcctaaatgctttgctttagtttgcagaaaatcgtttgtcagtttttttcttggttattcattattcgggcaaatgcaagtatgttttctagctgagttcaccaatccaaacctcaaaccacattcctccactccaggcctccgttctgtccgcggacttatgatcctgcctgccagcaggagtctaccctgaagtcgcgtgggatagataaagtgaggagaggaggatgaatggacagacaaacgagagcaattcttctacctgtgggctgtcctacgccttgcagtgccgggtcctgcggcgaccactgagccccttcgtcctcgccctcagtcccttcgtcctcgtcttcggtctccgctttcccagtcggccggggctcgtcgtccacgaccccgcacgtgccgccgacgtcgccctgccgattccgccgcaggaggtggaactgtagtggtgccggcggcttctcccctggggcggcggtggcgaggcgctcgctggcggcgggcagcggctggatgaaatacgcctcccccagcaggtagaaggcgccgcgcacgccctcgcagaggctgagggcggcagccgagctgggatcgccattcacggtgccggagtagaagcagtgcgccaggtcggtttccggaagcggcgtctcggacccggatttgcgccccacgttctggagcgtgaagccgggcgccaaaaagctgctgtcgggccgcagctccagatccagctgctggtcaaaggcgtgcaggcggaggcgcgtggtcccgtgtcccggggcgcgctccagctccggcaccactagctcctcgtcctcctcggaggggcgcccgagtgcgtccgacacggccagtagcgccgcggcgagcagcagcagcgtgggtactggcccaaagctccgagaccccggagcccgctccgcgttccccatgtcgctgcccagcttgcgccttccgaacccctcgggcacagctcgctgcattggagccccaggagacaccgctcgtagcagcgcacggagcgagggacctttagttcgggtcgggagagcaaagcctcgttggcctgctctggattgttaaaattaacaatttctattattcgttggaagggcgcgcagagccggctacagccgaagctcccggagtcactaaaaggaggcgctgcagttctgccggcgcgcgggaagtttttcttccagcgcaaagttggagacactgagaggcaggcgcaggcagagtggctctgctgggacaagaagcgctctggggcgcctccggggctgaggcaacgcggagattggtgcctggcgcccctcttcggcctccgccttggctgcgatgttgctcactctgctcagggctctcccctctccgtccggtagcgcaccctggctttgcaatagcccctggctcggagccgctttccagcgagtgcaagaaccgggcagccgagcggtccttttatagtggaccagtgaaacccccacccccaccccactcctcccctttggccct

SEQ ID NO: 120371 - DNA, 80 bp, Homo sapiens
  misc_feature 1..80: note = chr21:28217853-28217933
  misc_feature 1..80: note = Hyper
  source 1..80: mol_type = genomic DNA
gcgctccgcgctgcgggctcgggagggggagggggcagcctccgcgctggctccacgccactgctcgtcaatctaggggc

SEQ ID NO: 120372 - DNA, 81 bp, Homo sapiens; identical to SEQ ID NO: 13938
  misc_feature 1..81: note = chr21:28218267-28218348
  misc_feature 1..81: note = Hyper
  source 1..81: mol_type = genomic DNA

SEQ ID NO: 120373 - DNA, 166 bp, Homo sapiens; identical to SEQ ID NO: 88547
  misc_feature 1..166: note = chr21:28218552-28218718
  misc_feature 1..166: note = Hyper
  source 1..166: mol_type = genomic DNA

SEQ ID NO: 120374 - DNA, 196 bp, Homo sapiens; identical to SEQ ID NO: 88548
  misc_feature 1..196: note = chr21:28218958-28219154
  misc_feature 1..196: note = Hyper
  source 1..196: mol_type = genomic DNA

SEQ ID NO: 120375 - DNA, 30 bp, Homo sapiens
  misc_feature 1..30: note = chr21:28337895-28337925
  misc_feature 1..30: note = Hyper
  source 1..30: mol_type = genomic DNA
agcagctccacctggcgggcccgggagatg

SEQ ID NO: 120376 - DNA, 30 bp, Homo sapiens; identical to SEQ ID NO: 88549
  misc_feature 1..30: note = chr21:28338210-28338240
  misc_feature 1..30: note = Hyper
  source 1..30: mol_type = genomic DNA

SEQ ID NO: 120377 - DNA, 290 bp, Homo sapiens
  misc_feature 1..290: note = chr21:28338463-28338753
  misc_feature 1..290: note = Hyper
  source 1..290: mol_type = genomic DNA
cggagtagagttggtcgatgttctgcaccagccccttgctcctgcgccgctgcgccagggggtgcgggtggccgggaggctcggctcgctcctgcacctcctccccctgccgccggcggggctgggcggctgctgcagcagtcggaggctgcccggctttatcctgggcaggtgtcgcggcggggccgaccgcggccaggggcaggcggaacgcgcacagcagcagggacgcccacccgagcagcatagtgcgctgcccgcggggaggggctgcgcgactgggactttat

SEQ ID NO: 120378 - DNA, 339 bp, Homo sapiens
  misc_feature 1..339: note = chr21:28339162-28339501
  misc_feature 1..339: note = Hyper
  source 1..339: mol_type = genomic DNA
ggaggttccaagctccggggcccacttcctttcttattttgtgggtttccttggctctgctgggaccaggaggaagggaagaaagagaggggaaaaagccgtaaaaattaaaacaaaaatgcaggggggcagcctgaggcgagctggtgaagcggcgtgtctgtgtcccttcggctgcggtctcctcctgcccgccgtcatccccagtcggcagctgcgagcgccgagagcagcgcgagcgctgtgaagatgcgaggaggtggaacaatgaatttatagcggcatgccatcctgcaatggcaatttcaacagttcgtcactgcacgctgcctcttaaag

SEQ ID NO: 120379 - DNA, 497 bp, Homo sapiens
  misc_feature 1..497: note = chr21:28339851-28340348
  misc_feature 1..497: note = Hyper
  source 1..497: mol_type = genomic DNA
gtgggaagttcctgccgcaagtttttcccctttgcacacccgtgcgctctggcctcgcagaccgtgcaactccatccaccagccagagcttttcagcttcccgtgcgtcccctaaccaccgcgttcccttcgcttcctcccctccgtcccggcacccggtttcctccctccccattctccagcctcttgatgctttgacgctcgccggattcgggctccgggtgactaacttctcccggccaccagcagagcggctggacagccagagagcccagggcgcttcctggcgcgctgcggtaccccggggcgagaacgcccgccgcttgggaactccgcagctttgtgtgcgaacggcgggctcccagctttctccagcacgcctttcgtcagggtccacaatctgtcccttactcccagcccactggaacttcctttgctctaaaaaggcagagcgagaaagagttaactcttagagggaattccgctcattttttttc

SEQ ID NO: 120380 - DNA, 30 bp, Homo sapiens; identical to SEQ ID NO: 88555
  misc_feature 1..30: note = chr21:28793121-28793151
  misc_feature 1..30: note = Hypo
  source 1..30: mol_type = genomic DNA

SEQ ID NO: 120381 - DNA, 135 bp, Homo sapiens; identical to SEQ ID NO: 88556
  misc_feature 1..135: note = chr21:30275964-30276099
  misc_feature 1..135: note = Hypo
  source 1..135: mol_type = genomic DNA

SEQ ID NO: 120382 - DNA, 44 bp, Homo sapiens; identical to SEQ ID NO: 88557
  misc_feature 1..44: note = chr21:30653794-30653838
  misc_feature 1..44: note = Hypo
  source 1..44: mol_type = genomic DNA

SEQ ID NO: 120383 - DNA, 30 bp, Homo sapiens; identical to SEQ ID NO: 88558
  misc_feature 1..30: note = chr21:30973204-30973234
  misc_feature 1..30: note = Hypo
  source 1..30: mol_type = genomic DNA

SEQ ID NO: 120384 - DNA, 165 bp, Homo sapiens; identical to SEQ ID NO: 88559
  misc_feature 1..165: note = chr21:31015159-31015324
  misc_feature 1..165: note = Hypo
  source 1..165: mol_type = genomic DNA

SEQ ID NO: 120385 - DNA, 44 bp, Homo sapiens; identical to SEQ ID NO: 88560
  misc_feature 1..44: note = chr21:31057107-31057151
  misc_feature 1..44: note = Hypo
  source 1..44: mol_type = genomic DNA

SEQ ID NO: 120386 - DNA, 190 bp, Homo sapiens; identical to SEQ ID NO: 88561
  misc_feature 1..190: note = chr21:31059342-31059532
  misc_feature 1..190: note = Hypo
  source 1..190: mol_type = genomic DNA

SEQ ID NO: 120387 - DNA, 805 bp, Homo sapiens
  misc_feature 1..805: note = chr21:31311376-31312181
  misc_feature 1..805: note = Hyper
  source 1..805: mol_type = genomic DNA
gtggctgcagcggctcgcgatcccttgcccagagtaggggtgccggtccctgcgaacctggatccccgcactctagcccgcgttcctggagcccagattgaaaaacccgccaactgtacctcccggggaaggccggcaccctccaggagggaagcagtgacgcggctcccccttttttgtgtagcctcccatgagcactgacctccaccttccccagctccggctcctgcgccgccgcgcgctgcctcgcccgggacccgctacacccgcgttggtgcggcgaccgaccacgtctcccgagcaggcagcctggggctcactcaccgatcctgagtacttgcggggcggtctgagggaggatatagcagaggaaatagaggagtgcccagctggtgtccctggtccagagcccgggctgggcgaggagtgtgccgtgctccatcttcctagcttcttaattcatgccgagatacagccgctgccggacgcccgagagatgcacccaacttgggccgggtccccgcctcatcctctctggatgctccggttccaagcacgctgcgcgctccccacggagcgagctcgagggaacccgcgtgggaccgcggagctggctggcaaggctgagctctctcggggctcctcagtgctgtcgctagcccatcacggctcctcctcctcctcttccatgggccgcagaccgcggaggatcagcgctctctggctcccggagcccagagaccagctgaggaaagttgctgccccgatctgcaggaacgtctccctcattcgtcctttggtcaga

SEQ ID NO: 120388 - DNA, 19 bp, Homo sapiens
  misc_feature 1..19: note = chr21:31312405-31312424
  misc_feature 1..19: note = Hyper
  source 1..19: mol_type = genomic DNA
actgatcaagatactcgcg

SEQ ID NO: 120389 - DNA, 19 bp, Homo sapiens
  misc_feature 1..19: note = chr21:31312484-31312503
  misc_feature 1..19: note = Hyper
  source 1..19: mol_type = genomic DNA
cacacgctcttttttctct

SEQ ID NO: 120390 - DNA, 17 bp, Homo sapiens
  misc_feature 1..17: note = chr21:31347914-31347931
  misc_feature 1..17: note = Hypo
  source 1..17: mol_type = genomic DNA
gacgactgatcaagact

SEQ ID NO: 120391 - DNA, 30 bp, Homo sapiens; identical to SEQ ID NO: 46447
  misc_feature 1..30: note = chr21:32592616-32592646
  misc_feature 1..30: note = Hypo
  source 1..30: mol_type = genomic DNA

SEQ ID NO: 120392 - DNA, 23 bp, Homo sapiens
  misc_feature 1..23: note = chr21:32677003-32677026
  misc_feature 1..23: note = Hypo
  source 1..23: mol_type = genomic DNA
ttttatttttgagaccgagtctc

SEQ ID NO: 120393 - DNA, 263 bp, Homo sapiens; identical to SEQ ID NO: 88570
  misc_feature 1..263: note = chr21:32716235-32716498
  misc_feature 1..263: note = Hyper
  source 1..263: mol_type = genomic DNA

SEQ ID NO: 120394 - DNA, 19 bp, Homo sapiens
  misc_feature 1..19: note = chr21:33143333-33143352
  misc_feature 1..19: note = Hypo
  source 1..19: mol_type = genomic DNA
tttttttttttgagacgga

SEQ ID NO: 120395 - DNA, 55 bp, Homo sapiens; identical to SEQ ID NO: 88572
  misc_feature 1..55: note = chr21:33244992-33245047
  misc_feature 1..55: note = Hyper
  source 1..55: mol_type = genomic DNA

SEQ ID NO: 120396 - DNA, 152 bp, Homo sapiens; identical to SEQ ID NO: 38334
  misc_feature 1..152: note = chr21:33245337-33245489
  misc_feature 1..152: note = Hyper
  source 1..152: mol_type = genomic DNA

SEQ ID NO: 120397 - DNA, 84 bp, Homo sapiens; identical to SEQ ID NO: 88574
  misc_feature 1..84: note = chr21:33245793-33245877
  misc_feature 1..84: note = Hyper
  source 1..84: mol_type = genomic DNA

SEQ ID NO: 120398 - DNA, 274 bp, Homo sapiens; identical to SEQ ID NO: 88575
  misc_feature 1..274: note = chr21:33246140-33246414
  misc_feature 1..274: note = Hyper
  source 1..274: mol_type = genomic DNA

SEQ ID NO: 120399 - DNA, 23 bp, Homo sapiens
  misc_feature 1..23: note = chr21:33491252-33491275
  misc_feature 1..23: note = Hypo
  source 1..23: mol_type = genomic DNA
actttcttcttctttcgcatcct

SEQ ID NO: 120400 - DNA, 164 bp, Homo sapiens; identical to SEQ ID NO: 88577
  misc_feature 1..164: note = chr21:33579243-33579407
  misc_feature 1..164: note = Hypo
  source 1..164: mol_type = genomic DNA

SEQ ID NO: 120401 - DNA, 17 bp, Homo sapiens
  misc_feature 1..17: note = chr21:33604215-33604232
  misc_feature 1..17: note = Hypo
  source 1..17: mol_type = genomic DNA
tccgtctcaaaacaaaa

SEQ ID NO: 120402 - DNA, 30 bp, Homo sapiens; identical to SEQ ID NO: 88579
  misc_feature 1..30: note = chr21:33614037-33614067
  misc_feature 1..30: note = Hypo
  source 1..30: mol_type = genomic DNA

SEQ ID NO: 120403 - DNA, 76 bp, Homo sapiens; identical to SEQ ID NO: 88580
  misc_feature 1..76: note = chr21:33627506-33627582
  misc_feature 1..76: note = Hypo
  source 1..76: mol_type = genomic DNA

SEQ ID NO: 120404 - DNA, 84 bp, Homo sapiens; identical to SEQ ID NO: 88581
  misc_feature 1..84: note = chr21:33628811-33628895
  misc_feature 1..84: note = Hypo
  source 1..84: mol_type = genomic DNA

SEQ ID NO: 120405 - DNA, 30 bp, Homo sapiens; identical to SEQ ID NO: 46448
  misc_feature 1..30: note = chr21:33630406-33630436
  misc_feature 1..30: note = Hypo
  source 1..30: mol_type = genomic DNA

SEQ ID NO: 120406 - DNA, 197 bp, Homo sapiens; identical to SEQ ID NO: 88583
  misc_feature 1..197: note = chr21:33694545-33694742
  misc_feature 1..197: note = Hypo
  source 1..197: mol_type = genomic DNA

SEQ ID NO: 120407 - DNA, 30 bp, Homo sapiens; identical to SEQ ID NO: 88584
  misc_feature 1..30: note = chr21:33720348-33720378
  misc_feature 1..30: note = Hypo
  source 1..30: mol_type = genomic DNA

SEQ ID NO: 120408 - DNA, 125 bp, Homo sapiens; identical to SEQ ID NO: 88585
  misc_feature 1..125: note = chr21:33721756-33721881
  misc_feature 1..125: note = Hypo
  source 1..125: mol_type = genomic DNA

SEQ ID NO: 120409 - DNA, 134 bp, Homo sapiens; identical to SEQ ID NO: 88586
  misc_feature 1..134: note = chr21:33754456-33754590
  misc_feature 1..134: note = Hypo
  source 1..134: mol_type = genomic DNA

SEQ ID NO: 120410 - DNA, 49 bp, Homo sapiens; identical to SEQ ID NO: 88587
  misc_feature 1..49: note = chr21:33784031-33784080
  misc_feature 1..49: note = Hyper
  source 1..49: mol_type = genomic DNA

SEQ ID NO: 120411 - DNA, 53 bp, Homo sapiens; identical to SEQ ID NO: 88588
  misc_feature 1..53: note = chr21:33784912-33784965
  misc_feature 1..53: note = Hyper
  source 1..53: mol_type = genomic DNA

SEQ ID NO: 120412 - DNA, 30 bp, Homo sapiens; identical to SEQ ID NO: 88589
  misc_feature 1..30: note = chr21:33805592-33805622
  misc_feature 1..30: note = Hypo
  source 1..30: mol_type = genomic DNA

SEQ ID NO: 120413 - DNA, 202 bp, Homo sapiens; identical to SEQ ID NO: 88590
  misc_feature 1..202: note = chr21:33855579-33855781
  misc_feature 1..202: note = Hypo
  source 1..202: mol_type = genomic DNA

SEQ ID NO: 120414 - DNA, 28 bp, Homo sapiens
  misc_feature 1..28: note = chr21:33945034-33945062
  misc_feature 1..28: note = Hypo
  source 1..28: mol_type = genomic DNA
ggtctgaaggaggcggagctcaggccta

SEQ ID NO: 120415 - DNA, 278 bp, Homo sapiens; identical to SEQ ID NO: 46451
  misc_feature 1..278: note = chr21:33954157-33954435
  misc_feature 1..278: note = Hypo
  source 1..278: mol_type = genomic DNA

SEQ ID NO: 120416 - DNA, 30 bp, Homo sapiens; identical to SEQ ID NO: 88593
  misc_feature 1..30: note = chr21:33958272-33958302
  misc_feature 1..30: note = Hypo
  source 1..30: mol_type = genomic DNA

SEQ ID NO: 120417 - DNA, 84 bp, Homo sapiens; identical to SEQ ID NO: 46452
  misc_feature 1..84: note = chr21:33983236-33983320
  misc_feature 1..84: note = Hypo
  source 1..84: mol_type = genomic DNA

SEQ ID NO: 120418 - DNA, 30 bp, Homo sapiens; identical to SEQ ID NO: 46453
  misc_feature 1..30: note = chr21:34127723-34127753
  misc_feature 1..30: note = Hypo
  source 1..30: mol_type = genomic DNA

SEQ ID NO: 120419 - DNA, 1325 bp, Homo sapiens
  misc_feature 1..1325: note = chr21:34392013-34393338
  misc_feature 1..1325: note = Hyper
  source 1..1325: mol_type = genomic DNA
ctggttctcaagagccgggtgtaaggaaggaaaatcaaagattgaatttagatgtatgtattggaggggaatattggaggaagggggagcaggggagcacgcccagcctcctctcctgtctttcccgcccccttgtctaaactcaaaaccgagtccgggcgcgccttgcagggcgcccgagctctgcagcggcgttgcgggctgaacccatccggcacaaactgcgggccactggcccctcacacctgggagtttgcggcgctggcctgcagcccggggcccacgtggcggaagctttcccgggcgcgcgctgcgcagccccgcggggccggggagacaccgctcgggagtcctccgctcggctgcagaatctttatcagctgcactttaccgcagccctggctaggacgctaggcggtggagcgccctatccaggtgcgccgccgcaccatggatcaccgcgcccggtcccgcagtcccgccatggcctggggaggcccgaagcccggggacagtggccggcccatctccggctccgcggacccccggctcaggcgggagggcaggcgggtccctgcaggcccccagggagcccgggagcctctctctggcgtcattcagtcccggggcaacctgaagcgcggtagatattggagagggggcgtctgttggggggacctggcgtcattactgatggctagcagggaggagggaacgggttgtcacctcggcctcataaggccgtgagtgagtagtccagggcctcttcaggcatttttgaaactggattaactaggggggaaattgtagcactgaagccaccgtgactgtcttttgcgctgtgtggaaactccggtaaaactctttgggcaacagtcttatcaccagctcttcaacgtgtgcagcccttctggtcctgtccctgttctgggccccaggaatgcaaagcaggtccaggcactgtgaagaccctggcggtggaggaagaggcttcccggctgtggaggaagccagacccttacaacacaagacgagaaccagacctgcgtgggggagctctggatgctacaggggctcaaggaggggtggaggggccttcccaggccaacccctgaacggcttggacaagatgctcagatggacgggaggaacggcgtgtgggatgggggagctggaggcgggtgggtgggggggggaggatggggaaagcgctggcccacccagtgtgggaggggtagaggaaaagcccgcaggggccaggttgggaccccgtaggccgggttagagggcttggacttgatcctgacaggcgacagggagacata

SEQ ID NO: 120420 - DNA, 1774 bp, Homo sapiens; identical to SEQ ID NO: 88599
  misc_feature 1..1774: note = chr21:34394993-34396767
  misc_feature 1..1774: note = Hyper
  source 1..1774: mol_type = genomic DNA

SEQ ID NO: 120421 - DNA, 789 bp, Homo sapiens; identical to SEQ ID NO: 88600
  misc_feature 1..789: note = chr21:34396987-34397776
  misc_feature 1..789: note = Hyper
  source 1..789: mol_type = genomic DNA

SEQ ID NO: 120422 - DNA, 2550 bp, Homo sapiens
  misc_feature 1..2550: note = chr21:34397990-34400540
  misc_feature 1..2550: note = Hyper
  source 1..2550: mol_type = genomic DNA
tccccaagaatctcccggccacgggcgcccattggttgtgcgcagggaggaggcgtgtgcccggcctggcgagtttcattgagcggaattagcccggatgacatcagcttcccagccccccggcgggcccagctcattggcgaggcagcccctccaggacacgcacattgttccccgcccccgcccccgccaccgctgccgccgtcgccgctgccaccgggctataaaaaccggccgagcccctaaaggtgcggatgcttattatagatcgacgcgacaccagcgcccggtgccaggttctcccctgaggcttttcggagcgagctcctcaaatcgcatccagagtaagtgtccccgccccacagcagccgcagcctagatcccagggacagactctcctcaactcggctgtgacccagaatgctccgatacagggggtctggatccctactctgcgggccatttctccagagcgactttgctcttctgtcctccccacactcaccgctgcatctccctcaccaaaagcgagaagtcggagcgacaacagctctttctgcccaagccccagtcagctggtgagctccccgtggtctccagatgcagcacatggactctgggccccgcgccggctctgggtgcatgtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataacctgttgcatgagagcagaggggagatagagagagcttaattataggtacccgcgtgcagctaaaaggagggccagagatagtagcgagggggacgaggagccacgggccacctgtgccgggaccccgcgctgtggtactgcggtgcaggcgggagcagcttttctgtctctcactgactcactctctctctctctccctctctctctctctcattctctctcttttctcctcctctcctggaagttttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcac

SEQ ID NO: 120423 - DNA, 404 bp, Homo sapiens; identical to SEQ ID NO: 88607
  misc_feature 1..404: note = chr21:34401144-34401548
  misc_feature 1..404: note = Hyper
  source 1..404: mol_type = genomic DNA

SEQ ID NO: 120424 - DNA, 2454 bp, Homo sapiens
  misc_feature 1..2454: note = chr21:34442144-34444598
  misc_feature 1..2454: note = Hyper
  source 1..2454: mol_type = genomic DNA
tgctggaggaaggcacgtgagttgcagcctgaccagtgcgaccagtcctccttcaacagccccgcttgccttgaaaaggcgcccttactccgctcagggggcctgtcccgcgcggctggcacaggcgctcacaataacctcctaaagcggtgccagccgcacctccgcgcggccccggcacaagcagccaatgaacacgcggctgcgcccggcctcgcgcctccattggctgcgccccgccacccgctgccccgcaggttcccaagccgggtttaaaggggtagggcgcgggccagggccccaccatcgtttccccgcgcgcaggtccgcggggaggggcggcctgccgaccggcccaccccagggcgttcctgaagggcgtcctcggccgcccccaccgcctcccagatgtactatgcggtttcccaggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgctgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctacctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttga

SEQ ID NO: 120425 - DNA, 95 bp, Homo sapiens; identical to SEQ ID NO: 16704
  misc_feature 1..95: note = chr21:34459377-34459472
  misc_feature 1..95: note = Hypo
  source 1..95: mol_type = genomic DNA

SEQ ID NO: 120426 - DNA, 113 bp, Homo sapiens; identical to SEQ ID NO: 88612
  misc_feature 1..113: note = chr21:34466080-34466193
  misc_feature 1..113: note = Hypo
  source 1..113: mol_type = genomic DNA

SEQ ID NO: 120427 - DNA, 103 bp, Homo sapiens; identical to SEQ ID NO: 88613
  misc_feature 1..103: note = chr21:34466627-34466730
  misc_feature 1..103: note = Hypo
  source 1..103: mol_type = genomic DNA

SEQ ID NO: 120428 - DNA, 80 bp, Homo sapiens; identical to SEQ ID NO: 88614
  misc_feature 1..80: note = chr21:34471025-34471105
  misc_feature 1..80: note = Hypo
  source 1..80: mol_type = genomic DNA

SEQ ID NO: 120429 - DNA, 422 bp, Homo sapiens; identical to SEQ ID NO: 88615
  misc_feature 1..422: note = chr21:34481844-34482266
  misc_feature 1..422: note = Hyper
  source 1..422: mol_type = genomic DNA

SEQ ID NO: 120430 - DNA, 30 bp, Homo sapiens; identical to SEQ ID NO: 88616
  misc_feature 1..30: note = chr21:34494179-34494209
  misc_feature 1..30: note = Hypo
  source 1..30: mol_type = genomic DNA

SEQ ID NO: 120431 - DNA, 62 bp, Homo sapiens; identical to SEQ ID NO: 88617
  misc_feature 1..62: note = chr21:34499655-34499717
  misc_feature 1..62: note = Hyper
  source 1..62: mol_type = genomic DNA

SEQ ID NO: 120432 - DNA, 223 bp, Homo sapiens; identical to SEQ ID NO: 88618
  misc_feature 1..223: note = chr21:34508376-34508599
  misc_feature 1..223: note = Hypo
  source 1..223: mol_type = genomic DNA

SEQ ID NO: 120433 - DNA, 86 bp, Homo sapiens; identical to SEQ ID NO: 88619
  misc_feature 1..86: note = chr21:34525146-34525232
  misc_feature 1..86: note = Hypo
  source 1..86: mol_type = genomic DNA

SEQ ID NO: 120434 - DNA, 30 bp, Homo sapiens; identical to SEQ ID NO: 88620
  misc_feature 1..30: note = chr21:34538805-34538835
  misc_feature 1..30: note = Hypo
  source 1..30: mol_type = genomic DNA

SEQ ID NO: 120435 - DNA, 30 bp, Homo sapiens; identical to SEQ ID NO: 88621
  misc_feature 1..30: note = chr21:34637000-34637030
  misc_feature 1..30: note = Hypo
  source 1..30: mol_type = genomic DNA

SEQ ID NO: 120436 - DNA, 167 bp, Homo sapiens; identical to SEQ ID NO: 88622
  misc_feature 1..167: note = chr21:34675270-34675437
  misc_feature 1..167: note = Hypo
  source 1..167: mol_type = genomic DNA

SEQ ID NO: 120437 - DNA, 81 bp, Homo sapiens; identical to SEQ ID NO: 88623
  misc_feature 1..81: note = chr21:34927282-34927363
  misc_feature 1..81: note = Hypo
  source 1..81: mol_type = genomic DNA

SEQ ID NO: 120438 - DNA, 30 bp, Homo sapiens; identical to SEQ ID NO: 88624
  misc_feature 1..30: note = chr21:35426849-35426879
  misc_feature 1..30: note = Hypo
  source 1..30: mol_type = genomic DNA

SEQ ID NO: 120439 - DNA, 303 bp, Homo sapiens; identical to SEQ ID NO: 88625
  misc_feature 1..303: note = chr21:35574350-35574653
  misc_feature 1..303: note = Hyper
  source 1..303: mol_type = genomic DNA

SEQ ID NO: 120440 - DNA, 30 bp, Homo sapiens; identical to SEQ ID NO: 88626
  misc_feature 1..30: note = chr21:35755245-35755275
  misc_feature 1..30: note = Hypo
  source 1..30: mol_type = genomic DNA

SEQ ID NO: 120441 - DNA, 205 bp, Homo sapiens; identical to SEQ ID NO: 88627
  misc_feature 1..205: note = chr21:35819430-35819635
  misc_feature 1..205: note = Hypo
  source 1..205: mol_type = genomic DNA

SEQ ID NO: 120442 - DNA, 46 bp, Homo sapiens; identical to SEQ ID NO: 88628
  misc_feature 1..46: note = chr21:35832327-35832373
  misc_feature 1..46: note = Hypo
  source 1..46: mol_type = genomic DNA

SEQ ID NO: 120443 - DNA, 30 bp, Homo sapiens; identical to SEQ ID NO: 88629
  misc_feature 1..30: note = chr21:35947071-35947101
  misc_feature 1..30: note = Hypo
  source 1..30: mol_type = genomic DNA

SEQ ID NO: 120444 - DNA, 19 bp, Homo sapiens
  misc_feature 1..19: note = chr21:36005713-36005732
  misc_feature 1..19: note = Hypo
  source 1..19: mol_type = genomic DNA
caggcgtgagccaccgtgc

SEQ ID NO: 120445 - DNA, 1842 bp, Homo sapiens
  misc_feature 1..1842: note = chr21:36041468-36043310
  misc_feature 1..1842: note = Hyper
  source 1..1842: mol_type = genomic DNA
gctgggcagaaggggcgcagaggcttggggccaagcggagtttgccctgcgggtcctgcgcaaggccccagtgccccggctaaacctttgccgcaggatcccggagccggcgtccttcaaggagcacagagggccccgtagcacgccccttgcccagcgccaccgacccttaagcagcgtcaaggaaggagtcccgatcaaggacagggatctgcggccatggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgagactgaggccgaggagggagccccggagggtgccgaggtgccccaaggaggggaggagacaagcggcgcgcagcaggtggagggggcgagcccgggacgcggcgcgcagggcgagccccgcggggaggctcagagggagcccgaggactctgcggcccccgagaggcaggaggaggcggagcagaggcctgaggtcccggaaggtagcgcgtccggggaggcgggggacagcgtagacgcggagggcccgctgggggacaacatagaagcggagggcccggcgggcgacagcgtagaggcggagggccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccggtgagctcgcctgggacgcagcggaggaggcggaggtcccgggggtaaaggggtccgaagaagcggcccccggggacgcaagggcagacgctggcgaggacagggtaggggatgggccacagcaggagccgggggaggacgaagagagacgagagcggagcccggaggggccaagggaggaggaagcagcggggggcgaagaggaatcccccgacagcagcccacatggggaggcctccaggggcgccgcggagcctgaggcccagctcagcaaccacctggccgaggagggccccgccgagggtagcggcgaggccgcgcgcgtgaacggccgccgggaggacggagaggcgtccgagccccgggccctggggcaggagcacgacatcaccctcttcgtcaaggtaaagctcgcttccctcaattcttaggacgacccccttccattcgaggtcttggtcatctcagatcccagagggacgcgcagggaggaacccttggtggtatcctgattgtcatcaggcgcttccatgcgcgggcggtaggcgggacagccgggatttcccggagaagagtttccagggcatttgcgggaggactcaatggtttggaagcaaagactttgggggtgggggcgacggggagtgcgatgg

SEQ ID NO: 120446 - DNA, 190 bp, Homo sapiens; identical to SEQ ID NO: 88634
  misc_feature 1..190: note = chr21:36596361-36596551
  misc_feature 1..190: note = Hypo
  source 1..190: mol_type = genomic DNA

SEQ ID NO: 120447 - DNA, 30 bp, Homo sapiens; identical to SEQ ID NO: 88635
  misc_feature 1..30: note = chr21:37430856-37430886
  misc_feature 1..30: note = Hypo
  source 1..30: mol_type = genomic DNA

SEQ ID NO: 120448 - DNA, 109 bp, Homo sapiens; identical to SEQ ID NO: 88636
  misc_feature 1..109: note = chr21:37527928-37528037
  misc_feature 1..109: note = Hypo
  source 1..109: mol_type = genomic DNA

SEQ ID NO: 120449 - DNA, 30 bp, Homo sapiens; identical to SEQ ID NO: 88637
  misc_feature 1..30: note = chr21:37565748-37565778
  misc_feature 1..30: note = Hypo
  source 1..30: mol_type = genomic DNA

SEQ ID NO: 120450 - DNA, 30 bp, Homo sapiens; identical to SEQ ID NO: 88638
  misc_feature 1..30: note = chr21:37619012-37619042
  misc_feature 1..30: note = Hypo
  source 1..30: mol_type = genomic DNA

SEQ ID NO: 120451 - DNA, 19 bp, Homo sapiens
  misc_feature 1..19: note = chr21:37632345-37632364
  misc_feature 1..19: note = Hypo
  source 1..19: mol_type = genomic DNA
tgggaggctgaggcacgag

SEQ ID NO: 120452 - DNA, 23 bp, Homo sapiens
  misc_feature 1..23: note = chr21:37699121-37699144
  misc_feature 1..23: note = Hypo
  source 1..23: mol_type = genomic DNA
ttttttttttgagaccgagtctc

SEQ ID NO: 120453 - DNA, 33 bp, Homo sapiens; identical to SEQ ID NO: 88641
  misc_feature 1..33: note = chr21:37704743-37704776
  misc_feature 1..33: note = Hypo
  source 1..33: mol_type = genomic DNA

SEQ ID NO: 120454 - DNA, 133 bp, Homo sapiens; identical to SEQ ID NO: 46460
  misc_feature 1..133: note = chr21:37750031-37750164
  misc_feature 1..133: note = Hypo
  source 1..133: mol_type = genomic DNA

SEQ ID NO: 120455 - DNA, 46 bp, Homo sapiens; identical to SEQ ID NO: 88643
  misc_feature 1..46: note = chr21:37754435-37754481
  misc_feature 1..46: note = Hypo
  source 1..46: mol_type = genomic DNA

SEQ ID NO: 120456 - DNA, 145 bp, Homo sapiens; identical to SEQ ID NO: 88644
  misc_feature 1..145: note = chr21:37758492-37758637
  misc_feature 1..145: note = Hypo
  source 1..145: mol_type = genomic DNA

SEQ ID NO: 120457 - DNA, 120 bp, Homo sapiens; identical to SEQ ID NO: 88645
  misc_feature 1..120: note = chr21:37775052-37775172
  misc_feature 1..120: note = Hypo
  source 1..120: mol_type = genomic DNA

SEQ ID NO: 120458 - DNA, 30 bp, Homo sapiens; identical to SEQ ID NO: 88646
  misc_feature 1..30: note = chr21:37780714-37780744
  misc_feature 1..30: note = Hypo
  source 1..30: mol_type = genomic DNA

SEQ ID NO: 120459 - DNA, 23 bp, Homo sapiens
  misc_feature 1..23: note = chr21:37781166-37781189
  misc_feature 1..23: note = Hypo
  source 1..23: mol_type = genomic DNA
ttttagacggagtttcgctcttg

SEQ ID NO: 120460 - DNA, 83 bp, Homo sapiens; identical to SEQ ID NO: 88648
  misc_feature 1..83: note = chr21:37781609-37781692
  misc_feature 1..83: note = Hypo
  source 1..83: mol_type = genomic DNA

SEQ ID NO: 120461 - DNA, 210 bp, Homo sapiens; identical to SEQ ID NO: 88649
  misc_feature 1..210: note = chr21:38063485-38063695
  misc_feature 1..210: note = Hyper
  source 1..210: mol_type = genomic DNA

SEQ ID NO: 120462 - DNA, 97 bp, Homo sapiens; identical to SEQ ID NO: 88650
  misc_feature 1..97: note = chr21:38064515-38064612
  misc_feature 1..97: note = Hyper
  source 1..97: mol_type = genomic DNA

SEQ ID NO: 120463 - DNA, 1156 bp, Homo sapiens
  misc_feature 1..1156: note = chr21:38064998-38066154
  misc_feature 1..1156: note = Hyper
  source 1..1156: mol_type = genomic DNA
cgttggaccttcttccgcaatcgggaccactccaggtctccccggagaaggctgagtctccagcgcgtggattcagatcaggactctgtctaagtaggcgagagctggggataccgctgggggctttggcgaagctaagaaagcactggcttcttattctcaccagacatctcaacacccacgtgcgctgggtcccgcagtctctcgcccgccccacgcgggtcccagccctggtccttactccccgcgcgggaagaatctggggagggtgggggcggagaggcggctgatcggagagtgggagggaggatgggagatgggcagaggctgcccgcatcagggccaggacagacgtccgcgcggccccaggcactcacttgagtgtcacgcaagtcaccccaacaccgcacaagacagtggcggggtgcgcaccgaggcccctacctggggggtgtgcgcgcactgaacgaccccttctccaggtgcgcgagccgctccggcggccgtgcacactgcgcccccttccgcccacctgcctggcctgcgtttctaaccacgcgggcggtcccgagacttcgcgcaaaaggcaggaccgcgactcccaataatgatatcttcgaaataaccccctgctgagccggcgcccagggccgggggtagagtcccgagtcccttttgcggaattaaggagacctctggcgaccggggagcctgcccctgtgaccgctccagcagcccctgccgcgtgcgtgcccgagtgtggcccgcagctcccaaagcccaggtgtgtgtggcctagggcggggagagttggcgacccgggcccatcaccgccccagtgccaccgccccagtgcctgaccagatggggtgcggtccctacgcccggcgtggccccgccgccgctcagatctgaagtccggctttcgctcgccctgcgcggcggaacctctgacccggagcagctctaggccgtgggcttcgtctcctcctcctggaaggaatgaatgggctccccgacacacacctctcagaaaactcacctttcacgctgaccttcaaaagaaaagaaagaaagaaaaagaaaaatccgctcgaagcgggaaaatgtccacgcccggatttggggtggacacgcgccccggcctggctggagg

SEQ ID NO: 120464 - DNA, 176 bp, Homo sapiens; identical to SEQ ID NO: 88653
  misc_feature 1..176: note = chr21:38066809-38066985
  misc_feature 1..176: note = Hyper
  source 1..176: mol_type = genomic DNA

SEQ ID NO: 120465 - DNA, 162 bp, Homo sapiens; identical to SEQ ID NO: 88654
  misc_feature 1..162: note = chr21:38067345-38067507
  misc_feature 1..162: note = Hyper
  source 1..162: mol_type = genomic DNA

SEQ ID NO: 120466 - DNA, 30 bp, Homo sapiens; identical to SEQ ID NO: 38364
  misc_feature 1..30: note = chr21:38067871-38067901
  misc_feature 1..30: note = Hyper
  source 1..30: mol_type = genomic DNA

SEQ ID NO: 120467 - DNA, 605 bp, Homo sapiens
  misc_feature 1..605: note = chr21:38068178-38068783
  misc_feature 1..605: note = Hyper
  source 1..605: mol_type = genomic DNA
tagcctctcccatcccgcggggaacggccggagttcttcccttgatctctcccgagtcggcttccgctggggatggatcgcaggtaggcgccggcgcggcctggggaagaacagttgcggagcatctgaagcggaaaatccaagcagatgtgaggcgatccgggcccgcctcgttcctcttggggcctgaatttcttccagataagtttcctaatggaacatttctaagaggtggggtacgaggcggcttgctcgcacgcgcagtgggacagactgcgggtggggacgtactgagaggtccggacctcaatgcgtccgacccgtctccacaccgcccttttccagcccccagtctcctttcattccctactcttcaggctcctttggggccagtgggtgaaccgccatttagaacggtgcctcggactcgggggtcgtgcgctccatctctgcctcccccctggggcccgcgaggctggtccgggctttctgagctgggcgttcggctttaggcccaatacctggaccaggaatttcttctccccgcgccagaagggaaagacataggaggtgtcccaatctgcggtcaccgccgatgctcctga

SEQ ID NO: 120468 - DNA, 931 bp, Homo sapiens
  misc_feature 1..931: note = chr21:38069124-38070055
  misc_feature 1..931: note = Hyper
  source 1..931: mol_type = genomic DNA
cggcgaaaggatgtgcttgggggagccgagtacacaacgtctgcttgggcagctgctgggcaggcgttgggcctggaggtatctcacacccacgtatcttccagtcttcaaacacggcattgctctgcctcccgtagcgcgcttcgaacctgcctcgcggacacgtgaacagaggctgtccctgggaagataagtgcgctttcccgtaaaatccgggaaatttgccttgaggaaagtttccgttcttgttacttgtcgggtttctcccacttccacttagccatgtttctgcgatctgggtaatccctttcaagcccaggaggaattctcccgggtccataattgagggtcggaagccgtgggggtgagaaacgcattaaatcctcccgaagcccaggaggtgccagagcgggctcagggggccgcctgcggaagctgcggcaggggctgggtccgtagcctctaaccccttggagctccttctcccagaggcccggagccggcagctgtcagcgcagccaggagcgggatcctgggcgcggaggtgggtccgactcgccaggcttgggcattggagacccgcgccgctagcccatggccctctgctcaagccgctgcaacaggaaagcgctcctggatccgaaaccccaaaggaaagcgctgttactctgtgcgtccggctcgcgtggcgtcgcggtttcggagcaccaagcctgcgagccctggccacgatgtggactccgcaaggggctagggacaggcagggggagagcccgggtttgcgcacaccttccagcccctggagggagcctgctcggcttcgaacgccttcgaacttttgaccttcaaaggagtccctggaaaaggtcaggagcgcctgctgcaggcacggttgccgaaggccaggccttcctggcgcaggggagggcca

SEQ ID NO: 120469 - DNA, 639 bp, Homo sapiens; identical to SEQ ID NO: 88660
  misc_feature 1..639: note = chr21:38070425-38071064
  misc_feature 1..639: note = Hyper
  source 1..639: mol_type = genomic DNA

SEQ ID NO: 120470 - DNA, 52 bp, Homo sapiens; identical to SEQ ID NO: 88661
  misc_feature 1..52: note = chr21:38071635-38071687
  misc_feature 1..52: note = Hyper
  source 1..52: mol_type = genomic DNA

SEQ ID NO: 120471 - DNA, 551 bp, Homo sapiens; identical to SEQ ID NO: 88662
  misc_feature 1..551: note = chr21:38072016-38072567
  misc_feature 1..551: note = Hyper
  source 1..551: mol_type = genomic DNA

SEQ ID NO: 120472 - DNA, 972 bp, Homo sapiens
  misc_feature 1..972: note = chr21:38072905-38073877
  misc_feature 1..972: note = Hyper
  source 1..972: mol_type = genomic DNA
agggtcagcttcaggcgctgcgagtcagcggggatcacggtgaggcccaagcactgcaggctgaggccacagagcgaacacttgtgctgagccgggccctctcgtgaggctggggtgcgggaagtccgggcaggagagacccgcccccgccgttgctgagctgagacccggctgaaagagaggggtccgattaattcgaaaatggcagacagagctgagcgctgccgttcttttcaggattgaaaatgtgccagtgggccaggggcgctgggacccgcggtgcggaagactcggaacaggaagaaatagtggcgcgctgggtgggctgccccgccgcccacgccggttgccgctggtgacagtggctgcccggccaggcacctccgagcagcaggtctgagcgtttttggcgtcccaagcgttccgggccgcgtcttccagagcctctgctcccagcggggtcgctgcggcctggcccgaaggatttgactctttgctgggaggcgcgctgctcagggttctggtgggtcctctgggcccaggagctgggagggctgcgccggcctctggagccccgggagccagtgccgaggtagggagacaacttccgccgcagggcgccggacggtcggggcagagcaggcgacaggtgtccctaggccgcagggcgcttccatagcgccatccccaccaggcactctactcgaaatcggaaagctcgaccttttgcgttcgcctctgccaagcctgttatttgtgctggccgctgggtctggagctgcgcttctcggcccctccccggtggagcgcagagggctggtctgcaagcgcggcctccagccccgcggctccccggcccaggagccaggcgcgggctgacccgggagcacccggcagcggagggggctggaagcggaccctaggcctctcctgtgccacccggccctaccgcgcggccgcggggcgctctcc

SEQ ID NO: 120473 - DNA, 40 bp, Homo sapiens; identical to SEQ ID NO: 88666
  misc_feature 1..40: note = chr21:38074462-38074502
  misc_feature 1..40: note = Hyper
  source 1..40: mol_type = genomic DNA

SEQ ID NO: 120474 - DNA, 30 bp, Homo sapiens; identical to SEQ ID NO: 38375
  misc_feature 1..30: note = chr21:38075927-38075957
  misc_feature 1..30: note = Hyper
  source 1..30: mol_type = genomic DNA

SEQ ID NO: 120475 - DNA, 35 bp, Homo sapiens; identical to SEQ ID NO: 13975
  misc_feature 1..35: note = chr21:38076386-38076421
  misc_feature 1..35: note = Hyper
  source 1..35: mol_type = genomic DNA

SEQ ID NO: 120476 - DNA, 1002 bp, Homo sapiens
  misc_feature 1..1002: note = chr21:38076747-38077749
  misc_feature 1..1002: note = Hyper
  source 1..1002: mol_type = genomic DNA
ccaggagggaaagcccgcaggcgcagaggggacaatccgggaagtggtaaaggggacacccgggcacagggcctgtgctttcgttgcaggcgaggaagtggagcgcgcgctgcagattcagcgcggggctagaggaggggacctggatccctgaaccccggggcggaaagggagcctccgggcggctgtgggtgccgcgctcctcggagccagcagctgctggggcggcgtccgaactccccaggtctgcgcacggcaatgggggcaccgggccttctgtctgtcctcagaatacgtaggatacccgcgggcgacaagccgggccaggctaggagcctccttccctgcccctccccatcggccgcgggaggctttcttggggcgtccccacgaccacccccttctcacccggtccccagtttggaaaaaggcgcaagaagcgggcttttcagggaccccggggagaacacgagggctccgacgcgggagaaggattgaagcgtgcagaggcgccccaaattgcgacaatttactgggatccttttgtggggaaaggaggcttagaggctcaagctataggctgtcctagagcaactaggcgagaacctggccccaaactccctccttacgccctggcacaggttcccggcgactggtgttcccaagggagccccctgagcctaccgcccttgcagggggtcgtgctgcggcttctgggtcataaacgccgaggtcgggggtggcggagctgtagaggctgcccgcgcagaaagctccaggatcccaatatgtgcttgcgtggagcagggagcggaagaggcagccggtcctcaccctcctctcccgccacgcacatatccttcttgacttcgaagtggtttgcaatccgaaagtgagaccttgagtcctcagatggccggcaacgcgccgaggtcacgctccccagaaacacccctctcccctcccctaccccagctccccctggggcgggtggtaattggg

SEQ ID NO: 120477 - DNA, 72 bp, Homo sapiens; identical to SEQ ID NO: 38379
  misc_feature 1..72: note = chr21:38078415-38078487
  misc_feature 1..72: note = Hyper
  source 1..72: mol_type = genomic DNA

SEQ ID NO: 120478 - DNA, 44 bp, Homo sapiens; identical to SEQ ID NO: 88672
  misc_feature 1..44: note = chr21:38078751-38078795
  misc_feature 1..44: note = Hyper
  source 1..44: mol_type = genomic DNA

SEQ ID NO: 120479 - DNA, 845 bp, Homo sapiens
  misc_feature 1..845: note = chr21:38079908-38080753
  misc_feature 1..845: note = Hyper
  source 1..845: mol_type = genomic DNA
taggtttttagttgccgaatagggaagggtttgcgaagccgctgccctgggccgaggtgcattttacgcttccagaggtcgaggcctccagagaccgcgatgcccagggcgttcccggggaggctgagagacccagggtgctctgggtgactgcacggcgactcctcgggaacccactcgtggctgcccgcttggaagggctttgcggccccgggaacgatctccaggatctccacggctggtcaggttccccgtccctcgtatcccgcgctgcccgggggctcctgcctttggttcagtgctcgcggcaccaccgcactcaggacggcagtggggggctggggctggggctgggcctggcccagcgtgggttggggcgggggacgcgccagcagcgcccgcagctcgctccgcaggggtcgcagccaggggtcgggagctaggctcgtgggccgggagacgccgggcgcgttgtcctccggggaggttggggtgcaggcggtgcaccgaccctcgccatctggcgctgcagccaccagccacggcgcttagtggagggtctgcggccaggctcccggcggaaagattccggggagggctcgggggttgtcccagcccgcgctaagcgccgcagcctcgcccggctttcctgcttcctcggactgtgcaggggaagcctggggtctcgcggggcgcagcagtcaggtcgagggtgcagcaggaggggagtcctgacgggcaggtccctctttcccctggtgcgcaacactggttggtagcttttgcggaggtggtgaagaagggcaggaggcctgttgagcggaggagtccggggatccctaatt

SEQ ID NO: 120480 - DNA, 705 bp, Homo sapiens
  misc_feature 1..705: note = chr21:38081208-38081913
  misc_feature 1..705: note = Hyper
  source 1..705: mol_type = genomic DNA
tgggcctggcaggctcgcacaggcgcccgggctgccggccgctgcggggatttctcccccagccttttctttttaacagagggcaaaggggcgacggcgagagcacagatggcggctgcggagccggggaggcggcggggagacgcgcgggactcgtggggagggctggcagggtgcaggggttccgcgtgacctgcccggctcccaggcatcgggctgggcgctgcagtttaccgatttgctttcgtccctcgtccaggtttaggagacgcgtggggacagccgagccgcgccgggcccctggacggcgtcgccaaggagctgggatcgcacttgctgcaggtagagcggcctcgccgggggaggagcgcagccgccgcaggctcccttcccaccccgccaccccagcctccaggcgtcccttccccaggagcgccaggcagatccagaggctgccgggggctggggatggggtggtccccactgcggagggatggacgcttagcatgtcggatgcggcctgcggccaaccctaccctaaccctacgtctgcccccacaccccgccgaaggccccaggactccccaggccacctgagacctacgccaggggcgcctcccgagcgtggtcaagtgctttccaatctcacttccctcagcaggttccacccagcgcttgctctgtgccaggcgccagggctggagc

SEQ ID NO: 120481 - DNA, 696 bp, Homo sapiens
  misc_feature 1..696: note = chr21:38082478-38083174
  misc_feature 1..696: note = Hyper
  source 1..696: mol_type = genomic DNA
ctaaggtcacacagcaaggggtggagcggagttagcccactggcctagctctagagcccacccggataaccagaacttggtgaggcctccgggctcttgcttggtttggagccaggtgcttagcgccccgagcccggggccattcaccctgcaggagctgcacgcgcccctgacctcggcttttccctggcagcagaggggctttgcgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgccatgacttaggtcagcgagtcagccgctagctctgcatttccaaaaagcagatcttttcacaactctcttgccccaagtgccctggtgtggtttattttttaaaatgcatgcctgcggaagagaagacccggggaatattcgaaaccccgagcttttacaacataaagcgcatggtgtggccgcggcgagtaatggcgctctgggagccctgcccaggcggcctctgctcgccctcctccactt

SEQ ID NO: 120482 - DNA, 234 bp, Homo sapiens; identical to SEQ ID NO: 88679
  misc_feature 1..234: note = chr21:38092055-38092289
  misc_feature 1..234: note = Hypo
  source 1..234: mol_type = genomic DNA

SEQ ID NO: 120483 - DNA, 958 bp, Homo sapiens
  misc_feature 1..958: note = chr21:38119754-38120712
  misc_feature 1..958: note = Hyper
  source 1..958: mol_type = genomic DNA
ttccctgctttgtaacgcggctcctggaacatttcaggtcgcgtcctgagattggacagcacggcctagactaaggcgggggagggcgacagcgaccccgcgggtgcagcgcgtgggcggccgaggggtggtggctgcgcccggggcttgggggtggggtggctgcggccgcgccccttgctgccctctaacgtgtcgcctgtccccgcagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtc

SEQ ID NO: 120484 - DNA, 40 bp, Homo sapiens; identical to SEQ ID NO: 46465
  misc_feature 1..40: note = chr21:38363098-38363138
  misc_feature 1..40: note = Hypo
  source 1..40: mol_type = genomic DNA

SEQ ID NO: 120485 - DNA, 247 bp, Homo sapiens
  misc_feature 1..247: note = chr21:38378381-38378628
  misc_feature 1..247: note = Hyper
  source 1..247: mol_type = genomic DNA
gctgccgctctaaggcggtggaagcgagattctccggaaacccagggaatccgatgctcgcacaggaccaaagcccgaggccgcggggaccacagagggacggagaagccgggactcctcacatcccacatccggcaggggaagcccagcaggtgagcgcaggtccccccagtccccgagggagtgcgcccgacggaaacgcccctagcccgcgggcctcgctttcctctcccgggttcctgggtca

SEQ ID NO: 120486 - DNA, 335 bp, Homo sapiens; identical to SEQ ID NO: 88684
  misc_feature 1..335: note = chr21:38378928-38379263
  misc_feature 1..335: note = Hyper
  source 1..335: mol_type = genomic DNA

SEQ ID NO: 120487 - DNA, 65 bp, Homo sapiens; identical to SEQ ID NO: 88685
  misc_feature 1..65: note = chr21:38379523-38379588
  misc_feature 1..65: note = Hyper
  source 1..65: mol_type = genomic DNA

SEQ ID NO: 120488 - DNA, 30 bp, Homo sapiens; identical to SEQ ID NO: 88686
  misc_feature 1..30: note = chr21:38383158-38383188
  misc_feature 1..30: note = Hypo
  source 1..30: mol_type = genomic DNA

SEQ ID NO: 120489 - DNA, 30 bp, Homo sapiens; identical to SEQ ID NO: 88687
  misc_feature 1..30: note = chr21:38593074-38593104
  misc_feature 1..30: note = Hyper
  source 1..30: mol_type = genomic DNA

SEQ ID NO: 120490 - DNA, 367 bp, Homo sapiens; identical to SEQ ID NO: 88688
  misc_feature 1..367: note = chr21:38593362-38593729
  misc_feature 1..367: note = Hyper
  source 1..367: mol_type = genomic DNA

SEQ ID NO: 120491 - DNA, 77 bp, Homo sapiens; identical to SEQ ID NO: 88689
  misc_feature 1..77: note = chr21:38602978-38603055
  misc_feature 1..77: note = Hypo
  source 1..77: mol_type = genomic DNA

SEQ ID NO: 120492 - DNA, 30 bp, Homo sapiens; identical to SEQ ID NO: 88690
  misc_feature 1..30: note = chr21:38603457-38603487
  misc_feature 1..30: note = Hypo
  source 1..30: mol_type = genomic DNA

SEQ ID NO: 120493 - DNA, 63 bp, Homo sapiens; identical to SEQ ID NO: 88691
  misc_feature 1..63: note = chr21:38606032-38606095
  misc_feature 1..63: note = Hypo
  source 1..63: mol_type = genomic DNA

SEQ ID NO: 120494 - DNA, 216 bp, Homo sapiens; identical to SEQ ID NO: 88692
  misc_feature 1..216: note = chr21:38638487-38638703
  misc_feature 1..216: note = Hypo
  source 1..216: mol_type = genomic DNA

SEQ ID NO: 120495 - DNA, 30 bp, Homo sapiens; identical to SEQ ID NO: 46467
  misc_feature 1..30: note = chr21:38823635-38823665
  misc_feature 1..30: note = Hypo
  source 1..30: mol_type = genomic DNA

SEQ ID NO: 120496 - DNA, 23 bp, Homo sapiens
  misc_feature 1..23: note = chr21:38880597-38880620
  misc_feature 1..23: note = Hypo
  source 1..23: mol_type = genomic DNA
tctcccctgctgagacggagtct

SEQ ID NO: 120497 - DNA, 102 bp, Homo sapiens; identical to SEQ ID NO: 88695
  misc_feature 1..102: note = chr21:38918459-38918561
  misc_feature 1..102: note = Hypo
  source 1..102: mol_type = genomic DNA

SEQ ID NO: 120498 - DNA, 142 bp, Homo sapiens; identical to SEQ ID NO: 46469
  misc_feature 1..142: note = chr21:38935380-38935522
  misc_feature 1..142: note = Hypo
  source 1..142: mol_type = genomic DNA

SEQ ID NO: 120499 - DNA, 77 bp, Homo sapiens; identical to SEQ ID NO: 88697
  misc_feature 1..77: note = chr21:38936189-38936266
  misc_feature 1..77: note = Hyper
  source 1..77: mol_type = genomic DNA

SEQ ID NO: 120500 - DNA, 30 bp, Homo sapiens; identical to SEQ ID NO: 46470
  misc_feature 1..30: note = chr21:38987670-38987700
  misc_feature 1..30: note = Hypo
  source 1..30: mol_type = genomic DNA

SEQ ID NO: 120501 - DNA, 138 bp, Homo sapiens; identical to SEQ ID NO: 88699
  misc_feature 1..138: note = chr21:39047670-39047808
  misc_feature 1..138: note = Hyper
  source 1..138: mol_type = genomic DNA

SEQ ID NO: 120502 - DNA, 295 bp, Homo sapiens; identical to SEQ ID NO: 88700
  misc_feature 1..295: note = chr21:39286580-39286875
  misc_feature 1..295: note = Hyper
  source 1..295: mol_type = genomic DNA

SEQ ID NO: 120503 - DNA, 395 bp, Homo sapiens; identical to SEQ ID NO: 88701
  misc_feature 1..395: note = chr21:39287999-39288394
  misc_feature 1..395: note = Hyper
  source 1..395: mol_type = genomic DNA

SEQ ID NO: 120504 - DNA, 126 bp, Homo sapiens
  misc_feature 1..126: note = chr21:39288775-39288901
  misc_feature 1..126: note = Hyper
  source 1..126: mol_type = genomic DNA
tgctggggaaaaagccgcacagcgccggcgcggtccgggaggaaggggcgggggcgagcaggacagagccacagacccagagacgcccaccccgccgcccatgccagctagcgtgtcagcgcgtcg

SEQ ID NO: 120505 - DNA, 145 bp, Homo sapiens; identical to SEQ ID NO: 88703
  misc_feature 1..145: note = chr21:39289180-39289325
  misc_feature 1..145: note = Hyper
  source 1..145: mol_type = genomic DNA

SEQ ID NO: 120506 - DNA, 30 bp, Homo sapiens; identical to SEQ ID NO: 88704
  misc_feature 1..30: note = chr21:39953590-39953620
  misc_feature 1..30: note = Hypo
  source 1..30: mol_type = genomic DNA

SEQ ID NO: 120507 - DNA, 30 bp, Homo sapiens; identical to SEQ ID NO: 88705
  misc_feature 1..30: note = chr21:40022607-40022637
  misc_feature 1..30: note = Hypo
  source 1..30: mol_type = genomic DNA

SEQ ID NO: 120508 - DNA, 82 bp, Homo sapiens; identical to SEQ ID NO: 38398
  misc_feature 1..82: note = chr21:40032153-40032235
  misc_feature 1..82: note = Hyper
  source 1..82: mol_type = genomic DNA

SEQ ID NO: 120509 - DNA, 291 bp, Homo sapiens
  misc_feature 1..291: note = chr21:40032557-40032848
  misc_feature 1..291: note = Hyper
  source 1..291: mol_type = genomic DNA
tcgcactaactccctcggcgccgacgggctcagcccatggtgtgggcgccgggttcagggaggctccggctcccgccaatcgcggagcagggcggccgccccgacgcgcgacttgcgaacccggagtgcgcgccgggggcggggcagggacgcgtgggcgggaatgcacgcgcgtggccaggtgcgcgtgggtgcgagcgcgcgggagtcttcgagtgcgcgcgtgtccgtgtgcgcgtgggtgtgggtgtgctcgcgtgtccgtgcgcgcgccctcggggccaagagcgc

SEQ ID NO: 120510 - DNA, 252 bp, Homo sapiens; identical to SEQ ID NO: 88708
  misc_feature 1..252: note = chr21:40033106-40033358
  misc_feature 1..252: note = Hyper
  source 1..252: mol_type = genomic DNA

SEQ ID NO: 120511 - DNA, 30 bp, Homo sapiens; identical to SEQ ID NO: 88709
  misc_feature 1..30: note = chr21:40106338-40106368
  misc_feature 1..30: note = Hyper
  source 1..30: mol_type = genomic DNA

SEQ ID NO: 120512 - DNA, 30 bp, Homo sapiens; identical to SEQ ID NO: 88710
  misc_feature 1..30: note = chr21:40394086-40394116
  misc_feature 1..30: note = Hypo
  source 1..30: mol_type = genomic DNA

SEQ ID NO: 120513 - DNA, 146 bp, Homo sapiens; identical to SEQ ID NO: 88711
  misc_feature 1..146: note = chr21:40510522-40510668
  misc_feature 1..146: note = Hypo
  source 1..146: mol_type = genomic DNA

SEQ ID NO: 120514 - DNA, 206 bp, Homo sapiens; identical to SEQ ID NO: 88712
  misc_feature 1..206: note = chr21:40630336-40630542
  misc_feature 1..206: note = Hypo
  source 1..206: mol_type = genomic DNA

SEQ ID NO: 120515 - DNA, 41 bp, Homo sapiens; identical to SEQ ID NO: 88713
  misc_feature 1..41: note = chr21:40717636-40717677
  misc_feature 1..41: note = Hypo
  source 1..41: mol_type = genomic DNA

SEQ ID NO: 120516 - DNA, 30 bp, Homo sapiens; identical to SEQ ID NO: 38401
  misc_feature 1..30: note = chr21:40984793-40984823
  misc_feature 1..30: note = Hyper
  source 1..30: mol_type = genomic DNA

SEQ ID NO: 120517 - DNA, 36 bp, Homo sapiens; identical to SEQ ID NO: 88715
  misc_feature 1..36: note = chr21:42218886-42218922
  misc_feature 1..36: note = Hyper
  source 1..36: mol_type = genomic DNA

SEQ ID NO: 120518 - DNA, 30 bp, Homo sapiens; identical to SEQ ID NO: 88716
  misc_feature 1..30: note = chr21:42447793-42447823
  misc_feature 1..30: note = Hypo
  source 1..30: mol_type = genomic DNA

SEQ ID NO: 120519 - DNA, 39 bp, Homo sapiens; identical to SEQ ID NO: 46472
  misc_feature 1..39: note = chr21:42448116-42448155
  misc_feature 1..39: note = Hypo
  source 1..39: mol_type = genomic DNA

SEQ ID NO: 120520 - DNA, 145 bp, Homo sapiens; identical to SEQ ID NO: 88718
  misc_feature 1..145: note = chr21:42572656-42572801
  misc_feature 1..145: note = Hypo
  source 1..145: mol_type = genomic DNA

SEQ ID NO: 120521 - DNA, 30 bp, Homo sapiens; identical to SEQ ID NO: 88719
  misc_feature 1..30: note = chr21:42606870-42606900
  misc_feature 1..30: note = Hypo
  source 1..30: mol_type = genomic DNA

SEQ ID NO: 120522 - DNA, 63 bp, Homo sapiens; identical to SEQ ID NO: 88720
  misc_feature 1..63: note = chr21:42613756-42613819
  misc_feature 1..63: note = Hypo
  source 1..63: mol_type = genomic DNA

SEQ ID NO: 120523 - DNA, 611 bp, Homo sapiens; identical to SEQ ID NO: 88721
  misc_feature 1..611: note = chr21:42688619-42689230
  misc_feature 1..611: note = Hyper
  source 1..611: mol_type = genomic DNA

SEQ ID NO: 120524 - DNA, 104 bp, Homo sapiens; identical to SEQ ID NO: 88722
  misc_feature 1..104: note = chr21:42797863-42797967
  misc_feature 1..104: note = Hyper
  source 1..104: mol_type = genomic DNA

SEQ ID NO: 120525 - DNA, 47 bp, Homo sapiens; identical to SEQ ID NO: 88723
  misc_feature 1..47: note = chr21:42798497-42798544
  misc_feature 1..47: note = Hyper
  source 1..47: mol_type = genomic DNA

SEQ ID NO: 120526 - DNA, 530 bp, Homo sapiens; identical to SEQ ID NO: 88724
  misc_feature 1..530: note = chr21:42878710-42879240
  misc_feature 1..530: note = Hyper
  source 1..530: mol_type = genomic DNA

SEQ ID NO: 120527 - DNA, 45 bp, Homo sapiens; identical to SEQ ID NO: 88725
  misc_feature 1..45: note = chr21:42880059-42880104
  misc_feature 1..45: note = Hyper
  source 1..45: mol_type = genomic DNA

SEQ ID NO: 120528 - DNA, 194 bp, Homo sapiens; identical to SEQ ID NO: 88726
  misc_feature 1..194: note = chr21:42880402-42880596
  misc_feature 1..194: note = Hyper
  source 1..194: mol_type = genomic DNA

SEQ ID NO: 120529 - DNA, 18 bp, Homo sapiens
  misc_feature 1..18: note = chr21:42925199-42925217
  misc_feature 1..18: note = Hypo
  source 1..18: mol_type = genomic DNA
ttaaagattacaggccgg

SEQ ID NO: 120530 - DNA, 30 bp, Homo sapiens; identical to SEQ ID NO: 46474
  misc_feature 1..30: note = chr21:42953643-42953673
  misc_feature 1..30: note = Hypo
  source 1..30: mol_type = genomic DNA

SEQ ID NO: 120531 - DNA, 30 bp, Homo sapiens; identical to SEQ ID NO: 46475
  misc_feature 1..30: note = chr21:43033404-43033434
  misc_feature 1..30: note = Hypo
  source 1..30: mol_type = genomic DNA

SEQ ID NO: 120532 - DNA, 30 bp, Homo sapiens; identical to SEQ ID NO: 88730
  misc_feature 1..30: note = chr21:43187812-43187842
  misc_feature 1..30: note = Hyper
  source 1..30: mol_type = genomic DNA

SEQ ID NO: 120533 - DNA, 55 bp, Homo sapiens; identical to SEQ ID NO: 88731
  misc_feature 1..55: note = chr21:43188093-43188148
  misc_feature 1..55: note = Hyper
  source 1..55: mol_type = genomic DNA

SEQ ID NO: 120534 - DNA, 30 bp, Homo sapiens; identical to SEQ ID NO: 88732
  misc_feature 1..30: note = chr21:43188455-43188485
  misc_feature 1..30: note = Hyper
  source 1..30: mol_type = genomic DNA

SEQ ID NO: 120535 - DNA, 430 bp, Homo sapiens; identical to SEQ ID NO: 88733
  misc_feature 1..430: note = chr21:43248491-43248921
  misc_feature 1..430: note = Hypo
  source 1..430: mol_type = genomic DNA

SEQ ID NO: 120536 - DNA, 272 bp, Homo sapiens; identical to SEQ ID NO: 88734
  misc_feature 1..272: note = chr21:43255502-43255774
  misc_feature 1..272: note = Hypo
  source 1..272: mol_type = genomic DNA

SEQ ID NO: 120537 - DNA, 61 bp, Homo sapiens; identical to SEQ ID NO: 88735
  misc_feature 1..61: note = chr21:43376373-43376434
  misc_feature 1..61: note = Hypo
  source 1..61: mol_type = genomic DNA

SEQ ID NO: 120538 - DNA, 38 bp, Homo sapiens; identical to SEQ ID NO: 46479
  misc_feature 1..38: note = chr21:43493035-43493073
  misc_feature 1..38: note = Hypo
  source 1..38: mol_type = genomic DNA

SEQ ID NO: 120539 - DNA, 30 bp, Homo sapiens; identical to SEQ ID NO: 88737
  misc_feature 1..30: note = chr21:43520167-43520197
  misc_feature 1..30: note = Hypo
  source 1..30: mol_type = genomic DNA

SEQ ID NO: 120540 - DNA, 123 bp, Homo sapiens; identical to SEQ ID NO: 88738
  misc_feature 1..123: note = chr21:43521309-43521432
  misc_feature 1..123: note = Hypo
  source 1..123: mol_type = genomic DNA

SEQ ID NO: 120541 - DNA, 43 bp, Homo sapiens; identical to SEQ ID NO: 88739
  misc_feature 1..43: note = chr21:43526266-43526309
  misc_feature 1..43: note = Hypo
  source 1..43: mol_type = genomic DNA

SEQ ID NO: 120542 - DNA, 30 bp, Homo sapiens; identical to SEQ ID NO: 88740
  misc_feature 1..30: note = chr21:43527383-43527413
  misc_feature 1..30: note = Hypo
  source 1..30: mol_type = genomic DNA

SEQ ID NO: 120543 - DNA, 60 bp, Homo sapiens; identical to SEQ ID NO: 88741
  misc_feature 1..60: note = chr21:43640641-43640701
  misc_feature 1..60: note = Hyper
  source 1..60: mol_type = genomic DNA

SEQ ID NO: 120544 - DNA, 30 bp, Homo sapiens; identical to SEQ ID NO: 88742
  misc_feature 1..30: note = chr21:43714330-43714360
  misc_feature 1..30: note = Hypo
  source 1..30: mol_type = genomic DNA

SEQ ID NO: 120545 - DNA, 95 bp, Homo sapiens; identical to SEQ ID NO: 88743
  misc_feature 1..95: note = chr21:43725826-43725921
  misc_feature 1..95: note = Hypo
  source 1..95: mol_type = genomic DNA

SEQ ID NO: 120546 - DNA, 245 bp, Homo sapiens; identical to SEQ ID NO: 46481
  misc_feature 1..245: note = chr21:43786496-43786741
  misc_feature 1..245: note = Hypo
  source 1..245: mol_type = genomic DNA

SEQ ID NO: 120547 - DNA, 30 bp, Homo sapiens; identical to SEQ ID NO: 88745
  misc_feature 1..30: note = chr21:43852234-43852264
  misc_feature 1..30: note = Hypo
  source 1..30: mol_type = genomic DNA

SEQ ID NO: 120548 - DNA, 30 bp, Homo sapiens; identical to SEQ ID NO: 88746
  misc_feature 1..30: note = chr21:43859152-43859182
  misc_feature 1..30: note = Hypo
  source 1..30: mol_type = genomic DNA

SEQ ID NO: 120549 - DNA, 45 bp, Homo sapiens; identical to SEQ ID NO: 46482
  misc_feature 1..45: note = chr21:43864728-43864773
  misc_feature 1..45: note = Hypo
  source 1..45: mol_type = genomic DNA

SEQ ID NO: 120550 - DNA, 30 bp, Homo sapiens; identical to SEQ ID NO: 88748
  misc_feature 1..30: note = chr21:43981657-43981687
  misc_feature 1..30: note = Hypo
  source 1..30: mol_type = genomic DNA

SEQ ID NO: 120551 - DNA, 193 bp, Homo sapiens; identical to SEQ ID NO: 88749
  misc_feature 1..193: note = chr21:43991300-43991493
  misc_feature 1..193: note = Hypo
  source 1..193: mol_type = genomic DNA

SEQ ID NO: 120552 - DNA, 102 bp, Homo sapiens; identical to SEQ ID NO: 88750
  misc_feature 1..102: note = chr21:44037537-44037639
  misc_feature 1..102: note = Hypo
  source 1..102: mol_type = genomic DNA

SEQ ID NO: 120553 - DNA, 191 bp, Homo sapiens; identical to SEQ ID NO: 88751
  misc_feature 1..191: note = chr21:44073316-44073507
  misc_feature 1..191: note = Hyper
  source 1..191: mol_type = genomic DNA

SEQ ID NO: 120554 - DNA, 30 bp, Homo sapiens; identical to SEQ ID NO: 88752
  misc_feature 1..30: note = chr21:44081613-44081643
  misc_feature 1..30: note = Hypo
  source 1..30: mol_type = genomic DNA

SEQ ID NO: 120555 - DNA, 43 bp, Homo sapiens; identical to SEQ ID NO: 88753
  misc_feature 1..43: note = chr21:44086020-44086063
  misc_feature 1..43: note = Hypo
  source 1..43: mol_type = genomic DNA

SEQ ID NO: 120556 - DNA, 30 bp, Homo sapiens; identical to SEQ ID NO: 46484
  misc_feature 1..30: note = chr21:44093215-44093245
  misc_feature 1..30: note = Hypo
  source 1..30: mol_type = genomic DNA

SEQ ID NO: 120557 - DNA, 30 bp, Homo sapiens; identical to SEQ ID NO: 88755
  misc_feature 1..30: note = chr21:44163509-44163539
  misc_feature 1..30: note = Hypo
  source 1..30: mol_type = genomic DNA

SEQ ID NO: 120558 - DNA, 30 bp, Homo sapiens; identical to SEQ ID NO: 88756
  misc_feature 1..30: note = chr21:44187199-44187229
  misc_feature 1..30: note = Hypo
  source 1..30: mol_type = genomic DNA

SEQ ID NO: 120559 - DNA, 42 bp, Homo sapiens; identical to SEQ ID NO: 88757
  misc_feature 1..42: note = chr21:44283111-44283153
  misc_feature 1..42: note = Hypo
  source 1..42: mol_type = genomic DNA

SEQ ID NO: 120560 - DNA, 88 bp, Homo sapiens; identical to SEQ ID NO: 88758
  misc_feature 1..88: note = chr21:44283686-44283774
  misc_feature 1..88: note = Hypo
  source 1..88: mol_type = genomic DNA

SEQ ID NO: 120561 - DNA, 378 bp, Homo sapiens; identical to SEQ ID NO: 46486
  misc_feature 1..378: note = chr21:44338174-44338552
  misc_feature 1..378: note = Hypo
  source 1..378: mol_type = genomic DNA

SEQ ID NO: 120562 - DNA, 52 bp, Homo sapiens; identical to SEQ ID NO: 88760
  misc_feature 1..52: note = chr21:44340200-44340252
  misc_feature 1..52: note = Hypo
  source 1..52: mol_type = genomic DNA

SEQ ID NO: 120563 - DNA, 30 bp, Homo sapiens; identical to SEQ ID NO: 88761
  misc_feature 1..30: note = chr21:44361878-44361908
  misc_feature 1..30: note = Hypo
  source 1..30: mol_type = genomic DNA

SEQ ID NO: 120564 - DNA, 30 bp, Homo sapiens; identical to SEQ ID NO: 88762
  misc_feature 1..30: note = chr21:44474704-44474734
  misc_feature 1..30: note = Hypo
  source 1..30: mol_type = genomic DNA

SEQ ID NO: 120565 - DNA, 129 bp, Homo sapiens; identical to SEQ ID NO: 88763
  misc_feature 1..129: note = chr21:44480656-44480785
  misc_feature 1..129: note = Hypo
  source 1..129: mol_type = genomic DNA

SEQ ID NO: 120566 - DNA, 115 bp, Homo sapiens; identical to SEQ ID NO: 88764
  misc_feature 1..115: note = chr21:44482572-44482687
  misc_feature 1..115: note = Hypo
  source 1..115: mol_type = genomic DNA

SEQ ID NO: 120567 - DNA, 62 bp, Homo sapiens; identical to SEQ ID NO: 88765
  misc_feature 1..62: note = chr21:44482892-44482954
  misc_feature 1..62: note = Hypo
  source 1..62: mol_type = genomic DNA

SEQ ID NO: 120568 - DNA, 30 bp, Homo sapiens; identical to SEQ ID NO: 88766
  misc_feature 1..30: note = chr21:44483216-44483246
  misc_feature 1..30: note = Hypo
  source 1..30: mol_type = genomic DNA

SEQ ID NO: 120569 - DNA, 50 bp, Homo sapiens; identical to SEQ ID NO: 88767
  misc_feature 1..50: note = chr21:44483958-44484008
  misc_feature 1..50: note = Hypo
  source 1..50: mol_type = genomic DNA

SEQ ID NO: 120570 - DNA, 1442 bp, Homo sapiens
  misc_feature 1..1442: note = chr21:44494615-44496057
  misc_feature 1..1442: note = Hyper
  source 1..1442: mol_type = genomic DNA
gtaagaagccgccgccgtgagcggagcagcaccttcctccgcgggtcgcgggagtcacctacgggaagggactctccgtctggcacaggccctgtctggcctggggcgcgcatgctccgccgccgaatcttccagaaagccgtggacccgaggccccggcagacgcaggcggcccagcgccttgcttttggcccctcgcctcgccctggagccctctctcgcaaggtaagggactgccgggaacgcagatcgcaagccgtcggggctctgtagaactcagaggcgctcggcggaaagctcgccaggcgacccagacccgaacccgcgggctccccaagacaacagcgccgggcggccggatgcacgtgcgtcccgggaaggcgggttcagctggcatcgcctggccggttccgttcgctccttaaaccacaagacccccttggggtcacgacgttcccggggcacccctgcactcgcgcgccagcactcccggaggggcctggggaaggccacgcgcacggagagcgggaaactcctctaggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacgctccaggactcgccgccagtggggtccactccgccggcgcgggggctggggtgggagcccggggccacgtgcacggccagcccccatcttctgggcggtcaagaccgcaggcgtgggcgccggtggggcgggggtcttgggagaccctgtctcgccgcctttcggtgcagatgatgcaactctgggcggaggcgcggagagggaaaccgggacccagttgagatcctctgtccagagaggggagcgagtctcggtggggccggatctcacctggacggatacatggaaaagaggggcgagcggctgccccgactgcggcgaggcggagacggcgaccccggggtggcggcctcgcggggacccacggcgaggggagcaggcgggcggtgattggcggagaggcgggggcggaggccggcgccggccaatgtctcgtggcagagcaccc

SEQ ID NO: 120571 - DNA, 596 bp, Homo sapiens; identical to SEQ ID NO: 88771
  misc_feature 1..596: note = chr21:44496362-44496958
  misc_feature 1..596: note = Hyper
  source 1..596: mol_type = genomic DNA

SEQ ID NO: 120572 - DNA, 145 bp, Homo sapiens; identical to SEQ ID NO: 88772
  misc_feature 1..145: note = chr21:44561152-44561297
  misc_feature 1..145: note = Hypo
  source 1..145: mol_type = genomic DNA

SEQ ID NO: 120573 - DNA, 203 bp, Homo sapiens; identical to SEQ ID NO: 88773
  misc_feature 1..203: note = chr21:44752326-44752529
  misc_feature 1..203: note = Hypo
  source 1..203: mol_type = genomic DNA

SEQ ID NO: 120574 - DNA, 409 bp, Homo sapiens; identical to SEQ ID NO: 88774
  misc_feature 1..409: note = chr21:44836740-44837149
  misc_feature 1..409: note = Hypo
  source 1..409: mol_type = genomic DNA

SEQ ID NO: 120575 - DNA, 253 bp, Homo sapiens; identical to SEQ ID NO: 88775
  misc_feature 1..253: note = chr21:44837378-44837631
  misc_feature 1..253: note = Hypo
  source 1..253: mol_type = genomic DNA

SEQ ID NO: 120576 - DNA, 671 bp, Homo sapiens; identical to SEQ ID NO: 88776
  misc_feature 1..671: note = chr21:44840856-44841527
  misc_feature 1..671: note = Hypo
  source 1..671: mol_type = genomic DNA

SEQ ID NO: 120577 - DNA, 353 bp, Homo sapiens
  misc_feature 1..353: note = chr21:44847511-44847864
  misc_feature 1..353: note = Hyper
  source 1..353: mol_type = genomic DNA
ggacgtgcgggggcccgggggcctcgcgggctcgcgcgtggggctggcggcgcggatgccctggggcgctgcagaccccgagaggccgcttgcccgcggggacgtcagccgcttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccaggccggccgcctgggtagggga

SEQ ID NO: 120578 - DNA, 378 bp, Homo sapiens; identical to SEQ ID NO: 88779
  misc_feature 1..378: note = chr21:44866552-44866930
  misc_feature 1..378: note = Hypo
  source 1..378: mol_type = genomic DNA

SEQ ID NO: 120579 - DNA, 30 bp, Homo sapiens; identical to SEQ ID NO: 46493
  misc_feature 1..30: note = chr21:44871839-44871869
  misc_feature 1..30: note = Hypo
  source 1..30: mol_type = genomic DNA

SEQ ID NO: 120580 - DNA, 139 bp, Homo sapiens; identical to SEQ ID NO: 88781
  misc_feature 1..139: note = chr21:44881175-44881314
  misc_feature 1..139: note = Hypo
  source 1..139: mol_type = genomic DNA

SEQ ID NO: 120581 - DNA, 98 bp, Homo sapiens; identical to SEQ ID NO: 88782
  misc_feature 1..98: note = chr21:45078776-45078874
  misc_feature 1..98: note = Hypo
  source 1..98: mol_type = genomic DNA

SEQ ID NO: 120582 - DNA, 35 bp, Homo sapiens; identical to SEQ ID NO: 88783
  misc_feature 1..35: note = chr21:45140241-45140276
  misc_feature 1..35: note = Hypo
  source 1..35: mol_type = genomic DNA

SEQ ID NO: 120583 - DNA, 111 bp, Homo sapiens; identical to SEQ ID NO: 88784
  misc_feature 1..111: note = chr21:45140489-45140600
  misc_feature 1..111: note = Hypo
  source 1..111: mol_type = genomic DNA

SEQ ID NO: 120584 - DNA, 97 bp, Homo sapiens; identical to SEQ ID NO: 88785
  misc_feature 1..97: note = chr21:45140831-45140928
  misc_feature 1..97: note = Hypo
  source 1..97: mol_type = genomic DNA

SEQ ID NO: 120585 - DNA, 750 bp, Homo sapiens
  misc_feature 1..750: note = chr21:45148278-45149028
  misc_feature 1..750: note = Hyper
  source 1..750: mol_type = genomic DNA
ctgggtgggtggcttcggcttctgtgcagcgctcaccctgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggaggaggactgcgggctgcgcctgggcaggggatgagcttgtgtcgcgggcggcagggggaagggagtcggagagctcctgcggtccagccggatgactgatgaggttgaaagcacttccgctgcggcccccgcaggaagttcccaggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccccggctccgctgggtgcttggc

SEQ ID NO: 120586 - DNA, 189 bp, Homo sapiens; identical to SEQ ID NO: 88787
  misc_feature 1..189: note = chr21:45170219-45170408
  misc_feature 1..189: note = Hypo
  source 1..189: mol_type = genomic DNA

SEQ ID NO: 120587 - DNA, 80 bp, Homo sapiens; identical to SEQ ID NO: 88788
  misc_feature 1..80: note = chr21:45186755-45186835
  misc_feature 1..80: note = Hypo
  source 1..80: mol_type = genomic DNA

SEQ ID NO: 120588 - DNA, 30 bp, Homo sapiens; identical to SEQ ID NO: 88789
  misc_feature 1..30: note = chr21:45187186-45187216
  misc_feature 1..30: note = Hypo
  source 1..30: mol_type = genomic DNA

SEQ ID NO: 120589 - DNA, 30 bp, Homo sapiens; identical to SEQ ID NO: 88790
  misc_feature 1..30: note = chr21:45187276-45187306
  misc_feature 1..30: note = Hypo
  source 1..30: mol_type = genomic DNA

SEQ ID NO: 120590 - DNA, 215 bp, Homo sapiens; identical to SEQ ID NO: 88791
  misc_feature 1..215: note = chr21:45195149-45195364
  misc_feature 1..215: note = Hypo
  source 1..215: mol_type = genomic DNA

SEQ ID NO: 120591 - DNA, 41 bp, Homo sapiens; identical to SEQ ID NO: 88792
  misc_feature 1..41: note = chr21:45198310-45198351
  misc_feature 1..41: note = Hypo
  source 1..41: mol_type = genomic DNA

SEQ ID NO: 120592 - DNA, 30 bp, Homo sapiens; identical to SEQ ID NO: 88793
  misc_feature 1..30: note = chr21:45198576-45198606
  misc_feature 1..30: note = Hypo
  source 1..30: mol_type = genomic DNA

SEQ ID NO: 120593 - DNA, 102 bp, Homo sapiens; identical to SEQ ID NO: 88794
  misc_feature 1..102: note = chr21:45201249-45201351
  misc_feature 1..102: note = Hypo
  source 1..102: mol_type = genomic DNA

SEQ ID NO: 120594 - DNA, 79 bp, Homo sapiens; identical to SEQ ID NO: 88795
  misc_feature 1..79: note = chr21:45232923-45233002
  misc_feature 1..79: note = Hypo
  source 1..79: mol_type = genomic DNA

SEQ ID NO: 120595 - DNA, 30 bp, Homo sapiens; identical to SEQ ID NO: 88796
  misc_feature 1..30: note = chr21:45245930-45245960
  misc_feature 1..30: note = Hypo
  source 1..30: mol_type = genomic DNA

SEQ ID NO: 120596 - DNA, 30 bp, Homo sapiens; identical to SEQ ID NO: 16719
  misc_feature 1..30: note = chr21:45247147-45247177
  misc_feature 1..30: note = Hypo
  source 1..30: mol_type = genomic DNA

SEQ ID NO: 120597 - DNA, 101 bp, Homo sapiens; identical to SEQ ID NO: 88798
  misc_feature 1..101: note = chr21:45249923-45250024
  misc_feature 1..101: note = Hypo
  source 1..101: mol_type = genomic DNA

SEQ ID NO: 120598 - DNA, 40 bp, Homo sapiens; identical to SEQ ID NO: 88799
  misc_feature 1..40: note = chr21:45250324-45250364
  misc_feature 1..40: note = Hypo
  source 1..40: mol_type = genomic DNA

SEQ ID NO: 120599 - DNA, 30 bp, Homo sapiens; identical to SEQ ID NO: 88800
  misc_feature 1..30: note = chr21:45256017-45256047
  misc_feature 1..30: note = Hypo
  source 1..30: mol_type = genomic DNA

SEQ ID NO: 120600 - DNA, 181 bp, Homo sapiens; identical to SEQ ID NO: 88801
  misc_feature 1..181: note = chr21:45268768-45268949
  misc_feature 1..181: note = Hypo
  source 1..181: mol_type = genomic DNA

SEQ ID NO: 120601 - DNA, 92 bp, Homo sapiens; identical to SEQ ID NO: 88802
  misc_feature 1..92: note = chr21:45272579-45272671
  misc_feature 1..92: note = Hypo
  source 1..92: mol_type = genomic DNA

SEQ ID NO: 120602 - DNA, 30 bp, Homo sapiens; identical to SEQ ID NO: 46501
  misc_feature 1..30: note = chr21:45273343-45273373
  misc_feature 1..30: note = Hypo
  source 1..30: mol_type = genomic DNA

SEQ ID NO: 120603 - DNA, 334 bp, Homo sapiens; identical to SEQ ID NO: 46502
  misc_feature 1..334: note = chr21:45273579-45273913
  misc_feature 1..334: note = Hypo
  source 1..334: mol_type = genomic DNA

SEQ ID NO: 120604 - DNA, 99 bp, Homo sapiens; identical to SEQ ID NO: 46503
  misc_feature 1..99: note = chr21:45276620-45276719
  misc_feature 1..99: note = Hypo
  source 1..99: mol_type = genomic DNA

SEQ ID NO: 120605 - DNA, 30 bp, Homo sapiens; identical to SEQ ID NO: 46504
  misc_feature 1..30: note = chr21:45299990-45300020
  misc_feature 1..30: note = Hypo
  source 1..30: mol_type = genomic DNA

SEQ ID NO: 120606 - DNA, 30 bp, Homo sapiens; identical to SEQ ID NO: 88807
  misc_feature 1..30: note = chr21:45349806-45349836
  misc_feature 1..30: note = Hypo
  source 1..30: mol_type = genomic DNA

SEQ ID NO: 120607 - DNA, 56 bp, Homo sapiens; identical to SEQ ID NO: 88808
  misc_feature 1..56: note = chr21:45352946-45353002
  misc_feature 1..56: note = Hypo
  source 1..56: mol_type = genomic DNA

SEQ ID NO: 120608 - DNA, 62 bp, Homo sapiens; identical to SEQ ID NO: 88809
  misc_feature 1..62: note = chr21:45353502-45353564
  misc_feature 1..62: note = Hypo
  source 1..62: mol_type = genomic DNA

SEQ ID NO: 120609 - DNA, 220 bp, Homo sapiens; identical to SEQ ID NO: 88810
  misc_feature 1..220: note = chr21:45365737-45365957
  misc_feature 1..220: note = Hypo
  source 1..220: mol_type = genomic DNA

SEQ ID NO: 120610 - DNA, 83 bp, Homo sapiens; identical to SEQ ID NO: 88811
  misc_feature 1..83: note = chr21:45375005-45375088
  misc_feature 1..83: note = Hypo
  source 1..83: mol_type = genomic DNA

SEQ ID NO: 120611 - DNA, 90 bp, Homo sapiens; identical to SEQ ID NO: 88812
  misc_feature 1..90: note = chr21:45387435-45387525
  misc_feature 1..90: note = Hypo
  source 1..90: mol_type = genomic DNA

SEQ ID NO: 120612 - DNA, 30 bp, Homo sapiens; identical to SEQ ID NO: 88813
  misc_feature 1..30: note = chr21:45400824-45400854
  misc_feature 1..30: note = Hypo
  source 1..30: mol_type = genomic DNA

SEQ ID NO: 120613 - DNA, 72 bp, Homo sapiens; identical to SEQ ID NO: 88814
  misc_feature 1..72: note = chr21:45406862-45406934
  misc_feature 1..72: note = Hypo
  source 1..72: mol_type = genomic DNA

SEQ ID NO: 120614 - DNA, 30 bp, Homo sapiens; identical to SEQ ID NO: 88815
  misc_feature 1..30: note = chr21:45411378-45411408
  misc_feature 1..30: note = Hypo
  source 1..30: mol_type = genomic DNA

SEQ ID NO: 120615 - DNA, 73 bp, Homo sapiens; identical to SEQ ID NO: 88816
  misc_feature 1..73: note = chr21:45411841-45411914
  misc_feature 1..73: note = Hypo
  source 1..73: mol_type = genomic DNA

SEQ ID NO: 120616 - DNA, 19 bp, Homo sapiens
  misc_feature 1..19: note = chr21:45412668-45412687
  misc_feature 1..19: note = Hypo
  source 1..19: mol_type = genomic DNA
tcaccgtgcctggctcaag

SEQ ID NO: 120617 - DNA, 30 bp, Homo sapiens; identical to SEQ ID NO: 88818
  misc_feature 1..30: note = chr21:45435826-45435856
  misc_feature 1..30: note = Hypo
  source 1..30: mol_type = genomic DNA

SEQ ID NO: 120618 - DNA, 78 bp, Homo sapiens; identical to SEQ ID NO: 88819
  misc_feature 1..78: note = chr21:45508617-45508695
  misc_feature 1..78: note = Hypo
  source 1..78: mol_type = genomic DNA

SEQ ID NO: 120619 - DNA, 153 bp, Homo sapiens; identical to SEQ ID NO: 88820
  misc_feature 1..153: note = chr21:45516450-45516603
  misc_feature 1..153: note = Hypo
  source 1..153: mol_type = genomic DNA

SEQ ID NO: 120620 - DNA, 121 bp, Homo sapiens; identical to SEQ ID NO: 88821
  misc_feature 1..121: note = chr21:45583747-45583868
  misc_feature 1..121: note = Hypo
  source 1..121: mol_type = genomic DNA

SEQ ID NO: 120621 - DNA, 44 bp, Homo sapiens; identical to SEQ ID NO: 88822
  misc_feature 1..44: note = chr21:45626242-45626286
  misc_feature 1..44: note = Hypo
  source 1..44: mol_type = genomic DNA

SEQ ID NO: 120622 - DNA, 30 bp, Homo sapiens; identical to SEQ ID NO: 46510
  misc_feature 1..30: note = chr21:45657028-45657058
  misc_feature 1..30: note = Hypo
  source 1..30: mol_type = genomic DNA

SEQ ID NO: 120623 - DNA, 131 bp, Homo sapiens; identical to SEQ ID NO: 46511
  misc_feature 1..131: note = chr21:45681620-45681751
  misc_feature 1..131: note = Hypo
  source 1..131: mol_type = genomic DNA

SEQ ID NO: 120624 - DNA, 110 bp, Homo sapiens; identical to SEQ ID NO: 88825
  misc_feature 1..110: note = chr21:45682528-45682638
  misc_feature 1..110: note = Hypo
  source 1..110: mol_type = genomic DNA

SEQ ID NO: 120625 - DNA, 30 bp, Homo sapiens; identical to SEQ ID NO: 88826
  misc_feature 1..30: note = chr21:45683130-45683160
  misc_feature 1..30: note = Hypo
  source 1..30: mol_type = genomic DNA

SEQ ID NO: 120626 - DNA, 30 bp, Homo sapiens; identical to SEQ ID NO: 46513
  misc_feature 1..30: note = chr21:45710106-45710136
  misc_feature 1..30: note = Hypo
  source 1..30: mol_type = genomic DNA

SEQ ID NO: 120627 - DNA, 314 bp, Homo sapiens; identical to SEQ ID NO: 88828
  misc_feature 1..314: note = chr21:45712867-45713181
  misc_feature 1..314: note = Hypo
  source 1..314: mol_type = genomic DNA

SEQ ID NO: 120628 - DNA, 54 bp, Homo sapiens; identical to SEQ ID NO: 88829
  misc_feature 1..54: note = chr21:45713401-45713455
  misc_feature 1..54: note = Hypo
  source 1..54: mol_type = genomic DNA

SEQ ID NO: 120629 - DNA, 55 bp, Homo sapiens; identical to SEQ ID NO: 88830
  misc_feature 1..55: note = chr21:45727163-45727218
  misc_feature 1..55: note = Hypo
  source 1..55: mol_type = genomic DNA

SEQ ID NO: 120630 - DNA, 30 bp, Homo sapiens; identical to SEQ ID NO: 88831
  misc_feature 1..30: note = chr21:45748750-45748780
  misc_feature 1..30: note = Hypo
  source 1..30: mol_type = genomic DNA

SEQ ID NO: 120631 - DNA, 48 bp, Homo sapiens; identical to SEQ ID NO: 88832
  misc_feature 1..48: note = chr21:45749108-45749156
  misc_feature 1..48: note = Hypo
  source 1..48: mol_type = genomic DNA

SEQ ID NO: 120632 - DNA, 293 bp, Homo sapiens; identical to SEQ ID NO: 88833
  misc_feature 1..293: note = chr21:45749406-45749699
  misc_feature 1..293: note = Hypo
  source 1..293: mol_type = genomic DNA

SEQ ID NO: 120633 - DNA, 196 bp, Homo sapiens; identical to SEQ ID NO: 88834
  misc_feature 1..196: note = chr21:45749930-45750126
  misc_feature 1..196: note = Hypo
  source 1..196: mol_type = genomic DNA

SEQ ID NO: 120634 - DNA, 261 bp, Homo sapiens; identical to SEQ ID NO: 88835
  misc_feature 1..261: note = chr21:45750395-45750656
  misc_feature 1..261: note = Hypo
  source 1..261: mol_type = genomic DNA

SEQ ID NO: 120635 - DNA, 45 bp, Homo sapiens; identical to SEQ ID NO: 88836
  misc_feature 1..45: note = chr21:45751076-45751121
  misc_feature 1..45: note = Hypo
  source 1..45: mol_type = genomic DNA

SEQ ID NO: 120636 - DNA, 86 bp, Homo sapiens; identical to SEQ ID NO: 88837
  misc_feature 1..86: note = chr21:45752956-45753042
  misc_feature 1..86: note = Hypo
  source 1..86: mol_type = genomic DNA

SEQ ID NO: 120637 - DNA, 282 bp, Homo sapiens; identical to SEQ ID NO: 88838
  misc_feature 1..282: note = chr21:45753623-45753905
  misc_feature 1..282: note = Hypo
  source 1..282: mol_type = genomic DNA

SEQ ID NO: 120638 - DNA, 574 bp, Homo sapiens
  misc_feature 1..574: note = chr21:45769972-45770546
  misc_feature 1..574: note = Hyper
  source 1..574: mol_type = genomic DNA
gctgcgggcgcgggacgcggcgcgggagacgctctccgggctgagtgacgcagagcgctgcgggcggctccactgcaccgggcacgcggcgcacgctcgggcgagatgtggatggccccgcggggccagggcggcggtgctgcgcggggacgcgggtgacgccggggcgcgggcggctccgagcaggtaggtgcccgccggggccggggcgagggcgcgagcccgggtgcggggactgaggcggccgtcccgggagcttgtgaaggttgaggcggggtgcaagggcgcggatcggggtgccgagtgcgtgcaggggtgcggggtgcggggaccgaggcggccggccccggtgctgctgcagggcgcggcggaatgcaggggcgcggtggggtgcaggggcgcaggcggggttcggggcgctggtgcagggcgcggtggggtgcaagggcgcaggcggggttcggggcgctggtgcagggcacggcggggtgcaggggcgcgggtggggctcgaggcgctggtgcagggcgcggtggggtgcaggggcgcgaaggggctccgggcactggtgcag

SEQ ID NO: 120639 - DNA, 301 bp, Homo sapiens; identical to SEQ ID NO: 88841
  misc_feature 1..301: note = chr21:45790866-45791167
  misc_feature 1..301: note = Hypo
  source 1..301: mol_type = genomic DNA

SEQ ID NO: 120640 - DNA, 30 bp, Homo sapiens; identical to SEQ ID NO: 88842
  misc_feature 1..30: note = chr21:45799305-45799335
  misc_feature 1..30: note = Hypo
  source 1..30: mol_type = genomic DNA

SEQ ID NO: 120641 - DNA, 30 bp, Homo sapiens; identical to SEQ ID NO: 88843
  misc_feature 1..30: note = chr21:45819379-45819409
  misc_feature 1..30: note = Hypo
  source 1..30: mol_type = genomic DNA

SEQ ID NO: 120642 - DNA, 43 bp, Homo sapiens; identical to SEQ ID NO: 88844
  misc_feature 1..43: note = chr21:45824452-45824495
  misc_feature 1..43: note = Hypo
  source 1..43: mol_type = genomic DNA

SEQ ID NO: 120643 - DNA, 89 bp, Homo sapiens; identical to SEQ ID NO: 88845
  misc_feature 1..89: note = chr21:45825899-45825988
  misc_feature 1..89: note = Hypo
  source 1..89: mol_type = genomic DNA

SEQ ID NO: 120644 - DNA, 72 bp, Homo sapiens; identical to SEQ ID NO: 88846
  misc_feature 1..72: note = chr21:45844751-45844823
  misc_feature 1..72: note = Hypo
  source 1..72: mol_type = genomic DNA

SEQ ID NO: 120645 - DNA, 30 bp, Homo sapiens; identical to SEQ ID NO: 88847
  misc_feature 1..30: note = chr21:45847614-45847644
  misc_feature 1..30: note = Hypo
  source 1..30: mol_type = genomic DNA

SEQ ID NO: 120646 - DNA, 30 bp, Homo sapiens; identical to SEQ ID NO: 88848
  misc_feature 1..30: note = chr21:45870052-45870082
  misc_feature 1..30: note = Hypo
  source 1..30: mol_type = genomic DNA

SEQ ID NO: 120647 - DNA, 183 bp, Homo sapiens
  misc_feature 1..183: note = chr21:45875549-45875732
  misc_feature 1..183: note = Hyper
  source 1..183: mol_type = genomic DNA
gcccagccctgggagcgtggattcccacccaccccatgaccatccccccgccgcgagtgctggggtctcgggggtcccaggttccgggggtcctagggccggagggtctaaaggctggaggtcctgggggtccgagcctctcccggccggctccgcgcgcggccccgccgtccacgcccagcg

SEQ ID NO: 120648 - DNA, 32 bp, Homo sapiens; identical to SEQ ID NO: 88850
  misc_feature 1..32: note = chr21:45875956-45875988
  misc_feature 1..32: note = Hyper
  source 1..32: mol_type = genomic DNA

SEQ ID NO: 120649 - DNA, 240 bp, Homo sapiens; identical to SEQ ID NO: 88851
  misc_feature 1..240: note = chr21:45918988-45919228
  misc_feature 1..240: note = Hypo
  source 1..240: mol_type = genomic DNA

SEQ ID NO: 120650 - DNA, 259 bp, Homo sapiens; identical to SEQ ID NO: 88852
  misc_feature 1..259: note = chr21:45929112-45929371
  misc_feature 1..259: note = Hypo
  source 1..259: mol_type = genomic DNA

SEQ ID NO: 120651 - DNA, 249 bp, Homo sapiens; identical to SEQ ID NO: 88853
  misc_feature 1..249: note = chr21:45939565-45939814
  misc_feature 1..249: note = Hypo
  source 1..249: mol_type = genomic DNA

SEQ ID NO: 120652 - DNA, 30 bp, Homo sapiens; identical to SEQ ID NO: 88854
  misc_feature 1..30: note = chr21:45940440-45940470
  misc_feature 1..30: note = Hypo
  source 1..30: mol_type = genomic DNA

SEQ ID NO: 120653 - DNA, 30 bp, Homo sapiens; identical to SEQ ID NO: 88855
  misc_feature 1..30: note = chr21:45958213-45958243
  misc_feature 1..30: note = Hypo
  source 1..30: mol_type = genomic DNA

SEQ ID NO: 120654 - DNA, 63 bp, Homo sapiens; identical to SEQ ID NO: 88856
  misc_feature 1..63: note = chr21:45959291-45959354
  misc_feature 1..63: note = Hypo
  source 1..63: mol_type = genomic DNA

SEQ ID NO: 120655 - DNA, 172 bp, Homo sapiens; identical to SEQ ID NO: 88857
  misc_feature 1..172: note = chr21:45959901-45960073
  misc_feature 1..172: note = Hypo
  source 1..172: mol_type = genomic DNA

SEQ ID NO: 120656 - DNA, 194 bp, Homo sapiens; identical to SEQ ID NO: 88858
  misc_feature 1..194: note = chr21:45991563-45991757
  misc_feature 1..194: note = Hypo
  source 1..194: mol_type = genomic DNA

SEQ ID NO: 120657 - DNA, 46 bp, Homo sapiens; identical to SEQ ID NO: 88859
  misc_feature 1..46: note = chr21:46010155-46010201
  misc_feature 1..46: note = Hypo
  source 1..46: mol_type = genomic DNA

SEQ ID NO: 120658 - DNA, 30 bp, Homo sapiens; identical to SEQ ID NO: 16724
  misc_feature 1..30: note = chr21:46015435-46015465
  misc_feature 1..30: note = Hypo
  source 1..30: mol_type = genomic DNA

SEQ ID NO: 120659 - DNA, 78 bp, Homo sapiens; identical to SEQ ID NO: 88861
  misc_feature 1..78: note = chr21:46021444-46021522
  misc_feature 1..78: note = Hypo
  source 1..78: mol_type = genomic DNA

SEQ ID NO: 120660 - DNA, 41 bp, Homo sapiens; identical to SEQ ID NO: 88862
  misc_feature 1..41: note = chr21:46022629-46022670
  misc_feature 1..41: note = Hypo
  source 1..41: mol_type = genomic DNA

SEQ ID NO: 120661 - DNA, 141 bp, Homo sapiens; identical to SEQ ID NO: 88863
  misc_feature 1..141: note = chr21:46032641-46032782
  misc_feature 1..141: note = Hypo
  source 1..141: mol_type = genomic DNA

SEQ ID NO: 120662 - DNA, 102 bp, Homo sapiens; identical to SEQ ID NO: 88864
  misc_feature 1..102: note = chr21:46035158-46035260
  misc_feature 1..102: note = Hypo
  source 1..102: mol_type = genomic DNA

SEQ ID NO: 120663 - DNA, 255 bp, Homo sapiens; identical to SEQ ID NO: 46528
  misc_feature 1..255: note = chr21:46036572-46036827
  misc_feature 1..255: note = Hypo
  source 1..255: mol_type = genomic DNA

SEQ ID NO: 120664 - DNA, 30 bp, Homo sapiens; identical to SEQ ID NO: 88866
  misc_feature 1..30: note = chr21:46066733-46066763
  misc_feature 1..30: note = Hypo
  source 1..30: mol_type = genomic DNA

SEQ ID NO: 120665 - DNA, 58 bp, Homo sapiens; identical to SEQ ID NO: 46529
  misc_feature 1..58: note = chr21:46068645-46068703
  misc_feature 1..58: note = Hypo
  source 1..58: mol_type = genomic DNA

SEQ ID NO: 120666 - DNA, 1515 bp, Homo sapiens
  misc_feature 1..1515: note = chr21:46126008-46127523
  misc_feature 1..1515: note = Hyper
  source 1..1515: mol_type = genomic DNA
cccagctgcagatcgaggcctagtgcgagcacaggtccccccagacccttcccagtgcccaccaaccggcggcctaggccaggtagaactggcagcgcctcccctgctgcaacaccaggctctggtagaaacttcagaaaacatgcaccggcaaaaccaaggaagggtggctgcgtcccgggttcttccgcgcagctgtgtgtacacgcatgcacacacccacacgcacacacccacgtgcacacccccatgcacacgcacccacttgcacgcccatgcacgcacacacgcgcgtgcacccatgcgcacgcacccatgcacacacacgcgcgcacacacccacgtgcgcacccacatgtacacacccacgtgcacacacccacgcgtacacacccacgcgcacacaccgctgtccccagccgtgcagaacgatcctccctgagtccccggctccgacccacacgcagcactcgctaaacgcttcccacgcagtcgttttgctgggttgcgcttcacccacttctcagagggggcggccgaggcagaggtgtcggggatcgagcagctccgggcctcaggggtcgccccgccaccgttttcctttcccagatgctgggacgggggcagggaggggctccccaggctgaacccgactaggtcaccctagaagcgaggcgagcttctcttctgtttttcttcggcgcccctgagcccctgacagtgcccaagctgcccatgggattggattcgccagagcctcctacgcagaccccacccagggccaaagccaaccccaagccccaccaccttggtggtgtgggatgaaaagtgagccatcgagagatggggtccccccacccccaacccctccaaggacaaaggcgggctgggaagcacccgctttcacgtccgcccctgcccggctttcctagcggaattggcgccggcatcagttgggggttgtgggatcagtgaggaatcccgtggggtcgcctccatttatcagttgtgtggggttgggcgagcacccctagccccagcccaggcgatcagggcgcgaagcccactggacgcggatttgggattaggacgggggtgacagccaggaggaccgcacctgccctccccactcctgccgctccacccctgcccccaccgcaacaccaaggtctccaccaggaagatgggggtggggaaaggacgcggggtgggggggggtgcggggagagaggacacagggtcggaagggtgaggggtagtggcagaggcggaggccgaggccacgcagctgcggggcgcagggaggggcagaggaggggcgttcagatgggaacctagtccagacccgtcggggccctcgtgtgcggctcgttatcctggaaccagagaggctggagacccttggcttgtctggagcggaaccgtagtgtccaatagagtgtgtggggctcagccctaaagctaaacattctttatttcctgatgaccatgggggcggagcgggggaaaagccct

SEQ ID NO: 120667 - DNA, 28 bp, Homo sapiens
  misc_feature 1..28: note = chr21:46127878-46127906
  misc_feature 1..28: note = Hyper
  source 1..28: mol_type = genomic DNA
ctagcctgtgccccccgattccccccct

SEQ ID NO: 120668 - DNA, 88 bp, Homo sapiens; identical to SEQ ID NO: 88871
  misc_feature 1..88: note = chr21:46128221-46128309
  misc_feature 1..88: note = Hyper
  source 1..88: mol_type = genomic DNA

SEQ ID NO: 120669 - DNA, 212 bp, Homo sapiens; identical to SEQ ID NO: 38420
  misc_feature 1..212: note = chr21:46128884-46129096
  misc_feature 1..212: note = Hyper
  source 1..212: mol_type = genomic DNA

SEQ ID NO: 120670 - DNA, 326 bp, Homo sapiens; identical to SEQ ID NO: 88873
  misc_feature 1..326: note = chr21:46129376-46129702
  misc_feature 1..326: note = Hyper
  source 1..326: mol_type = genomic DNA

SEQ ID NO: 120671 - DNA, 39 bp, Homo sapiens; identical to SEQ ID NO: 88874
  misc_feature 1..39: note = chr21:46130020-46130059
  misc_feature 1..39: note = Hyper
  source 1..39: mol_type = genomic DNA

SEQ ID NO: 120672 - DNA, 48 bp, Homo sapiens; identical to SEQ ID NO: 88875
  misc_feature 1..48: note = chr21:46130394-46130442
  misc_feature 1..48: note = Hyper
  source 1..48: mol_type = genomic DNA

SEQ ID NO: 120673 - DNA, 30 bp, Homo sapiens; identical to SEQ ID NO: 38423
  misc_feature 1..30: note = chr21:46132288-46132318
  misc_feature 1..30: note = Hyper
  source 1..30: mol_type = genomic DNA

SEQ ID NO: 120674 - DNA, 170 bp, Homo sapiens; identical to SEQ ID NO: 88877
  misc_feature 1..170: note = chr21:46143057-46143227
  misc_feature 1..170: note = Hyper
  source 1..170: mol_type = genomic DNA

SEQ ID NO: 120675 - DNA, 90 bp, Homo sapiens; identical to SEQ ID NO: 88878
  misc_feature 1..90: note = chr21:46143579-46143669
  misc_feature 1..90: note = Hyper
  source 1..90: mol_type = genomic DNA

SEQ ID NO: 120676 - DNA, 30 bp, Homo sapiens; identical to SEQ ID NO: 46530
  misc_feature 1..30: note = chr21:46169786-46169816
  misc_feature 1..30: note = Hypo
  source 1..30: mol_type = genomic DNA

SEQ ID NO: 120677 - DNA, 62 bp, Homo sapiens; identical to SEQ ID NO: 88880
  misc_feature 1..62: note = chr21:46173291-46173353
  misc_feature 1..62: note = Hypo
  source 1..62: mol_type = genomic DNA

SEQ ID NO: 120678 - DNA, 120 bp, Homo sapiens; identical to SEQ ID NO: 88881
  misc_feature 1..120: note = chr21:46183961-46184081
  misc_feature 1..120: note = Hypo
  source 1..120: mol_type = genomic DNA

SEQ ID NO: 120679 - DNA, 208 bp, Homo sapiens; identical to SEQ ID NO: 88882
  misc_feature 1..208: note = chr21:46184437-46184645
  misc_feature 1..208: note = Hypo
  source 1..208: mol_type = genomic DNA

SEQ ID NO: 120680 - DNA, 30 bp, Homo sapiens; identical to SEQ ID NO: 88883
  misc_feature 1..30: note = chr21:46205669-46205699
  misc_feature 1..30: note = Hypo
  source 1..30: mol_type = genomic DNA

SEQ ID NO: 120681 - DNA, 154 bp, Homo sapiens; identical to SEQ ID NO: 88884
  misc_feature 1..154: note = chr21:46206072-46206226
  misc_feature 1..154: note = Hypo
  source 1..154: mol_type = genomic DNA

SEQ ID NO: 120682 - DNA, 286 bp, Homo sapiens; identical to SEQ ID NO: 88885
  misc_feature 1..286: note = chr21:46238788-46239074
  misc_feature 1..286: note = Hypo
  source 1..286: mol_type = genomic DNA

SEQ ID NO: 120683 - DNA, 41 bp, Homo sapiens; identical to SEQ ID NO: 88886
  misc_feature 1..41: note = chr21:46255003-46255044
  misc_feature 1..41: note = Hypo
  source 1..41: mol_type = genomic DNA

SEQ ID NO: 120684 - DNA, 440 bp, Homo sapiens; identical to SEQ ID NO: 88887
  misc_feature 1..440: note = chr21:46256907-46257347
  misc_feature 1..440: note = Hypo
  source 1..440: mol_type = genomic DNA

SEQ ID NO: 120685 - DNA, 330 bp, Homo sapiens; identical to SEQ ID NO: 88888
  misc_feature 1..330: note = chr21:46257708-46258038
  misc_feature 1..330: note = Hypo
  source 1..330: mol_type = genomic DNA

SEQ ID NO: 120686 - DNA, 30 bp, Homo sapiens; identical to SEQ ID NO: 88889
  misc_feature 1..30: note = chr21:46263121-46263151
  misc_feature 1..30: note = Hypo
  source 1..30: mol_type = genomic DNA

SEQ ID NO: 120687 - DNA, 78 bp, Homo sapiens; identical to SEQ ID NO: 46537
  misc_feature 1..78: note = chr21:46273062-46273140
  misc_feature 1..78: note = Hypo
  source 1..78: mol_type = genomic DNA

SEQ ID NO: 120688 - DNA, 33 bp, Homo sapiens; identical to SEQ ID NO: 88891
  misc_feature 1..33: note = chr21:46277581-46277614
  misc_feature 1..33: note = Hypo
  source 1..33: mol_type = genomic DNA

SEQ ID NO: 120689 - DNA, 979 bp, Homo sapiens; identical to SEQ ID NO: 88892
  misc_feature 1..979: note = chr21:46308425-46309404
  misc_feature 1..979: note = Hypo
  source 1..979: mol_type = genomic DNA

SEQ ID NO: 120690 - DNA, 55 bp, Homo sapiens; identical to SEQ ID NO: 88893
  misc_feature 1..55: note = chr21:46309906-46309961
  misc_feature 1..55: note = Hypo
  source 1..55: mol_type = genomic DNA

SEQ ID NO: 120691 - DNA, 395 bp, Homo sapiens; identical to SEQ ID NO: 88894
  misc_feature 1..395: note = chr21:46310422-46310817
  misc_feature 1..395: note = Hypo
  source 1..395: mol_type = genomic DNA

SEQ ID NO: 120692 - DNA, 149 bp, Homo sapiens; identical to SEQ ID NO: 88895
  misc_feature 1..149: note = chr21:46311753-46311902
  misc_feature 1..149: note = Hypo
  source 1..149: mol_type = genomic DNA

SEQ ID NO: 120693 - DNA, 30 bp, Homo sapiens; identical to SEQ ID NO: 88896
  misc_feature 1..30: note = chr21:46313354-46313384
  misc_feature 1..30: note = Hypo
  source 1..30: mol_type = genomic DNA

SEQ ID NO: 120694 - DNA, 30 bp, Homo sapiens; identical to SEQ ID NO: 88897
  misc_feature 1..30: note = chr21:46315995-46316025
  misc_feature 1..30: note = Hypo
  source 1..30: mol_type = genomic DNA

SEQ ID NO: 120695 - DNA, 222 bp, Homo sapiens; identical to SEQ ID NO: 88898
  misc_feature 1..222: note = chr21:46317030-46317252
  misc_feature 1..222: note = Hypo
  source 1..222: mol_type = genomic DNA

SEQ ID NO: 120696 - DNA, 160 bp, Homo sapiens; identical to SEQ ID NO: 88899
  misc_feature 1..160: note = chr21:46318183-46318343
  misc_feature 1..160: note = Hypo
  source 1..160: mol_type = genomic DNA

SEQ ID NO: 120697 - DNA, 731 bp, Homo sapiens; identical to SEQ ID NO: 88900
  misc_feature 1..731: note = chr21:46318774-46319505
  misc_feature 1..731: note = Hypo
  source 1..731: mol_type = genomic DNA

SEQ ID NO: 120698 - DNA, 135 bp, Homo sapiens; identical to SEQ ID NO: 88901
  misc_feature 1..135: note = chr21:46321513-46321648
  misc_feature 1..135: note = Hypo
  source 1..135: mol_type = genomic DNA

SEQ ID NO: 120699 - DNA, 30 bp, Homo sapiens; identical to SEQ ID NO: 88902
  misc_feature 1..30: note = chr21:46329001-46329031
  misc_feature 1..30: note = Hypo
  source 1..30: mol_type = genomic DNA

SEQ ID NO: 120700 - DNA, 124 bp, Homo sapiens; identical to SEQ ID NO: 88903
  misc_feature 1..124: note = chr21:46351313-46351437
  misc_feature 1..124: note = Hyper
  source 1..124: mol_type = genomic DNA

SEQ ID NO: 120701 - DNA, 626 bp, Homo sapiens; identical to SEQ ID NO: 88904
  misc_feature 1..626: note = chr21:46351653-46352279
  misc_feature 1..626: note = Hyper
  source 1..626: mol_type = genomic DNA

SEQ ID NO: 120702 - DNA, 195 bp, Homo sapiens; identical to SEQ ID NO: 88905
  misc_feature 1..195: note = chr21:46352673-46352868
  misc_feature 1..195: note = Hyper
  source 1..195: mol_type = genomic DNA

SEQ ID NO: 120703 - DNA, 340 bp, Homo sapiens; identical to SEQ ID NO: 88906
  misc_feature 1..340: note = chr21:46359019-46359359
  misc_feature 1..340: note = Hypo
  source 1..340: mol_type = genomic DNA

SEQ ID NO: 120704 - DNA, 55 bp, Homo sapiens; identical to SEQ ID NO: 88907
  misc_feature 1..55: note = chr21:46402502-46402557
  misc_feature 1..55: note = Hypo
  source 1..55: mol_type = genomic DNA

SEQ ID NO: 120705 - DNA, 60 bp, Homo sapiens; identical to SEQ ID NO: 88908
  misc_feature 1..60: note = chr21:46424460-46424520
  misc_feature 1..60: note = Hypo
  source 1..60: mol_type = genomic DNA

SEQ ID NO: 120706 - DNA, 30 bp, Homo sapiens; identical to SEQ ID NO: 88909
  misc_feature 1..30: note = chr21:46424927-46424957
  misc_feature 1..30: note = Hypo
  source 1..30: mol_type = genomic DNA

SEQ ID NO: 120707 - DNA, 65 bp, Homo sapiens; identical to SEQ ID NO: 46549
  misc_feature 1..65: note = chr21:46431841-46431906
  misc_feature 1..65: note = Hypo
  source 1..65: mol_type = genomic DNA

SEQ ID NO: 120708 - DNA, 897 bp, Homo sapiens
  misc_feature 1..897: note = chr21:46438210-46439107
  misc_feature 1..897: note = Hyper
  source 1..897: mol_type = genomic DNA
acccccgccctcagccgttcgtgcacttggtccaggcgggacccggcaggacccccagcagccccgggaagcgcccggacgacggcacgggggccccagggcgccgcgaaggaagccccccgagggcgaggccgggcgaggccagggggccggggccagaggcggtcgcggcgggggtgggtgtcctggagcaggagcggcagcgggaaacgaagacacgcgcttcttcctactggggggatggctgggaagtaagaccggccgggccgccgagcccgctgcgaggggcttcgcgtggcggccgcacctgagcccgagcgcgcccttgagaggcggcgcccacgggggcagagacccacggtccacgcgcagacccggagaacccgcgatgtcgccgcacgcagcgccgctgtgaaggacggaggcggggcggggccctgggacagggagcgggtgggggcggggtggggggagggcccgtccgggcctgcgcgggaagccctgggttggccttggtgctctgtgatgcccacgctgggtgcaaatgttgctttggtaaaaataacaacaacgaaaggaaaagccaagccggaccagccccacccgcagggccccggccccggccccggccccgcccttggactcttccccgccccacccccacccgtgggcgagcgagcccggaccgtgaagggagggggcggggcgggggcccggaggggcggggaggggccgggtcctcccgcgcggggtcctggaggtcgcggcacgcgctccctgcaggcgaccctggggcgcgtctgtcccaggcccgggcaggacccccgcccgctggttgtctgcgcggctgccccgcgcccgccgcccccggccgctgtcgcgcgttcccagacattc

SEQ ID NO: 120709 - DNA, 73 bp, Homo sapiens; identical to SEQ ID NO: 88913
  misc_feature 1..73: note = chr21:46439283-46439356
  misc_feature 1..73: note = Hypo
  source 1..73: mol_type = genomic DNA

SEQ ID NO: 120710 - DNA, 30 bp, Homo sapiens; identical to SEQ ID NO: 88914
  misc_feature 1..30: note = chr21:46441167-46441197
  misc_feature 1..30: note = Hypo
  source 1..30: mol_type = genomic DNA

SEQ ID NO: 120711 - DNA, 356 bp, Homo sapiens; identical to SEQ ID NO: 88915
  misc_feature 1..356: note = chr21:46452216-46452572
  misc_feature 1..356: note = Hypo
  source 1..356: mol_type = genomic DNA

SEQ ID NO: 120712 - DNA, 30 bp, Homo sapiens; identical to SEQ ID NO: 88916
  misc_feature 1..30: note = chr21:46462910-46462940
  misc_feature 1..30: note = Hypo
  source 1..30: mol_type = genomic DNA

SEQ ID NO: 120713 - DNA, 124 bp, Homo sapiens; identical to SEQ ID NO: 88917
  misc_feature 1..124: note = chr21:46492315-46492439
  misc_feature 1..124: note = Hypo
  source 1..124: mol_type = genomic DNA

SEQ ID NO: 120714 - DNA, 41 bp, Homo sapiens; identical to SEQ ID NO: 88918
  misc_feature 1..41: note = chr21:46495431-46495472
  misc_feature 1..41: note = Hyper
  source 1..41: mol_type = genomic DNA

SEQ ID NO: 120715 - DNA, 34 bp, Homo sapiens; identical to SEQ ID NO: 46552
  misc_feature 1..34: note = chr21:46549475-46549509
  misc_feature 1..34: note = Hypo
  source 1..34: mol_type = genomic DNA

SEQ ID NO: 120716 - DNA, 159 bp, Homo sapiens; identical to SEQ ID NO: 88920
  misc_feature 1..159: note = chr21:46677734-46677893
  misc_feature 1..159: note = Hypo
  source 1..159: mol_type = genomic DNA

SEQ ID NO: 120717 - DNA, 67 bp, Homo sapiens; identical to SEQ ID NO: 88921
  misc_feature 1..67: note = chr21:46678745-46678812
  misc_feature 1..67: note = Hypo
  source 1..67: mol_type = genomic DNA

SEQ ID NO: 120718 - DNA, 217 bp, Homo sapiens
  misc_feature 1..217: note = chr21:46706791-46707008
  misc_feature 1..217: note = Hyper
  source 1..217: mol_type = genomic DNA
cccacagccacagggcggccgcgaagctcgtcttggccctgagaattcactgcggagcgcccgcccggcactgactcccggctccgcacacccaggcctggacccgtgtcacttgcaggggcctccggagccagcccacgctcagcctgagcaacccggcccccttcctgggctcccgaggctgcgccccgggcctcgcagacgaccccgcctgcag

SEQ ID NO: 120719 - DNA, 37 bp, Homo sapiens; identical to SEQ ID NO: 88923
  misc_feature 1..37: note = chr21:46713325-46713362
  misc_feature 1..37: note = Hypo
  source 1..37: mol_type = genomic DNA

SEQ ID NO: 120720 - DNA, 30 bp, Homo sapiens; identical to SEQ ID NO: 88924
  misc_feature 1..30: note = chr21:46723304-46723334
  misc_feature 1..30: note = Hypo
  source 1..30: mol_type = genomic DNA

SEQ ID NO: 120721 - DNA, 30 bp, Homo sapiens; identical to SEQ ID NO: 88925
  misc_feature 1..30: note = chr21:46754541-46754571
  misc_feature 1..30: note = Hypo
  source 1..30: mol_type = genomic DNA

SEQ ID NO: 120722 - DNA, 30 bp, Homo sapiens; identical to SEQ ID NO: 88926
  misc_feature 1..30: note = chr21:46764430-46764460
  misc_feature 1..30: note = Hypo
  source 1..30: mol_type = genomic DNA

SEQ ID NO: 120723 - DNA, 167 bp, Homo sapiens; identical to SEQ ID NO: 88927
  misc_feature 1..167: note = chr21:46765675-46765842
  misc_feature 1..167: note = Hypo
  source 1..167: mol_type = genomic DNA

SEQ ID NO: 120724 - DNA, 59 bp, Homo sapiens; identical to SEQ ID NO: 88928
  misc_feature 1..59: note = chr21:46766071-46766130
  misc_feature 1..59: note = Hypo
  source 1..59: mol_type = genomic DNA

SEQ ID NO: 120725 - DNA, 30 bp, Homo sapiens; identical to SEQ ID NO: 88929
  misc_feature 1..30: note = chr21:46785365-46785395
  misc_feature 1..30: note = Hypo
  source 1..30: mol_type = genomic DNA

SEQ ID NO: 120726 - DNA, 102 bp, Homo sapiens; identical to SEQ ID NO: 88930
  misc_feature 1..102: note = chr21:46790661-46790763
  misc_feature 1..102: note = Hypo
  source 1..102: mol_type = genomic DNA

SEQ ID NO: 120727 - DNA, 30 bp, Homo sapiens; identical to SEQ ID NO: 88931
  misc_feature 1..30: note = chr21:46800750-46800780
  misc_feature 1..30: note = Hypo
  source 1..30: mol_type = genomic DNA

SEQ ID NO: 120728 - DNA, 30 bp, Homo sapiens; identical to SEQ ID NO: 88932
  misc_feature 1..30: note = chr21:46804073-46804103
  misc_feature 1..30: note = Hypo
  source 1..30: mol_type = genomic DNA

SEQ ID NO: 120729 - DNA, 64 bp, Homo sapiens; identical to SEQ ID NO: 88933
  misc_feature 1..64: note = chr21:46804718-46804782
  misc_feature 1..64: note = Hypo
  source 1..64: mol_type = genomic DNA

SEQ ID NO: 120730 - DNA, 70 bp, Homo sapiens; identical to SEQ ID NO: 88934
  misc_feature 1..70: note = chr21:46805792-46805862
  misc_feature 1..70: note = Hypo
  source 1..70: mol_type = genomic DNA

SEQ ID NO: 120731 - DNA, 30 bp, Homo sapiens; identical to SEQ ID NO: 88935
  misc_feature 1..30: note = chr21:46808834-46808864
  misc_feature 1..30: note = Hypo
  source 1..30: mol_type = genomic DNA

SEQ ID NO: 120732 - DNA, 30 bp, Homo sapiens; identical to SEQ ID NO: 88936
  misc_feature 1..30: note = chr21:46813076-46813106
  misc_feature 1..30: note = Hypo
  source 1..30: mol_type = genomic DNA

SEQ ID NO: 120733 - DNA, 30 bp, Homo sapiens; identical to SEQ ID NO: 88937
  misc_feature 1..30: note = chr21:46822823-46822853
  misc_feature 1..30: note = Hypo
  source 1..30: mol_type = genomic DNA

SEQ ID NO: 120734 - DNA, 597 bp, Homo sapiens; identical to SEQ ID NO: 88938
  misc_feature 1..597: note = chr21:46825134-46825731
  misc_feature 1..597: note = Hyper
  source 1..597: mol_type = genomic DNA

SEQ ID NO: 120735 - DNA, 210 bp, Homo sapiens; identical to SEQ ID NO: 88939
  misc_feature 1..210: note = chr21:46839039-46839249
  misc_feature 1..210: note = Hypo
  source 1..210: mol_type = genomic DNA

SEQ ID NO: 120736 - DNA, 135 bp, Homo sapiens; identical to SEQ ID NO: 88940
  misc_feature 1..135: note = chr21:46844628-46844763
  misc_feature 1..135: note = Hypo
  source 1..135: mol_type = genomic DNA

SEQ ID NO: 120737 - DNA, 32 bp, Homo sapiens; identical to SEQ ID NO: 88941
  misc_feature 1..32: note = chr21:46845211-46845243
  misc_feature 1..32: note = Hypo
  source 1..32: mol_type = genomic DNA

SEQ ID NO: 120738 - DNA, 30 bp, Homo sapiens; identical to SEQ ID NO: 88942
  misc_feature 1..30: note = chr21:46846999-46847029
  misc_feature 1..30: note = Hypo
  source 1..30: mol_type = genomic DNA

SEQ ID NO: 120739 - DNA, 79 bp, Homo sapiens
  misc_feature 1..79: note = chr21:46847351-46847430
  misc_feature 1..79: note = Hypo
  source 1..79: mol_type = genomic DNA
tcaggcctcttgacccgcctggcactgaccagactgtgtgcccgggtgccgtgcccatgggctccgcctcccccaggca

SEQ ID NO: 120740 - DNA, 153 bp, Homo sapiens
  misc_feature 1..153: note = chr21:46848052-46848205
  misc_feature 1..153: note = Hypo
  source 1..153: mol_type = genomic DNA
gtgcaggttggggtccggcgctcctgcaggcaggcggcgtctgggcctgggggctctcagagtttgaggagcgtgtggtgagggtggcctcgggcctcaaagacgcagcgctgtgggaaccgggagactggctgagcccgctctgaggaaggt

SEQ ID NO: 120741 - DNA, 190 bp, Homo sapiens; identical to SEQ ID NO: 88944
  misc_feature 1..190: note = chr21:46848572-46848762
  misc_feature 1..190: note = Hypo
  source 1..190: mol_type = genomic DNA

SEQ ID NO: 120742 - DNA, 188 bp, Homo sapiens; identical to SEQ ID NO: 88945
  misc_feature 1..188: note = chr21:46853309-46853497
  misc_feature 1..188: note = Hypo
  source 1..188: mol_type = genomic DNA

SEQ ID NO: 120743 - DNA, 49 bp, Homo sapiens; identical to SEQ ID NO: 88946
  misc_feature 1..49: note = chr21:46854204-46854253
  misc_feature 1..49: note = Hypo
  source 1..49: mol_type = genomic DNA

SEQ ID NO: 120744 - DNA, 30 bp, Homo sapiens; identical to SEQ ID NO: 88947
  misc_feature 1..30: note = chr21:46855623-46855653
  misc_feature 1..30: note = Hypo
  source 1..30: mol_type = genomic DNA

SEQ ID NO: 120745 - DNA, 139 bp, Homo sapiens; identical to SEQ ID NO: 88948
  misc_feature 1..139: note = chr21:46859943-46860082
  misc_feature 1..139: note = Hypo
  source 1..139: mol_type = genomic DNA

SEQ ID NO: 120746 - DNA, 83 bp, Homo sapiens; identical to SEQ ID NO: 46558
  misc_feature 1..83: note = chr21:46863752-46863835
  misc_feature 1..83: note = Hypo
  source 1..83: mol_type = genomic DNA

SEQ ID NO: 120747 - DNA, 321 bp, Homo sapiens; identical to SEQ ID NO: 88950
  misc_feature 1..321: note = chr21:46864130-46864451
  misc_feature 1..321: note = Hypo
  source 1..321: mol_type = genomic DNA

SEQ ID NO: 120748 - DNA, 139 bp, Homo sapiens; identical to SEQ ID NO: 88951
  misc_feature 1..139: note = chr21:46894771-46894910
  misc_feature 1..139: note = Hypo
  source 1..139: mol_type = genomic DNA

SEQ ID NO: 120749 - DNA, 324 bp, Homo sapiens; identical to SEQ ID NO: 88952
  misc_feature 1..324: note = chr21:46895167-46895491
  misc_feature 1..324: note = Hypo
  source 1..324: mol_type = genomic DNA

SEQ ID NO: 120750 - DNA, 30 bp, Homo sapiens; identical to SEQ ID NO: 88953
  misc_feature 1..30: note = chr21:46895706-46895736
  misc_feature 1..30: note = Hypo
  source 1..30: mol_type = genomic DNA

SEQ ID NO: 120751 - DNA, 47 bp, Homo sapiens; identical to SEQ ID NO: 88954
  misc_feature 1..47: note = chr21:46901324-46901371
  misc_feature 1..47: note = Hypo
  source 1..47: mol_type = genomic DNA

SEQ ID NO: 120752 - DNA, 644 bp, Homo sapiens; identical to SEQ ID NO: 88955
  misc_feature 1..644: note = chr21:46908900-46909544
  misc_feature 1..644: note = Hypo
  source 1..644: mol_type = genomic DNA

SEQ ID NO: 120753 - DNA, 471 bp, Homo sapiens; identical to SEQ ID NO: 88956
  misc_feature 1..471: note = chr21:46912057-46912528
  misc_feature 1..471: note = Hypo
  source 1..471: mol_type = genomic DNA

SEQ ID NO: 120754 - DNA, 77 bp, Homo sapiens; identical to SEQ ID NO: 88957
  misc_feature 1..77: note = chr21:46913283-46913360
  misc_feature 1..77: note = Hypo
  source 1..77: mol_type = genomic DNA

SEQ ID NO: 120755 - DNA, 30 bp, Homo sapiens; identical to SEQ ID NO: 88958
  misc_feature 1..30: note = chr21:46919113-46919143
  misc_feature 1..30: note = Hypo
  source 1..30: mol_type = genomic DNA

SEQ ID NO: 120756 - DNA, 163 bp, Homo sapiens; identical to SEQ ID NO: 46566
  misc_feature 1..163: note = chr21:46921470-46921633
  misc_feature 1..163: note = Hypo
  source 1..163: mol_type = genomic DNA

SEQ ID NO: 120757 - DNA, 30 bp, Homo sapiens; identical to SEQ ID NO: 88960
  misc_feature 1..30: note = chr21:46921992-46922022
  misc_feature 1..30: note = Hypo
  source 1..30: mol_type = genomic DNA

SEQ ID NO: 120758 - DNA, 583 bp, Homo sapiens; identical to SEQ ID NO: 88961
  misc_feature 1..583: note = chr21:46925317-46925900
  misc_feature 1..583: note = Hypo
  source 1..583: mol_type = genomic DNA

SEQ ID NO: 120759 - DNA, 145 bp, Homo sapiens; identical to SEQ ID NO: 46569
  misc_feature 1..145: note = chr21:46926439-46926584
  misc_feature 1..145: note = Hypo
  source 1..145: mol_type = genomic DNA

SEQ ID NO: 120760 - DNA, 89 bp, Homo sapiens; identical to SEQ ID NO: 46570
  misc_feature 1..89: note = chr21:46934071-46934160
  misc_feature 1..89: note = Hypo
  source 1..89: mol_type = genomic DNA

SEQ ID NO: 120761 - DNA, 154 bp, Homo sapiens; identical to SEQ ID NO: 88964
  misc_feature 1..154: note = chr21:46935829-46935983
  misc_feature 1..154: note = Hypo
  source 1..154: mol_type = genomic DNA

SEQ ID NO: 120762 - DNA, 157 bp, Homo sapiens; identical to SEQ ID NO: 88965
  misc_feature 1..157: note = chr21:46946883-46947040
  misc_feature 1..157: note = Hypo
  source 1..157: mol_type = genomic DNA

SEQ ID NO: 120763 - DNA, 41 bp, Homo sapiens; identical to SEQ ID NO: 88966
  misc_feature 1..41: note = chr21:46961319-46961360
  misc_feature 1..41: note = Hypo
  source 1..41: mol_type = genomic DNA

SEQ ID NO: 120764 - DNA, 43 bp, Homo sapiens; identical to SEQ ID NO: 88967
  misc_feature 1..43: note = chr21:46978498-46978541
  misc_feature 1..43: note = Hypo
  source 1..43: mol_type = genomic DNA

SEQ ID NO: 120765 - DNA, 117 bp, Homo sapiens; identical to SEQ ID NO: 88968
  misc_feature 1..117: note = chr21:46998723-46998840
  misc_feature 1..117: note = Hypo
  source 1..117: mol_type = genomic DNA

SEQ ID NO: 120766 - DNA, 40 bp, Homo sapiens; identical to SEQ ID NO: 88969
  misc_feature 1..40: note = chr21:46999819-46999859
  misc_feature 1..40: note = Hypo
  source 1..40: mol_type = genomic DNA

SEQ ID NO: 120767 - DNA, 692 bp, Homo sapiens
  misc_feature 1..692: note = chr21:47010090-47010782
  misc_feature 1..692: note = Hyper
  source 1..692: mol_type = genomic DNA
aaaaagtcctccttccgtttcccgcactggtaggaaagctggggagagagaaggagtctcaccgtcctggaccagtcggaaccacagaggccgctccgggtccgggggcgacttccgagtgggggaaggaggccggagggcgcgcggccgagcccagacccagcagagcgcgcggccgcccgctcccaggtttccctccatctcggccccggccgcctctgaggttctggaccaagcccagtgcccgctgcccgcagaaggcctcactctggagccggcggggagggcggggacgcggctgtccagagctccgtgcccgccccgggagttcgaagggtgctggggccgaggggaaggctctggtcggcggcgtcagcggcagctcccagacgacctaggactgcaaagggcccaggacggggggcggggcggagacaggaggcggggcggaggcatgggggcggagacatgaaggggcggggctggggcggggctgaggcaggaggggcggggctgaggcaggaggggcggggctgaggcaggaggggcggggcagagcctgagacaccccgccccgccccccacctccacctcgagcccgcccctctcccaggctcctgctccagggcgaacccgggggtcctctcccatggctctgtgggggaccccggggaggtcgccctggcacggga

SEQ ID NO: 120768 - DNA, 77 bp, Homo sapiens; identical to SEQ ID NO: 46574
  misc_feature 1..77: note = chr21:47013235-47013312
  misc_feature 1..77: note = Hypo
  source 1..77: mol_type = genomic DNA

SEQ ID NO: 120769 - DNA, 156 bp, Homo sapiens; identical to SEQ ID NO: 88973
  misc_feature 1..156: note = chr21:47019157-47019313
  misc_feature 1..156: note = Hypo
  source 1..156: mol_type = genomic DNA

SEQ ID NO: 120770 - DNA, 33 bp, Homo sapiens; identical to SEQ ID NO: 88974
  misc_feature 1..33: note = chr21:47026246-47026279
  misc_feature 1..33: note = Hypo
  source 1..33: mol_type = genomic DNA

SEQ ID NO: 120771 - DNA, 420 bp, Homo sapiens; identical to SEQ ID NO: 88975
  misc_feature 1..420: note = chr21:47026399-47026819
  misc_feature 1..420: note = Hypo
  source 1..420: mol_type = genomic DNA

SEQ ID NO: 120772 - DNA, 160 bp, Homo sapiens; identical to SEQ ID NO: 88976
  misc_feature 1..160: note = chr21:47027910-47028070
  misc_feature 1..160: note = Hypo
  source 1..160: mol_type = genomic DNA

SEQ ID NO: 120773 - DNA, 16 bp, Homo sapiens
  misc_feature 1..16: note = chr21:47034414-47034430
  misc_feature 1..16: note = Hypo
  source 1..16: mol_type = genomic DNA
gcgtgagccaccgtgc

SEQ ID NO: 120774 - DNA, 30 bp, Homo sapiens; identical to SEQ ID NO: 88978
  misc_feature 1..30: note = chr21:47034932-47034962
  misc_feature 1..30: note = Hypo
  source 1..30: mol_type = genomic DNA

SEQ ID NO: 120775 - DNA, 96 bp, Homo sapiens; identical to SEQ ID NO: 88979
  misc_feature 1..96: note = chr21:47036030-47036126
  misc_feature 1..96: note = Hypo
  source 1..96: mol_type = genomic DNA

SEQ ID NO: 120776 - DNA, 83 bp, Homo sapiens; identical to SEQ ID NO: 88980
  misc_feature 1..83: note = chr21:47036475-47036558
  misc_feature 1..83: note = Hypo
  source 1..83: mol_type = genomic DNA

SEQ ID NO: 120777 - DNA, 517 bp, Homo sapiens
  misc_feature 1..517: note = chr21:47062381-47062898
  misc_feature 1..517: note = Hyper
  source 1..517: mol_type = genomic DNA
gaaacggggcccaggcgcggcgactgcggaggacgcgcctcggccccagcgccctggtcctcggggcgtccggctgcccttgcccgaggccggggcgggcgctcagcgccgcggaagaaacgcccgggcggggacgcacagcgaggcgggctccgcgggaagtaccgggaaaacggcgcggagcggaacagcccggagccagcccagagaaagggcggcctccccctgcagcccccggggcccagcaacgccccgccccaggccacggcacgcgaacgccgggcgggcggaggggacagggcggcgggaccagcgcggggcgggcagcgtctgggcacaggctcacgagccgctcggggcccctgcccgccgggcgctgcggccccagcctccgggccggggccaggcccacagagaacgggaagcgggcgctgcagggggaccttcggggttgcggcacggctgggaattcaacggccattcccgtcccgtcgggcccacccgcccgcccgccaaa

SEQ ID NO: 120778 - DNA, 1044 bp, Homo sapiens; identical to SEQ ID NO: 88982
  misc_feature 1..1044: note = chr21:47063432-47064476
  misc_feature 1..1044: note = Hyper
  source 1..1044: mol_type = genomic DNA

SEQ ID NO: 120779 - DNA, 30 bp, Homo sapiens; identical to SEQ ID NO: 88983
  misc_feature 1..30: note = chr21:47167443-47167473
  misc_feature 1..30: note = Hypo
  source 1..30: mol_type = genomic DNA

SEQ ID NO: 120780 - DNA, 30 bp, Homo sapiens; identical to SEQ ID NO: 88984
  misc_feature 1..30: note = chr21:47168125-47168155
  misc_feature 1..30: note = Hypo
  source 1..30: mol_type = genomic DNA

SEQ ID NO: 120781 - DNA, 151 bp, Homo sapiens; identical to SEQ ID NO: 88985
  misc_feature 1..151: note = chr21:47181649-47181800
  misc_feature 1..151: note = Hypo
  source 1..151: mol_type = genomic DNA

SEQ ID NO: 120782 - DNA, 30 bp, Homo sapiens; identical to SEQ ID NO: 88986
  misc_feature 1..30: note = chr21:47189452-47189482
  misc_feature 1..30: note = Hypo
  source 1..30: mol_type = genomic DNA

SEQ ID NO: 120783 - DNA, 131 bp, Homo sapiens; identical to SEQ ID NO: 88987
  misc_feature 1..131: note = chr21:47213449-47213580
  misc_feature 1..131: note = Hypo
  source 1..131: mol_type = genomic DNA

SEQ ID NO: 120784 - DNA, 30 bp, Homo sapiens; identical to SEQ ID NO: 88988
  misc_feature 1..30: note = chr21:47254735-47254765
  misc_feature 1..30: note = Hypo
  source 1..30: mol_type = genomic DNA

SEQ ID NO: 120785 - DNA, 30 bp, Homo sapiens; identical to SEQ ID NO: 88989
  misc_feature 1..30: note = chr21:47283366-47283396
  misc_feature 1..30: note = Hypo
  source 1..30: mol_type = genomic DNA

SEQ ID NO: 120786 - DNA, 413 bp, Homo sapiens; identical to SEQ ID NO: 88990
  misc_feature 1..413: note = chr21:47287026-47287439
  misc_feature 1..413: note = Hypo
  source 1..413: mol_type = genomic DNA

SEQ ID NO: 120787 - DNA, 30 bp, Homo sapiens; identical to SEQ ID NO: 88991
  misc_feature 1..30: note = chr21:47295773-47295803
  misc_feature 1..30: note = Hypo
  source 1..30: mol_type = genomic DNA

SEQ ID NO: 120788 - DNA, 30 bp, Homo sapiens; identical to SEQ ID NO: 88992
  misc_feature 1..30: note = chr21:47320229-47320259
  misc_feature 1..30: note = Hypo
  source 1..30: mol_type = genomic DNA

SEQ ID NO: 120789 - DNA, 242 bp, Homo sapiens; identical to SEQ ID NO: 88993
  misc_feature 1..242: note = chr21:47328400-47328642
  misc_feature 1..242: note = Hypo
  source 1..242: mol_type = genomic DNA

SEQ ID NO: 120790 - DNA, 30 bp, Homo sapiens; identical to SEQ ID NO: 88994
  misc_feature 1..30: note = chr21:47329348-47329378
  misc_feature 1..30: note = Hypo
  source 1..30: mol_type = genomic DNA

SEQ ID NO: 120791 - DNA, 47 bp, Homo sapiens; identical to SEQ ID NO: 88995
  misc_feature 1..47: note = chr21:47333573-47333620
  misc_feature 1..47: note = Hypo
  source 1..47: mol_type = genomic DNA

SEQ ID NO: 120792 - DNA, 43 bp, Homo sapiens; identical to SEQ ID NO: 88996
  misc_feature 1..43: note = chr21:47365144-47365187
  misc_feature 1..43: note = Hypo
  source 1..43: mol_type = genomic DNA

SEQ ID NO: 120793 - DNA, 295 bp, Homo sapiens; identical to SEQ ID NO: 88997
  misc_feature 1..295: note = chr21:47365639-47365934
  misc_feature 1..295: note = Hypo
  source 1..295: mol_type = genomic DNA

SEQ ID NO: 120794 - DNA, 157 bp, Homo sapiens; identical to SEQ ID NO: 88998
  misc_feature 1..157: note = chr21:47369368-47369525
  misc_feature 1..157: note = Hypo
  source 1..157: mol_type = genomic DNA

SEQ ID NO: 120795 - DNA, 440 bp, Homo sapiens
  misc_feature 1..440: note = chr21:47392685-47393125
  misc_feature 1..440: note = Hyper
  source 1..440: mol_type = genomic DNA
ctgagctgtgccactcgtgcagccctggccctccgcagcctcggcaaccccacccgagggctcccactgctgcccacagacatctcagggtctcccgggccgggtcagcggcgccggaacagggtctcccgggccgggtcagcggcgccggaagtgattctcgtcagcaggaatgcgctggctgcccgggagccttcagggtgggctctgggggccaggtgcggcctcagcgccgtcccttcccgggaagcctcctccctggggtccacgccggctcctgctggctcccccattccgctgaaatctgaggaaaaggctctgggaacgcagccagactcccccacagctcagacggctgtaaagaaatattcctgccagatgttcagaggcggaggccagcatgaggtaacgggaaaggcttaacccgtccagccccgcag

SEQ ID NO: 120796 - DNA, 42 bp, Homo sapiens; identical to SEQ ID NO: 89000
  misc_feature 1..42: note = chr21:47393499-47393541
  misc_feature 1..42: note = Hyper
  source 1..42: mol_type = genomic DNA

SEQ ID NO: 120797 - DNA, 222 bp, Homo sapiens; identical to SEQ ID NO: 89001
  misc_feature 1..222: note = chr21:47393601-47393823
  misc_feature 1..222: note = Hyper
  source 1..222: mol_type = genomic DNA

SEQ ID NO: 120798 - DNA, 30 bp, Homo sapiens; identical to SEQ ID NO: 89002
  misc_feature 1..30: note = chr21:47394641-47394671
  misc_feature 1..30: note = Hyper
  source 1..30: mol_type = genomic DNA

SEQ ID NO: 120799 - DNA, 99 bp, Homo sapiens; identical to SEQ ID NO: 89003
  misc_feature 1..99: note = chr21:47401911-47402010
  misc_feature 1..99: note = Hyper
  source 1..99: mol_type = genomic DNA

SEQ ID NO: 120800 - DNA, 333 bp, Homo sapiens; identical to SEQ ID NO: 89004
  misc_feature 1..333: note = chr21:47403992-47404325
  misc_feature 1..333: note = Hypo
  source 1..333: mol_type = genomic DNA

SEQ ID NO: 120801 - DNA, 30 bp, Homo sapiens; identical to SEQ ID NO: 89005
  misc_feature 1..30: note = chr21:47407032-47407062
  misc_feature 1..30: note = Hypo
  source 1..30: mol_type = genomic DNA

SEQ ID NO: 120802 - DNA, 32 bp, Homo sapiens; identical to SEQ ID NO: 89006
  misc_feature 1..32: note = chr21:47414295-47414327
  misc_feature 1..32: note = Hypo
  source 1..32: mol_type = genomic DNA

SEQ ID NO: 120803 - DNA, 349 bp, Homo sapiens; identical to SEQ ID NO: 89007
  misc_feature 1..349: note = chr21:47417760-47418109
  misc_feature 1..349: note = Hypo
  source 1..349: mol_type = genomic DNA

SEQ ID NO: 120804 - DNA, 49 bp, Homo sapiens; identical to SEQ ID NO: 89008
  misc_feature 1..49: note = chr21:47418439-47418488
  misc_feature 1..49: note = Hypo
  source 1..49: mol_type = genomic DNA

SEQ ID NO: 120805 - DNA, 144 bp, Homo sapiens; identical to SEQ ID NO: 89009
  misc_feature 1..144: note = chr21:47420442-47420586
  misc_feature 1..144: note = Hypo
  source 1..144: mol_type = genomic DNA

SEQ ID NO: 120806 - DNA, 252 bp, Homo sapiens; identical to SEQ ID NO: 89010
  misc_feature 1..252: note = chr21:47421120-47421372
  misc_feature 1..252: note = Hypo
  source 1..252: mol_type = genomic DNA

SEQ ID NO: 120807 - DNA, 30 bp, Homo sapiens; identical to SEQ ID NO: 89011
  misc_feature 1..30: note = chr21:47421881-47421911
  misc_feature 1..30: note = Hypo
  source 1..30: mol_type = genomic DNA

SEQ ID NO: 120808 - DNA, 515 bp, Homo sapiens; identical to SEQ ID NO: 89012
  misc_feature 1..515: note = chr21:47422662-47423177
  misc_feature 1..515: note = Hypo
  source 1..515: mol_type = genomic DNA

SEQ ID NO: 120809 - DNA, 30 bp, Homo sapiens; identical to SEQ ID NO: 89013
  misc_feature 1..30: note = chr21:47423396-47423426
  misc_feature 1..30: note = Hypo
  source 1..30: mol_type = genomic DNA

SEQ ID NO: 120810 - DNA, 327 bp, Homo sapiens; identical to SEQ ID NO: 89014
  misc_feature 1..327: note = chr21:47425521-47425848
  misc_feature 1..327: note = Hypo
  source 1..327: mol_type = genomic DNA

SEQ ID NO: 120811 - DNA, 286 bp, Homo sapiens; identical to SEQ ID NO: 89015
  misc_feature 1..286: note = chr21:47426447-47426733
  misc_feature 1..286: note = Hypo
  source 1..286: mol_type = genomic DNA

SEQ ID NO: 120812 - DNA, 73 bp, Homo sapiens; identical to SEQ ID NO: 89016
  misc_feature 1..73: note = chr21:47430142-47430215
  misc_feature 1..73: note = Hypo
  source 1..73: mol_type = genomic DNA

SEQ ID NO: 120813 - DNA, 30 bp, Homo sapiens; identical to SEQ ID NO: 89017
  misc_feature 1..30: note = chr21:47442780-47442810
  misc_feature 1..30: note = Hypo
  source 1..30: mol_type = genomic DNA

SEQ ID NO: 120814 - DNA, 65 bp, Homo sapiens; identical to SEQ ID NO: 89018
  misc_feature 1..65: note = chr21:47452998-47453063
  misc_feature 1..65: note = Hypo
  source 1..65: mol_type = genomic DNA

SEQ ID NO: 120815 - DNA, 44 bp, Homo sapiens; identical to SEQ ID NO: 89019
  misc_feature 1..44: note = chr21:47457144-47457188
  misc_feature 1..44: note = Hypo
  source 1..44: mol_type = genomic DNA

SEQ ID NO: 120816 - DNA, 72 bp, Homo sapiens; identical to SEQ ID NO: 89020
  misc_feature 1..72: note = chr21:47457442-47457514
  misc_feature 1..72: note = Hypo
  source 1..72: mol_type = genomic DNA

SEQ ID NO: 120817 - DNA, 30 bp, Homo sapiens; identical to SEQ ID NO: 89021
  misc_feature 1..30: note = chr21:47457793-47457823
  misc_feature 1..30: note = Hypo
  source 1..30: mol_type = genomic DNA

SEQ ID NO: 120818 - DNA, 35 bp, Homo sapiens; identical to SEQ ID NO: 46592
  misc_feature 1..35: note = chr21:47459822-47459857
  misc_feature 1..35: note = Hypo
  source 1..35: mol_type = genomic DNA

SEQ ID NO: 120819 - DNA, 149 bp, Homo sapiens; identical to SEQ ID NO: 89023
  misc_feature 1..149: note = chr21:47461082-47461231
  misc_feature 1..149: note = Hypo
  source 1..149: mol_type = genomic DNA

SEQ ID NO: 120820 - DNA, 53 bp, Homo sapiens; identical to SEQ ID NO: 89024
  misc_feature 1..53: note = chr21:47470121-47470174
  misc_feature 1..53: note = Hypo
  source 1..53: mol_type = genomic DNA

SEQ ID NO: 120821 - DNA, 65 bp, Homo sapiens; identical to SEQ ID NO: 46593
  misc_feature 1..65: note = chr21:47471074-47471139
  misc_feature 1..65: note = Hypo
  source 1..65: mol_type = genomic DNA

SEQ ID NO: 120822 - DNA, 30 bp, Homo sapiens; identical to SEQ ID NO: 89026
  misc_feature 1..30: note = chr21:47472379-47472409
  misc_feature 1..30: note = Hypo
  source 1..30: mol_type = genomic DNA

SEQ ID NO: 120823 - DNA, 133 bp, Homo sapiens; identical to SEQ ID NO: 89027
  misc_feature 1..133: note = chr21:47475230-47475363
  misc_feature 1..133: note = Hypo
  source 1..133: mol_type = genomic DNA

SEQ ID NO: 120824 - DNA, 289 bp, Homo sapiens; identical to SEQ ID NO: 89028
  misc_feature 1..289: note = chr21:47487537-47487826
  misc_feature 1..289: note = Hypo
  source 1..289: mol_type = genomic DNA

SEQ ID NO: 120825 - DNA, 153 bp, Homo sapiens; identical to SEQ ID NO: 89029
  misc_feature 1..153: note = chr21:47489936-47490089
  misc_feature 1..153: note = Hypo
  source 1..153: mol_type = genomic DNA

SEQ ID NO: 120826 - DNA, 40 bp, Homo sapiens; identical to SEQ ID NO: 89030
  misc_feature 1..40: note = chr21:47501864-47501904
  misc_feature 1..40: note = Hypo
  source 1..40: mol_type = genomic DNA

SEQ ID NO: 120827 - DNA, 34 bp, Homo sapiens; identical to SEQ ID NO: 16748
  misc_feature 1..34: note = chr21:47503061-47503095
  misc_feature 1..34: note = Hypo
  source 1..34: mol_type = genomic DNA

SEQ ID NO: 120828 - DNA, 43 bp, Homo sapiens; identical to SEQ ID NO: 89032
  misc_feature 1..43: note = chr21:47504852-47504895
  misc_feature 1..43: note = Hypo
  source 1..43: mol_type = genomic DNA

SEQ ID NO: 120829 - DNA, 1306 bp, Homo sapiens
  misc_feature 1..1306: note = chr21:47517762-47519068
  misc_feature 1..1306: note = Hyper
  source 1..1306: mol_type = genomic DNA
acgggcggccgggcccgggacgcgaagtccgagcagcagcgggcaggggctggcgggggagctcggcccgggctgcaggggggtccccaccctctccacctcctccagcctcccgccctcgagggtccccgcttccctcccatccccctcccgtgcccccggccccctcctcccatccgcggggccgcagcgcttcctggcggcggggcgggtcaggccggcggggcggggtataaagggggcggcgccggccgcggttccctccctgctgcttactcggcgcccgcgcctcgggccgtcgggagcggagcctcctcgggaccaggtgagcgcctcccggaccccgcaccctggaagccgctcggcccgcggggggtgaccccgagtcctgggaaggcggcggcggcggctccgtccctcgggtccccgggaagggggactccagccccagggacggcggggggctcggcgggttcggggctcctcctcgcggggctggggccgcgcctgcccctgtggctccgcgtctctgggtccgaccctcgggcgcgcgacttggggccacctccccgcggcctcctctggggcggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccacacccgccctgggactccgccggggcgctggtggaaccgctgggcctgggtctccactgctggcaaccgaacggatcggccctctgtggagccgcaggtgtgcgggcgagcggcgcccatccgggctgtgccagcagaaccccggtgcccgcgcctaggacgcccctggagaagggaccttccctttggggtcggaacccagaaaggaggggcctgcgatccgcggagctccttgttcttgggataacacagctctggcttggaggcccccttgcacttcgactctggtgatta

SEQ ID NO: 120830 - DNA, 212 bp, Homo sapiens; identical to SEQ ID NO: 89036
  misc_feature 1..212: note = chr21:47531922-47532134
  misc_feature 1..212: note = Hypo
  source 1..212: mol_type = genomic DNA

SEQ ID NO: 120831 - DNA, 184 bp, Homo sapiens; identical to SEQ ID NO: 89037
  misc_feature 1..184: note = chr21:47537583-47537767
  misc_feature 1..184: note = Hypo
  source 1..184: mol_type = genomic DNA

SEQ ID NO: 120832 - DNA, 192 bp, Homo sapiens; identical to SEQ ID NO: 89038
  misc_feature 1..192: note = chr21:47538699-47538891
  misc_feature 1..192: note = Hypo
  source 1..192: mol_type = genomic DNA

SEQ ID NO: 120833 - DNA, 36 bp, Homo sapiens; identical to SEQ ID NO: 89039
  misc_feature 1..36: note = chr21:47539603-47539639
  misc_feature 1..36: note = Hypo
  source 1..36: mol_type = genomic DNA

SEQ ID NO: 120834 - DNA, 128 bp, Homo sapiens; identical to SEQ ID NO: 89040
  misc_feature 1..128: note = chr21:47545946-47546074
  misc_feature 1..128: note = Hypo
  source 1..128: mol_type = genomic DNA

SEQ ID NO: 120835 - DNA, 155 bp, Homo sapiens; identical to SEQ ID NO: 89041
  misc_feature 1..155: note = chr21:47548588-47548743
  misc_feature 1..155: note = Hypo
  source 1..155: mol_type = genomic DNA

SEQ ID NO: 120836 - DNA, 94 bp, Homo sapiens; identical to SEQ ID NO: 89042
  misc_feature 1..94: note = chr21:47565176-47565270
  misc_feature 1..94: note = Hypo
  source 1..94: mol_type = genomic DNA

SEQ ID NO: 120837 - DNA, 109 bp, Homo sapiens; identical to SEQ ID NO: 89043
  misc_feature 1..109: note = chr21:47570249-47570358
  misc_feature 1..109: note = Hypo
  source 1..109: mol_type = genomic DNA

SEQ ID NO: 120838 - DNA, 246 bp, Homo sapiens; identical to SEQ ID NO: 89044
  misc_feature 1..246: note = chr21:47602459-47602705
  misc_feature 1..246: note = Hypo
  source 1..246: mol_type = genomic DNA

SEQ ID NO: 120839 - DNA, 62 bp, Homo sapiens; identical to SEQ ID NO: 89045
  misc_feature 1..62: note = chr21:47689638-47689700
  misc_feature 1..62: note = Hypo
  source 1..62: mol_type = genomic DNA

SEQ ID NO: 120840 - DNA, 238 bp, Homo sapiens
  misc_feature 1..238: note = chr21:47717212-47717450
  misc_feature 1..238: note = Hyper
  source 1..238: mol_type = genomic DNA
ctcccactcccctcccgaggccccgcttattctcccggcctgtggcggttcgtgcactcgctgagctcaggttctggtgaaggtgcccggagccgggtcccgccttcggcctgagctagagccgcgcgggcggccggcttcccccaaaccctgtgggaggggcatcccgaggaggcgaccccagagagtggggcgcggacaccttccctggggagggccagcgcgcttccttccttcc

SEQ ID NO: 120841 - DNA, 30 bp, Homo sapiens
  misc_feature 1..30: note = chr21:47717697-47717727
  misc_feature 1..30: note = Hyper
  source 1..30: mol_type = genomic DNA
aaaacggttccgagccgtggcatcgagagg

SEQ ID NO: 120842 - DNA, 70 bp, Homo sapiens; identical to SEQ ID NO: 89048
  misc_feature 1..70: note = chr21:47737895-47737965
  misc_feature 1..70: note = Hypo
  source 1..70: mol_type = genomic DNA

SEQ ID NO: 120843 - DNA, 300 bp, Homo sapiens; identical to SEQ ID NO: 89049
  misc_feature 1..300: note = chr21:47746178-47746478
  misc_feature 1..300: note = Hypo
  source 1..300: mol_type = genomic DNA

SEQ ID NO: 120844 - DNA, 349 bp, Homo sapiens; identical to SEQ ID NO: 89050
  misc_feature 1..349: note = chr21:47771760-47772109
  misc_feature 1..349: note = Hypo
  source 1..349: mol_type = genomic DNA

SEQ ID NO: 120845 - DNA, 30 bp, Homo sapiens; identical to SEQ ID NO: 89051
  misc_feature 1..30: note = chr21:47798788-47798818
  misc_feature 1..30: note = Hypo
  source 1..30: mol_type = genomic DNA

SEQ ID NO: 120846 - DNA, 44 bp, Homo sapiens; identical to SEQ ID NO: 46610
  misc_feature 1..44: note = chr21:47799181-47799225
  misc_feature 1..44: note = Hypo
  source 1..44: mol_type = genomic DNA

SEQ ID NO: 120847 - DNA, 58 bp, Homo sapiens; identical to SEQ ID NO: 89053
  misc_feature 1..58: note = chr21:47799808-47799866
  misc_feature 1..58: note = Hypo
  source 1..58: mol_type = genomic DNA

SEQ ID NO: 120848 - DNA, 30 bp, Homo sapiens; identical to SEQ ID NO: 89054
  misc_feature 1..30: note = chr21:47808338-47808368
  misc_feature 1..30: note = Hypo
  source 1..30: mol_type = genomic DNA

SEQ ID NO: 120849 - DNA, 33 bp, Homo sapiens; identical to SEQ ID NO: 89055
  misc_feature 1..33: note = chr21:47813009-47813042
  misc_feature 1..33: note = Hypo
  source 1..33: mol_type = genomic DNA

SEQ ID NO: 120850 - DNA, 30 bp, Homo sapiens; identical to SEQ ID NO: 89056
  misc_feature 1..30: note = chr21:48068622-48068652
  misc_feature 1..30: note = Hypo
  source 1..30: mol_type = genomic DNA

SEQ ID NO: 120851 - DNA, 1088 bp, Homo sapiens; identical to SEQ ID NO: 89057
  misc_feature 1..1088: note = chr21:48087199-48088287
  misc_feature 1..1088: note = Hyper
  source 1..1088: mol_type = genomic DNA

SEQ ID NO: 120852 - DNA, 30 bp, Homo sapiens; identical to SEQ ID NO: 89058
  misc_feature 1..30: note = chr22:17076404-17076434
  misc_feature 1..30: note = Hypo
  source 1..30: mol_type = genomic DNA

SEQ ID NO: 120853 - DNA, 1664 bp, Homo sapiens
  misc_feature 1..1664: note = chr22:17081893-17083557
  misc_feature 1..1664: note = Hyper
  source 1..1664: mol_type = genomic DNA
ggcgttggattagaacgaagttgactccattccttttcctccccgtagtgtgggcgatacgaggaaagacctcggcaagaaccagcgaagccccggctgccctcgccctgcgggcgcacacttgctcctcgcgccgggctgcgccgggcgcccgcgccgcctcggcgtgtgtccgcggctccctcccgccctcgcccgcagtcccccgatcccgatcccggatctctgggtccacagcttggctccctcccgagccggagccggagccggagccgaagtcgcggctgggcccggccgccccgtcacagggggagggaacccatggggagggggaggggcggtgaggtcagcggcggcggcgcgtccgcgggcggcgggagcttcgcatgcgcggagcgaggcccgtgagtggcagcggcggcgcgcggggggcgggcgaggggccgagagtgggggagcgggcgggggccgtcgaggaggcgttgtgtgggcgcgacggctgcgagttggggaggtctgtggtgcgggtcgccccgggggatccccggcgcgggcctcgcgcgacggccacggtcgcgcggcgtgtgtggggggtccacgcacacccgcaaaacttcctcctcccctgctccgggagagcgagcgagcgtgtgtgagagcgagtgtgaggagcgagccgcggcccgacgcccagcgccgccgctggagcagctgtcaaaacttcgccgccgcccgggccccgcggcccgccctccccgcgccgggcccctttctcttcctgctgcgggcggcccgggggaggggccgcgggcggagaccccggaggccggcgcccctcacgccgcccgcccgcccgctccccgcccggcccctgcgcgcgtgcgtgtcctgctcgctccatgttgccgcctctcccggtacctgctgctgctcccggggcttcgggaaatgcgagagtctgagccggggaggaggaacccgagcagcggcggcggcggccgcggcggcgggagccccccaagaggaggaccgggatccatgtgtctttcctggtgactaggatgtcgtcggaggagaacaagtgcgtggagcagccgcagccaccaccccccgaggagcctggagccccggccccgagccccccagccgcagacaaaagacctcggggccggcctcgcaaggcgcttcccctttccagagagccagaaagaagtaagttgagtgcgagggagccaggccgggagccagcggcggcgccgggccggagctgccaccgggcgcccgccccgcggcctccacgccttggcgccccccggcgggatgggggcggggcgggcccgcgggcggcggcagctcccggccccggccccacgcccctcggtagccgcccgcgcccggcctcccccgctccgcgccgcccgcccgggctcccgtcggcgcccggcttcgcacactttacttttcagtcgggccttttcagtgggtcttctccgcgactcttcttttggagaaatttctcgtagccgcgtcttggcctagctggatcattgagaaaacaagcccggagcgcgcgcaggtagtccccggacggactccgagcgaaccgccgagccgtgggcgctcgggaaactcggagctgtcaaaacgcccgggccaggtggtct

SEQ ID NO: 120854 - DNA, 287 bp, Homo sapiens
  misc_feature 1..287: note = chr22:17083805-17084092
  misc_feature 1..287: note = Hyper
  source 1..287: mol_type = genomic DNA
tagccagcgtcccctcgtaaggcagaataccaagagcacttattcagagagagtgcagatgtaaatgtcgtttccctcgtaagtcttagctgtaaggggcttgggaatagggtcgcctgcctttgaccgaccgtactgtagggctggacaccggcttattagaggaccagaaatgtcttcttacagaacggttatttgacggctttgcttgtaaattaagacaccgttttagtgccagcgagctgctcggcttctgtggctctcgcgtgtgccgtggaagaactgtg

SEQ ID NO: 120855 - DNA, 216 bp, Homo sapiens
  misc_feature 1..216: note = chr22:17090649-17090865
  misc_feature 1..216: note = Hyper
  source 1..216: mol_type = genomic DNA
ccgacgtcccccctccgcccgcgccccaagggctgactgggcaaattggcagatccgccccgcggggcgacccaacttttcggaacagccccccaccgcccacccctgcagatccccggacccccgctcccggcggagattcagggaaccccgcatcccaagcccttctaaatcgtgcggcctgagtgtgacggccaagagcggatgcagcccggg

SEQ ID NO: 120856 - DNA, 79 bp, Homo sapiens; identical to SEQ ID NO: 89068
  misc_feature 1..79: note = chr22:17129959-17130038
  misc_feature 1..79: note = Hypo
  source 1..79: mol_type = genomic DNA

SEQ ID NO: 120857 - DNA, 37 bp, Homo sapiens; identical to SEQ ID NO: 46611
  misc_feature 1..37: note = chr22:17330739-17330776
  misc_feature 1..37: note = Hypo
  source 1..37: mol_type = genomic DNA

SEQ ID NO: 120858 - DNA, 37 bp, Homo sapiens; identical to SEQ ID NO: 89070
  misc_feature 1..37: note = chr22:17489436-17489473
  misc_feature 1..37: note = Hypo
  source 1..37: mol_type = genomic DNA

SEQ ID NO: 120859 - DNA, 562 bp, Homo sapiens
  misc_feature 1..562: note = chr22:17600944-17601506
  misc_feature 1..562: note = Hyper
  source 1..562: mol_type = genomic DNA
agcgccatggtgagacggaagcccgtggtgccgaagggcgcgcgtagctcgatgaggtctaggatggacgtgcccaggatcagcaccaccttgggagtgaaggcgatggagtagataagccaggccaggtaggcgaaggcgaactcgcccgctgccgcggccgcccccaggccgccccccgcgccgccggcgcccccgcgggctccgcgtgccttggccccagcggtagcggccgagggggcgggcagatgcaggggcggcgcggcgtggtggtggtgcaggtggtggttgtgcgcgccgctggctgcgccgccccgacggccccggctgttcttggcgaagaagatggcccagcccaccaccaccaccaggtcagtggcgatccaggagcaccagtacaggtcggtgacggcgatgaggtacaggtccagcaggccgccctgcgccagcagcagcaccacggacagcgcctggtagccccagcggcacctgggactgggggcgcagccgcggcgccgacctctgcggccggggcggtctgggcagccgcagcagcagcaac

SEQ ID NO: 120860 - DNA, 71 bp, Homo sapiens; identical to SEQ ID NO: 89073
  misc_feature 1..71: note = chr22:17601956-17602027
  misc_feature 1..71: note = Hyper
  source 1..71: mol_type = genomic DNA

SEQ ID NO: 120861 - DNA, 321 bp, Homo sapiens; identical to SEQ ID NO: 89074
  misc_feature 1..321: note = chr22:17602324-17602645
  misc_feature 1..321: note = Hyper
  source 1..321: mol_type = genomic DNA

SEQ ID NO: 120862 - DNA, 465 bp, Homo sapiens
  misc_feature 1..465: note = chr22:17849412-17849877
  misc_feature 1..465: note = Hyper
  source 1..465: mol_type = genomic DNA
ttagcagtactccaccgcgctacagcagttagcatttctaaagcacacactccaacacccttcggccgtagcacattcaatccctccgccggggcgtgggggtctcctcccctccgagcacagtccccggcttcccgatttcctctgccccatccccccgccttccaagcacattgtgctcactcttccaggcagctctttcagcggccgggcagtagcagggttccgagcccgtcttctccggggcggtcacacgtgtccattccctggggttggggatcgctcttcccgcttggctgctgattggtgcctccccctaccccacccttcccgccgctctccagcctccatcctacttcgttccagctcaatcagccccaccgccttcttccctcggagaaaaaagccacttcagagctccttgggcgccgttctcggctggaataaaagcgttaagaaacaggt

SEQ ID NO: 120863 - DNA, 1039 bp, Homo sapiens; identical to SEQ ID NO: 89077
  misc_feature 1..1039: note = chr22:17850114-17851153
  misc_feature 1..1039: note = Hyper
  source 1..1039: mol_type = genomic DNA

SEQ ID NO: 120864 - DNA, 120 bp, Homo sapiens; identical to SEQ ID NO: 46612
  misc_feature 1..120: note = chr22:18009965-18010085
  misc_feature 1..120: note = Hypo
  source 1..120: mol_type = genomic DNA

SEQ ID NO: 120865 - DNA, 97 bp, Homo sapiens; identical to SEQ ID NO: 46613
  misc_feature 1..97: note = chr22:18110592-18110689
  misc_feature 1..97: note = Hypo
  source 1..97: mol_type = genomic DNA

SEQ ID NO: 120866 - DNA, 47 bp, Homo sapiens; identical to SEQ ID NO: 89080
  misc_feature 1..47: note = chr22:18265476-18265523
  misc_feature 1..47: note = Hypo
  source 1..47: mol_type = genomic DNA

SEQ ID NO: 120867 - DNA, 30 bp, Homo sapiens; identical to SEQ ID NO: 46614
  misc_feature 1..30: note = chr22:18265801-18265831
  misc_feature 1..30: note = Hypo
  source 1..30: mol_type = genomic DNA

SEQ ID NO: 120868 - DNA, 30 bp, Homo sapiens; identical to SEQ ID NO: 89082
  misc_feature 1..30: note = chr22:18272947-18272977
  misc_feature 1..30: note = Hypo
  source 1..30: mol_type = genomic DNA

SEQ ID NO: 120869 - DNA, 263 bp, Homo sapiens; identical to SEQ ID NO: 89083
  misc_feature 1..263: note = chr22:18328093-18328356
  misc_feature 1..263: note = Hypo
  source 1..263: mol_type = genomic DNA

SEQ ID NO: 120870 - DNA, 130 bp, Homo sapiens; identical to SEQ ID NO: 89084
  misc_feature 1..130: note = chr22:18355580-18355710
  misc_feature 1..130: note = Hypo
  source 1..130: mol_type = genomic DNA

SEQ ID NO: 120871 - DNA, 30 bp, Homo sapiens; identical to SEQ ID NO: 89085
  misc_feature 1..30: note = chr22:18422755-18422785
  misc_feature 1..30: note = Hypo
  source 1..30: mol_type = genomic DNA

SEQ ID NO: 120872 - DNA, 30 bp, Homo sapiens; identical to SEQ ID NO: 89086
  misc_feature 1..30: note = chr22:18432493-18432523
  misc_feature 1..30: note = Hypo
  source 1..30: mol_type = genomic DNA

SEQ ID NO: 120873 - DNA, 30 bp, Homo sapiens; identical to SEQ ID NO: 89087
  misc_feature 1..30: note = chr22:18470447-18470477
  misc_feature 1..30: note = Hypo
  source 1..30: mol_type = genomic DNA

SEQ ID NO: 120874 - DNA, 30 bp, Homo sapiens; identical to SEQ ID NO: 89088
  misc_feature 1..30: note = chr22:18553593-18553623
  misc_feature 1..30: note = Hypo
  source 1..30: mol_type = genomic DNA

SEQ ID NO: 120875 - DNA, 121 bp, Homo sapiens; identical to SEQ ID NO: 89089
  misc_feature 1..121: note = chr22:18553829-18553950
  misc_feature 1..121: note = Hypo
  source 1..121: mol_type = genomic DNA

SEQ ID NO: 120876 - DNA, 53 bp, Homo sapiens; identical to SEQ ID NO: 46618
  misc_feature 1..53: note = chr22:18634479-18634532
  misc_feature 1..53: note = Hypo
  source 1..53: mol_type = genomic DNA

SEQ ID NO: 120877 - DNA, 196 bp, Homo sapiens; identical to SEQ ID NO: 89091
  misc_feature 1..196: note = chr22:18923386-18923582
  misc_feature 1..196: note = Hyper
  source 1..196: mol_type = genomic DNA

SEQ ID NO: 120878 - DNA, 116 bp, Homo sapiens; identical to SEQ ID NO: 89092
  misc_feature 1..116: note = chr22:18958033-18958149
  misc_feature 1..116: note = Hyper
  source 1..116: mol_type = genomic DNA

SEQ ID NO: 120879 - DNA, 209 bp, Homo sapiens; identical to SEQ ID NO: 89093
  misc_feature 1..209: note = chr22:18986543-18986752
  misc_feature 1..209: note = Hyper
  source 1..209: mol_type = genomic DNA

SEQ ID NO: 120880 - DNA, 30 bp, Homo sapiens; identical to SEQ ID NO: 89094
  misc_feature 1..30: note = chr22:19011932-19011962
  misc_feature 1..30: note = Hypo
  source 1..30: mol_type = genomic DNA

SEQ ID NO: 120881 - DNA, 760 bp, Homo sapiens; identical to SEQ ID NO: 89095
  misc_feature 1..760: note = chr22:19016838-19017598
  misc_feature 1..760: note = Hyper
  source 1..760: mol_type = genomic DNA

SEQ ID NO: 120882 - DNA, 166 bp, Homo sapiens; identical to SEQ ID NO: 89096
  misc_feature 1..166: note = chr22:19020499-19020665
  misc_feature 1..166: note = Hypo
  source 1..166: mol_type = genomic DNA

SEQ ID NO: 120883 - DNA, 42 bp, Homo sapiens; identical to SEQ ID NO: 89097
  misc_feature 1..42: note = chr22:19030399-19030441
  misc_feature 1..42: note = Hypo
  source 1..42: mol_type = genomic DNA

SEQ ID NO: 120884 - DNA, 45 bp, Homo sapiens; identical to SEQ ID NO: 89098
  misc_feature 1..45: note = chr22:19048344-19048389
  misc_feature 1..45: note = Hypo
  source 1..45: mol_type = genomic DNA

SEQ ID NO: 120885 - DNA, 139 bp, Homo sapiens; identical to SEQ ID NO: 46619
  misc_feature 1..139: note = chr22:19117537-19117676
  misc_feature 1..139: note = Hypo
  source 1..139: mol_type = genomic DNA

SEQ ID NO: 120886 - DNA, 30 bp, Homo sapiens; identical to SEQ ID NO: 89100
  misc_feature 1..30: note = chr22:19125886-19125916
  misc_feature 1..30: note = Hypo
  source 1..30: mol_type = genomic DNA

SEQ ID NO: 120887 - DNA, 80 bp, Homo sapiens; identical to SEQ ID NO: 89101
  misc_feature 1..80: note = chr22:19132825-19132905
  misc_feature 1..80: note = Hypo
  source 1..80: mol_type = genomic DNA

SEQ ID NO: 120888 - DNA, 56 bp, Homo sapiens; identical to SEQ ID NO: 89102
  misc_feature 1..56: note = chr22:19444363-19444419
  misc_feature 1..56: note = Hypo
  source 1..56: mol_type = genomic DNA

SEQ ID NO: 120889 - DNA, 1678 bp, Homo sapiens
  misc_feature 1..1678: note = chr22:19510749-19512427
  misc_feature 1..1678: note = Hyper
  source 1..1678: mol_type = genomic DNA
ctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaa

SEQ ID NO: 120890 - DNA, 499 bp, Homo sapiens
  misc_feature 1..499: note = chr22:19706198-19706697
  misc_feature 1..499: note = Hyper
  source 1..499: mol_type = genomic DNA
ctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggc

SEQ ID NO: 120891 - DNA, 202 bp, Homo sapiens
  misc_feature 1..202: note = chr22:19711085-19711287
  misc_feature 1..202: note = Hyper
  source 1..202: mol_type = genomic DNA
tctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggct

SEQ ID NO: 120892 - DNA, 262 bp, Homo sapiens
  misc_feature 1..262: note = chr22:19711690-19711952
  misc_feature 1..262: note = Hyper
  source 1..262: mol_type = genomic DNA
gagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgc

SEQ ID NO: 120893 - DNA, 49 bp, Homo sapiens; identical to SEQ ID NO: 89111
  misc_feature 1..49: note = chr22:19723403-19723452
  misc_feature 1..49: note = Hypo
  source 1..49: mol_type = genomic DNA

SEQ ID NO: 120894 - DNA, 30 bp, Homo sapiens; identical to SEQ ID NO: 89112
  misc_feature 1..30: note = chr22:19726569-19726599
  misc_feature 1..30: note = Hypo
  source 1..30: mol_type = genomic DNA

SEQ ID NO: 120895 - DNA, 379 bp, Homo sapiens
  misc_feature 1..379: note = chr22:19742613-19742992
  misc_feature 1..379: note = Hyper
  source 1..379: mol_type = genomic DNA
ttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcccgctcccgctcctcccccgccacccccgcccgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggaggga

SEQ ID NO: 120896 - DNA, 37 bp, Homo sapiens; identical to SEQ ID NO: 89115
  misc_feature 1..37: note = chr22:19748231-19748268
  misc_feature 1..37: note = Hyper
  source 1..37: mol_type = genomic DNA

SEQ ID NO: 120897 - DNA, 474 bp, Homo sapiens
  misc_feature 1..474: note = chr22:19748589-19749063
  misc_feature 1..474: note = Hyper
  source 1..474: mol_type = genomic DNA
cgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggtcagggcgcccctccccacgccgcgaccctccccacgtgctgccgccagggctgcgggcctccgcctgatccgcgcgagcggggccgaaagccgggtcgggggcgcggcctggccacctgcgggcccctctgggccccgctgcctccttcgctgttcgccgtcccggctccggcgacagccgcccggcgctcccctcctaacacctatcctccgccggggcgggaggagacggcgcgggccgcacgggaacggcgagga

SEQ ID NO: 120898 - DNA, 219 bp, Homo sapiens; identical to SEQ ID NO: 89118
  misc_feature 1..219: note = chr22:19771670-19771889
  misc_feature 1..219: note = Hypo
  source 1..219: mol_type = genomic DNA

SEQ ID NO: 120899 - DNA, 30 bp, Homo sapiens; identical to SEQ ID NO: 89119
  misc_feature 1..30: note = chr22:19839985-19840015
  misc_feature 1..30: note = Hypo
  source 1..30: mol_type = genomic DNA

SEQ ID NO: 120900 - DNA, 43 bp, Homo sapiens; identical to SEQ ID NO: 89120
  misc_feature 1..43: note = chr22:19856455-19856498
  misc_feature 1..43: note = Hypo
  source 1..43: mol_type = genomic DNA

SEQ ID NO: 120901 - DNA, 47 bp, Homo sapiens; identical to SEQ ID NO: 89121
  misc_feature 1..47: note = chr22:19876172-19876219
  misc_feature 1..47: note = Hypo
  source 1..47: mol_type = genomic DNA

SEQ ID NO: 120902 - DNA, 30 bp, Homo sapiens; identical to SEQ ID NO: 89122
  misc_feature 1..30: note = chr22:19951604-19951634
  misc_feature 1..30: note = Hypo
  source 1..30: mol_type = genomic DNA

SEQ ID NO: 120903 - DNA, 38 bp, Homo sapiens; identical to SEQ ID NO: 89123
  misc_feature 1..38: note = chr22:19961683-19961721
  misc_feature 1..38: note = Hypo
  source 1..38: mol_type = genomic DNA

SEQ ID NO: 120904 - DNA, 155 bp, Homo sapiens; identical to SEQ ID NO: 89124
  misc_feature 1..155: note = chr22:19964966-19965121
  misc_feature 1..155: note = Hypo
  source 1..155: mol_type = genomic DNA

SEQ ID NO: 120905 - DNA, 71 bp, Homo sapiens; identical to SEQ ID NO: 89125
  misc_feature 1..71: note = chr22:19970544-19970615
  misc_feature 1..71: note = Hypo
  source 1..71: mol_type = genomic DNA

SEQ ID NO: 120906 - DNA, 142 bp, Homo sapiens; identical to SEQ ID NO: 89126
  misc_feature 1..142: note = chr22:20027370-20027512
  misc_feature 1..142: note = Hypo
  source 1..142: mol_type = genomic DNA

SEQ ID NO: 120907 - DNA, 121 bp, Homo sapiens; identical to SEQ ID NO: 89127
  misc_feature 1..121: note = chr22:20027900-20028021
  misc_feature 1..121: note = Hypo
  source 1..121: mol_type = genomic DNA

SEQ ID NO: 120908 - DNA, 30 bp, Homo sapiens; identical to SEQ ID NO: 89128
  misc_feature 1..30: note = chr22:20108065-20108095
  misc_feature 1..30: note = Hypo
  source 1..30: mol_type = genomic DNA

SEQ ID NO: 120909 - DNA, 42 bp, Homo sapiens; identical to SEQ ID NO: 89129
  misc_feature 1..42: note = chr22:20137019-20137061
  misc_feature 1..42: note = Hypo
  source 1..42: mol_type = genomic DNA

SEQ ID NO: 120910 - DNA, 151 bp, Homo sapiens; identical to SEQ ID NO: 46623
  misc_feature 1..151: note = chr22:20166058-20166209
  misc_feature 1..151: note = Hypo
  source 1..151: mol_type = genomic DNA

SEQ ID NO: 120911 - DNA, 44 bp, Homo sapiens; identical to SEQ ID NO: 89131
  misc_feature 1..44: note = chr22:20254350-20254394
  misc_feature 1..44: note = Hypo
  source 1..44: mol_type = genomic DNA

SEQ ID NO: 120912 - DNA, 217 bp, Homo sapiens; identical to SEQ ID NO: 89132
  misc_feature 1..217: note = chr22:20271994-20272211
  misc_feature 1..217: note = Hypo
  source 1..217: mol_type = genomic DNA

SEQ ID NO: 120913 - DNA, 30 bp, Homo sapiens; identical to SEQ ID NO: 89133
  misc_feature 1..30: note = chr22:20285993-20286023
  misc_feature 1..30: note = Hypo
  source 1..30: mol_type = genomic DNA

SEQ ID NO: 120914 - DNA, 30 bp, Homo sapiens; identical to SEQ ID NO: 89134
  misc_feature 1..30: note = chr22:20287662-20287692
  misc_feature 1..30: note = Hyper
  source 1..30: mol_type = genomic DNA

SEQ ID NO: 120915 - DNA, 79 bp, Homo sapiens; identical to SEQ ID NO: 89135
  misc_feature 1..79: note = chr22:20295969-20296048
  misc_feature 1..79: note = Hypo
  source 1..79: mol_type = genomic DNA

SEQ ID NO: 120916 - DNA, 86 bp, Homo sapiens; identical to SEQ ID NO: 89136
  misc_feature 1..86: note = chr22:20308760-20308846
  misc_feature 1..86: note = Hypo
  source 1..86: mol_type = genomic DNA

SEQ ID NO: 120917 - DNA, 42 bp, Homo sapiens; identical to SEQ ID NO: 89137
  misc_feature 1..42: note = chr22:20749361-20749403
  misc_feature 1..42: note = Hypo
  source 1..42: mol_type = genomic DNA

SEQ ID NO: 120918 - DNA, 23 bp, Homo sapiens
  misc_feature 1..23: note = chr22:20765466-20765489
  misc_feature 1..23: note = Hypo
  source 1..23: mol_type = genomic DNA
aacatgaacggctgggcacagcc

SEQ ID NO: 120919 - DNA, 2041 bp, Homo sapiens
  misc_feature 1..2041: note = chr22:20790558-20792599
  misc_feature 1..2041: note = Hyper
  source 1..2041: mol_type = genomic DNA
gctagagcctggcaccggacccccattcctggtcccgggcctgtctgggaaagagggctggagtgagtagacagagaccacggcgatcgcgccctccccctctccaggcaccgccccgcccgccgccgccgctgcattcctggggccggggaggcccgggagtccgcggcggcggcatcgatgcgaagcagatggcgggccaggccggcccccgccccggaggcggggctcgcagcggggaggggtctgcgcgcctccggaccagagttcggaaaccccgcgctgccccctcgcagccccttgtctctggcgccgagcccctggactcggcttgccccgggtccgtggctcaggcgccccgacgcgacccagctcggagcccggcggccgcctctgcggctgccagcccgtgcggcgtctccaatccgcgccaaggcgcccccacacgcccgctcctcacccctgcgtggagatgcccttgaccttgtggcctttggccagcccaccggctcccccgaccccagctcctaactcctggcgtccggggctcacctctctgccctccgtgcaaactcccggactcgcccccccaccggccgggcctgtcgcctgcctgtcccacactggcttccccagccggcgccccacatttgcgcggccccttcttgcacccagaatccccacctggttgtcgccagggttcccacatcctccggtcccctgtgcctgtcatagtccttccgcctcccgcttctggtccacttcgagcgccggctcctcgacgctcgcctgggtcaccaccctcccacccgcgcccgctctaagacgcgaatctgtctttccaagtctggcttgctccaggacctccccggctagcaccgctcctcctcccctgaccttcctcctcactcccactcccggctccagtcggactagtgcggggctttagcacatgcagttcctttggcttgaatgcccttccccagcttttccccgtggacttcacaactcggtcaagggtccctttttccaggtctttcctgatatcccggacaacgcgtgtcatcccctgggtgcccacggcactccatcctcccctcaggtgacttctcgtccagggttccctgggatgcactgtcgtggcccatggccgaggctgggcctggaacggagccgcgctggctagggagccgaaggggcccacacttggcgtaggaaggttccggtagccccctcccaatgcccggcgccgccacaccactgcccagagcgtccctctcgccccctcccccagccaggccggctcctacccgggagcacggcacacgttgcggccgcgagggttcagttcctgaggcgccacggtgtccggcagcatccagagcagcagcagcagcagcagcgacggcagcagcggtgacggcggccccccggctccccggcgccgcgccggcccggccccccggggccctgcgccctccatgaggcgcggggcaggcgcggggcgggcacgggcgcgggtgcggccgcagcgagagcggccggaagcggagtgcgaggccgggcggggggcggcaggaggggcgccgagccgggcaggaaattccacatcggctccctgatcccgggccagccgcggccggccaggcggcagcgcccgccccgcgctccagaccccaccctccggcctagccaccgcccctccgcgcagcccccgcccccatttggccgctcgcaaacttgggggcgaacttggaggaggcccgccgagcgctggtggagggagggtccgcccgaggaatccccggttcccgcgcctttccctccgctccctagacatctaccgaagcagccgcccctgcgcgcccactgcgtaggccaggcccgggacgggaaggcggatcggggacacggacgcgactccgcaagcccacccccgctcccagcgcctcggaaccggccaagggagtggggcccgcagacagcccaggtcgaggccgaaagccaactccacagcaccccaccgcgaagtccttgtagt

SEQ ID NO: 120920 - DNA, 40 bp, Homo sapiens; identical to SEQ ID NO: 89141
  misc_feature 1..40: note = chr22:20851270-20851310
  misc_feature 1..40: note = Hypo
  source 1..40: mol_type = genomic DNA

SEQ ID NO: 120921 - DNA, 88 bp, Homo sapiens; identical to SEQ ID NO: 89142
  misc_feature 1..88: note = chr22:20864327-20864415
  misc_feature 1..88: note = Hypo
  source 1..88: mol_type = genomic DNA

SEQ ID NO: 120922 - DNA, 147 bp, Homo sapiens; identical to SEQ ID NO: 89143
  misc_feature 1..147: note = chr22:20864655-20864802
  misc_feature 1..147: note = Hypo
  source 1..147: mol_type = genomic DNA

SEQ ID NO: 120923 - DNA, 92 bp, Homo sapiens; identical to SEQ ID NO: 89144
  misc_feature 1..92: note = chr22:20933768-20933860
  misc_feature 1..92: note = Hypo
  source 1..92: mol_type = genomic DNA

SEQ ID NO: 120924 - DNA, 30 bp, Homo sapiens; identical to SEQ ID NO: 89145
  misc_feature 1..30: note = chr22:21011807-21011837
  misc_feature 1..30: note = Hypo
  source 1..30: mol_type = genomic DNA

SEQ ID NO: 120925 - DNA, 46 bp, Homo sapiens; identical to SEQ ID NO: 89146
  misc_feature 1..46: note = chr22:21024902-21024948
  misc_feature 1..46: note = Hypo
  source 1..46: mol_type = genomic DNA

SEQ ID NO: 120926 - DNA, 84 bp, Homo sapiens; identical to SEQ ID NO: 89147
  misc_feature 1..84: note = chr22:21058566-21058650
  misc_feature 1..84: note = Hyper
  source 1..84: mol_type = genomic DNA

SEQ ID NO: 120927 - DNA, 149 bp, Homo sapiens; identical to SEQ ID NO: 89148
  misc_feature 1..149: note = chr22:21105244-21105393
  misc_feature 1..149: note = Hypo
  source 1..149: mol_type = genomic DNA

SEQ ID NO: 120928 - DNA, 30 bp, Homo sapiens; identical to SEQ ID NO: 46630
  misc_feature 1..30: note = chr22:21150528-21150558
  misc_feature 1..30: note = Hypo
  source 1..30: mol_type = genomic DNA

SEQ ID NO: 120929 - DNA, 30 bp, Homo sapiens; identical to SEQ ID NO: 46631
  misc_feature 1..30: note = chr22:21153993-21154023
  misc_feature 1..30: note = Hypo
  source 1..30: mol_type = genomic DNA

SEQ ID NO: 120930 - DNA, 91 bp, Homo sapiens; identical to SEQ ID NO: 46632
  misc_feature 1..91: note = chr22:21214252-21214343
  misc_feature 1..91: note = Hypo
  source 1..91: mol_type = genomic DNA

SEQ ID NO: 120931 - DNA, 29 bp, Homo sapiens
  misc_feature 1..29: note = chr22:21304978-21305007
  misc_feature 1..29: note = Hypo
  source 1..29: mol_type = genomic DNA
gccgtgagccgccgcgcctggcctagact

SEQ ID NO: 120932 - DNA, 592 bp, Homo sapiens; identical to SEQ ID NO: 89153
  misc_feature 1..592: note = chr22:21311370-21311962
  misc_feature 1..592: note = Hyper
  source 1..592: mol_type = genomic DNA

SEQ ID NO: 120933 - DNA, 32 bp, Homo sapiens; identical to SEQ ID NO: 38476
  misc_feature 1..32: note = chr22:21319163-21319195
  misc_feature 1..32: note = Hyper
  source 1..32: mol_type = genomic DNA

SEQ ID NO: 120934 - DNA, 306 bp, Homo sapiens; identical to SEQ ID NO: 89155
  misc_feature 1..306: note = chr22:21319585-21319891
  misc_feature 1..306: note = Hyper
  source 1..306: mol_type = genomic DNA

SEQ ID NO: 120935 - DNA, 276 bp, Homo sapiens; identical to SEQ ID NO: 89156
  misc_feature 1..276: note = chr22:21333740-21334016
  misc_feature 1..276: note = Hyper
  source 1..276: mol_type = genomic DNA

SEQ ID NO: 120936 - DNA, 260 bp, Homo sapiens; identical to SEQ ID NO: 89157
  misc_feature 1..260: note = chr22:21354214-21354474
  misc_feature 1..260: note = Hypo
  source 1..260: mol_type = genomic DNA

SEQ ID NO: 120937 - DNA, 396 bp, Homo sapiens
  misc_feature 1..396: note = chr22:21368301-21368697
  misc_feature 1..396: note = Hyper
  source 1..396: mol_type = genomic DNA
ctcccacaacccctgcgggagaagcccccaaggggaggagacgggcctggcccctgccccgagcaccttccgtctctaggtcggagtctgaatcggccttgggaccctgcttggcttcggggacccctgcaagacgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtgggcggagtctgcggctgcgctgaccaatcgagtgtggcgtccatcgactggcgtctgccacggcaattagcgacgcgctcccccgcggcggtcgccccggcaacccagtgct

SEQ ID NO: 120938 - DNA, 63 bp, Homo sapiens; identical to SEQ ID NO: 89160
  misc_feature 1..63: note = chr22:21380295-21380358
  misc_feature 1..63: note = Hypo
  source 1..63: mol_type = genomic DNA

SEQ ID NO: 120939 - DNA, 434 bp, Homo sapiens
  misc_feature 1..434: note = chr22:21386579-21387013
  misc_feature 1..434: note = Hyper
  source 1..434: mol_type = genomic DNA
acagacagacagtggcggctacatacacccccgcccctgcacccgtggccaggctggggtatccgcgcgccaggcggaatgcaggggcgccctgggcccgcacacctccccatgtccgacacgccgctgctgctagagcctgctccgccgcgcccccgtccccggacacctgcgccttcgcctgttcttgggcctgagcccgtcccagtccccgtccccgcaggatctgctgcaacccacctgctgctgccgcagccgctgcctccgctctgagcactgagcccgcccagttcgccggcgccgagcgcagggcccgcccccatcccaggccccccgcgcggccccacccgctgccacacacccagatatttcaccctgcccactctgcccgacctcgcaaggtcgttaccggagctcaccggggtctagggaag

SEQ ID NO: 120940 - DNA, 240 bp, Homo sapiens; identical to SEQ ID NO: 89163
  misc_feature 1..240: note = chr22:21400043-21400283
  misc_feature 1..240: note = Hyper
  source 1..240: mol_type = genomic DNA

SEQ ID NO: 120941 - DNA, 30 bp, Homo sapiens; identical to SEQ ID NO: 89164
  misc_feature 1..30: note = chr22:21805390-21805420
  misc_feature 1..30: note = Hypo
  source 1..30: mol_type = genomic DNA

SEQ ID NO: 120942 - DNA, 30 bp, Homo sapiens
  misc_feature 1..30: note = chr22:21823907-21823937
  misc_feature 1..30: note = Hyper
  source 1..30: mol_type = genomic DNA
ggtgcgtgctgggcgcgctgcaggtgctgc

SEQ ID NO: 120943 - DNA, 30 bp, Homo sapiens; identical to SEQ ID NO: 89165
  misc_feature 1..30: note = chr22:21945402-21945432
  misc_feature 1..30: note = Hypo
  source 1..30: mol_type = genomic DNA

SEQ ID NO: 120944 - DNA, 45 bp, Homo sapiens; identical to SEQ ID NO: 89166
  misc_feature 1..45: note = chr22:21977345-21977390
  misc_feature 1..45: note = Hypo
  source 1..45: mol_type = genomic DNA

SEQ ID NO: 120945 - DNA, 36 bp, Homo sapiens; identical to SEQ ID NO: 89167
  misc_feature 1..36: note = chr22:21978264-21978300
  misc_feature 1..36: note = Hypo
  source 1..36: mol_type = genomic DNA

SEQ ID NO: 120946 - DNA, 249 bp, Homo sapiens; identical to SEQ ID NO: 89168
  misc_feature 1..249: note = chr22:21982792-21983041
  misc_feature 1..249: note = Hypo
  source 1..249: mol_type = genomic DNA

SEQ ID NO: 120947 - DNA, 144 bp, Homo sapiens; identical to SEQ ID NO: 89169
  misc_feature 1..144: note = chr22:21986687-21986831
  misc_feature 1..144: note = Hypo
  source 1..144: mol_type = genomic DNA

SEQ ID NO: 120948 - DNA, 20 bp, Homo sapiens
  misc_feature 1..20: note = chr22:21992966-21992986
  misc_feature 1..20: note = Hypo
  source 1..20: mol_type = genomic DNA
attaacggcatgagcaactg

SEQ ID NO: 120949 - DNA, 50 bp, Homo sapiens; identical to SEQ ID NO: 89171
  misc_feature 1..50: note = chr22:22006098-22006148
  misc_feature 1..50: note = Hyper
  source 1..50: mol_type = genomic DNA

SEQ ID NO: 120950 - DNA, 30 bp, Homo sapiens; identical to SEQ ID NO: 89172
  misc_feature 1..30: note = chr22:22036143-22036173
  misc_feature 1..30: note = Hypo
  source 1..30: mol_type = genomic DNA

SEQ ID NO: 120951 - DNA, 333 bp, Homo sapiens; identical to SEQ ID NO: 89173
  misc_feature 1..333: note = chr22:22058076-22058409
  misc_feature 1..333: note = Hypo
  source 1..333: mol_type = genomic DNA

SEQ ID NO: 120952 - DNA, 201 bp, Homo sapiens
  misc_feature 1..201: note = chr22:22090541-22090742
  misc_feature 1..201: note = Hyper
  source 1..201: mol_type = genomic DNA
gctgaggcgagcttgcgcgcagcctcctcgtccagcgccgtgcacgtaccgcccgtccgcgcggtcggccgcgttgtaggggacggacgtggaggccgaggcgagcttgtgtgcgcctgaccagggcccgccttggccggacccctccgcggccgggtccccagaatgcggtcgtccgtgctgtcccgtccccaccaccct

SEQ ID NO: 120953 - DNA, 30 bp, Homo sapiens; identical to SEQ ID NO: 89174
  misc_feature 1..30: note = chr22:22272279-22272309
  misc_feature 1..30: note = Hypo
  source 1..30: mol_type = genomic DNA

SEQ ID NO: 120954 - DNA, 30 bp, Homo sapiens; identical to SEQ ID NO: 46637
  misc_feature 1..30: note = chr22:22344036-22344066
  misc_feature 1..30: note = Hypo
  source 1..30: mol_type = genomic DNA

SEQ ID NO: 120955 - DNA, 699 bp, Homo sapiens
  misc_feature 1..699: note = chr22:22862608-22863307
  misc_feature 1..699: note = Hyper
  source 1..699: mol_type = genomic DNA
tttaaatacattgagcgccaaaagagaccccgcgggggcgatgggggaggggagcgcactgggagccaggaaaggccccttctccaggaggcccgggcccagcccgggggtgggggcgtctgcgtgagggagtggaggctgatgtaaaagtggcgcccgctgagattagggaagggggtgtgcgtgaggggatcgtgggacctggttctgccctgcactcccccacagaaagcggctgtattgcaaaggccgctccggcagcgcacggccaagcgcggtgtcgcgacccgcagggctgcggctcgccatgaaatccctcaagtctcccctcagggaacgctgaagccgcgccacgcccccgtccttaccagtccggatcagctgctgttcgcgagctgccggccacgcaccagccccggaggcgctcccggggcacagccggcggcgactacgcctcctcaggcccccggcgccgccgacgcgcacgcctccacacgcgcgcgtccagtggagacctgcgattggctgccaggtgccggcgcgagatcggcgcggctccgagctaggagcatgcgcgcgctctgacgcccctggtggcgacggctggacgcggggttaaattgagaaggaggagggcagcagcaatacccctgaggccttgaaaggatcttgggttccggatcacggttccaggcagtc

SEQ ID NO: 120956 - DNA, 379 bp, Homo sapiens; identical to SEQ ID NO: 89178
  misc_feature 1..379: note = chr22:22899599-22899978
  misc_feature 1..379: note = Hypo
  source 1..379: mol_type = genomic DNA

SEQ ID NO: 120957 - DNA, 350 bp, Homo sapiens; identical to SEQ ID NO: 89179
  misc_feature 1..350: note = chr22:22901105-22901455
  misc_feature 1..350: note = Hypo
  source 1..350: mol_type = genomic DNA

SEQ ID NO: 120958 - DNA, 30 bp, Homo sapiens; identical to SEQ ID NO: 89180
  misc_feature 1..30: note = chr22:23017536-23017566
  misc_feature 1..30: note = Hypo
  source 1..30: mol_type = genomic DNA

SEQ ID NO: 120959 - DNA, 55 bp, Homo sapiens; identical to SEQ ID NO: 89181
  misc_feature 1..55: note = chr22:23437576-23437631
  misc_feature 1..55: note = Hypo
  source 1..55: mol_type = genomic DNA

SEQ ID NO: 120960 - DNA, 170 bp, Homo sapiens; identical to SEQ ID NO: 89182
  misc_feature 1..170: note = chr22:23453131-23453301
  misc_feature 1..170: note = Hypo
  source 1..170: mol_type = genomic DNA

SEQ ID NO: 120961 - DNA, 104 bp, Homo sapiens; identical to SEQ ID NO: 89183
  misc_feature 1..104: note = chr22:23791402-23791506
  misc_feature 1..104: note = Hypo
  source 1..104: mol_type = genomic DNA

SEQ ID NO: 120962 - DNA, 30 bp, Homo sapiens; identical to SEQ ID NO: 89184
  misc_feature 1..30: note = chr22:23792721-23792751
  misc_feature 1..30: note = Hypo
  source 1..30: mol_type = genomic DNA

SEQ ID NO: 120963 - DNA, 30 bp, Homo sapiens; identical to SEQ ID NO: 89185
  misc_feature 1..30: note = chr22:23800930-23800960
  misc_feature 1..30: note = Hypo
  source 1..30: mol_type = genomic DNA

SEQ ID NO: 120964 - DNA, 30 bp, Homo sapiens; identical to SEQ ID NO: 89186
  misc_feature 1..30: note = chr22:23801462-23801492
  misc_feature 1..30: note = Hypo
  source 1..30: mol_type = genomic DNA

SEQ ID NO: 120965 - DNA, 168 bp, Homo sapiens; identical to SEQ ID NO: 89187
  misc_feature 1..168: note = chr22:23860776-23860944
  misc_feature 1..168: note = Hypo
  source 1..168: mol_type = genomic DNA

SEQ ID NO: 120966 - DNA, 215 bp, Homo sapiens; identical to SEQ ID NO: 89188
  misc_feature 1..215: note = chr22:23908072-23908287
  misc_feature 1..215: note = Hyper
  source 1..215: mol_type = genomic DNA

SEQ ID NO: 120967 - DNA, 355 bp, Homo sapiens; identical to SEQ ID NO: 89189
  misc_feature 1..355: note = chr22:23908599-23908954
  misc_feature 1..355: note = Hyper
  source 1..355: mol_type = genomic DNA

SEQ ID NO: 120968 - DNA, 126 bp, Homo sapiens; identical to SEQ ID NO: 89190
  misc_feature 1..126: note = chr22:23915557-23915683
  misc_feature 1..126: note = Hypo
  source 1..126: mol_type = genomic DNA

SEQ ID NO: 120969 - DNA, 28 bp, Homo sapiens
  misc_feature 1..28: note = chr22:24091898-24091926
  misc_feature 1..28: note = Hypo
  source 1..28: mol_type = genomic DNA
gcgtgagccccctcgcccagccctaaag

SEQ ID NO: 120970 - DNA, 1205 bp, Homo sapiens
  misc_feature 1..1205: note = chr22:24180522-24181727
  misc_feature 1..1205: note = Hyper
  source 1..1205: mol_type = genomic DNA
cctgcgggaaggatacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccggcctctctcccagcccggccggcctgccctccacccagcccgtgtccgcagggcgcaggatacacgaagagcatgttgaagaagaagctgaatcccaggggcccgaagaagaggaagttggtgacgagcctccagacctacgggggacgggcggtcaggtgcggggtgggtgggtcgggcccacaggtgcgcggcgcggggcggcctcacctggaacttccggaacacaaggtgcgggttgaagtagagttgaaaggggctgaggagctccagctgctgtggaaccaggggccagtcaagagctgcccgggagccacgccgtaaccatggcgaccctcacccctcccgccagaggctgtaaccaaggcgacgtccggtccgcccggccgcttaccaccgcggcggtggtgaggacacaggctgcggtgtaagcccgcgtcaccgccggcacctgcaggaactcggccgctagtccctgccacgccattgaaccttctcaagcacgcgtggcccagccagcaacgcgctctttaacccgcctcccagccccgccttcggccaatccgcatccgaggcgctgcgcgccccaggctgaaaagagagcccctgagcccgacagccaatggaaggaagaagagggaaattaggggcggaaagggagagtgggcgggtagaggctggtggccaatgggcaggcgccaaggttgagcacgtggcggttgttgtggctgcggtggtggcgcgggagaacgtgtggccaatgaggaactggtcatttcgcggctttctaggagaggaccagtagcgtggacccacgacaccacgggggcggggctaagatcgtatgggttacaggagcgaagacccgagcaggcgaggcaaaactggaaagggcggggcgcgtgggcggggcgcggagtgtggcggctcagaccgtgctggctcactaactgacgacctagccacaacgttgtcctcgctgccagcccaagacaggcccacctaacccacagcagggaggcattcgggaatgtgtccaa

SEQ ID NO: 120971 - DNA, 223 bp, Homo sapiens; identical to SEQ ID NO: 89194
  misc_feature 1..223: note = chr22:24209104-24209327
  misc_feature 1..223: note = Hypo
  source 1..223: mol_type = genomic DNA

SEQ ID NO: 120972 - DNA, 30 bp, Homo sapiens; identical to SEQ ID NO: 89195
  misc_feature 1..30: note = chr22:24224775-24224805
  misc_feature 1..30: note = Hypo
  source 1..30: mol_type = genomic DNA

SEQ ID NO: 120973 - DNA, 155 bp, Homo sapiens; identical to SEQ ID NO: 89196
  misc_feature 1..155: note = chr22:24238113-24238268
  misc_feature 1..155: note = Hypo
  source 1..155: mol_type = genomic DNA

SEQ ID NO: 120974 - DNA, 1280 bp, Homo sapiens; identical to SEQ ID NO: 89197
  misc_feature 1..1280: note = chr22:24551644-24552924
  misc_feature 1..1280: note = Hyper
  source 1..1280: mol_type = genomic DNA

SEQ ID NO: 120975 - DNA, 34 bp, Homo sapiens; identical to SEQ ID NO: 46644
  misc_feature 1..34: note = chr22:24560385-24560419
  misc_feature 1..34: note = Hypo
  source 1..34: mol_type = genomic DNA

SEQ ID NO: 120976 - DNA, 110 bp, Homo sapiens; identical to SEQ ID NO: 89199
  misc_feature 1..110: note = chr22:24580134-24580244
  misc_feature 1..110: note = Hypo
  source 1..110: mol_type = genomic DNA

SEQ ID NO: 120977 - DNA, 84 bp, Homo sapiens; identical to SEQ ID NO: 89200
  misc_feature 1..84: note = chr22:24646515-24646599
  misc_feature 1..84: note = Hypo
  source 1..84: mol_type = genomic DNA

SEQ ID NO: 120978 - DNA, 30 bp, Homo sapiens; identical to SEQ ID NO: 89201
  misc_feature 1..30: note = chr22:24721228-24721258
  misc_feature 1..30: note = Hyper
  source 1..30: mol_type = genomic DNA

SEQ ID NO: 120979 - DNA, 412 bp, Homo sapiens; identical to SEQ ID NO: 89202
  misc_feature 1..412: note = chr22:24820074-24820486
  misc_feature 1..412: note = Hyper
  source 1..412: mol_type = genomic DNA

SEQ ID NO: 120980 - DNA, 30 bp, Homo sapiens; identical to SEQ ID NO: 89203
  misc_feature 1..30: note = chr22:24985165-24985195
  misc_feature 1..30: note = Hypo
  source 1..30: mol_type = genomic DNA

SEQ ID NO: 120981 - DNA, 30 bp, Homo sapiens; identical to SEQ ID NO: 46646
  misc_feature 1..30: note = chr22:25091239-25091269
  misc_feature 1..30: note = Hypo
  source 1..30: mol_type = genomic DNA

SEQ ID NO: 120982 - DNA, 21 bp, Homo sapiens
  misc_feature 1..21: note = chr22:25171155-25171176
  misc_feature 1..21: note = Hypo
  source 1..21: mol_type = genomic DNA
tcctcacgtggaagagtggaa

SEQ ID NO: 120983 - DNA, 30 bp, Homo sapiens; identical to SEQ ID NO: 89206
  misc_feature 1..30: note = chr22:25297771-25297801
  misc_feature 1..30: note = Hypo
  source 1..30: mol_type = genomic DNA

SEQ ID NO: 120984 - DNA, 30 bp, Homo sapiens; identical to SEQ ID NO: 89207
  misc_feature 1..30: note = chr22:25339267-25339297
  misc_feature 1..30: note = Hypo
  source 1..30: mol_type = genomic DNA

SEQ ID NO: 120985 - DNA, 43 bp, Homo sapiens; identical to SEQ ID NO: 89208
  misc_feature 1..43: note = chr22:25348442-25348485
  misc_feature 1..43: note = Hyper
  source 1..43: mol_type = genomic DNA

SEQ ID NO: 120986 - DNA, 76 bp, Homo sapiens; identical to SEQ ID NO: 89209
  misc_feature 1..76: note = chr22:25349272-25349348
  misc_feature 1..76: note = Hyper
  source 1..76: mol_type = genomic DNA

SEQ ID NO: 120987 - DNA, 36 bp, Homo sapiens; identical to SEQ ID NO: 89210
  misc_feature 1..36: note = chr22:25458444-25458480
  misc_feature 1..36: note = Hyper
  source 1..36: mol_type = genomic DNA

SEQ ID NO: 120988 - DNA, 1219 bp, Homo sapiens
  misc_feature 1..1219: note = chr22:25678246-25679465
  misc_feature 1..1219: note = Hyper
  source 1..1219: mol_type = genomic DNA
cttcatcattacctgcggggacaggtgggacacatgcatttccggggtcatcccagacctcctggaggatgctgattgatgctgtcccgtttgagaactactgtgtccaggtagcagaggcctccccgatgccccttgagtagtgggcacggggcccagggcttctctggatgagctgggcgggcatgagaacgcatggagctgggggcaggaggtcggagcagcgaacgaggaggagaaggagtaggcggaggccgaaggagaggtgggggaggaagaagaggaggaggaggagtcccttgtggccaccccgaagggagggagggctaccgtagagacttggtcgagaggcgcgggacaagcctggccgctgggactgtgcgctgaggtgcaccgaccgtcgggccgcgagctccccgcagaccctcgcggaatgagctggggggcggcgcgcgaggcggcggagcggaaggcgcactgcgaccccggcgggctacagcctgcggcgcttgcagggcgctggtggggcgcgccgagcaggggctgccctggggctgccccagtcccaccaggtcggggctcagctggcggcggcggcggcggtggcggcagcgcgtcccatccgggtccgagtaaccgccgccgccgccaaaactcgccaacgtggcggacccggaggctgtgctggcagatgccagttacctgatggccatggagaagagcaaggcgactccggccgcccgcgccagcaagaggaccgtcctgcccgatcccaggtaccagctgccccggcccgcgctggtccccacgccgccgtccccaagcggccgtcagcgacctcctgcgtccgggagggtcgggcattgagtcgtcgctgtcctgggtgcgggtgacaccgcggaactggcgatgcggggccggcctccccgttccagtctctgaaatggggcatcggatggccggtgggggggactccgggagagagcgctccaaagtgcccagcgcggcgccctgcgcgcagcgagcgccccagggaggggctggttatgacttggctggaccagctccatccctgtcgccccctccccccggccctgtcctgtcctgtcccatccccgtggttcttcctgttgcattggtgtggtccctgtgggctcgttgcctgtcactcctttgcgctccttcttggtcgctgcttcttccccggctctgtggtccc

SEQ ID NO: 120989 - DNA, 867 bp, Homo sapiens; identical to SEQ ID NO: 89215
  misc_feature 1..867: note = chr22:25816871-25817738
  misc_feature 1..867: note = Hyper
  source 1..867: mol_type = genomic DNA

SEQ ID NO: 120990 - DNA, 210 bp, Homo sapiens; identical to SEQ ID NO: 89216
  misc_feature 1..210: note = chr22:26124910-26125120
  misc_feature 1..210: note = Hypo
  source 1..210: mol_type = genomic DNA

SEQ ID NO: 120991 - DNA, 158 bp, Homo sapiens; identical to SEQ ID NO: 89217
  misc_feature 1..158: note = chr22:26161975-26162133
  misc_feature 1..158: note = Hypo
  source 1..158: mol_type = genomic DNA

SEQ ID NO: 120992 - DNA, 30 bp, Homo sapiens; identical to SEQ ID NO: 89218
  misc_feature 1..30: note = chr22:26238111-26238141
  misc_feature 1..30: note = Hypo
  source 1..30: mol_type = genomic DNA

SEQ ID NO: 120993 - DNA, 30 bp, Homo sapiens; identical to SEQ ID NO: 89219
  misc_feature 1..30: note = chr22:26268171-26268201
  misc_feature 1..30: note = Hypo
  source 1..30: mol_type = genomic DNA

SEQ ID NO: 120994 - DNA, 141 bp, Homo sapiens; identical to SEQ ID NO: 89220
  misc_feature 1..141: note = chr22:26564752-26564893
  misc_feature 1..141: note = Hyper
  source 1..141: mol_type = genomic DNA

SEQ ID NO: 120995 - DNA, 834 bp, Homo sapiens
  misc_feature 1..834: note = chr22:26565165-26565999
  misc_feature 1..834: note = Hyper
  source 1..834: mol_type = genomic DNA
cagagctgctgggagcgtcagcagggagagaaaacgctcggctcccaggacgcaaggggaattggcgttaaactttgcagggccgacgggccggcggccagaggaggcggctggcacccccggcgccgccgcggcccctccagctcactgcccgctcgcccgccccctccctccctgcactcgctcggcacagactcggccccagccccctccctcctcccgctcgctccacgctcgttcgctcgctcgccggctcctcctcactcgcccgcccgcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgaggtaagcgccccgaggggcggggcgggcagggggcaaagttgccgggagagcggggcagccaggggtcggggctgaccagggcgactcaggcaccacccgccgggatgggaagcggtggtggctgtccaaaatcggggctaggaaccgcacgtccccttggcccgggctgatgggagtgtggaggcggggatgtgttgaaggactcgggcgcttccctgcttcggctgcgggctccctttcggtcttccccggctgcggggctgattctcc

SEQ ID NO: 120996 - DNA, 32 bp, Homo sapiens; identical to SEQ ID NO: 89224
  misc_feature 1..32: note = chr22:26738332-26738364
  misc_feature 1..32: note = Hypo
  source 1..32: mol_type = genomic DNA

SEQ ID NO: 120997 - DNA, 30 bp, Homo sapiens; identical to SEQ ID NO: 46648
  misc_feature 1..30: note = chr22:26763231-26763261
  misc_feature 1..30: note = Hypo
  source 1..30: mol_type = genomic DNA

SEQ ID NO: 120998 - DNA, 46 bp, Homo sapiens; identical to SEQ ID NO: 89226
  misc_feature 1..46: note = chr22:26848744-26848790
  misc_feature 1..46: note = Hypo
  source 1..46: mol_type = genomic DNA

SEQ ID NO: 120999 - DNA, 192 bp, Homo sapiens; identical to SEQ ID NO: 89227
  misc_feature 1..192: note = chr22:26930338-26930530
  misc_feature 1..192: note = Hypo
  source 1..192: mol_type = genomic DNA

SEQ ID NO: 121000 - DNA, 38 bp, Homo sapiens; identical to SEQ ID NO: 46649
  misc_feature 1..38: note = chr22:26932483-26932521
  misc_feature 1..38: note = Hypo
  source 1..38: mol_type = genomic DNA

SEQ ID NO: 121001 - DNA, 28 bp, Homo sapiens
  misc_feature 1..28: note = chr22:26965177-26965205
  misc_feature 1..28: note = Hypo
  source 1..28: mol_type = genomic DNA
tggatcgggaccccgttccagtaacagt

SEQ ID NO: 121002 - DNA, 21 bp, Homo sapiens
  misc_feature 1..21: note = chr22:26991250-26991271
  misc_feature 1..21: note = Hypo
  source 1..21: mol_type = genomic DNA
gcctgtgaggccaggcgcagt

SEQ ID NO: 121003 - DNA, 30 bp, Homo sapiens; identical to SEQ ID NO: 89231
  misc_feature 1..30: note = chr22:26997870-26997900
  misc_feature 1..30: note = Hypo
  source 1..30: mol_type = genomic DNA

SEQ ID NO: 121004 - DNA, 78 bp, Homo sapiens; identical to SEQ ID NO: 89232
  misc_feature 1..78: note = chr22:26998743-26998821
  misc_feature 1..78: note = Hypo
  source 1..78: mol_type = genomic DNA

SEQ ID NO: 121005 - DNA, 50 bp, Homo sapiens; identical to SEQ ID NO: 89233
  misc_feature 1..50: note = chr22:27007819-27007869
  misc_feature 1..50: note = Hypo
  source 1..50: mol_type = genomic DNA

SEQ ID NO: 121006 - DNA, 20 bp, Homo sapiens
  misc_feature 1..20: note = chr22:27010657-27010677
  misc_feature 1..20: note = Hypo
  source 1..20: mol_type = genomic DNA
taaaaacaagtaaatcggcc

SEQ ID NO: 121007 - DNA, 80 bp, Homo sapiens; identical to SEQ ID NO: 89235
  misc_feature 1..80: note = chr22:27019215-27019295
  misc_feature 1..80: note = Hypo
  source 1..80: mol_type = genomic DNA

SEQ ID NO: 121008 - DNA, 154 bp, Homo sapiens; identical to SEQ ID NO: 89236
  misc_feature 1..154: note = chr22:27045844-27045998
  misc_feature 1..154: note = Hypo
  source 1..154: mol_type = genomic DNA

SEQ ID NO: 121009 - DNA, 511 bp, Homo sapiens; identical to SEQ ID NO: 89237
  misc_feature 1..511: note = chr22:27053517-27054028
  misc_feature 1..511: note = Hyper
  source 1..511: mol_type = genomic DNA

SEQ ID NO: 121010 - DNA, 317 bp, Homo sapiens; identical to SEQ ID NO: 89238
  misc_feature 1..317: note = chr22:27068921-27069238
  misc_feature 1..317: note = Hyper
  source 1..317: mol_type = genomic DNA

SEQ ID NO: 121011 - DNA, 30 bp, Homo sapiens; identical to SEQ ID NO: 89239
  misc_feature 1..30: note = chr22:27299019-27299049
  misc_feature 1..30: note = Hyper
  source 1..30: mol_type = genomic DNA

SEQ ID NO: 121012 - DNA, 33 bp, Homo sapiens; identical to SEQ ID NO: 89240
  misc_feature 1..33: note = chr22:27299656-27299689
  misc_feature 1..33: note = Hyper
  source 1..33: mol_type = genomic DNA

SEQ ID NO: 121013 - DNA, 287 bp, Homo sapiens; identical to SEQ ID NO: 89241
  misc_feature 1..287: note = chr22:27695150-27695437
  misc_feature 1..287: note = Hyper
  source 1..287: mol_type = genomic DNA

SEQ ID NO: 121014 - DNA, 30 bp, Homo sapiens; identical to SEQ ID NO: 89242
  misc_feature 1..30: note = chr22:27728029-27728059
  misc_feature 1..30: note = Hyper
  source 1..30: mol_type = genomic DNA

SEQ ID NO: 121015 - DNA, 112 bp, Homo sapiens; identical to SEQ ID NO: 89243
  misc_feature 1..112: note = chr22:28007163-28007275
  misc_feature 1..112: note = Hypo
  source 1..112: mol_type = genomic DNA

SEQ ID NO: 121016 - DNA, 30 bp, Homo sapiens; identical to SEQ ID NO: 89244
  misc_feature 1..30: note = chr22:28017941-28017971
  misc_feature 1..30: note = Hypo
  source 1..30: mol_type = genomic DNA

SEQ ID NO: 121017 - DNA, 30 bp, Homo sapiens; identical to SEQ ID NO: 89245
  misc_feature 1..30: note = chr22:28035016-28035046
  misc_feature 1..30: note = Hypo
  source 1..30: mol_type = genomic DNA

SEQ ID NO: 121018 - DNA, 30 bp, Homo sapiens; identical to SEQ ID NO: 38505
  misc_feature 1..30: note = chr22:28196522-28196552
  misc_feature 1..30: note = Hyper
  source 1..30: mol_type = genomic DNA

SEQ ID NO: 121019 - DNA, 83 bp, Homo sapiens; identical to SEQ ID NO: 89247
  misc_feature 1..83: note = chr22:28196966-28197049
  misc_feature 1..83: note = Hyper
  source 1..83: mol_type = genomic DNA

SEQ ID NO: 121020 - DNA, 1244 bp, Homo sapiens; identical to SEQ ID NO: 89248
  misc_feature 1..1244: note = chr22:28197259-28198503
  misc_feature 1..1244: note = Hyper
  source 1..1244: mol_type = genomic DNA

SEQ ID NO: 121021 - DNA, 220 bp, Homo sapiens; identical to SEQ ID NO: 89249
  misc_feature 1..220: note = chr22:28371504-28371724
  misc_feature 1..220: note = Hypo
  source 1..220: mol_type = genomic DNA

SEQ ID NO: 121022 - DNA, 270 bp, Homo sapiens; identical to SEQ ID NO: 89250
  misc_feature 1..270: note = chr22:28838179-28838449
  misc_feature 1..270: note = Hyper
  source 1..270: mol_type = genomic DNA

SEQ ID NO: 121023 - DNA, 50 bp, Homo sapiens; identical to SEQ ID NO: 38510
  misc_feature 1..50: note = chr22:28838794-28838844
  misc_feature 1..50: note = Hyper
  source 1..50: mol_type = genomic DNA

SEQ ID NO: 121024 - DNA, 813 bp, Homo sapiens; identical to SEQ ID NO: 38511
  misc_feature 1..813: note = chr22:29075406-29076219
  misc_feature 1..813: note = Hyper
  source 1..813: mol_type = genomic DNA

SEQ ID NO: 121025 - DNA, 18 bp, Homo sapiens
  misc_feature 1..18: note = chr22:29167152-29167170
  misc_feature 1..18: note = Hypo
  source 1..18: mol_type = genomic DNA
ccacggagcccagccaaa

SEQ ID NO: 121026 - DNA, 120 bp, Homo sapiens; identical to SEQ ID NO: 89254
  misc_feature 1..120: note = chr22:29167697-29167817
  misc_feature 1..120: note = Hypo
  source 1..120: mol_type = genomic DNA

SEQ ID NO: 121027 - DNA, 30 bp, Homo sapiens; identical to SEQ ID NO: 46657
  misc_feature 1..30: note = chr22:29168256-29168286
  misc_feature 1..30: note = Hypo
  source 1..30: mol_type = genomic DNA

SEQ ID NO: 121028 - DNA, 94 bp, Homo sapiens; identical to SEQ ID NO: 89256
  misc_feature 1..94: note = chr22:29426559-29426653
  misc_feature 1..94: note = Hyper
  source 1..94: mol_type = genomic DNA

SEQ ID NO: 121029 - DNA, 1051 bp, Homo sapiens; identical to SEQ ID NO: 89257
  misc_feature 1..1051: note = chr22:29445592-29446643
  misc_feature 1..1051: note = Hypo
  source 1..1051: mol_type = genomic DNA

SEQ ID NO: 121030 - DNA, 30 bp, Homo sapiens; identical to SEQ ID NO: 89258
  misc_feature 1..30: note = chr22:29467712-29467742
  misc_feature 1..30: note = Hyper
  source 1..30: mol_type = genomic DNA

SEQ ID NO: 121031 - DNA, 106 bp, Homo sapiens; identical to SEQ ID NO: 89259
  misc_feature 1..106: note = chr22:29469954-29470060
  misc_feature 1..106: note = Hyper
  source 1..106: mol_type = genomic DNA

SEQ ID NO: 121032 - DNA, 34 bp, Homo sapiens; identical to SEQ ID NO: 89260
  misc_feature 1..34: note = chr22:29540984-29541018
  misc_feature 1..34: note = Hypo
  source 1..34: mol_type = genomic DNA

SEQ ID NO: 121033 - DNA, 28 bp, Homo sapiens
  misc_feature 1..28: note = chr22:29550679-29550707
  misc_feature 1..28: note = Hyper
  source 1..28: mol_type = genomic DNA
tccattacagttacacggattttttgcc

SEQ ID NO: 121034 - DNA, 45 bp, Homo sapiens; identical to SEQ ID NO: 89262
  misc_feature 1..45: note = chr22:29610336-29610381
  misc_feature 1..45: note = Hypo
  source 1..45: mol_type = genomic DNA

SEQ ID NO: 121035 - DNA, 156 bp, Homo sapiens; identical to SEQ ID NO: 89263
  misc_feature 1..156: note = chr22:29611127-29611283
  misc_feature 1..156: note = Hypo
  source 1..156: mol_type = genomic DNA

SEQ ID NO: 121036 - DNA, 167 bp, Homo sapiens; identical to SEQ ID NO: 89264
  misc_feature 1..167: note = chr22:29616031-29616198
  misc_feature 1..167: note = Hypo
  source 1..167: mol_type = genomic DNA

SEQ ID NO: 121037 - DNA, 22 bp, Homo sapiens
  misc_feature 1..22: note = chr22:29617650-29617672
  misc_feature 1..22: note = Hypo
  source 1..22: mol_type = genomic DNA
ccacgcccggccaggatatgac

SEQ ID NO: 121038 - DNA, 24 bp, Homo sapiens
  misc_feature 1..24: note = chr22:29701029-29701053
  misc_feature 1..24: note = Hypo
  source 1..24: mol_type = genomic DNA
gcgcccggccgggaatgttaagac

SEQ ID NO: 121039 - DNA, 100 bp, Homo sapiens; identical to SEQ ID NO: 89267
  misc_feature 1..100: note = chr22:29709200-29709300
  misc_feature 1..100: note = Hyper
  source 1..100: mol_type = genomic DNA

SEQ ID NO: 121040 - DNA, 37 bp, Homo sapiens; identical to SEQ ID NO: 89268
  misc_feature 1..37: note = chr22:29710305-29710342
  misc_feature 1..37: note = Hyper
  source 1..37: mol_type = genomic DNA

SEQ ID NO: 121041 - DNA, 467 bp, Homo sapiens; identical to SEQ ID NO: 89269
  misc_feature 1..467: note = chr22:29711155-29711622
  misc_feature 1..467: note = Hyper
  source 1..467: mol_type = genomic DNA

SEQ ID NO: 121042 - DNA, 34 bp, Homo sapiens; identical to SEQ ID NO: 89270
  misc_feature 1..34: note = chr22:29736031-29736065
  misc_feature 1..34: note = Hypo
  source 1..34: mol_type = genomic DNA

SEQ ID NO: 121043 - DNA, 149 bp, Homo sapiens; identical to SEQ ID NO: 89271
  misc_feature 1..149: note = chr22:29773804-29773953
  misc_feature 1..149: note = Hypo
  source 1..149: mol_type = genomic DNA

SEQ ID NO: 121044 - DNA, 209 bp, Homo sapiens
  misc_feature 1..209: note = chr22:29875904-29876113
  misc_feature 1..209: note = Hyper
  source 1..209: mol_type = genomic DNA
tcccctttcttattccgaacacactcgcaggctcttccgacgcgcacccgggggtcctcactggcccactccgggagtcctctgcccgcttccccgacctcgagggtctcctctgacgcagcgtcgattccccttccctcctcggtcccctgccccgcccctctcactgcggcggagccggtcggccggggggccgcaggggaggaggc

SEQ ID NO: 121045 - DNA, 669 bp, Homo sapiens; identical to SEQ ID NO: 38516
  misc_feature 1..669: note = chr22:29876916-29877585
  misc_feature 1..669: note = Hyper
  source 1..669: mol_type = genomic DNA

SEQ ID NO: 121046 - DNA, 120 bp, Homo sapiens; identical to SEQ ID NO: 89275
  misc_feature 1..120: note = chr22:29977635-29977755
  misc_feature 1..120: note = Hypo
  source 1..120: mol_type = genomic DNA

SEQ ID NO: 121047 - DNA, 81 bp, Homo sapiens; identical to SEQ ID NO: 89276
  misc_feature 1..81: note = chr22:29977935-29978016
  misc_feature 1..81: note = Hypo
  source 1..81: mol_type = genomic DNA

SEQ ID NO: 121048 - DNA, 24 bp, Homo sapiens
  misc_feature 1..24: note = chr22:29997189-29997213
  misc_feature 1..24: note = Hypo
  source 1..24: mol_type = genomic DNA
cctttttttttgagacggagtctc

SEQ ID NO: 121049 - DNA, 36 bp, Homo sapiens; identical to SEQ ID NO: 46664
  misc_feature 1..36: note = chr22:29998650-29998686
  misc_feature 1..36: note = Hypo
  source 1..36: mol_type = genomic DNA

SEQ ID NO: 121050 - DNA, 30 bp, Homo sapiens; identical to SEQ ID NO: 89279
  misc_feature 1..30: note = chr22:30023357-30023387
  misc_feature 1..30: note = Hypo
  source 1..30: mol_type = genomic DNA

SEQ ID NO: 121051 - DNA, 128 bp, Homo sapiens; identical to SEQ ID NO: 89280
  misc_feature 1..128: note = chr22:30087744-30087872
  misc_feature 1..128: note = Hypo
  source 1..128: mol_type = genomic DNA

SEQ ID NO: 121052 - DNA, 191 bp, Homo sapiens; identical to SEQ ID NO: 89281
  misc_feature 1..191: note = chr22:30091110-30091301
  misc_feature 1..191: note = Hypo
  source 1..191: mol_type = genomic DNA

SEQ ID NO: 121053 - DNA, 1178 bp, Homo sapiens; identical to SEQ ID NO: 89282
  misc_feature 1..1178: note = chr22:30115961-30117139
  misc_feature 1..1178: note = Hyper
  source 1..1178: mol_type = genomic DNA

SEQ ID NO: 121054 - DNA, 35 bp, Homo sapiens; identical to SEQ ID NO: 89283
  misc_feature 1..35: note = chr22:30158330-30158365
  misc_feature 1..35: note = Hypo
  source 1..35: mol_type = genomic DNA

SEQ ID NO: 121055 - DNA, 30 bp, Homo sapiens; identical to SEQ ID NO: 89284
  misc_feature 1..30: note = chr22:30198046-30198076
  misc_feature 1..30: note = Hypo
  source 1..30: mol_type = genomic DNA

SEQ ID NO: 121056 - DNA, 44 bp, Homo sapiens; identical to SEQ ID NO: 89285
  misc_feature 1..44: note = chr22:30233100-30233144
  misc_feature 1..44: note = Hypo
  source 1..44: mol_type = genomic DNA

SEQ ID NO: 121057 - DNA, 24 bp, Homo sapiens
  misc_feature 1..24: note = chr22:30375203-30375227
  misc_feature 1..24: note = Hypo
  source 1..24: mol_type = genomic DNA
aggcgcggtggctcacgcctgtaa

SEQ ID NO: 121058 - DNA, 30 bp, Homo sapiens; identical to SEQ ID NO: 89287
  misc_feature 1..30: note = chr22:30606857-30606887
  misc_feature 1..30: note = Hypo
  source 1..30: mol_type = genomic DNA

SEQ ID NO: 121059 - DNA, 30 bp, Homo sapiens; identical to SEQ ID NO: 89288
  misc_feature 1..30: note = chr22:30634326-30634356
  misc_feature 1..30: note = Hypo
  source 1..30: mol_type = genomic DNA

SEQ ID NO: 121060 - DNA, 99 bp, Homo sapiens; identical to SEQ ID NO: 89289
  misc_feature 1..99: note = chr22:30642585-30642684
  misc_feature 1..99: note = Hyper
  source 1..99: mol_type = genomic DNA

SEQ ID NO: 121061 - DNA, 54 bp, Homo sapiens; identical to SEQ ID NO: 89290
  misc_feature 1..54: note = chr22:30767980-30768034
  misc_feature 1..54: note = Hypo
  source 1..54: mol_type = genomic DNA

SEQ ID NO: 121062 - DNA, 30 bp, Homo sapiens; identical to SEQ ID NO: 89291
  misc_feature 1..30: note = chr22:30769627-30769657
  misc_feature 1..30: note = Hypo
  source 1..30: mol_type = genomic DNA

SEQ ID NO: 121063 - DNA, 102 bp, Homo sapiens; identical to SEQ ID NO: 46669
  misc_feature 1..102: note = chr22:30783894-30783996
  misc_feature 1..102: note = Hypo
  source 1..102: mol_type = genomic DNA

SEQ ID NO: 121064 - DNA, 30 bp, Homo sapiens; identical to SEQ ID NO: 89293
  misc_feature 1..30: note = chr22:30836081-30836111
  misc_feature 1..30: note = Hypo
  source 1..30: mol_type = genomic DNA

SEQ ID NO: 121065 - DNA, 443 bp, Homo sapiens; identical to SEQ ID NO: 89294
  misc_feature 1..443: note = chr22:30857284-30857727
  misc_feature 1..443: note = Hypo
  source 1..443: mol_type = genomic DNA

SEQ ID NO: 121066 - DNA, 30 bp, Homo sapiens; identical to SEQ ID NO: 89295
  misc_feature 1..30: note = chr22:30899622-30899652
  misc_feature 1..30: note = Hypo
  source 1..30: mol_type = genomic DNA

SEQ ID NO: 121067 - DNA, 30 bp, Homo sapiens; identical to SEQ ID NO: 46671
  misc_feature 1..30: note = chr22:30924831-30924861
  misc_feature 1..30: note = Hypo
  source 1..30: mol_type = genomic DNA

SEQ ID NO: 121068 - DNA, 142 bp, Homo sapiens; identical to SEQ ID NO: 89297
  misc_feature 1..142: note = chr22:30926975-30927117
  misc_feature 1..142: note = Hypo
  source 1..142: mol_type = genomic DNA

SEQ ID NO: 121069 - DNA, 630 bp, Homo sapiens
  misc_feature 1..630: note = chr22:30938028-30938658
  misc_feature 1..630: note = Hyper
  source 1..630: mol_type = genomic DNA
cgcgaaagggcaggccggtgggcggggacgcccggctcagaccccgtccccagcctggacctgggccccaccctgcccacaccgcgaccctccccatccgtctcgcgaccctaccagaaagtccactccagcttttccttcacctcggcacggctctgaaaggatcggtcccctccggcccgcacccacccccaagaggggccttcagctttggggctcagaggcacgacctcttggggagggttaaaaggcagacacccccccacccccgcgcctccactccccgactccttcgccgcctccagcctctcgccagtgggaagcgggagtagccgcgcggccggagtccggaggcgaggggaggtcggccgcaacttccccaggccaccttaagaggacgatgtagccagctcgcagcgctgacctcagaaaaacaagtttgcgcaaagtggagcggggacccggcctctgggcagccccggcggcgcttctagtgccttccagccctcgcgggcggcgtagccgcggcccatggagcccgcgggccggtccccggccgcctcgggccgctgctctgcctgctgctccccgcgtcctgcgcctggtcaggagtggcgggtgaggaggagc

SEQ ID NO: 121070 - DNA, 30 bp, Homo sapiens; identical to SEQ ID NO: 46672
  misc_feature 1..30: note = chr22:30940902-30940932
  misc_feature 1..30: note = Hypo
  source 1..30: mol_type = genomic DNA

SEQ ID NO: 121071 - DNA, 19 bp, Homo sapiens
  misc_feature 1..19: note = chr22:30962611-30962630
  misc_feature 1..19: note = Hypo
  source 1..19: mol_type = genomic DNA
cttgagacagagtctcgct

SEQ ID NO: 121072 - DNA, 55 bp, Homo sapiens; identical to SEQ ID NO: 89302
  misc_feature 1..55: note = chr22:31003131-31003186
  misc_feature 1..55: note = Hyper
  source 1..55: mol_type = genomic DNA

SEQ ID NO: 121073 - DNA, 260 bp, Homo sapiens; identical to SEQ ID NO: 89303
  misc_feature 1..260: note = chr22:31198492-31198752
  misc_feature 1..260: note = Hyper
  source 1..260: mol_type = genomic DNA

SEQ ID NO: 121074 - DNA, 702 bp, Homo sapiens; identical to SEQ ID NO: 89304
  misc_feature 1..702: note = chr22:31218244-31218946
  misc_feature 1..702: note = Hyper
  source 1..702: mol_type = genomic DNA

SEQ ID NO: 121075 - DNA, 30 bp, Homo sapiens; identical to SEQ ID NO: 89305
  misc_feature 1..30: note = chr22:31280871-31280901
  misc_feature 1..30: note = Hypo
  source 1..30: mol_type = genomic DNA

SEQ ID NO: 121076 - DNA, 40 bp, Homo sapiens; identical to SEQ ID NO: 89306
  misc_feature 1..40: note = chr22:31317641-31317681
  misc_feature 1..40: note = Hyper
  source 1..40: mol_type = genomic DNA

SEQ ID NO: 121077 - DNA, 30 bp, Homo sapiens; identical to SEQ ID NO: 46673
  misc_feature 1..30: note = chr22:31460423-31460453
  misc_feature 1..30: note = Hypo
  source 1..30: mol_type = genomic DNA

SEQ ID NO: 121078 - DNA, 880 bp, Homo sapiens; identical to SEQ ID NO: 89308
  misc_feature 1..880: note = chr22:31480651-31481531
  misc_feature 1..880: note = Hyper
  source 1..880: mol_type = genomic DNA

SEQ ID NO: 121079 - DNA, 65 bp, Homo sapiens; identical to SEQ ID NO: 89309
  misc_feature 1..65: note = chr22:31494732-31494797
  misc_feature 1..65: note = Hypo
  source 1..65: mol_type = genomic DNA

SEQ ID NO: 121080 - DNA, 140 bp, Homo sapiens; identical to SEQ ID NO: 89310
  misc_feature 1..140: note = chr22:31639212-31639352
  misc_feature 1..140: note = Hypo
  source 1..140: mol_type = genomic DNA

SEQ ID NO: 121081 - DNA, 30 bp, Homo sapiens; identical to SEQ ID NO: 89311
  misc_feature 1..30: note = chr22:32009388-32009418
  misc_feature 1..30: note = Hypo
  source 1..30: mol_type = genomic DNA

SEQ ID NO: 121082 - DNA, 140 bp, Homo sapiens; identical to SEQ ID NO: 89312
  misc_feature 1..140: note = chr22:32014233-32014373
  misc_feature 1..140: note = Hypo
  source 1..140: mol_type = genomic DNA

SEQ ID NO: 121083 - DNA, 68 bp, Homo sapiens; identical to SEQ ID NO: 89313
  misc_feature 1..68: note = chr22:32019687-32019755
  misc_feature 1..68: note = Hypo
  source 1..68: mol_type = genomic DNA

SEQ ID NO: 121084 - DNA, 91 bp, Homo sapiens; identical to SEQ ID NO: 89314
  misc_feature 1..91: note = chr22:32058932-32059023
  misc_feature 1..91: note = Hypo
  source 1..91: mol_type = genomic DNA

SEQ ID NO: 121085 - DNA, 30 bp, Homo sapiens; identical to SEQ ID NO: 89315
  misc_feature 1..30: note = chr22:32059263-32059293
  misc_feature 1..30: note = Hypo
  source 1..30: mol_type = genomic DNA

SEQ ID NO: 121086 - DNA, 39 bp, Homo sapiens; identical to SEQ ID NO: 89316
  misc_feature 1..39: note = chr22:32062176-32062215
  misc_feature 1..39: note = Hypo
  source 1..39: mol_type = genomic DNA

SEQ ID NO: 121087 - DNA, 27 bp, Homo sapiens
  misc_feature 1..27: note = chr22:32356779-32356806
  misc_feature 1..27: note = Hypo
  source 1..27: mol_type = genomic DNA
aaactccgtccccgccccccccccccc

SEQ ID NO: 121088 - DNA, 30 bp, Homo sapiens; identical to SEQ ID NO: 89318
  misc_feature 1..30: note = chr22:32530895-32530925
  misc_feature 1..30: note = Hypo
  source 1..30: mol_type = genomic DNA

SEQ ID NO: 121089 - DNA, 549 bp, Homo sapiens; identical to SEQ ID NO: 89319
  misc_feature 1..549: note = chr22:32571939-32572488
  misc_feature 1..549: note = Hyper
  source 1..549: mol_type = genomic DNA

SEQ ID NO: 121090 - DNA, 30 bp, Homo sapiens; identical to SEQ ID NO: 89320
  misc_feature 1..30: note = chr22:32601764-32601794
  misc_feature 1..30: note = Hypo
  source 1..30: mol_type = genomic DNA

SEQ ID NO: 121091 - DNA, 69 bp, Homo sapiens; identical to SEQ ID NO: 89321
  misc_feature 1..69: note = chr22:32650981-32651050
  misc_feature 1..69: note = Hypo
  source 1..69: mol_type = genomic DNA

SEQ ID NO: 121092 - DNA, 127 bp, Homo sapiens; identical to SEQ ID NO: 89322
  misc_feature 1..127: note = chr22:32667536-32667663
  misc_feature 1..127: note = Hypo
  source 1..127: mol_type = genomic DNA

SEQ ID NO: 121093 - DNA, 119 bp, Homo sapiens; identical to SEQ ID NO: 89323
  misc_feature 1..119: note = chr22:32701637-32701756
  misc_feature 1..119: note = Hypo
  source 1..119: mol_type = genomic DNA

SEQ ID NO: 121094 - DNA, 86 bp, Homo sapiens; identical to SEQ ID NO: 89324
  misc_feature 1..86: note = chr22:32748880-32748966
  misc_feature 1..86: note = Hypo
  source 1..86: mol_type = genomic DNA

SEQ ID NO: 121095 - DNA, 164 bp, Homo sapiens; identical to SEQ ID NO: 89325
  misc_feature 1..164: note = chr22:32958084-32958248
  misc_feature 1..164: note = Hypo
  source 1..164: mol_type = genomic DNA

SEQ ID NO: 121096 - DNA, 24 bp, Homo sapiens
  misc_feature 1..24: note = chr22:33170623-33170647
  misc_feature 1..24: note = Hypo
  source 1..24: mol_type = genomic DNA
gctggagtgcaatggcgcacgatc

SEQ ID NO: 121097 - DNA, 988 bp, Homo sapiens; identical to SEQ ID NO: 89327
  misc_feature 1..988: note = chr22:33197384-33198372
  misc_feature 1..988: note = Hyper
  source 1..988: mol_type = genomic DNA

SEQ ID NO: 121098 - DNA, 185 bp, Homo sapiens; identical to SEQ ID NO: 89328
  misc_feature 1..185: note = chr22:33255195-33255380
  misc_feature 1..185: note = Hypo
  source 1..185: mol_type = genomic DNA

SEQ ID NO: 121099 - DNA, 78 bp, Homo sapiens; identical to SEQ ID NO: 89329
  misc_feature 1..78: note = chr22:33286634-33286712
  misc_feature 1..78: note = Hypo
  source 1..78: mol_type = genomic DNA

SEQ ID NO: 121100 - DNA, 30 bp, Homo sapiens; identical to SEQ ID NO: 89330
  misc_feature 1..30: note = chr22:33355598-33355628
  misc_feature 1..30: note = Hypo
  source 1..30: mol_type = genomic DNA

SEQ ID NO: 121101 - DNA, 628 bp, Homo sapiens
  misc_feature 1..628: note = chr22:33453877-33454505
  misc_feature 1..628: note = Hyper
  source 1..628: mol_type = genomic DNA
gcaggtcctaggagccggcgcagagcagaggtccggccgctgcggttcctggtttcccgcaagctcttccccgggccgggcgctgggtggaggcagtcttaggatccacagtcttgcgcgcccccggctcccgggcccggcagacggcccccgcacgccgatctgtctgtcccagggaccggcccagggccccggcagcggcagcctggggagacaccgtggtgcgcggctccttgcctccctccctgcccctccgtgcgcccgcatcccgcggacacagagccggagctccaggggacgcagcccgacgcgagaacgcaccagcagcccccgctcgaggtggggtctcccggctgtcagaaaccccacaaagtctactttgcggcgccgcgccgcttaccgtgcgagccgccaggaactcggcgcccggtggtgcctcggcgcggcgcccgccagtcgatccgctccgggtcccgggagctcagcctctgcccctcaacgcgcgcgagcgcccccgcccggcggcccggcctccccgcgccgcggcgccccattggctcgggcaacgaggcccccggacggccccgcccacccgcgcccactccctcgcccacgcctctccccaacg

SEQ ID NO: 121102 - DNA, 44 bp, Homo sapiens; identical to SEQ ID NO: 89335
  misc_feature 1..44: note = chr22:33492816-33492860
  misc_feature 1..44: note = Hypo
  source 1..44: mol_type = genomic DNA

SEQ ID NO: 121103 - DNA, 42 bp, Homo sapiens; identical to SEQ ID NO: 89336
  misc_feature 1..42: note = chr22:33716477-33716519
  misc_feature 1..42: note = Hypo
  source 1..42: mol_type = genomic DNA

SEQ ID NO: 121104 - DNA, 30 bp, Homo sapiens; identical to SEQ ID NO: 89337
  misc_feature 1..30: note = chr22:35292274-35292304
  misc_feature 1..30: note = Hypo
  source 1..30: mol_type = genomic DNA

SEQ ID NO: 121105 - DNA, 30 bp, Homo sapiens; identical to SEQ ID NO: 89338
  misc_feature 1..30: note = chr22:35321014-35321044
  misc_feature 1..30: note = Hypo
  source 1..30: mol_type = genomic DNA

SEQ ID NO: 121106 - DNA, 109 bp, Homo sapiens; identical to SEQ ID NO: 89339
  misc_feature 1..109: note = chr22:35420206-35420315
  misc_feature 1..109: note = Hyper
  source 1..109: mol_type = genomic DNA

SEQ ID NO: 121107 - DNA, 98 bp, Homo sapiens; identical to SEQ ID NO: 89340
  misc_feature 1..98: note = chr22:35652867-35652965
  misc_feature 1..98: note = Hypo
  source 1..98: mol_type = genomic DNA

SEQ ID NO: 121108 - DNA, 42 bp, Homo sapiens; identical to SEQ ID NO: 89341
  misc_feature 1..42: note = chr22:35768487-35768529
  misc_feature 1..42: note = Hypo
  source 1..42: mol_type = genomic DNA

SEQ ID NO: 121109 - DNA, 96 bp, Homo sapiens; identical to SEQ ID NO: 46682
  misc_feature 1..96: note = chr22:35822686-35822782
  misc_feature 1..96: note = Hypo
  source 1..96: mol_type = genomic DNA

SEQ ID NO: 121110 - DNA, 30 bp, Homo sapiens; identical to SEQ ID NO: 89343
  misc_feature 1..30: note = chr22:35827951-35827981
  misc_feature 1..30: note = Hypo
  source 1..30: mol_type = genomic DNA

SEQ ID NO: 121111 - DNA, 64 bp, Homo sapiens; identical to SEQ ID NO: 46683
  misc_feature 1..64: note = chr22:35848324-35848388
  misc_feature 1..64: note = Hypo
  source 1..64: mol_type = genomic DNA

SEQ ID NO: 121112 - DNA, 27 bp, Homo sapiens
  misc_feature 1..27: note = chr22:35853047-35853074
  misc_feature 1..27: note = Hypo
  source 1..27: mol_type = genomic DNA
tttccagctgcccgtgctccttgagtt

SEQ ID NO: 121113 - DNA, 30 bp, Homo sapiens; identical to SEQ ID NO: 46684
  misc_feature 1..30: note = chr22:35964914-35964944
  misc_feature 1..30: note = Hypo
  source 1..30: mol_type = genomic DNA

SEQ ID NO: 121114 - DNA, 39 bp, Homo sapiens; identical to SEQ ID NO: 89347
  misc_feature 1..39: note = chr22:36246196-36246235
  misc_feature 1..39: note = Hypo
  source 1..39: mol_type = genomic DNA

SEQ ID NO: 121115 - DNA, 99 bp, Homo sapiens; identical to SEQ ID NO: 89348
  misc_feature 1..99: note = chr22:36246295-36246394
  misc_feature 1..99: note = Hypo
  source 1..99: mol_type = genomic DNA

SEQ ID NO: 121116 - DNA, 175 bp, Homo sapiens; identical to SEQ ID NO: 89349
  misc_feature 1..175: note = chr22:36553193-36553368
  misc_feature 1..175: note = Hyper
  source 1..175: mol_type = genomic DNA

SEQ ID NO: 121117 - DNA, 42 bp, Homo sapiens; identical to SEQ ID NO: 89350
  misc_feature 1..42: note = chr22:36566759-36566801
  misc_feature 1..42: note = Hypo
  source 1..42: mol_type = genomic DNA

SEQ ID NO: 121118 - DNA, 42 bp, Homo sapiens; identical to SEQ ID NO: 89351
  misc_feature 1..42: note = chr22:36569398-36569440
  misc_feature 1..42: note = Hypo
  source 1..42: mol_type = genomic DNA

SEQ ID NO: 121119 - DNA, 101 bp, Homo sapiens; identical to SEQ ID NO: 89352
  misc_feature 1..101: note = chr22:36585930-36586031
  misc_feature 1..101: note = Hypo
  source 1..101: mol_type = genomic DNA

SEQ ID NO: 121120 - DNA, 30 bp, Homo sapiens; identical to SEQ ID NO: 89353
  misc_feature 1..30: note = chr22:36632925-36632955
  misc_feature 1..30: note = Hypo
  source 1..30: mol_type = genomic DNA

SEQ ID NO: 121121 - DNA, 247 bp, Homo sapiens; identical to SEQ ID NO: 89354
  misc_feature 1..247: note = chr22:36684196-36684443
  misc_feature 1..247: note = Hypo
  source 1..247: mol_type = genomic DNA

SEQ ID NO: 121122 - DNA, 30 bp, Homo sapiens; identical to SEQ ID NO: 89355
  misc_feature 1..30: note = chr22:36707722-36707752
  misc_feature 1..30: note = Hypo
  source 1..30: mol_type = genomic DNA

SEQ ID NO: 121123 - DNA, 30 bp, Homo sapiens; identical to SEQ ID NO: 89356
  misc_feature 1..30: note = chr22:36721819-36721849
  misc_feature 1..30: note = Hypo
  source 1..30: mol_type = genomic DNA

SEQ ID NO: 121124 - DNA, 30 bp, Homo sapiens; identical to SEQ ID NO: 38534
  misc_feature 1..30: note = chr22:36726916-36726946
  misc_feature 1..30: note = Hyper
  source 1..30: mol_type = genomic DNA

SEQ ID NO: 121125 - DNA, 30 bp, Homo sapiens; identical to SEQ ID NO: 89358
  misc_feature 1..30: note = chr22:36795040-36795070
  misc_feature 1..30: note = Hypo
  source 1..30: mol_type = genomic DNA

SEQ ID NO: 121126 - DNA, 39 bp, Homo sapiens; identical to SEQ ID NO: 89359
  misc_feature 1..39: note = chr22:36848073-36848112
  misc_feature 1..39: note = Hyper
  source 1..39: mol_type = genomic DNA

SEQ ID NO: 121127 - DNA, 221 bp, Homo sapiens; identical to SEQ ID NO: 89360
  misc_feature 1..221: note = chr22:36851867-36852088
  misc_feature 1..221: note = Hypo
  source 1..221: mol_type = genomic DNA

SEQ ID NO: 121128 - DNA, 30 bp, Homo sapiens; identical to SEQ ID NO: 89361
  misc_feature 1..30: note = chr22:36860909-36860939
  misc_feature 1..30: note = Hypo
  source 1..30: mol_type = genomic DNA

SEQ ID NO: 121129 - DNA, 30 bp, Homo sapiens; identical to SEQ ID NO: 16776
  misc_feature 1..30: note = chr22:36878964-36878994
  misc_feature 1..30: note = Hypo
  source 1..30: mol_type = genomic DNA

SEQ ID NO: 121130 - DNA, 764 bp, Homo sapiens; identical to SEQ ID NO: 89363
  misc_feature 1..764: note = chr22:36901801-36902565
  misc_feature 1..764: note = Hypo
  source 1..764: mol_type = genomic DNA

SEQ ID NO: 121131 - DNA, 41 bp, Homo sapiens; identical to SEQ ID NO: 46691
  misc_feature 1..41: note = chr22:36906156-36906197
  misc_feature 1..41: note = Hypo
  source 1..41: mol_type = genomic DNA

SEQ ID NO: 121132 - DNA, 637 bp, Homo sapiens; identical to SEQ ID NO: 89365
  misc_feature 1..637: note = chr22:37099142-37099779
  misc_feature 1..637: note = Hyper
  source 1..637: mol_type = genomic DNA

SEQ ID NO: 121133 - DNA, 30 bp, Homo sapiens; identical to SEQ ID NO: 89366
  misc_feature 1..30: note = chr22:37121549-37121579
  misc_feature 1..30: note = Hypo
  source 1..30: mol_type = genomic DNA

SEQ ID NO: 121134 - DNA, 492 bp, Homo sapiens
  misc_feature 1..492: note = chr22:37212414-37212906
  misc_feature 1..492: note = Hyper
  source 1..492: mol_type = genomic DNA
gcactgaggatgccccgtgcgggcttaggcagagctgtgcgccggctccagaaggtcacctcgcccgcaggtccgttgctgaatctcagtaaaggaactaggacagtcagggggccaacaaaggctaccgcctggcgggaaaagtcctgtccagaatgagggtccaggaaaggggtctcttggagaggaggatgccccctgcagtcccctctaagtgccttaaagaggacgtccagagagctcgtacaaggaccctggaggtctctcctccgaccctggtcttcgcccttggtcccggaccctgagtcctcccagccaccgggccttcagcaccctcaagtttctgtaacttaggcggggcgccctcttccccgcccgctccccgcgccaagcctcgcccggacagagtttgggaactgccaaggacgcccccgccccgacctcgccggcgcccagcgggaagtgtgggcagaagcgcgctggggaggatcc

SEQ ID NO: 121135 - DNA, 179 bp, Homo sapiens; identical to SEQ ID NO: 89369
  misc_feature 1..179: note = chr22:37213140-37213319
  misc_feature 1..179: note = Hyper
  source 1..179: mol_type = genomic DNA

SEQ ID NO: 121136 - DNA, 26 bp, Homo sapiens
  misc_feature 1..26: note = chr22:37285265-37285291
  misc_feature 1..26: note = Hypo
  source 1..26: mol_type = genomic DNA
aagtactattcatgccgggcgcggtg

SEQ ID NO: 121137 - DNA, 30 bp, Homo sapiens; identical to SEQ ID NO: 89371
  misc_feature 1..30: note = chr22:37285909-37285939
  misc_feature 1..30: note = Hypo
  source 1..30: mol_type = genomic DNA

SEQ ID NO: 121138 - DNA, 153 bp, Homo sapiens; identical to SEQ ID NO: 89372
  misc_feature 1..153: note = chr22:37321872-37322025
  misc_feature 1..153: note = Hypo
  source 1..153: mol_type = genomic DNA

SEQ ID NO: 121139 - DNA, 173 bp, Homo sapiens; identical to SEQ ID NO: 89373
  misc_feature 1..173: note = chr22:37328730-37328903
  misc_feature 1..173: note = Hypo
  source 1..173: mol_type = genomic DNA

SEQ ID NO: 121140 - DNA, 46 bp, Homo sapiens; identical to SEQ ID NO: 89374
  misc_feature 1..46: note = chr22:37329983-37330029
  misc_feature 1..46: note = Hypo
  source 1..46: mol_type = genomic DNA

SEQ ID NO: 121141 - DNA, 239 bp, Homo sapiens; identical to SEQ ID NO: 89375
  misc_feature 1..239: note = chr22:37334157-37334396
  misc_feature 1..239: note = Hypo
  source 1..239: mol_type = genomic DNA

SEQ ID NO: 121142 - DNA, 50 bp, Homo sapiens; identical to SEQ ID NO: 46695
  misc_feature 1..50: note = chr22:37335158-37335208
  misc_feature 1..50: note = Hypo
  source 1..50: mol_type = genomic DNA

SEQ ID NO: 121143 - DNA, 115 bp, Homo sapiens; identical to SEQ ID NO: 89377
  misc_feature 1..115: note = chr22:37348877-37348992
  misc_feature 1..115: note = Hypo
  source 1..115: mol_type = genomic DNA

SEQ ID NO: 121144 - DNA, 83 bp, Homo sapiens; identical to SEQ ID NO: 89378
  misc_feature 1..83: note = chr22:37367478-37367561
  misc_feature 1..83: note = Hypo
  source 1..83: mol_type = genomic DNA

SEQ ID NO: 121145 - DNA, 30 bp, Homo sapiens; identical to SEQ ID NO: 46698
  misc_feature 1..30: note = chr22:37367799-37367829
  misc_feature 1..30: note = Hypo
  source 1..30: mol_type = genomic DNA

SEQ ID NO: 121146 - DNA, 30 bp, Homo sapiens; identical to SEQ ID NO: 89380
  misc_feature 1..30: note = chr22:37377170-37377200
  misc_feature 1..30: note = Hypo
  source 1..30: mol_type = genomic DNA

SEQ ID NO: 121147 - DNA, 20 bp, Homo sapiens
  misc_feature 1..20: note = chr22:37389811-37389831
  misc_feature 1..20: note = Hypo
  source 1..20: mol_type = genomic DNA
gaaaacgaaaaataagatca

SEQ ID NO: 121148 - DNA, 30 bp, Homo sapiens; identical to SEQ ID NO: 89382
  misc_feature 1..30: note = chr22:37395703-37395733
  misc_feature 1..30: note = Hypo
  source 1..30: mol_type = genomic DNA

SEQ ID NO: 121149 - DNA, 30 bp, Homo sapiens; identical to SEQ ID NO: 46699
  misc_feature 1..30: note = chr22:37395982-37396012
  misc_feature 1..30: note = Hypo
  source 1..30: mol_type = genomic DNA

SEQ ID NO: 121150 - DNA, 30 bp, Homo sapiens; identical to SEQ ID NO: 89384
  misc_feature 1..30: note = chr22:37411386-37411416
  misc_feature 1..30: note = Hypo
  source 1..30: mol_type = genomic DNA

SEQ ID NO: 121151 - DNA, 164 bp, Homo sapiens; identical to SEQ ID NO: 89385
  misc_feature 1..164: note = chr22:37483725-37483889
  misc_feature 1..164: note = Hypo
  source 1..164: mol_type = genomic DNA

SEQ ID NO: 121152 - DNA, 30 bp, Homo sapiens; identical to SEQ ID NO: 89386
  misc_feature 1..30: note = chr22:37507640-37507670
  misc_feature 1..30: note = Hypo
  source 1..30: mol_type = genomic DNA

SEQ ID NO: 121153 - DNA, 30 bp, Homo sapiens; identical to SEQ ID NO: 89387
  misc_feature 1..30: note = chr22:37578241-37578271
  misc_feature 1..30: note = Hypo
  source 1..30: mol_type = genomic DNA

SEQ ID NO: 121154 - DNA, 30 bp, Homo sapiens; identical to SEQ ID NO: 89388
  misc_feature 1..30: note = chr22:37610830-37610860
  misc_feature 1..30: note = Hypo
  source 1..30: mol_type = genomic DNA

SEQ ID NO: 121155 - DNA, 30 bp, Homo sapiens; identical to SEQ ID NO: 89389
  misc_feature 1..30: note = chr22:37646399-37646429
  misc_feature 1..30: note = Hypo
  source 1..30: mol_type = genomic DNA

SEQ ID NO: 121156 - DNA, 821 bp, Homo sapiens
  misc_feature 1..821: note = chr22:37730457-37731278
  misc_feature 1..821: note = Hyper
  source 1..821: mol_type = genomic DNA
tacaggtgagcaaagcgcggctcgggaaggtagctcctgccggaatggagcagaaacgtctcggctgggaatcgaacccagggtcagtcagtagcggccgcgttttaggacccggcggtgcaccgaagacccggcggaacggcgcgcaccccgggcccagagctcattagccgggcgccgcgggggccttcattaaagctcagcgacgcggaggctgcccgcggcggccccgcctgggcgctccgggctggcccggacctgcggcgtcggcccaggagcatctggaaagggggcgcgggcggggatcggtaggaccgcctatgctcagggactgtcacccaccccctcccccaagccaaggagtagcggggaaggggggcgagtgcacccaggtattggggggagcatcaaatcggagtggagggggccggtgtcaccgagctatccccaaacctcgaacggccaaggccgagtcacccccgccccacccccacacactatgcacccatttcacagatggcaggtcctagctcagagggttagggcaggcccagaaccgcatcgccatcgcccgttcgcaggcctgattgagaggctggaaacgaggatgggcagggagtgaggacctgtaggctctgccggagaacttgggcgtgggcggagcggggcatccaggaagaagcccccaccccagccttggatagggtagtatacgatagggggcgtaaagaagggtcatgggctccggtggtcgcaggtcccaccggcaaccgccagggcgggggcagcaggagcaggaacctgctcgcctccgcatctcg

SEQ ID NO: 121157 - DNA, 30 bp, Homo sapiens; identical to SEQ ID NO: 89392
  misc_feature 1..30: note = chr22:37734363-37734393
  misc_feature 1..30: note = Hypo
  source 1..30: mol_type = genomic DNA

SEQ ID NO: 121158 - DNA, 30 bp, Homo sapiens; identical to SEQ ID NO: 89393
  misc_feature 1..30: note = chr22:37742873-37742903
  misc_feature 1..30: note = Hypo
  source 1..30: mol_type = genomic DNA

SEQ ID NO: 121159 - DNA, 30 bp, Homo sapiens; identical to SEQ ID NO: 89394
  misc_feature 1..30: note = chr22:37769281-37769311
  misc_feature 1..30: note = Hypo
  source 1..30: mol_type = genomic DNA

SEQ ID NO: 121160 - DNA, 78 bp, Homo sapiens; identical to SEQ ID NO: 89395
  misc_feature 1..78: note = chr22:37769566-37769644
  misc_feature 1..78: note = Hypo
  source 1..78: mol_type = genomic DNA

SEQ ID NO: 121161 - DNA, 117 bp, Homo sapiens; identical to SEQ ID NO: 89396
  misc_feature 1..117: note = chr22:37769882-37769999
  misc_feature 1..117: note = Hypo
  source 1..117: mol_type = genomic DNA

SEQ ID NO: 121162 - DNA, 30 bp, Homo sapiens; identical to SEQ ID NO: 46700
  misc_feature 1..30: note = chr22:37770782-37770812
  misc_feature 1..30: note = Hypo
  source 1..30: mol_type = genomic DNA

SEQ ID NO: 121163 - DNA, 318 bp, Homo sapiens; identical to SEQ ID NO: 89398
  misc_feature 1..318: note = chr22:37816014-37816332
  misc_feature 1..318: note = Hyper
  source 1..318: mol_type = genomic DNA

SEQ ID NO: 121164 - DNA, 35 bp, Homo sapiens; identical to SEQ ID NO: 89399
  misc_feature 1..35: note = chr22:37816789-37816824
  misc_feature 1..35: note = Hyper
  source 1..35: mol_type = genomic DNA

SEQ ID NO: 121165 - DNA, 30 bp, Homo sapiens; identical to SEQ ID NO: 89400
  misc_feature 1..30: note = chr22:37823354-37823384
  misc_feature 1..30: note = Hyper
  source 1..30: mol_type = genomic DNA

SEQ ID NO: 121166 - DNA, 356 bp, Homo sapiens; identical to SEQ ID NO: 89401
  misc_feature 1..356: note = chr22:37823590-37823946
  misc_feature 1..356: note = Hyper
  source 1..356: mol_type = genomic DNA

SEQ ID NO: 121167 - DNA, 30 bp, Homo sapiens; identical to SEQ ID NO: 89402
  misc_feature 1..30: note = chr22:37845091-37845121
  misc_feature 1..30: note = Hypo
  source 1..30: mol_type = genomic DNA

SEQ ID NO: 121168 - DNA, 54 bp, Homo sapiens; identical to SEQ ID NO: 89403
  misc_feature 1..54: note = chr22:37914879-37914933
  misc_feature 1..54: note = Hyper
  source 1..54: mol_type = genomic DNA

SEQ ID NO: 121169 - DNA, 97 bp, Homo sapiens; identical to SEQ ID NO: 89404
  misc_feature 1..97: note = chr22:38002842-38002939
  misc_feature 1..97: note = Hypo
  source 1..97: mol_type = genomic DNA

SEQ ID NO: 121170 - DNA, 30 bp, Homo sapiens; identical to SEQ ID NO: 89405
  misc_feature 1..30: note = chr22:38030040-38030070
  misc_feature 1..30: note = Hyper
  source 1..30: mol_type = genomic DNA

SEQ ID NO: 121171 - DNA, 40 bp, Homo sapiens; identical to SEQ ID NO: 89406
  misc_feature 1..40: note = chr22:38064571-38064611
  misc_feature 1..40: note = Hypo
  source 1..40: mol_type = genomic DNA

SEQ ID NO: 121172 - DNA, 82 bp, Homo sapiens; identical to SEQ ID NO: 89407
  misc_feature 1..82: note = chr22:38081717-38081799
  misc_feature 1..82: note = Hypo
  source 1..82: mol_type = genomic DNA

SEQ ID NO: 121173 - DNA, 144 bp, Homo sapiens; identical to SEQ ID NO: 89408
  misc_feature 1..144: note = chr22:38085121-38085265
  misc_feature 1..144: note = Hypo
  source 1..144: mol_type = genomic DNA

SEQ ID NO: 121174 - DNA, 80 bp, Homo sapiens; identical to SEQ ID NO: 89409
  misc_feature 1..80: note = chr22:38122369-38122449
  misc_feature 1..80: note = Hypo
  source 1..80: mol_type = genomic DNA

SEQ ID NO: 121175 - DNA, 30 bp, Homo sapiens; identical to SEQ ID NO: 89410
  misc_feature 1..30: note = chr22:38138874-38138904
  misc_feature 1..30: note = Hypo
  source 1..30: mol_type = genomic DNA

SEQ ID NO: 121176 - DNA, 324 bp, Homo sapiens; identical to SEQ ID NO: 89411
  misc_feature 1..324: note = chr22:38199680-38200004
  misc_feature 1..324: note = Hypo
  source 1..324: mol_type = genomic DNA

SEQ ID NO: 121177 - DNA, 33 bp, Homo sapiens; identical to SEQ ID NO: 89412
  misc_feature 1..33: note = chr22:38214652-38214685
  misc_feature 1..33: note = Hyper
  source 1..33: mol_type = genomic DNA

SEQ ID NO: 121178 - DNA, 772 bp, Homo sapiens; identical to SEQ ID NO: 89413
  misc_feature 1..772: note = chr22:38220595-38221367
  misc_feature 1..772: note = Hyper
  source 1..772: mol_type = genomic DNA

SEQ ID NO: 121179 - DNA, 190 bp, Homo sapiens; identical to SEQ ID NO: 89414
  misc_feature 1..190: note = chr22:38339567-38339757
  misc_feature 1..190: note = Hypo
  source 1..190: mol_type = genomic DNA

SEQ ID NO: 121180 - DNA, 116 bp, Homo sapiens; identical to SEQ ID NO: 89415
  misc_feature 1..116: note = chr22:38380321-38380437
  misc_feature 1..116: note = Hypo
  source 1..116: mol_type = genomic DNA

SEQ ID NO: 121181 - DNA, 30 bp, Homo sapiens; identical to SEQ ID NO: 89416
  misc_feature 1..30: note = chr22:38434976-38435006
  misc_feature 1..30: note = Hypo
  source 1..30: mol_type = genomic DNA

SEQ ID NO: 121182 - DNA, 883 bp, Homo sapiens
  misc_feature 1..883: note = chr22:38476933-38477816
  misc_feature 1..883: note = Hyper
  source 1..883: mol_type = genomic DNA
ccgccatgagcacctcgaactgcagcgcgcccaccatgccgtaggagaggccgaaggcgacgcagaaggcgacgagggcgccgtaggagcgcgcgcgtgcgctgctcaggtctgtgagcccattggccagcagggccaggctgaacagatacgggacgtgcggccgcagacgcgccaggcccgccagggcgccgcacgccgggcgcgccacgatgtccacgaagcccacgatggacagcaggaaggcggcgtcggtgtcgggcacgcccgcgtccttggcgtagttcaccagcaggatggcggggacgaagagcccgagcgccatcaggaacttggtgacggcgtacacggcgaaggcgcggtcggtgcacactgccaagtccagcaggcgccggcggggccggaccctgggggatgcctcgcgcagctgcagccccgcaccgtcagcctccgcctcgcccggagcgtccccggcgcggtcgccggcgctgtccctgcgcggtcgcgggcccggcccgggcggcggcctcatgacagccccgcaggcgcagcagtgcagcaggagcccgccgagcagcaggaagccgccgcgccagccgaagcgctccagcagctgctggccgagcggcgacagcgcggacaggaacacggggctgcccgccgccgccagcccgttggccagaggccgccgccgctcgaagtacagccccagcatgatgagcgacggctggaagttgagggccaggcccaggcctgcgggcgaggcggtgctgtgccggggtccccggagagcccctccctggcccccacaggagggaggggccaggcccgggaacccagcagatccgggaacccagccgagggacttcgaagactgtccctc

SEQ ID NO: 121183 - DNA, 223 bp, Homo sapiens
  misc_feature 1..223: note = chr22:38478409-38478632
  misc_feature 1..223: note = Hyper
  source 1..223: mol_type = genomic DNA
tgcctctacaatgggcgggtgtggtcttagaaggggccctctgagctcgcagggcagccccctgggccggccccgcctctggccgctgtctccctcccgccctctcttcccctctttctggtgccagggttcccacaggcaggaagggacttcgggggccaccccgagggtcagggggatgctcaggggctcgggtgtctcctggttccggatcccaggggtc

SEQ ID NO: 121184 - DNA, 30 bp, Homo sapiens; identical to SEQ ID NO: 89420
  misc_feature 1..30: note = chr22:38482327-38482357
  misc_feature 1..30: note = Hypo
  source 1..30: mol_type = genomic DNA

SEQ ID NO: 121185 - DNA, 47 bp, Homo sapiens; identical to SEQ ID NO: 89421
  misc_feature 1..47: note = chr22:38507636-38507683
  misc_feature 1..47: note = Hypo
  source 1..47: mol_type = genomic DNA

SEQ ID NO: 121186 - DNA, 131 bp, Homo sapiens; identical to SEQ ID NO: 89422
  misc_feature 1..131: note = chr22:38516843-38516974
  misc_feature 1..131: note = Hypo
  source 1..131: mol_type = genomic DNA

SEQ ID NO: 121187 - DNA, 176 bp, Homo sapiens; identical to SEQ ID NO: 89423
  misc_feature 1..176: note = chr22:38520276-38520452
  misc_feature 1..176: note = Hypo
  source 1..176: mol_type = genomic DNA

SEQ ID NO: 121188 - DNA, 84 bp, Homo sapiens; identical to SEQ ID NO: 46704
  misc_feature 1..84: note = chr22:38578330-38578414
  misc_feature 1..84: note = Hypo
  source 1..84: mol_type = genomic DNA

SEQ ID NO: 121189 - DNA, 24 bp, Homo sapiens
  misc_feature 1..24: note = chr22:38578714-38578738
  misc_feature 1..24: note = Hypo
  source 1..24: mol_type = genomic DNA
gcccggctccgaaatttttaacat

SEQ ID NO: 121190 - DNA, 96 bp, Homo sapiens; identical to SEQ ID NO: 89426
  misc_feature 1..96: note = chr22:38592952-38593048
  misc_feature 1..96: note = Hypo
  source 1..96: mol_type = genomic DNA

SEQ ID NO: 121191 - DNA, 30 bp, Homo sapiens; identical to SEQ ID NO: 89427
  misc_feature 1..30: note = chr22:38639203-38639233
  misc_feature 1..30: note = Hypo
  source 1..30: mol_type = genomic DNA

SEQ ID NO: 121192 - DNA, 136 bp, Homo sapiens; identical to SEQ ID NO: 46706
  misc_feature 1..136: note = chr22:38679362-38679498
  misc_feature 1..136: note = Hypo
  source 1..136: mol_type = genomic DNA

SEQ ID NO: 121193 - DNA, 38 bp, Homo sapiens; identical to SEQ ID NO: 89429
  misc_feature 1..38: note = chr22:38687259-38687297
  misc_feature 1..38: note = Hypo
  source 1..38: mol_type = genomic DNA

SEQ ID NO: 121194 - DNA, 148 bp, Homo sapiens; identical to SEQ ID NO: 89430
  misc_feature 1..148: note = chr22:38694445-38694593
  misc_feature 1..148: note = Hypo
  source 1..148: mol_type = genomic DNA

SEQ ID NO: 121195 - DNA, 33 bp, Homo sapiens; identical to SEQ ID NO: 89431
  misc_feature 1..33: note = chr22:38841842-38841875
  misc_feature 1..33: note = Hypo
  source 1..33: mol_type = genomic DNA

SEQ ID NO: 121196 - DNA, 91 bp, Homo sapiens; identical to SEQ ID NO: 89432
  misc_feature 1..91: note = chr22:38843208-38843299
  misc_feature 1..91: note = Hypo
  source 1..91: mol_type = genomic DNA

SEQ ID NO: 121197 - DNA, 547 bp, Homo sapiens; identical to SEQ ID NO: 89433
  misc_feature 1..547: note = chr22:38850751-38851298
  misc_feature 1..547: note = Hyper
  source 1..547: mol_type = genomic DNA

SEQ ID NO: 121198 - DNA, 148 bp, Homo sapiens; identical to SEQ ID NO: 89434
  misc_feature 1..148: note = chr22:38851520-38851668
  misc_feature 1..148: note = Hyper
  source 1..148: mol_type = genomic DNA

SEQ ID NO: 121199 - DNA, 30 bp, Homo sapiens; identical to SEQ ID NO: 89435
  misc_feature 1..30: note = chr22:38864955-38864985
  misc_feature 1..30: note = Hypo
  source 1..30: mol_type = genomic DNA

SEQ ID NO: 121200 - DNA, 138 bp, Homo sapiens; identical to SEQ ID NO: 89436
  misc_feature 1..138: note = chr22:38965908-38966046
  misc_feature 1..138: note = Hyper
  source 1..138: mol_type = genomic DNA

SEQ ID NO: 121201 - DNA, 17 bp, Homo sapiens
  misc_feature 1..17: note = chr22:39097903-39097920
  misc_feature 1..17: note = Hypo
  source 1..17: mol_type = genomic DNA
ttggagacggagtttcg

SEQ ID NO: 121202 - DNA, 39 bp, Homo sapiens; identical to SEQ ID NO: 89438
  misc_feature 1..39: note = chr22:39098887-39098926
  misc_feature 1..39: note = Hypo
  source 1..39: mol_type = genomic DNA

SEQ ID NO: 121203 - DNA, 30 bp, Homo sapiens; identical to SEQ ID NO: 89439
  misc_feature 1..30: note = chr22:39150522-39150552
  misc_feature 1..30: note = Hyper
  source 1..30: mol_type = genomic DNA

SEQ ID NO: 121204 - DNA, 30 bp, Homo sapiens; identical to SEQ ID NO: 89440
  misc_feature 1..30: note = chr22:39227742-39227772
  misc_feature 1..30: note = Hypo
  source 1..30: mol_type = genomic DNA

SEQ ID NO: 121205 - DNA, 30 bp, Homo sapiens; identical to SEQ ID NO: 46709
  misc_feature 1..30: note = chr22:39228205-39228235
  misc_feature 1..30: note = Hypo
  source 1..30: mol_type = genomic DNA

SEQ ID NO: 121206 - DNA, 66 bp, Homo sapiens; identical to SEQ ID NO: 89442
  misc_feature 1..66: note = chr22:39239346-39239412
  misc_feature 1..66: note = Hyper
  source 1..66: mol_type = genomic DNA

SEQ ID NO: 121207 - DNA, 30 bp, Homo sapiens; identical to SEQ ID NO: 89443
  misc_feature 1..30: note = chr22:39256879-39256909
  misc_feature 1..30: note = Hypo
  source 1..30: mol_type = genomic DNA

SEQ ID NO: 121208 - DNA, 30 bp, Homo sapiens; identical to SEQ ID NO: 89444
  misc_feature 1..30: note = chr22:39370509-39370539
  misc_feature 1..30: note = Hypo
  source 1..30: mol_type = genomic DNA

SEQ ID NO: 121209 - DNA, 35 bp, Homo sapiens; identical to SEQ ID NO: 89445
  misc_feature 1..35: note = chr22:39413652-39413687
  misc_feature 1..35: note = Hypo
  source 1..35: mol_type = genomic DNA

SEQ ID NO: 121210 - DNA, 30 bp, Homo sapiens; identical to SEQ ID NO: 89446
  misc_feature 1..30: note = chr22:39427969-39427999
  misc_feature 1..30: note = Hypo
  source 1..30: mol_type = genomic DNA

SEQ ID NO: 121211 - DNA, 34 bp, Homo sapiens; identical to SEQ ID NO: 89447
  misc_feature 1..34: note = chr22:39435689-39435723
  misc_feature 1..34: note = Hypo
  source 1..34: mol_type = genomic DNA

SEQ ID NO: 121212 - DNA, 168 bp, Homo sapiens; identical to SEQ ID NO: 89448
  misc_feature 1..168: note = chr22:39473204-39473372
  misc_feature 1..168: note = Hyper
  source 1..168: mol_type = genomic DNA

SEQ ID NO: 121213 - DNA, 40 bp, Homo sapiens; identical to SEQ ID NO: 89449
  misc_feature 1..40: note = chr22:39530973-39531013
  misc_feature 1..40: note = Hypo
  source 1..40: mol_type = genomic DNA

SEQ ID NO: 121214 - DNA, 30 bp, Homo sapiens; identical to SEQ ID NO: 89450
  misc_feature 1..30: note = chr22:39531766-39531796
  misc_feature 1..30: note = Hypo
  source 1..30: mol_type = genomic DNA

SEQ ID NO: 121215 - DNA, 85 bp, Homo sapiens; identical to SEQ ID NO: 89451
  misc_feature 1..85: note = chr22:39549387-39549472
  misc_feature 1..85: note = Hyper
  source 1..85: mol_type = genomic DNA

SEQ ID NO: 121216 - DNA, 19 bp, Homo sapiens
  misc_feature 1..19: note = chr22:39551428-39551447
  misc_feature 1..19: note = Hypo
  source 1..19: mol_type = genomic DNA
gccacggaagaggtacgtt

SEQ ID NO: 121217 - DNA, 66 bp, Homo sapiens; identical to SEQ ID NO: 89453
  misc_feature 1..66: note = chr22:39639644-39639710
  misc_feature 1..66: note = Hyper
  source 1..66: mol_type = genomic DNA

SEQ ID NO: 121218 - DNA, 110 bp, Homo sapiens; identical to SEQ ID NO: 89454
  misc_feature 1..110: note = chr22:39680042-39680152
  misc_feature 1..110: note = Hypo
  source 1..110: mol_type = genomic DNA

SEQ ID NO: 121219 - DNA, 30 bp, Homo sapiens; identical to SEQ ID NO: 89455
  misc_feature 1..30: note = chr22:39690071-39690101
  misc_feature 1..30: note = Hypo
  source 1..30: mol_type = genomic DNA

SEQ ID NO: 121220 - DNA, 31 bp, Homo sapiens; identical to SEQ ID NO: 89456
  misc_feature 1..31: note = chr22:39716831-39716862
  misc_feature 1..31: note = Hypo
  source 1..31: mol_type = genomic DNA

SEQ ID NO: 121221 - DNA, 30 bp, Homo sapiens; identical to SEQ ID NO: 89457
  misc_feature 1..30: note = chr22:39735204-39735234
  misc_feature 1..30: note = Hypo
  source 1..30: mol_type = genomic DNA

SEQ ID NO: 121222 - DNA, 342 bp, Homo sapiens; identical to SEQ ID NO: 89458
  misc_feature 1..342: note = chr22:39745777-39746119
  misc_feature 1..342: note = Hyper
  source 1..342: mol_type = genomic DNA

SEQ ID NO: 121223 - DNA, 140 bp, Homo sapiens; identical to SEQ ID NO: 89459
  misc_feature 1..140: note = chr22:39746397-39746537
  misc_feature 1..140: note = Hyper
  source 1..140: mol_type = genomic DNA

SEQ ID NO: 121224 - DNA, 182 bp, Homo sapiens; identical to SEQ ID NO: 46711
  misc_feature 1..182: note = chr22:39756856-39757038
  misc_feature 1..182: note = Hypo
  source 1..182: mol_type = genomic DNA

SEQ ID NO: 121225 - DNA, 166 bp, Homo sapiens; identical to SEQ ID NO: 89461
  misc_feature 1..166: note = chr22:39770472-39770638
  misc_feature 1..166: note = Hypo
  source 1..166: mol_type = genomic DNA

SEQ ID NO: 121226 - DNA, 196 bp, Homo sapiens; identical to SEQ ID NO: 89462
  misc_feature 1..196: note = chr22:39784299-39784495
  misc_feature 1..196: note = Hyper
  source 1..196: mol_type = genomic DNA

SEQ ID NO: 121227 - DNA, 34 bp, Homo sapiens; identical to SEQ ID NO: 89463
  misc_feature 1..34: note = chr22:39830355-39830389
  misc_feature 1..34: note = Hypo
  source 1..34: mol_type = genomic DNA

SEQ ID NO: 121228 - DNA, 66 bp, Homo sapiens; identical to SEQ ID NO: 38552
  misc_feature 1..66: note = chr22:39853091-39853157
  misc_feature 1..66: note = Hyper
  source 1..66: mol_type = genomic DNA

SEQ ID NO: 121229 - DNA, 244 bp, Homo sapiens
  misc_feature 1..244: note = chr22:39853382-39853626
  misc_feature 1..244: note = Hyper
  source 1..244: mol_type = genomic DNA
gggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggtgagttgaccccggcgtcctggggggcgccgcggcccctctatccccgcgctgcccgccctcc

SEQ ID NO: 121230 - DNA, 35 bp, Homo sapiens; identical to SEQ ID NO: 89467
  misc_feature 1..35: note = chr22:39853899-39853934
  misc_feature 1..35: note = Hyper
  source 1..35: mol_type = genomic DNA

SEQ ID NO: 121231 - DNA, 151 bp, Homo sapiens; identical to SEQ ID NO: 89468
  misc_feature 1..151: note = chr22:39854212-39854363
  misc_feature 1..151: note = Hyper
  source 1..151: mol_type = genomic DNA

SEQ ID NO: 121232 - DNA, 210 bp, Homo sapiens; identical to SEQ ID NO: 89469
  misc_feature 1..210: note = chr22:39877226-39877436
  misc_feature 1..210: note = Hypo
  source 1..210: mol_type = genomic DNA

SEQ ID NO: 121233 - DNA, 30 bp, Homo sapiens; identical to SEQ ID NO: 46714
  misc_feature 1..30: note = chr22:39932533-39932563
  misc_feature 1..30: note = Hypo
  source 1..30: mol_type = genomic DNA

SEQ ID NO: 121234 - DNA, 48 bp, Homo sapiens; identical to SEQ ID NO: 89471
  misc_feature 1..48: note = chr22:39942097-39942145
  misc_feature 1..48: note = Hyper
  source 1..48: mol_type = genomic DNA

SEQ ID NO: 121235 - DNA, 687 bp, Homo sapiens
  misc_feature 1..687: note = chr22:39953464-39954151
  misc_feature 1..687: note = Hyper
  source 1..687: mol_type = genomic DNA
tgtctgtcgcctccacgcctcccccctccagcgtcccgcgcctgcagctttccccgaagacatttggtgtcagtataaggacggcttttcctcgcacgcagcgcggctcggtctcgccgccgccgcacgtccccgcaccgccaggcgctcgggctcctccgcagcccccgccgcgcgcagaccccgcgcttcgagccctgagccggaggcgcgagcagagccgaggcaggcgagagaccggcctcagccccgcgctccccgccgcgctggtctctcccgggcacttgccccgctgctcggtccccgcagcacccgcgcccccgccccggcccggagcgccgcgctcccgcccgccgcccgcccagagcctcgccgtccctccagcccgccgcctcctcctcctcccgccatggcccgggcccccgggcccgccgccccccgcccgccgccccccgcgccccgggggctcagctgatcctgaattggcggggggtcggctggcggggctgggggtccctctcgatcgccggcttcgggtggggacgcgttgtccccgcgtctctaacctggacgaccccccgcggccgggccacgtccatgccaaggtaggtgggggctgggtgggtggggggaaggaagggagggcttcgcttcgatgccagtttcttggcgcgttggcttctctct

SEQ ID NO: 121236 - DNA, 209 bp, Homo sapiens
  misc_feature 1..209: note = chr22:39954397-39954606
  misc_feature 1..209: note = Hyper
  source 1..209: mol_type = genomic DNA
gtccggccgcccctccgcggctgcggctctgcgggcagctgggccagagctggtgcccgtgtccggcgggctgagctgggagcgctggcctgggagcgcggcagcgggggccactggatgggggaatcccgggcagggtttaactttcccggaggcgggggtggcggagaccccccctttggctggcaccccagcggggcggaggcctc

SEQ ID NO: 121237 - DNA, 30 bp, Homo sapiens; identical to SEQ ID NO: 89477
  misc_feature 1..30: note = chr22:39994870-39994900
  misc_feature 1..30: note = Hypo
  source 1..30: mol_type = genomic DNA

SEQ ID NO: 121238 - DNA, 30 bp, Homo sapiens; identical to SEQ ID NO: 89478
  misc_feature 1..30: note = chr22:40014407-40014437
  misc_feature 1..30: note = Hypo
  source 1..30: mol_type = genomic DNA

SEQ ID NO: 121239 - DNA, 323 bp, Homo sapiens; identical to SEQ ID NO: 89479
  misc_feature 1..323: note = chr22:40014919-40015242
  misc_feature 1..323: note = Hypo
  source 1..323: mol_type = genomic DNA

SEQ ID NO: 121240 - DNA, 206 bp, Homo sapiens; identical to SEQ ID NO: 46715
  misc_feature 1..206: note = chr22:40018133-40018339
  misc_feature 1..206: note = Hypo
  source 1..206: mol_type = genomic DNA

SEQ ID NO: 121241 - DNA, 75 bp, Homo sapiens; identical to SEQ ID NO: 89481
  misc_feature 1..75: note = chr22:40037009-40037084
  misc_feature 1..75: note = Hypo
  source 1..75: mol_type = genomic DNA

SEQ ID NO: 121242 - DNA, 354 bp, Homo sapiens; identical to SEQ ID NO: 89482
  misc_feature 1..354: note = chr22:40042546-40042900
  misc_feature 1..354: note = Hypo
  source 1..354: mol_type = genomic DNA

SEQ ID NO: 121243 - DNA, 68 bp, Homo sapiens; identical to SEQ ID NO: 89483
  misc_feature 1..68: note = chr22:40055020-40055088
  misc_feature 1..68: note = Hypo
  source 1..68: mol_type = genomic DNA

SEQ ID NO: 121244 - DNA, 53 bp, Homo sapiens; identical to SEQ ID NO: 89484
  misc_feature 1..53: note = chr22:40055554-40055607
  misc_feature 1..53: note = Hypo
  source 1..53: mol_type = genomic DNA

SEQ ID NO: 121245 - DNA, 36 bp, Homo sapiens; identical to SEQ ID NO: 89485
  misc_feature 1..36: note = chr22:40060586-40060622
  misc_feature 1..36: note = Hyper
  source 1..36: mol_type = genomic DNA

SEQ ID NO: 121246 - DNA, 36 bp, Homo sapiens; identical to SEQ ID NO: 89486
  misc_feature 1..36: note = chr22:40069714-40069750
  misc_feature 1..36: note = Hypo
  source 1..36: mol_type = genomic DNA

SEQ ID NO: 121247 - DNA, 148 bp, Homo sapiens; identical to SEQ ID NO: 89487
  misc_feature 1..148: note = chr22:40073967-40074115
  misc_feature 1..148: note = Hypo
  source 1..148: mol_type = genomic DNA

SEQ ID NO: 121248 - DNA, 39 bp, Homo sapiens; identical to SEQ ID NO: 89488
  misc_feature 1..39: note = chr22:40075188-40075227
  misc_feature 1..39: note = Hypo
  source 1..39: mol_type = genomic DNA

SEQ ID NO: 121249 - DNA, 276 bp, Homo sapiens
  misc_feature 1..276: note = chr22:40081776-40082052
  misc_feature 1..276: note = Hyper
  source 1..276: mol_type = genomic DNA
cgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggaccc

SEQ ID NO: 121250 - DNA, 235 bp, Homo sapiens; identical to SEQ ID NO: 89490
  misc_feature 1..235: note = chr22:40095526-40095761
  misc_feature 1..235: note = Hypo
  source 1..235: mol_type = genomic DNA

SEQ ID NO: 121251 - DNA, 32 bp, Homo sapiens; identical to SEQ ID NO: 89491
  misc_feature 1..32: note = chr22:40111009-40111041
  misc_feature 1..32: note = Hypo
  source 1..32: mol_type = genomic DNA

SEQ ID NO: 121252 - DNA, 30 bp, Homo sapiens; identical to SEQ ID NO: 46722
  misc_feature 1..30: note = chr22:40113507-40113537
  misc_feature 1..30: note = Hypo
  source 1..30: mol_type = genomic DNA

SEQ ID NO: 121253 - DNA, 75 bp, Homo sapiens; identical to SEQ ID NO: 89493
  misc_feature 1..75: note = chr22:40215378-40215453
  misc_feature 1..75: note = Hypo
  source 1..75: mol_type = genomic DNA

SEQ ID NO: 121254 - DNA, 137 bp, Homo sapiens; identical to SEQ ID NO: 89494
  misc_feature 1..137: note = chr22:40226362-40226499
  misc_feature 1..137: note = Hypo
  source 1..137: mol_type = genomic DNA

SEQ ID NO: 121255 - DNA, 171 bp, Homo sapiens; identical to SEQ ID NO: 89495
  misc_feature 1..171: note = chr22:40367623-40367794
  misc_feature 1..171: note = Hypo
  source 1..171: mol_type = genomic DNA

SEQ ID NO: 121256 - DNA, 30 bp, Homo sapiens; identical to SEQ ID NO: 89496
  misc_feature 1..30: note = chr22:40368168-40368198
  misc_feature 1..30: note = Hypo
  source 1..30: mol_type = genomic DNA

SEQ ID NO: 121257 - DNA, 226 bp, Homo sapiens; identical to SEQ ID NO: 89497
  misc_feature 1..226: note = chr22:40390429-40390655
  misc_feature 1..226: note = Hyper
  source 1..226: mol_type = genomic DNA

SEQ ID NO: 121258 - DNA, 172 bp, Homo sapiens; identical to SEQ ID NO: 89498
  misc_feature 1..172: note = chr22:40417456-40417628
  misc_feature 1..172: note = Hypo
  source 1..172: mol_type = genomic DNA

SEQ ID NO: 121259 - DNA, 78 bp, Homo sapiens; identical to SEQ ID NO: 89499
  misc_feature 1..78: note = chr22:40548259-40548337
  misc_feature 1..78: note = Hypo
  source 1..78: mol_type = genomic DNA

SEQ ID NO: 121260 - DNA, 30 bp, Homo sapiens; identical to SEQ ID NO: 89500
  misc_feature 1..30: note = chr22:40815121-40815151
  misc_feature 1..30: note = Hypo
  source 1..30: mol_type = genomic DNA

SEQ ID NO: 121261 - DNA, 37 bp, Homo sapiens; identical to SEQ ID NO: 89501
  misc_feature 1..37: note = chr22:40991442-40991479
  misc_feature 1..37: note = Hypo
  source 1..37: mol_type = genomic DNA

SEQ ID NO: 121262 - DNA, 45 bp, Homo sapiens; identical to SEQ ID NO: 89502
  misc_feature 1..45: note = chr22:41034525-41034570
  misc_feature 1..45: note = Hypo
  source 1..45: mol_type = genomic DNA

SEQ ID NO: 121263 - DNA, 67 bp, Homo sapiens
  misc_feature 1..67: note = chr22:41048451-41048518
  misc_feature 1..67: note = Hypo
  source 1..67: mol_type = genomic DNA
cccacaccccagcaccggggagcgccccagggctccgctgtggcctgccctgcggctggcaggccat

SEQ ID NO: 121264 - DNA, 221 bp, Homo sapiens; identical to SEQ ID NO: 89503
  misc_feature 1..221: note = chr22:41048732-41048953
  misc_feature 1..221: note = Hypo
  source 1..221: mol_type = genomic DNA

SEQ ID NO: 121265 - DNA, 35 bp, Homo sapiens; identical to SEQ ID NO: 89504
  misc_feature 1..35: note = chr22:41398391-41398426
  misc_feature 1..35: note = Hypo
  source 1..35: mol_type = genomic DNA

SEQ ID NO: 121266 - DNA, 82 bp, Homo sapiens; identical to SEQ ID NO: 89505
  misc_feature 1..82: note = chr22:41578498-41578580
  misc_feature 1..82: note = Hypo
  source 1..82: mol_type = genomic DNA

SEQ ID NO: 121267 - DNA, 444 bp, Homo sapiens; identical to SEQ ID NO: 46727
  misc_feature 1..444: note = chr22:41634411-41634855
  misc_feature 1..444: note = Hypo
  source 1..444: mol_type = genomic DNA

SEQ ID NO: 121268 - DNA, 97 bp, Homo sapiens; identical to SEQ ID NO: 89507
  misc_feature 1..97: note = chr22:41637099-41637196
  misc_feature 1..97: note = Hypo
  source 1..97: mol_type = genomic DNA

SEQ ID NO: 121269 - DNA, 101 bp, Homo sapiens; identical to SEQ ID NO: 46729
  misc_feature 1..101: note = chr22:41657315-41657416
  misc_feature 1..101: note = Hypo
  source 1..101: mol_type = genomic DNA

SEQ ID NO: 121270 - DNA, 71 bp, Homo sapiens; identical to SEQ ID NO: 89509
  misc_feature 1..71: note = chr22:41668097-41668168
  misc_feature 1..71: note = Hypo
  source 1..71: mol_type = genomic DNA

SEQ ID NO: 121271 - DNA, 22 bp, Homo sapiens
  misc_feature 1..22: note = chr22:41690045-41690067
  misc_feature 1..22: note = Hypo
  source 1..22: mol_type = genomic DNA
ctctccctctccccacggtctc

SEQ ID NO: 121272 - DNA, 30 bp, Homo sapiens; identical to SEQ ID NO: 89511
  misc_feature 1..30: note = chr22:41762483-41762513
  misc_feature 1..30: note = Hypo
  source 1..30: mol_type = genomic DNA

SEQ ID NO: 121273 - DNA, 33 bp, Homo sapiens; identical to SEQ ID NO: 89512
  misc_feature 1..33: note = chr22:41776124-41776157
  misc_feature 1..33: note = Hypo
  source 1..33: mol_type = genomic DNA

SEQ ID NO: 121274 - DNA, 81 bp, Homo sapiens; identical to SEQ ID NO: 46732
  misc_feature 1..81: note = chr22:41839301-41839382
  misc_feature 1..81: note = Hypo
  source 1..81: mol_type = genomic DNA

SEQ ID NO: 121275 - DNA, 21 bp, Homo sapiens
  misc_feature 1..21: note = chr22:41839922-41839943
  misc_feature 1..21: note = Hypo
  source 1..21: mol_type = genomic DNA
cccggccggaaggtttttcag

SEQ ID NO: 121276 - DNA, 39 bp, Homo sapiens; identical to SEQ ID NO: 89515
  misc_feature 1..39: note = chr22:41939338-41939377
  misc_feature 1..39: note = Hypo
  source 1..39: mol_type = genomic DNA

SEQ ID NO: 121277 - DNA, 83 bp, Homo sapiens; identical to SEQ ID NO: 89516
  misc_feature 1..83: note = chr22:41995514-41995597
  misc_feature 1..83: note = Hypo
  source 1..83: mol_type = genomic DNA

SEQ ID NO: 121278 - DNA, 165 bp, Homo sapiens; identical to SEQ ID NO: 89517
  misc_feature 1..165: note = chr22:42096088-42096253
  misc_feature 1..165: note = Hypo
  source 1..165: mol_type = genomic DNA

SEQ ID NO: 121279 - DNA, 42 bp, Homo sapiens; identical to SEQ ID NO: 46735
  misc_feature 1..42: note = chr22:42109080-42109122
  misc_feature 1..42: note = Hypo
  source 1..42: mol_type = genomic DNA

SEQ ID NO: 121280 - DNA, 575 bp, Homo sapiens; identical to SEQ ID NO: 89519
  misc_feature 1..575: note = chr22:42306066-42306641
  misc_feature 1..575: note = Hyper
  source 1..575: mol_type = genomic DNA

SEQ ID NO: 121281 - DNA, 395 bp, Homo sapiens
  misc_feature 1..395: note = chr22:42306872-42307267
  misc_feature 1..395: note = Hyper
  source 1..395: mol_type = genomic DNA
ggaacagaacccagacggggcgtgggggctgccaagcctgcctgcctctcgagagacccagggggaggctctggagcccgagcctcagatcacagccccggccagcaaatcctgcatctggaaccttcctcacacatcacagccccccagactcgaggccgcaggacccgtggggggtccctttccaccctggcgagctggctggccggtcgggcccctcacccgcagaggccgcggctcatttccaccggggaagcctctatgccccagccgagggaccgcctctcggcctctcacgcccctccgcgtgctccgccgccgctcagccccgcccgccaccgactcacctgcgctgttgtggggggagccccgggggaggccgtcccccatctgca

SEQ ID NO: 121282 - DNA, 924 bp, Homo sapiens; identical to SEQ ID NO: 89522
  misc_feature 1..924: note = chr22:42310042-42310966
  misc_feature 1..924: note = Hyper
  source 1..924: mol_type = genomic DNA

SEQ ID NO: 121283 - DNA, 297 bp, Homo sapiens; identical to SEQ ID NO: 89523
  misc_feature 1..297: note = chr22:42311316-42311613
  misc_feature 1..297: note = Hyper
  source 1..297: mol_type = genomic DNA

SEQ ID NO: 121284 - DNA, 100 bp, Homo sapiens; identical to SEQ ID NO: 89524
  misc_feature 1..100: note = chr22:42315581-42315681
  misc_feature 1..100: note = Hyper
  source 1..100: mol_type = genomic DNA

SEQ ID NO: 121285 - DNA, 59 bp, Homo sapiens; identical to SEQ ID NO: 89525
  misc_feature 1..59: note = chr22:42315890-42315949
  misc_feature 1..59: note = Hyper
  source 1..59: mol_type = genomic DNA

SEQ ID NO: 121286 - DNA, 65 bp, Homo sapiens; identical to SEQ ID NO: 89526
  misc_feature 1..65: note = chr22:42322145-42322210
  misc_feature 1..65: note = Hyper
  source 1..65: mol_type = genomic DNA

SEQ ID NO: 121287 - DNA, 32 bp, Homo sapiens; identical to SEQ ID NO: 89527
  misc_feature 1..32: note = chr22:42322723-42322755
  misc_feature 1..32: note = Hyper
  source 1..32: mol_type = genomic DNA

SEQ ID NO: 121288 - DNA, 451 bp, Homo sapiens; identical to SEQ ID NO: 38566
  misc_feature 1..451: note = chr22:42353573-42354024
  misc_feature 1..451: note = Hyper
  source 1..451: mol_type = genomic DNA

SEQ ID NO: 121289 - DNA, 120 bp, Homo sapiens; identical to SEQ ID NO: 89529
  misc_feature 1..120: note = chr22:42367935-42368055
  misc_feature 1..120: note = Hypo
  source 1..120: mol_type = genomic DNA

SEQ ID NO: 121290 - DNA, 129 bp, Homo sapiens; identical to SEQ ID NO: 89530
  misc_feature 1..129: note = chr22:42373203-42373332
  misc_feature 1..129: note = Hyper
  source 1..129: mol_type = genomic DNA

SEQ ID NO: 121291 - DNA, 140 bp, Homo sapiens; identical to SEQ ID NO: 89531
  misc_feature 1..140: note = chr22:42395150-42395290
  misc_feature 1..140: note = Hypo
  source 1..140: mol_type = genomic DNA

SEQ ID NO: 121292 - DNA, 54 bp, Homo sapiens; identical to SEQ ID NO: 89532
  misc_feature 1..54: note = chr22:42470162-42470216
  misc_feature 1..54: note = Hyper
  source 1..54: mol_type = genomic DNA

SEQ ID NO: 121293 - DNA, 244 bp, Homo sapiens; identical to SEQ ID NO: 89533
  misc_feature 1..244: note = chr22:42667169-42667413
  misc_feature 1..244: note = Hypo
  source 1..244: mol_type = genomic DNA

SEQ ID NO: 121294 - DNA, 30 bp, Homo sapiens; identical to SEQ ID NO: 46738
  misc_feature 1..30: note = chr22:42675831-42675861
  misc_feature 1..30: note = Hypo
  source 1..30: mol_type = genomic DNA

SEQ ID NO: 121295 - DNA, 796 bp, Homo sapiens
  misc_feature 1..796: note = chr22:42679388-42680184
  misc_feature 1..796: note = Hyper
  source 1..796: mol_type = genomic DNA
cggaggggacgggggcgcggctggatctggaccggaggggacgggggcgggcactcggcccctgggactgtgacccggggccctgcccttcacgcccctgctgctgccgcgctccccgagcagccccctcgggcccctcctctcccggccaccctcctgggcactgctctgaacatcccccgcctccccgccctccatcgctctttatggcagtttcaaagctacagccgccactcgagcagctgcggcctttgatggggacaaggcagtaaaggccgcccgggaggcccctgcccagccctgccctggcccggcgcggcccctgcccgcccccggggagcctcgggccagggcagcgcggcgcggcggagcacccggcgggcacgcctcgcacgccagagcaaactttcacgaccgcgggagaggcaccgcgcacaccgttacctttgcagccgcatccttccctggcccttgccccagaccccttgccagcccggcgaccacgggggaggaaaacaactcctgagccgaggcgggggaggaggggaaagggaaaaaaggagaaggaaaaggaaaggggggcagtttctcggctctcagcctcctcgcggctcctcctgcccaagccggcaagtgaagtcacagggccggggcggtgacatcagctgagcctctgacatcacggcccctgccgatctcacctctgcagggtggagatggaggagcagcggggaggagggatggatggatggaggagggaggggagcacccgatcccccctcgccttcaactgcgg

SEQ ID NO: 121296 - DNA, 152 bp, Homo sapiens; identical to SEQ ID NO: 89537
  misc_feature 1..152: note = chr22:42695951-42696103
  misc_feature 1..152: note = Hyper
  source 1..152: mol_type = genomic DNA

SEQ ID NO: 121297 - DNA, 30 bp, Homo sapiens; identical to SEQ ID NO: 89538
  misc_feature 1..30: note = chr22:42697866-42697896
  misc_feature 1..30: note = Hypo
  source 1..30: mol_type = genomic DNA

SEQ ID NO: 121298 - DNA, 185 bp, Homo sapiens; identical to SEQ ID NO: 89539
  misc_feature 1..185: note = chr22:42829925-42830110
  misc_feature 1..185: note = Hypo
  source 1..185: mol_type = genomic DNA

SEQ ID NO: 121299 - DNA, 204 bp, Homo sapiens; identical to SEQ ID NO: 89540
  misc_feature 1..204: note = chr22:42896511-42896715
  misc_feature 1..204: note = Hyper
  source 1..204: mol_type = genomic DNA

SEQ ID NO: 121300 - DNA, 42 bp, Homo sapiens; identical to SEQ ID NO: 89541
  misc_feature 1..42: note = chr22:42916273-42916315
  misc_feature 1..42: note = Hypo
  source 1..42: mol_type = genomic DNA

SEQ ID NO: 121301 - DNA, 36 bp, Homo sapiens; identical to SEQ ID NO: 89542
  misc_feature 1..36: note = chr22:42944631-42944667
  misc_feature 1..36: note = Hypo
  source 1..36: mol_type = genomic DNA

SEQ ID NO: 121302 - DNA, 74 bp, Homo sapiens; identical to SEQ ID NO: 89543
  misc_feature 1..74: note = chr22:42963239-42963313
  misc_feature 1..74: note = Hypo
  source 1..74: mol_type = genomic DNA

SEQ ID NO: 121303 - DNA, 19 bp, Homo sapiens
  misc_feature 1..19: note = chr22:42995312-42995331
  misc_feature 1..19: note = Hypo
  source 1..19: mol_type = genomic DNA
gaaaggctctattcacgcc

SEQ ID NO: 121304 - DNA, 30 bp, Homo sapiens; identical to SEQ ID NO: 16790
  misc_feature 1..30: note = chr22:42995705-42995735
  misc_feature 1..30: note = Hypo
  source 1..30: mol_type = genomic DNA

SEQ ID NO: 121305 - DNA, 103 bp, Homo sapiens; identical to SEQ ID NO: 89546
  misc_feature 1..103: note = chr22:43012479-43012582
  misc_feature 1..103: note = Hypo
  source 1..103: mol_type = genomic DNA

SEQ ID NO: 121306 - DNA, 102 bp, Homo sapiens; identical to SEQ ID NO: 89547
  misc_feature 1..102: note = chr22:43012882-43012984
  misc_feature 1..102: note = Hypo
  source 1..102: mol_type = genomic DNA

SEQ ID NO: 121307 - DNA, 50 bp, Homo sapiens; identical to SEQ ID NO: 89548
  misc_feature 1..50: note = chr22:43033683-43033733
  misc_feature 1..50: note = Hypo
  source 1..50: mol_type = genomic DNA

SEQ ID NO: 121308 - DNA, 140 bp, Homo sapiens; identical to SEQ ID NO: 89549
  misc_feature 1..140: note = chr22:43083005-43083145
  misc_feature 1..140: note = Hypo
  source 1..140: mol_type = genomic DNA

SEQ ID NO: 121309 - DNA, 208 bp, Homo sapiens; identical to SEQ ID NO: 89550
  misc_feature 1..208: note = chr22:43116061-43116269
  misc_feature 1..208: note = Hyper
  source 1..208: mol_type = genomic DNA

SEQ ID NO: 121310 - DNA, 30 bp, Homo sapiens; identical to SEQ ID NO: 89551
  misc_feature 1..30: note = chr22:43265859-43265889
  misc_feature 1..30: note = Hypo
  source 1..30: mol_type = genomic DNA

SEQ ID NO: 121311 - DNA, 169 bp, Homo sapiens; identical to SEQ ID NO: 89552
  misc_feature 1..169: note = chr22:43434409-43434578
  misc_feature 1..169: note = Hypo
  source 1..169: mol_type = genomic DNA

SEQ ID NO: 121312 - DNA, 25 bp, Homo sapiens
  misc_feature 1..25: note = chr22:43484637-43484662
  misc_feature 1..25: note = Hypo
  source 1..25: mol_type = genomic DNA
cgtgcccggccggggcccatctttt

SEQ ID NO: 121313 - DNA, 203 bp, Homo sapiens; identical to SEQ ID NO: 89554
  misc_feature 1..203: note = chr22:43523306-43523509
  misc_feature 1..203: note = Hypo
  source 1..203: mol_type = genomic DNA

SEQ ID NO: 121314 - DNA, 77 bp, Homo sapiens; identical to SEQ ID NO: 89555
  misc_feature 1..77: note = chr22:43524552-43524629
  misc_feature 1..77: note = Hypo
  source 1..77: mol_type = genomic DNA

SEQ ID NO: 121315 - DNA, 194 bp, Homo sapiens; identical to SEQ ID NO: 46745
  misc_feature 1..194: note = chr22:43524923-43525117
  misc_feature 1..194: note = Hypo
  source 1..194: mol_type = genomic DNA

SEQ ID NO: 121316 - DNA, 60 bp, Homo sapiens; identical to SEQ ID NO: 89557
  misc_feature 1..60: note = chr22:43528378-43528438
  misc_feature 1..60: note = Hypo
  source 1..60: mol_type = genomic DNA

SEQ ID NO: 121317 - DNA, 30 bp, Homo sapiens; identical to SEQ ID NO: 89558
  misc_feature 1..30: note = chr22:43553497-43553527
  misc_feature 1..30: note = Hypo
  source 1..30: mol_type = genomic DNA

SEQ ID NO: 121318 - DNA, 67 bp, Homo sapiens; identical to SEQ ID NO: 89559
  misc_feature 1..67: note = chr22:43570247-43570314
  misc_feature 1..67: note = Hypo
  source 1..67: mol_type = genomic DNA

SEQ ID NO: 121319 - DNA, 43 bp, Homo sapiens; identical to SEQ ID NO: 89560
  misc_feature 1..43: note = chr22:43571286-43571329
  misc_feature 1..43: note = Hypo
  source 1..43: mol_type = genomic DNA

SEQ ID NO: 121320 - DNA, 30 bp, Homo sapiens; identical to SEQ ID NO: 16795
  misc_feature 1..30: note = chr22:43581330-43581360
  misc_feature 1..30: note = Hypo
  source 1..30: mol_type = genomic DNA

SEQ ID NO: 121321 - DNA, 36 bp, Homo sapiens; identical to SEQ ID NO: 89562
  misc_feature 1..36: note = chr22:43581591-43581627
  misc_feature 1..36: note = Hypo
  source 1..36: mol_type = genomic DNA

SEQ ID NO: 121322 - DNA, 30 bp, Homo sapiens; identical to SEQ ID NO: 89563
  misc_feature 1..30: note = chr22:43584877-43584907
  misc_feature 1..30: note = Hypo
  source 1..30: mol_type = genomic DNA

SEQ ID NO: 121323 - DNA, 39 bp, Homo sapiens; identical to SEQ ID NO: 89564
  misc_feature 1..39: note = chr22:43593004-43593043
  misc_feature 1..39: note = Hypo
  source 1..39: mol_type = genomic DNA

SEQ ID NO: 121324 - DNA, 398 bp, Homo sapiens; identical to SEQ ID NO: 89565
  misc_feature 1..398: note = chr22:43600957-43601355
  misc_feature 1..398: note = Hypo
  source 1..398: mol_type = genomic DNA

SEQ ID NO: 121325 - DNA, 202 bp, Homo sapiens; identical to SEQ ID NO: 46749
  misc_feature 1..202: note = chr22:43603869-43604071
  misc_feature 1..202: note = Hypo
  source 1..202: mol_type = genomic DNA

SEQ ID NO: 121326 - DNA, 30 bp, Homo sapiens; identical to SEQ ID NO: 89567
  misc_feature 1..30: note = chr22:43608657-43608687
  misc_feature 1..30: note = Hypo
  source 1..30: mol_type = genomic DNA

SEQ ID NO: 121327 - DNA, 30 bp, Homo sapiens; identical to SEQ ID NO: 89568
  misc_feature 1..30: note = chr22:43641411-43641441
  misc_feature 1..30: note = Hypo
  source 1..30: mol_type = genomic DNA

SEQ ID NO: 121328 - DNA, 30 bp, Homo sapiens; identical to SEQ ID NO: 89569
  misc_feature 1..30: note = chr22:43655786-43655816
  misc_feature 1..30: note = Hypo
  source 1..30: mol_type = genomic DNA

SEQ ID NO: 121329 - DNA, 92 bp, Homo sapiens; identical to SEQ ID NO: 89570
  misc_feature 1..92: note = chr22:43665077-43665169
  misc_feature 1..92: note = Hypo
  source 1..92: mol_type = genomic DNA

SEQ ID NO: 121330 - DNA, 167 bp, Homo sapiens; identical to SEQ ID NO: 89571
  misc_feature 1..167: note = chr22:43677829-43677996
  misc_feature 1..167: note = Hypo
  source 1..167: mol_type = genomic DNA

SEQ ID NO: 121331 - DNA, 30 bp, Homo sapiens; identical to SEQ ID NO: 89572
  misc_feature 1..30: note = chr22:43687676-43687706
  misc_feature 1..30: note = Hypo
  source 1..30: mol_type = genomic DNA

SEQ ID NO: 121332 - DNA, 343 bp, Homo sapiens; identical to SEQ ID NO: 89573
  misc_feature 1..343: note = chr22:43689396-43689739
  misc_feature 1..343: note = Hypo
  source 1..343: mol_type = genomic DNA

SEQ ID NO: 121333 - DNA, 30 bp, Homo sapiens; identical to SEQ ID NO: 89574
  misc_feature 1..30: note = chr22:43705089-43705119
  misc_feature 1..30: note = Hypo
  source 1..30: mol_type = genomic DNA

SEQ ID NO: 121334 - DNA, 30 bp, Homo sapiens; identical to SEQ ID NO: 46753
  misc_feature 1..30: note = chr22:43735330-43735360
  misc_feature 1..30: note = Hypo
  source 1..30: mol_type = genomic DNA

SEQ ID NO: 121335 - DNA, 30 bp, Homo sapiens; identical to SEQ ID NO: 89576
  misc_feature 1..30: note = chr22:43738298-43738328
  misc_feature 1..30: note = Hyper
  source 1..30: mol_type = genomic DNA

SEQ ID NO: 121336 - DNA, 114 bp, Homo sapiens; identical to SEQ ID NO: 89577
  misc_feature 1..114: note = chr22:43738536-43738650
  misc_feature 1..114: note = Hyper
  source 1..114: mol_type = genomic DNA

SEQ ID NO: 121337 - DNA, 1182 bp, Homo sapiens
  misc_feature 1..1182: note = chr22:43738979-43740161
  misc_feature 1..1182: note = Hyper
  source 1..1182: mol_type = genomic DNA
cggactcaggagccccggccgcccgggctgcggggagggggcgccccgggccggccctagaagttactttgcaaagaggcagggggcgcggggccgcgcggggcgagctcgggatccgcggggaagaagccctccgggaccgcgcctcggccgcccgagccccccgcgcccgccgccccccacctcggtcgggggcttacctgggagcccgctgcccccggccagccgcccgcgtgtgcccagggccagcagcacgcacaagtgccagcgcacggccgccgcgcccatgctcaatgcgggccccgctgggcgtgcgggcgtgcggggcgcggggacccgaccgaccggccgctcccgcaggcgctgctcgctgctcgccgctccgccaccgctcgggctcccgagccgcccagccagcccggctgatgagctgacagcgcgcgctcattggcccgtggcgtcggaggggcggggcgtcgcccagggccggccaatgggcgccggcctccggccctccgaggaagaggggggctcgggcgtcgtcggggggacccttcccctggggcgggcggcaggtggggggtgtgggcctggccggccggctcgctaggcgcggggtctaggccaggctggggctgcttggaggctgcgccctcccctgcccgcggcgccccggcccccgccgtcgagagtggacgcccctctggggtaacccctcccggcccagaggcagcctcgggggcggggatcctgcgaaccggggatcccgtgaggtcgcccgccatccgtgggcagtgaaacgcgccagcgcgcagagcagactcgcctgcgctgccgtttgctggacgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacctcggccggcgaagttcgctgcccggaatgcgaggccgaggcctccccctgtgacagaccgggcggggccaggaggag

SEQ ID NO: 121338 - DNA, 81 bp, Homo sapiens; identical to SEQ ID NO: 89582
  misc_feature 1..81: note = chr22:43795778-43795859
  misc_feature 1..81: note = Hypo
  source 1..81: mol_type = genomic DNA

SEQ ID NO: 121339 - DNA, 347 bp, Homo sapiens
  misc_feature 1..347: note = chr22:43807413-43807760
  misc_feature 1..347: note = Hyper
  source 1..347: mol_type = genomic DNA
ggaccttccagaccccgggcgggaggggcccacagcagggtgccccggcggccccaggagggggtccgggcctcgggcgaaggctgcggcgccccggaaggagccgcgcacgcccctgcacgcggtgcccgctgcggaggccacggatccggaggtgagagcgcccccgccccgctccctgcccagcccgcgcgcggcccggtccggggctgggggcgggcgccaagaggggcgccgggcgcagtggggcggccccctcccttttccgcagcgcgggccccgctcctcctcccgcgtccaggcccgcggccgcgctccctgtccctccgcagcgggatgcggactcc

SEQ ID NO: 121340 - DNA, 170 bp, Homo sapiens; identical to SEQ ID NO: 89585
  misc_feature 1..170: note = chr22:43808237-43808407
  misc_feature 1..170: note = Hyper
  source 1..170: mol_type = genomic DNA

SEQ ID NO: 121341 - DNA, 30 bp, Homo sapiens; identical to SEQ ID NO: 89586
  misc_feature 1..30: note = chr22:43898540-43898570
  misc_feature 1..30: note = Hypo
  source 1..30: mol_type = genomic DNA

SEQ ID NO: 121342 - DNA, 44 bp, Homo sapiens; identical to SEQ ID NO: 89587
  misc_feature 1..44: note = chr22:44208519-44208563
  misc_feature 1..44: note = Hyper
  source 1..44: mol_type = genomic DNA

SEQ ID NO: 121343 - DNA, 30 bp, Homo sapiens; identical to SEQ ID NO: 89588
  misc_feature 1..30: note = chr22:44235527-44235557
  misc_feature 1..30: note = Hypo
  source 1..30: mol_type = genomic DNA

SEQ ID NO: 121344 - DNA, 30 bp, Homo sapiens; identical to SEQ ID NO: 89589
  misc_feature 1..30: note = chr22:44255795-44255825
  misc_feature 1..30: note = Hypo
  source 1..30: mol_type = genomic DNA

SEQ ID NO: 121345 - DNA, 45 bp, Homo sapiens
  misc_feature 1..45: note = chr22:44257998-44258043
  misc_feature 1..45: note = Hyper
  source 1..45: mol_type = genomic DNA
gcccagcagaagccccgggcgcgggcgcggcgtctacgcggccgc

SEQ ID NO: 121346 - DNA, 253 bp, Homo sapiens; identical to SEQ ID NO: 89591
  misc_feature 1..253: note = chr22:44258280-44258533
  misc_feature 1..253: note = Hyper
  source 1..253: mol_type = genomic DNA

SEQ ID NO: 121347 - DNA, 91 bp, Homo sapiens; identical to SEQ ID NO: 89592
  misc_feature 1..91: note = chr22:44263881-44263972
  misc_feature 1..91: note = Hyper
  source 1..91: mol_type = genomic DNA

SEQ ID NO: 121348 - DNA, 478 bp, Homo sapiens; identical to SEQ ID NO: 89593
  misc_feature 1..478: note = chr22:44287444-44287922
  misc_feature 1..478: note = Hyper
  source 1..478: mol_type = genomic DNA

SEQ ID NO: 121349 - DNA, 741 bp, Homo sapiens
  misc_feature 1..741: note = chr22:44319733-44320474
  misc_feature 1..741: note = Hyper
  source 1..741: mol_type = genomic DNA
gccgattcccgatcccgacccagatcctaacccgcgcccccgccccgccgccgccgccatgtacgacgcagagcgcggctggagcttgtccttcgcgggctgcggcttcctgggcttctaccacgtcggggcgacccgctgcctgagcgagcacgccccgcacctcctccgcgacgcgcgcatgttgttcggcgcttcggccggggcgttgcactgcgtcggcgtcctctccggtatcccgctgggtgcgtctggggacgctgcccgggctccacgtgcggagtgggtgccccctaggccggggagcgggggatccccaggggtcgcggggccctggaggagcgggcatcggacgcggacacggcggggtgcatcccgagggccccctccgaggcagatgcttcctgcgggggcgctgttcctgggcccgggaagggggcgttggaaccccgagcggtccgggccgaagcctgggactctcgtgcgtccccacccctacccccatcaggcgcccgtgcatgaagggagaccctcacctccggactgagagtcggagcgtctcggagcgacggggagtagggagcgggacccggggcggagggtagtgctggcccctgcggactccgggtcccctgtgtcctctcgggaggggctggacgggctgagctgccgaggggccgatttgccctgggccggacaaagagtggggctttggccggtcccccacggtgggctccttcc

SEQ ID NO: 121350 - DNA, 104 bp, Homo sapiens; identical to SEQ ID NO: 89596
  misc_feature 1..104: note = chr22:44419815-44419919
  misc_feature 1..104: note = Hyper
  source 1..104: mol_type = genomic DNA

SEQ ID NO: 121351 - DNA, 202 bp, Homo sapiens; identical to SEQ ID NO: 89597
  misc_feature 1..202: note = chr22:44420478-44420680
  misc_feature 1..202: note = Hyper
  source 1..202: mol_type = genomic DNA

SEQ ID NO: 121352 - DNA, 30 bp, Homo sapiens; identical to SEQ ID NO: 89598
  misc_feature 1..30: note = chr22:44440960-44440990
  misc_feature 1..30: note = Hypo
  source 1..30: mol_type = genomic DNA

SEQ ID NO: 121353 - DNA, 30 bp, Homo sapiens; identical to SEQ ID NO: 89599
  misc_feature 1..30: note = chr22:44451937-44451967
  misc_feature 1..30: note = Hypo
  source 1..30: mol_type = genomic DNA

SEQ ID NO: 121354 - DNA, 237 bp, Homo sapiens; identical to SEQ ID NO: 89600
  misc_feature 1..237: note = chr22:44455600-44455837
  misc_feature 1..237: note = Hypo
  source 1..237: mol_type = genomic DNA

SEQ ID NO: 121355 - DNA, 37 bp, Homo sapiens; identical to SEQ ID NO: 89601
  misc_feature 1..37: note = chr22:44456975-44457012
  misc_feature 1..37: note = Hypo
  source 1..37: mol_type = genomic DNA

SEQ ID NO: 121356 - DNA, 30 bp, Homo sapiens; identical to SEQ ID NO: 89602
  misc_feature 1..30: note = chr22:44478056-44478086
  misc_feature 1..30: note = Hypo
  source 1..30: mol_type = genomic DNA

SEQ ID NO: 121357 - DNA, 271 bp, Homo sapiens; identical to SEQ ID NO: 89603
  misc_feature 1..271: note = chr22:44484711-44484982
  misc_feature 1..271: note = Hypo
  source 1..271: mol_type = genomic DNA

SEQ ID NO: 121358 - DNA, 30 bp, Homo sapiens; identical to SEQ ID NO: 89604
  misc_feature 1..30: note = chr22:44487778-44487808
  misc_feature 1..30: note = Hypo
  source 1..30: mol_type = genomic DNA

SEQ ID NO: 121359 - DNA, 30 bp, Homo sapiens; identical to SEQ ID NO: 89605
  misc_feature 1..30: note = chr22:44490749-44490779
  misc_feature 1..30: note = Hypo
  source 1..30: mol_type = genomic DNA

SEQ ID NO: 121360 - DNA, 30 bp, Homo sapiens; identical to SEQ ID NO: 89606
  misc_feature 1..30: note = chr22:44492533-44492563
  misc_feature 1..30: note = Hypo
  source 1..30: mol_type = genomic DNA

SEQ ID NO: 121361 - DNA, 35 bp, Homo sapiens; identical to SEQ ID NO: 89607
  misc_feature 1..35: note = chr22:44493706-44493741
  misc_feature 1..35: note = Hypo
  source 1..35: mol_type = genomic DNA

SEQ ID NO: 121362 - DNA, 30 bp, Homo sapiens; identical to SEQ ID NO: 89608
  misc_feature 1..30: note = chr22:44498119-44498149
  misc_feature 1..30: note = Hypo
  source 1..30: mol_type = genomic DNA

SEQ ID NO: 121363 - DNA, 48 bp, Homo sapiens; identical to SEQ ID NO: 89609
  misc_feature 1..48: note = chr22:44500221-44500269
  misc_feature 1..48: note = Hypo
  source 1..48: mol_type = genomic DNA

SEQ ID NO: 121364 - DNA, 30 bp, Homo sapiens; identical to SEQ ID NO: 89610
  misc_feature 1..30: note = chr22:44512205-44512235
  misc_feature 1..30: note = Hypo
  source 1..30: mol_type = genomic DNA

SEQ ID NO: 121365 - DNA, 36 bp, Homo sapiens; identical to SEQ ID NO: 46756
  misc_feature 1..36: note = chr22:44527455-44527491
  misc_feature 1..36: note = Hypo
  source 1..36: mol_type = genomic DNA

SEQ ID NO: 121366 - DNA, 39 bp, Homo sapiens; identical to SEQ ID NO: 16798
  misc_feature 1..39: note = chr22:44538737-44538776
  misc_feature 1..39: note = Hypo
  source 1..39: mol_type = genomic DNA

SEQ ID NO: 121367 - DNA, 148 bp, Homo sapiens; identical to SEQ ID NO: 89613
  misc_feature 1..148: note = chr22:44547536-44547684
  misc_feature 1..148: note = Hypo
  source 1..148: mol_type = genomic DNA

SEQ ID NO: 121368 - DNA, 361 bp, Homo sapiens; identical to SEQ ID NO: 89614
  misc_feature 1..361: note = chr22:44564136-44564497
  misc_feature 1..361: note = Hypo
  source 1..361: mol_type = genomic DNA

SEQ ID NO: 121369 - DNA, 62 bp, Homo sapiens; identical to SEQ ID NO: 46760
  misc_feature 1..62: note = chr22:44580537-44580599
  misc_feature 1..62: note = Hypo
  source 1..62: mol_type = genomic DNA

SEQ ID NO: 121370 - DNA, 202 bp, Homo sapiens; identical to SEQ ID NO: 89616
  misc_feature 1..202: note = chr22:44664405-44664607
  misc_feature 1..202: note = Hypo
  source 1..202: mol_type = genomic DNA

SEQ ID NO: 121371 - DNA, 60 bp, Homo sapiens; identical to SEQ ID NO: 89617
  misc_feature 1..60: note = chr22:44671250-44671310
  misc_feature 1..60: note = Hypo
  source 1..60: mol_type = genomic DNA

SEQ ID NO: 121372 - DNA, 124 bp, Homo sapiens; identical to SEQ ID NO: 89618
  misc_feature 1..124: note = chr22:44681378-44681502
  misc_feature 1..124: note = Hypo
  source 1..124: mol_type = genomic DNA

SEQ ID NO: 121373 - DNA, 149 bp, Homo sapiens; identical to SEQ ID NO: 89619
  misc_feature 1..149: note = chr22:44698427-44698576
  misc_feature 1..149: note = Hypo
  source 1..149: mol_type = genomic DNA

SEQ ID NO: 121374 - DNA, 30 bp, Homo sapiens; identical to SEQ ID NO: 89620
  misc_feature 1..30: note = chr22:44708919-44708949
  misc_feature 1..30: note = Hypo
  source 1..30: mol_type = genomic DNA

SEQ ID NO: 121375 - DNA, 174 bp, Homo sapiens; identical to SEQ ID NO: 89621
  misc_feature 1..174: note = chr22:44715015-44715189
  misc_feature 1..174: note = Hypo
  source 1..174: mol_type = genomic DNA

SEQ ID NO: 121376 - DNA, 345 bp, Homo sapiens
  misc_feature 1..345: note = chr22:44726709-44727054
  misc_feature 1..345: note = Hyper
  source 1..345: mol_type = genomic DNA
ggatcaatgttgattcggccccggaggcgacagcggttccgcaggggccgcgcggcggaccaggacccaggggcacgcacttgggaggggtccttctacccgtcccctgcgctgcccagctgggacccccaggcccctctgggtccgcagcgtggccctcagtccccgtgcagcccgcacggggctcccagctcactgagctccccgactctgttcttggaagccagtcccccccttggacgcggattccggtcccggccgccgcgtcccggcgcggtgcgccccgaactgctctcttcggaacccagccccttcctctccaaggttcagcgaccccgaccttgg

SEQ ID NO: 121377 - DNA, 890 bp, Homo sapiens; identical to SEQ ID NO: 89623
  misc_feature 1..890: note = chr22:44727361-44728251
  misc_feature 1..890: note = Hyper
  source 1..890: mol_type = genomic DNA

SEQ ID NO: 121378 - DNA, 30 bp, Homo sapiens; identical to SEQ ID NO: 89624
  misc_feature 1..30: note = chr22:44765215-44765245
  misc_feature 1..30: note = Hypo
  source 1..30: mol_type = genomic DNA

SEQ ID NO: 121379 - DNA, 30 bp, Homo sapiens; identical to SEQ ID NO: 89625
  misc_feature 1..30: note = chr22:44782734-44782764
  misc_feature 1..30: note = Hypo
  source 1..30: mol_type = genomic DNA

SEQ ID NO: 121380 - DNA, 862 bp, Homo sapiens; identical to SEQ ID NO: 89626
  misc_feature 1..862: note = chr22:44892516-44893378
  misc_feature 1..862: note = Hypo
  source 1..862: mol_type = genomic DNA

SEQ ID NO: 121381 - DNA, 144 bp, Homo sapiens; identical to SEQ ID NO: 89627
  misc_feature 1..144: note = chr22:45004252-45004396
  misc_feature 1..144: note = Hypo
  source 1..144: mol_type = genomic DNA

SEQ ID NO: 121382 - DNA, 303 bp, Homo sapiens; identical to SEQ ID NO: 89628
  misc_feature 1..303: note = chr22:45016198-45016501
  misc_feature 1..303: note = Hyper
  source 1..303: mol_type = genomic DNA

SEQ ID NO: 121383 - DNA, 150 bp, Homo sapiens; identical to SEQ ID NO: 89629
  misc_feature 1..150: note = chr22:45020626-45020776
  misc_feature 1..150: note = Hypo
  source 1..150: mol_type = genomic DNA

SEQ ID NO: 121384 - DNA, 77 bp, Homo sapiens; identical to SEQ ID NO: 89630
  misc_feature 1..77: note = chr22:45064126-45064203
  misc_feature 1..77: note = Hyper
  source 1..77: mol_type = genomic DNA

SEQ ID NO: 121385 - DNA, 243 bp, Homo sapiens; identical to SEQ ID NO: 89631
  misc_feature 1..243: note = chr22:45064675-45064918
  misc_feature 1..243: note = Hyper
  source 1..243: mol_type = genomic DNA

SEQ ID NO: 121386 - DNA, 163 bp, Homo sapiens; identical to SEQ ID NO: 46766
  misc_feature 1..163: note = chr22:45075725-45075888
  misc_feature 1..163: note = Hypo
  source 1..163: mol_type = genomic DNA

SEQ ID NO: 121387 - DNA, 30 bp, Homo sapiens; identical to SEQ ID NO: 89633
  misc_feature 1..30: note = chr22:45085002-45085032
  misc_feature 1..30: note = Hypo
  source 1..30: mol_type = genomic DNA

SEQ ID NO: 121388 - DNA, 30 bp, Homo sapiens; identical to SEQ ID NO: 89634
  misc_feature 1..30: note = chr22:45087165-45087195
  misc_feature 1..30: note = Hypo
  source 1..30: mol_type = genomic DNA

SEQ ID NO: 121389 - DNA, 156 bp, Homo sapiens; identical to SEQ ID NO: 89635
  misc_feature 1..156: note = chr22:45088610-45088766
  misc_feature 1..156: note = Hypo
  source 1..156: mol_type = genomic DNA

SEQ ID NO: 121390 - DNA, 133 bp, Homo sapiens; identical to SEQ ID NO: 89636
  misc_feature 1..133: note = chr22:45093092-45093225
  misc_feature 1..133: note = Hypo
  source 1..133: mol_type = genomic DNA

SEQ ID NO: 121391 - DNA, 51 bp, Homo sapiens; identical to SEQ ID NO: 89637
  misc_feature 1..51: note = chr22:45098330-45098381
  misc_feature 1..51: note = Hyper
  source 1..51: mol_type = genomic DNA

SEQ ID NO: 121392 - DNA, 49 bp, Homo sapiens; identical to SEQ ID NO: 89638
  misc_feature 1..49: note = chr22:45098851-45098900
  misc_feature 1..49: note = Hyper
  source 1..49: mol_type = genomic DNA

SEQ ID NO: 121393 - DNA, 132 bp, Homo sapiens; identical to SEQ ID NO: 89639
  misc_feature 1..132: note = chr22:45120626-45120758
  misc_feature 1..132: note = Hypo
  source 1..132: mol_type = genomic DNA

SEQ ID NO: 121394 - DNA, 22 bp, Homo sapiens
  misc_feature 1..22: note = chr22:45129859-45129881
  misc_feature 1..22: note = Hypo
  source 1..22: mol_type = genomic DNA
gtacctgggtgtggccgggtgc

SEQ ID NO: 121395 - DNA, 40 bp, Homo sapiens; identical to SEQ ID NO: 89641
  misc_feature 1..40: note = chr22:45135939-45135979
  misc_feature 1..40: note = Hypo
  source 1..40: mol_type = genomic DNA

SEQ ID NO: 121396 - DNA, 99 bp, Homo sapiens; identical to SEQ ID NO: 89642
  misc_feature 1..99: note = chr22:45137823-45137922
  misc_feature 1..99: note = Hypo
  source 1..99: mol_type = genomic DNA

SEQ ID NO: 121397 - DNA, 213 bp, Homo sapiens; identical to SEQ ID NO: 89643
  misc_feature 1..213: note = chr22:45148657-45148870
  misc_feature 1..213: note = Hyper
  source 1..213: mol_type = genomic DNA

SEQ ID NO: 121398 - DNA, 30 bp, Homo sapiens; identical to SEQ ID NO: 89644
  misc_feature 1..30: note = chr22:45218482-45218512
  misc_feature 1..30: note = Hypo
  source 1..30: mol_type = genomic DNA

SEQ ID NO: 121399 - DNA, 162 bp, Homo sapiens; identical to SEQ ID NO: 89645
  misc_feature 1..162: note = chr22:45259666-45259828
  misc_feature 1..162: note = Hypo
  source 1..162: mol_type = genomic DNA

SEQ ID NO: 121400 - DNA, 351 bp, Homo sapiens; identical to SEQ ID NO: 89646
  misc_feature 1..351: note = chr22:45277170-45277521
  misc_feature 1..351: note = Hypo
  source 1..351: mol_type = genomic DNA

SEQ ID NO: 121401 - DNA, 30 bp, Homo sapiens; identical to SEQ ID NO: 89647
  misc_feature 1..30: note = chr22:45289175-45289205
  misc_feature 1..30: note = Hypo
  source 1..30: mol_type = genomic DNA

SEQ ID NO: 121402 - DNA, 30 bp, Homo sapiens; identical to SEQ ID NO: 89648
  misc_feature 1..30: note = chr22:45304141-45304171
  misc_feature 1..30: note = Hypo
  source 1..30: mol_type = genomic DNA

SEQ ID NO: 121403 - DNA, 30 bp, Homo sapiens; identical to SEQ ID NO: 89649
  misc_feature 1..30: note = chr22:45343734-45343764
  misc_feature 1..30: note = Hypo
  source 1..30: mol_type = genomic DNA

SEQ ID NO: 121404 - DNA, 30 bp, Homo sapiens; identical to SEQ ID NO: 89650
  misc_feature 1..30: note = chr22:45395822-45395852
  misc_feature 1..30: note = Hypo
  source 1..30: mol_type = genomic DNA

SEQ ID NO: 121405 - DNA, 401 bp, Homo sapiens; identical to SEQ ID NO: 89651
  misc_feature 1..401: note = chr22:45402788-45403189
  misc_feature 1..401: note = Hyper
  source 1..401: mol_type = genomic DNA

SEQ ID NO: 121406 - DNA, 1803 bp, Homo sapiens
  misc_feature 1..1803: note = chr22:45403911-45405714
  misc_feature 1..1803: note = Hyper
  source 1..1803: mol_type = genomic DNA
ttccccgggagctggcgtcaggttccaagaataaaaagtgaagctagggaagtggaaggtggtgggggggagggagcctcgaggaacgatttcaaaacgaggtttgccacggaacccagaaatcgcttccaacgagtttggtgtccaggcccccacggccgcccccctccgcccccatggccgcctcagcgcaaagcgggggactccgagccgggagaaatcgccacgttccaaaaacatgtccaccacctcaaaatggacgccgggccgcgcgctgccttttaagtgagctcctctcttcggcccccgcagggcccggctctccctgccgcctccgagaacccggctctttctttccaggaaaggggaggggtggggaactttgagaactggagacagacccctctgggagtctgagcgtgcgtcgcccaggctggcactttttagggcgccgccaaagtgcccagccaccctcccgccccatcccagggggggccgcgatcccatcgcttacttgtttgtcgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgggggccgaggccacccggcggcgcgccccgagccgtgcaagtttgcaggccggggtgcgtgtgcgagtgagtgtgagtgtgagtgtgtgccgggggaggggggaggaacaaagagccaagtaaacacggcgagtccgtgtcgagcaaagctcataaatattcaagtcgcgtcctaatctccccaacacacacacgcgcacgccgagccccgctcaggctccggccgccacgccgccgctcgccagcagcgatcgccaaaactacttctgcacaccgggcaggttcgcccggggcgcgggggcccgaggggaggccggaagggggcctattcgcactcccctccccgggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagcctggaagacccagagacccggaagagaggatgctgggctcgggtcccccgaccccctcaccccgcaacacactccccggccccgggcccggcccccggccacctacctggtggcgcgcgagttccacggcgagcgcctcgggccggctctgcagctccatcccggcaacttgggcagcactttgcgctcactttggcccgggctcccgggaagttgcgcggctccgcgggggccagagcgggcgcgggcggacgcggcctccgggctgggttgggggggacacgagccccctcccccacggccgaaagggaagggggctggcgaaggggaagacaggcttccgggcgccgcggcgccgagccctcggctgccccaactcctcaggctgcccggcaagttgcgccgggtccccgggctgccggcgcggcccggagcatggccccc

SEQ ID NO: 121407 - DNA, 441 bp, Homo sapiens
  misc_feature 1..441: note = chr22:45405944-45406385
  misc_feature 1..441: note = Hyper
  source 1..441: mol_type = genomic DNA
gccccgcccccgccccgcccgcgcctgcgcactgccgccccgccgcggcccggcaccccgagcggagaacaaaagtggcggtggacggggacgcacggtcgccggctccggggactgctcgggccgggcgctcggagaggacgactgcggagtcatcctctccgtccccgggccaacccggggaacgcggcgcccccaccccctgcgccgtgtaacgccgggatcaggacactttccgctgggaggctgcgagtccgtgtttccatttctcctcaccctggtcctcggctccctcctttcccccctcctccgcctccctctgatattttatttaaattcttccgtcccctcctgtccataccagcgccgcgacttgggggattaaattagtcgcgtcgccacattcccccgccgcctgatggcctccgtgttgtttaaaca

SEQ ID NO: 121408 - DNA, 142 bp, Homo sapiens; identical to SEQ ID NO: 89658
  misc_feature 1..142: note = chr22:45477440-45477582
  misc_feature 1..142: note = Hypo
  source 1..142: mol_type = genomic DNA

SEQ ID NO: 121409 - DNA, 49 bp, Homo sapiens; identical to SEQ ID NO: 16801
  misc_feature 1..49: note = chr22:45593666-45593715
  misc_feature 1..49: note = Hypo
  source 1..49: mol_type = genomic DNA

SEQ ID NO: 121410 - DNA, 104 bp, Homo sapiens; identical to SEQ ID NO: 89660
  misc_feature 1..104: note = chr22:45595127-45595231
  misc_feature 1..104: note = Hypo
  source 1..104: mol_type = genomic DNA

SEQ ID NO: 121411 - DNA, 30 bp, Homo sapiens; identical to SEQ ID NO: 89661
  misc_feature 1..30: note = chr22:45603916-45603946
  misc_feature 1..30: note = Hypo
  source 1..30: mol_type = genomic DNA

SEQ ID NO: 121412 - DNA, 203 bp, Homo sapiens; identical to SEQ ID NO: 89662
  misc_feature 1..203: note = chr22:45604184-45604387
  misc_feature 1..203: note = Hypo
  source 1..203: mol_type = genomic DNA

SEQ ID NO: 121413 - DNA, 218 bp, Homo sapiens; identical to SEQ ID NO: 89663
  misc_feature 1..218: note = chr22:45680590-45680808
  misc_feature 1..218: note = Hyper
  source 1..218: mol_type = genomic DNA

SEQ ID NO: 121414 - DNA, 142 bp, Homo sapiens; identical to SEQ ID NO: 89664
  misc_feature 1..142: note = chr22:45809468-45809610
  misc_feature 1..142: note = Hyper
  source 1..142: mol_type = genomic DNA

SEQ ID NO: 121415 - DNA, 722 bp, Homo sapiens
  misc_feature 1..722: note = chr22:45898351-45899073
  misc_feature 1..722: note = Hyper
  source 1..722: mol_type = genomic DNA
agggtgcggggttggcggtaaggcctgccccagtgccccccagcagccgggcctccgactgcaggcccgggtccccgctcctccgcgcggagtcgggcggggataacctttgatcccgagccctcccctcgagagggggtggggggaggaggggatcgggtttcacggagtgttgggggataggactgggggcatccggcccgaaggcgccccctctgtgccccctccggggaagtctgggatccaggccctcgcccccagccgtgggcgcgcgcccctcgcagccggggtccggggagggagggtcccggcagggggcgccggggagggaggaccaggagacccgcggccccgcctccgccgcgccctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggaggtaggggcgtcccgggtccgccgccccagcttagggtcccgaccccctcggcctcgcgctccctgcgagtttcggaaccacggggactcggagtccgtgcgttgccctgcgcggcgcccccggactgtc

SEQ ID NO: 121416 - DNA, 106 bp, Homo sapiens; identical to SEQ ID NO: 46773
  misc_feature 1..106: note = chr22:45931289-45931395
  misc_feature 1..106: note = Hypo
  source 1..106: mol_type = genomic DNA

SEQ ID NO: 121417 - DNA, 55 bp, Homo sapiens; identical to SEQ ID NO: 89668
  misc_feature 1..55: note = chr22:45939677-45939732
  misc_feature 1..55: note = Hypo
  source 1..55: mol_type = genomic DNA

SEQ ID NO: 121418 - DNA, 30 bp, Homo sapiens; identical to SEQ ID NO: 46774
  misc_feature 1..30: note = chr22:45981309-45981339
  misc_feature 1..30: note = Hypo
  source 1..30: mol_type = genomic DNA

SEQ ID NO: 121419 - DNA, 30 bp, Homo sapiens; identical to SEQ ID NO: 89670
  misc_feature 1..30: note = chr22:46077505-46077535
  misc_feature 1..30: note = Hypo
  source 1..30: mol_type = genomic DNA

SEQ ID NO: 121420 - DNA, 1430 bp, Homo sapiens
  misc_feature 1..1430: note = chr22:46262418-46263848
  misc_feature 1..1430: note = Hyper
  source 1..1430: mol_type = genomic DNA
gggaggtggagacagcgcgctcccgagccctggaccactccctctgccccgcgcggggccgagctccacggcacgtgctttggcttggaccgggaaggcccgcagtcccacagtgcccggggaggacggtccgcgccttccacgacttcgcgccgcccgcgtggctgcagcgccgtggcccggggacgcgaggccacagcccgggagcgaggagcgcgggaggaccggcctgcctgtgcccggcaaagggggcccttccgaggcgggctcccttccccgccgctcccgtaagcgcgggagccagaggaccccagacccgccgcggcccaccccaagccccgatcaagtcctgcagcgcgggagggacccctgcaggcgcggggccagacgggcgacaaagcggcggactgcgagggccctgaggaagccggcggcgcggggtcaggagcaacctgctattcgtagggtcaggagcccacgcgtccccactgcggagggcggggtcgcagccaggcctccccgtttctagctgtgcggcctggggcgaggtgcttgacctctcggggcctcagtttccttctctatgaagcggagctgatcggccgcgtcccggggctgctgtgacagtccaaggcgagaacagcagctccgcgccgcccctggtgctggagaaccgctggggcctcgggagagggcgcggcgcggcggagcggccctggcagccggagggcgcgtgtggccagggccgatcctgcactgccctctgcgggatggcccggcccagtcctcgacccccagcacctccgccgcccggcctggccaccacctccgctccacgcgcccaggccgctcccgtcgcgggtctcggagattctcccgcgcccaggggtgtcccgcagccccgggcctcagcacccagcgctcccttctccacgacgacaatgaggcggaccctccccagcgccctccagagctgtcgcatcccgggaggtcagggcgagtgttgtttgcatttcacagagcaggaagcttaggcacagacagcggctccccgaccctcgctcggcctctgctgagcagggaacggcctgaacgcgtccggccaagcgccgcctccggcctctgcccgcggcccggcgcgccctcctccccagcgcgcccctatcctgcacgcatccgcggccccgggccctttccgcagccccacgcggtctcctcccgggttaaatctatccactcgcgcgttccttggcagccgtgatcacaggcgtgaccacggtccccaagccctcgcgcctccgtccacgctattgcggccgcccctgcgcgcctgtcccctccctgtcccctccttccagctctggaaacagcagcaccggaagccccctgccccagactcactgcccacccccggccgagctggctgccag

SEQ ID NO: 121421 - DNA, 130 bp, Homo sapiens; identical to SEQ ID NO: 89674
  misc_feature 1..130: note = chr22:46276993-46277123
  misc_feature 1..130: note = Hyper
  source 1..130: mol_type = genomic DNA

SEQ ID NO: 121422 - DNA, 30 bp, Homo sapiens; identical to SEQ ID NO: 89675
  misc_feature 1..30: note = chr22:46278524-46278554
  misc_feature 1..30: note = Hypo
  source 1..30: mol_type = genomic DNA

SEQ ID NO: 121423 - DNA, 39 bp, Homo sapiens; identical to SEQ ID NO: 89676
  misc_feature 1..39: note = chr22:46318740-46318779
  misc_feature 1..39: note = Hypo
  source 1..39: mol_type = genomic DNA

SEQ ID NO: 121424 - DNA, 30 bp, Homo sapiens; identical to SEQ ID NO: 89677
  misc_feature 1..30: note = chr22:46346365-46346395
  misc_feature 1..30: note = Hypo
  source 1..30: mol_type = genomic DNA

SEQ ID NO: 121425 - DNA, 58 bp, Homo sapiens; identical to SEQ ID NO: 38600
  misc_feature 1..58: note = chr22:46367066-46367124
  misc_feature 1..58: note = Hyper
  source 1..58: mol_type = genomic DNA

SEQ ID NO: 121426 - DNA, 303 bp, Homo sapiens
  misc_feature 1..303: note = chr22:46368029-46368332
  misc_feature 1..303: note = Hyper
  source 1..303: mol_type = genomic DNA
ctcacaagtagctgccgctggacaggaggagaaagatctgcgggcaatagacggagacgagcgcgctgcgcggcgacagtagaagcatggtgggccggcgtgcctggcggggctgaacaggctccgcgggccgggcgcctgggccagctgaggccggggtccccgcggagctccccgatgcagggcggcggcgctgggcgctaggggccgggtctcgtgggcccgggcgcagttgtcgcccgtgccccgccgctagggccgcgcatggcgctgggtctggggcagcggcgggagctggggctg

SEQ ID NO: 121427 - DNA, 404 bp, Homo sapiens; identical to SEQ ID NO: 89680
  misc_feature 1..404: note = chr22:46372053-46372457
  misc_feature 1..404: note = Hyper
  source 1..404: mol_type = genomic DNA

SEQ ID NO: 121428 - DNA, 30 bp, Homo sapiens; identical to SEQ ID NO: 89681
  misc_feature 1..30: note = chr22:46372944-46372974
  misc_feature 1..30: note = Hyper
  source 1..30: mol_type = genomic DNA

SEQ ID NO: 121429 - DNA, 47 bp, Homo sapiens; identical to SEQ ID NO: 89682
  misc_feature 1..47: note = chr22:46373779-46373826
  misc_feature 1..47: note = Hyper
  source 1..47: mol_type = genomic DNA

SEQ ID NO: 121430 - DNA, 24 bp, Homo sapiens
  misc_feature 1..24: note = chr22:46410610-46410634
  misc_feature 1..24: note = Hypo
  source 1..24: mol_type = genomic DNA
gtgagccaccgcgcacggctatcc

SEQ ID NO: 121431 - DNA, 172 bp, Homo sapiens; identical to SEQ ID NO: 89684
  misc_feature 1..172: note = chr22:46435835-46436007
  misc_feature 1..172: note = Hypo
  source 1..172: mol_type = genomic DNA

SEQ ID NO: 121432 - DNA, 27 bp, Homo sapiens
  misc_feature 1..27: note = chr22:46438085-46438112
  misc_feature 1..27: note = Hypo
  source 1..27: mol_type = genomic DNA
aaaatcagctgggcacgttggctcacg

SEQ ID NO: 121433 - DNA, 153 bp, Homo sapiens; identical to SEQ ID NO: 89686
  misc_feature 1..153: note = chr22:46440550-46440703
  misc_feature 1..153: note = Hyper
  source 1..153: mol_type = genomic DNA

SEQ ID NO: 121434 - DNA, 120 bp, Homo sapiens
  misc_feature 1..120: note = chr22:46440994-46441114
  misc_feature 1..120: note = Hyper
  source 1..120: mol_type = genomic DNA
gccgctgcaccggagcgcacggccgagcccgcggcccggcccccggcgaagtcagcccccagcctcccaaacaaagactcgcaaagttcggaagagaatctttcccgacattttccctcc

SEQ ID NO: 121435 - DNA, 118 bp, Homo sapiens; identical to SEQ ID NO: 89688
  misc_feature 1..118: note = chr22:46495143-46495261
  misc_feature 1..118: note = Hypo
  source 1..118: mol_type = genomic DNA

SEQ ID NO: 121436 - DNA, 30 bp, Homo sapiens; identical to SEQ ID NO: 89689
  misc_feature 1..30: note = chr22:46498655-46498685
  misc_feature 1..30: note = Hypo
  source 1..30: mol_type = genomic DNA

SEQ ID NO: 121437 - DNA, 55 bp, Homo sapiens; identical to SEQ ID NO: 89690
  misc_feature 1..55: note = chr22:46512624-46512679
  misc_feature 1..55: note = Hyper
  source 1..55: mol_type = genomic DNA

SEQ ID NO: 121438 - DNA, 187 bp, Homo sapiens; identical to SEQ ID NO: 89691
  misc_feature 1..187: note = chr22:46521852-46522039
  misc_feature 1..187: note = Hypo
  source 1..187: mol_type = genomic DNA

SEQ ID NO: 121439 - DNA, 53 bp, Homo sapiens; identical to SEQ ID NO: 89692
  misc_feature 1..53: note = chr22:46545478-46545531
  misc_feature 1..53: note = Hyper
  source 1..53: mol_type = genomic DNA

SEQ ID NO: 121440 - DNA, 30 bp, Homo sapiens; identical to SEQ ID NO: 89693
  misc_feature 1..30: note = chr22:46571644-46571674
  misc_feature 1..30: note = Hypo
  source 1..30: mol_type = genomic DNA

SEQ ID NO: 121441 - DNA, 34 bp, Homo sapiens; identical to SEQ ID NO: 89694
  misc_feature 1..34: note = chr22:46615432-46615466
  misc_feature 1..34: note = Hypo
  source 1..34: mol_type = genomic DNA

SEQ ID NO: 121442 - DNA, 232 bp, Homo sapiens; identical to SEQ ID NO: 89695
  misc_feature 1..232: note = chr22:46634500-46634732
  misc_feature 1..232: note = Hypo
  source 1..232: mol_type = genomic DNA

SEQ ID NO: 121443 - DNA, 21 bp, Homo sapiens
  misc_feature 1..21: note = chr22:46651216-46651237
  misc_feature 1..21: note = Hypo
  source 1..21: mol_type = genomic DNA
ccactgcgcccagcccccatg

SEQ ID NO: 121444 - DNA, 286 bp, Homo sapiens
  misc_feature 1..286: note = chr22:46658633-46658919
  misc_feature 1..286: note = Hyper
  source 1..286: mol_type = genomic DNA
cggcctgcaacatcacgcgcgcggggccgtctgtggggcactcggtgcgggccacgaagccctgctggggccgcgggcctggcgcggcggagcgcggggagacgcgggccgcgggggaggccgggcgggcggcgccgggtccgagcagccgcaggcggaaggcccaggccaggcgcccgggcgagcgcggcagccgcacggaccacgtcagggagaggcggccgccgcgcgcggagagctgcaggtcgacgagcgcgagcgcgggcgcggccggccagggcaggcg

SEQ ID NO: 121445 - DNA, 144 bp, Homo sapiens; identical to SEQ ID NO: 89698
  misc_feature 1..144: note = chr22:46719046-46719190
  misc_feature 1..144: note = Hypo
  source 1..144: mol_type = genomic DNA

SEQ ID NO: 121446 - DNA, 37 bp, Homo sapiens; identical to SEQ ID NO: 89699
  misc_feature 1..37: note = chr22:46748950-46748987
  misc_feature 1..37: note = Hypo
  source 1..37: mol_type = genomic DNA

SEQ ID NO: 121447 - DNA, 77 bp, Homo sapiens; identical to SEQ ID NO: 89700
  misc_feature 1..77: note = chr22:46770807-46770884
  misc_feature 1..77: note = Hypo
  source 1..77: mol_type = genomic DNA

SEQ ID NO: 121448 - DNA, 138 bp, Homo sapiens; identical to SEQ ID NO: 89701
  misc_feature 1..138: note = chr22:46805005-46805143
  misc_feature 1..138: note = Hypo
  source 1..138: mol_type = genomic DNA

SEQ ID NO: 121449 - DNA, 30 bp, Homo sapiens; identical to SEQ ID NO: 89702
  misc_feature 1..30: note = chr22:46847001-46847031
  misc_feature 1..30: note = Hypo
  source 1..30: mol_type = genomic DNA

SEQ ID NO: 121450 - DNA, 148 bp, Homo sapiens; identical to SEQ ID NO: 46779
  misc_feature 1..148: note = chr22:46929253-46929401
  misc_feature 1..148: note = Hypo
  source 1..148: mol_type = genomic DNA

SEQ ID NO: 121451 - DNA, 93 bp, Homo sapiens; identical to SEQ ID NO: 89704
  misc_feature 1..93: note = chr22:46929625-46929718
  misc_feature 1..93: note = Hypo
  source 1..93: mol_type = genomic DNA

SEQ ID NO: 121452 - DNA, 113 bp, Homo sapiens; identical to SEQ ID NO: 89705
  misc_feature 1..113: note = chr22:46929921-46930034
  misc_feature 1..113: note = Hypo
  source 1..113: mol_type = genomic DNA

SEQ ID NO: 121453 - DNA, 30 bp, Homo sapiens; identical to SEQ ID NO: 89706
  misc_feature 1..30: note = chr22:46930811-46930841
  misc_feature 1..30: note = Hypo
  source 1..30: mol_type = genomic DNA

SEQ ID NO: 121454 - DNA, 30 bp, Homo sapiens; identical to SEQ ID NO: 89707
  misc_feature 1..30: note = chr22:46931231-46931261
  misc_feature 1..30: note = Hypo
  source 1..30: mol_type = genomic DNA

SEQ ID NO: 121455 - DNA, 409 bp, Homo sapiens; identical to SEQ ID NO: 89708
  misc_feature 1..409: note = chr22:46931719-46932128
  misc_feature 1..409: note = Hypo
  source 1..409: mol_type = genomic DNA

SEQ ID NO: 121456 - DNA, 277 bp, Homo sapiens; identical to SEQ ID NO: 89709
  misc_feature 1..277: note = chr22:46932725-46933002
  misc_feature 1..277: note = Hyper
  source 1..277: mol_type = genomic DNA

SEQ ID NO: 121457 - DNA, 173 bp, Homo sapiens; identical to SEQ ID NO: 46782
  misc_feature 1..173: note = chr22:47005073-47005246
  misc_feature 1..173: note = Hypo
  source 1..173: mol_type = genomic DNA

SEQ ID NO: 121458 - DNA, 57 bp, Homo sapiens; identical to SEQ ID NO: 46783
  misc_feature 1..57: note = chr22:47005505-47005562
  misc_feature 1..57: note = Hypo
  source 1..57: mol_type = genomic DNA

SEQ ID NO: 121459 - DNA, 81 bp, Homo sapiens; identical to SEQ ID NO: 89712
  misc_feature 1..81: note = chr22:47022551-47022632
  misc_feature 1..81: note = Hypo
  source 1..81: mol_type = genomic DNA

SEQ ID NO: 121460 - DNA, 69 bp, Homo sapiens; identical to SEQ ID NO: 89713
  misc_feature 1..69: note = chr22:47023112-47023181
  misc_feature 1..69: note = Hypo
  source 1..69: mol_type = genomic DNA

SEQ ID NO: 121461 - DNA, 89 bp, Homo sapiens; identical to SEQ ID NO: 89714
  misc_feature 1..89: note = chr22:47054535-47054624
  misc_feature 1..89: note = Hypo
  source 1..89: mol_type = genomic DNA

SEQ ID NO: 121462 - DNA, 36 bp, Homo sapiens; identical to SEQ ID NO: 46785
  misc_feature 1..36: note = chr22:47193335-47193371
  misc_feature 1..36: note = Hypo
  source 1..36: mol_type = genomic DNA

SEQ ID NO: 121463 - DNA, 30 bp, Homo sapiens; identical to SEQ ID NO: 89716
  misc_feature 1..30: note = chr22:47298494-47298524
  misc_feature 1..30: note = Hypo
  source 1..30: mol_type = genomic DNA

SEQ ID NO: 121464 - DNA, 30 bp, Homo sapiens; identical to SEQ ID NO: 89717
  misc_feature 1..30: note = chr22:47328152-47328182
  misc_feature 1..30: note = Hypo
  source 1..30: mol_type = genomic DNA

SEQ ID NO: 121465 - DNA, 183 bp, Homo sapiens; identical to SEQ ID NO: 89718
  misc_feature 1..183: note = chr22:47428866-47429049
  misc_feature 1..183: note = Hypo
  source 1..183: mol_type = genomic DNA

SEQ ID NO: 121466 - DNA, 78 bp, Homo sapiens; identical to SEQ ID NO: 89719
  misc_feature 1..78: note = chr22:47523374-47523452
  misc_feature 1..78: note = Hypo
  source 1..78: mol_type = genomic DNA

SEQ ID NO: 121467 - DNA, 219 bp, Homo sapiens; identical to SEQ ID NO: 46787
  misc_feature 1..219: note = chr22:47525705-47525924
  misc_feature 1..219: note = Hypo
  source 1..219: mol_type = genomic DNA

SEQ ID NO: 121468 - DNA, 66 bp, Homo sapiens; identical to SEQ ID NO: 89721
  misc_feature 1..66: note = chr22:47594807-47594873
  misc_feature 1..66: note = Hypo
  source 1..66: mol_type = genomic DNA

SEQ ID NO: 121469 - DNA, 143 bp, Homo sapiens; identical to SEQ ID NO: 89722
  misc_feature 1..143: note = chr22:47598585-47598728
  misc_feature 1..143: note = Hypo
  source 1..143: mol_type = genomic DNA

SEQ ID NO: 121470 - DNA, 158 bp, Homo sapiens; identical to SEQ ID NO: 89723
  misc_feature 1..158: note = chr22:47605408-47605566
  misc_feature 1..158: note = Hypo
  source 1..158: mol_type = genomic DNA

SEQ ID NO: 121471 - DNA, 16 bp, Homo sapiens
  misc_feature 1..16: note = chr22:47622148-47622164
  misc_feature 1..16: note = Hypo
  source 1..16: mol_type = genomic DNA
gcggtttggatggctg

SEQ ID NO: 121472 - DNA, 39 bp, Homo sapiens; identical to SEQ ID NO: 89725
  misc_feature 1..39: note = chr22:47666772-47666811
  misc_feature 1..39: note = Hypo
  source 1..39: mol_type = genomic DNA

SEQ ID NO: 121473 - DNA, 100 bp, Homo sapiens; identical to SEQ ID NO: 89726
  misc_feature 1..100: note = chr22:47739194-47739294
  misc_feature 1..100: note = Hypo
  source 1..100: mol_type = genomic DNA

SEQ ID NO: 121474 - DNA, 36 bp, Homo sapiens; identical to SEQ ID NO: 89727
  misc_feature 1..36: note = chr22:47840461-47840497
  misc_feature 1..36: note = Hypo
  source 1..36: mol_type = genomic DNA

SEQ ID NO: 121475 - DNA, 110 bp, Homo sapiens; identical to SEQ ID NO: 89728
  misc_feature 1..110: note = chr22:48027676-48027786
  misc_feature 1..110: note = Hypo
  source 1..110: mol_type = genomic DNA

SEQ ID NO: 121476 - DNA, 30 bp, Homo sapiens; identical to SEQ ID NO: 89729
  misc_feature 1..30: note = chr22:48465028-48465058
  misc_feature 1..30: note = Hypo
  source 1..30: mol_type = genomic DNA

SEQ ID NO: 121477 - DNA, 173 bp, Homo sapiens; identical to SEQ ID NO: 89730
  misc_feature 1..173: note = chr22:48548955-48549128
  misc_feature 1..173: note = Hypo
  source 1..173: mol_type = genomic DNA

SEQ ID NO: 121478 - DNA, 34 bp, Homo sapiens; identical to SEQ ID NO: 46790
  misc_feature 1..34: note = chr22:48553477-48553511
  misc_feature 1..34: note = Hypo
  source 1..34: mol_type = genomic DNA

SEQ ID NO: 121479 - DNA, 30 bp, Homo sapiens; identical to SEQ ID NO: 89732
  misc_feature 1..30: note = chr22:48631792-48631822
  misc_feature 1..30: note = Hypo
  source 1..30: mol_type = genomic DNA

SEQ ID NO: 121480 - DNA, 30 bp, Homo sapiens; identical to SEQ ID NO: 89733
  misc_feature 1..30: note = chr22:48657078-48657108
  misc_feature 1..30: note = Hypo
  source 1..30: mol_type = genomic DNA

SEQ ID NO: 121481 - DNA, 67 bp, Homo sapiens; identical to SEQ ID NO: 89734
  misc_feature 1..67: note = chr22:48661092-48661159
  misc_feature 1..67: note = Hypo
  source 1..67: mol_type = genomic DNA

SEQ ID NO: 121482 - DNA, 86 bp, Homo sapiens; identical to SEQ ID NO: 89735
  misc_feature 1..86: note = chr22:48728717-48728803
  misc_feature 1..86: note = Hypo
  source 1..86: mol_type = genomic DNA

SEQ ID NO: 121483 - DNA, 30 bp, Homo sapiens; identical to SEQ ID NO: 89736
  misc_feature 1..30: note = chr22:48729299-48729329
  misc_feature 1..30: note = Hypo
  source 1..30: mol_type = genomic DNA

SEQ ID NO: 121484 - DNA, 30 bp, Homo sapiens; identical to SEQ ID NO: 46793
  misc_feature 1..30: note = chr22:48793754-48793784
  misc_feature 1..30: note = Hypo
  source 1..30: mol_type = genomic DNA

SEQ ID NO: 121485 - DNA, 30 bp, Homo sapiens; identical to SEQ ID NO: 89738
  misc_feature 1..30: note = chr22:48836877-48836907
  misc_feature 1..30: note = Hypo
  source 1..30: mol_type = genomic DNA

SEQ ID NO: 121486 - DNA, 2071 bp, Homo sapiens
  misc_feature 1..2071: note = chr22:48884914-48886985
  misc_feature 1..2071: note = Hyper
  source 1..2071: mol_type = genomic DNA
tccaggccctggctgcggtggatgggggcgcggaaggcccaagtgcgcgaacttcacctggcccggccgtcctccccgtggggggcccaggctgcgggcgcgtcaggccgtctctgtcgccatccggaggagcggcttgggcgccgcgtcccctctgccaggcccgggtcggcgggcggctggagcccccagcggtggcgggcgcgcgcctctctcgcggatgccggggcgcgcgtagccggggcgcgcagtgacgcccagagcggggccggcgtccccctggcgggccggcgcggggtcggcgggcgcgggcgcgagcgcgggcggcgcgggcgcggcgcggggcgcggtgggccggggcccgggcgcggcggcggcggcggcggaggatggcgcgcgcggggcccgcacgtggaggccggcgcgggggcgcgggcagggccggctgctgagacgcgctgctgccccccgcgcgggcgccgcggcttcaatggcgccatcgcccaggaccggcagccggcaagatgcgaccgccctgcccagcatgtcctcaactttctgggcgttcatgatcctggccagcctgctcatcgcctactgcagtgagtaccgcgcggccccggccccggcacggccctctgggccccggaccccctcctccggccccggcaggcgccccgcgggcctcccggagtcggcgcggagttacgagcgccgggcgcatggtcccccgagtcccggccggtccaacgctgcgctgggcgggcgagagggtccacccgggttccgggcgctcgagcacttcggggtcggacgccccggcccgagcctcccttccctgactccccggcagggcccgggctccaggccccgggtggcgcggcccgtccctgcccggcggtcggagcccagccagcggcttcccggccgagatgcgcgctcaggaggcagccgcaggtcgcggagggcgggcggcgctgccggggtgtctgcggagcgccctccccgtgcctcagcccgggacaaggggggaggcggcggccgagcccggagaggagctcttcaggcaggagcccagcctgggctcggaggagcagctggagcttccgctttcccgggaaacgggctcgtcaggcgccttctggaaagagaagcgaagtgagggatgggatgcccggagggggctcgccgcggccgcggacgtttctcgggtcgtgtctggggcccgagctggtgaccggcgggactggcgcgggcgcgggctggggtggtgcgggccagtgggcgcccgggcgtgagctgagggctggggtagggggtgaccgccgcgggctccctgttgcctggagtgaagggtggggggtggcctgtgcccctgccgaggctccaggcgggtggaatgaggggtggttggagtcccgggtgcagactccagcctcggcgctggggagggtgctcagcatcccggggcacgttcgcggctggtggggtaagtgggggccgctcagcgtcccgggcacaggctctggccccagatggcgcgggctggtcggcttcagctccgggagctccgggcttcttgtcttcagcgggagaataggacgggtgctggggagcacctgtcatggagaattgccatgggcgcgggaggtgatggaaaaatatggattctttacaaaaaaaaaaaaaaaaggccagcaccgaacctccctccacagacaccacctcctccagagccccgggcctccaagctcccagtccgatctgatccttccgctgtcgccaaaatgagagcacagtggcccagggagacccgggcagccgcgggatcggcctccggagtcctgggacagcccagctcgccaggatcgcaagggaaacccggggaccagagcaggaattttcctacttgcttcagcgcggttatgcatttccctagaaatgctgtggcaccgagcggggaggggtcgccaagcctgggggtctcaacccgagctgcccaggcagacgaggccaccgtgggtgcgccggcgcccctgggaactcactggctggccgcctgcagggagca

SEQ ID NO: 121487 - DNA, 175 bp, Homo sapiens; identical to SEQ ID NO: 89743
  misc_feature 1..175: note = chr22:48907729-48907904
  misc_feature 1..175: note = Hypo
  source 1..175: mol_type = genomic DNA

SEQ ID NO: 121488 - DNA, 98 bp, Homo sapiens; identical to SEQ ID NO: 89744
  misc_feature 1..98: note = chr22:48912088-48912186
  misc_feature 1..98: note = Hypo
  source 1..98: mol_type = genomic DNA

SEQ ID NO: 121489 - DNA, 198 bp, Homo sapiens; identical to SEQ ID NO: 89745
  misc_feature 1..198: note = chr22:48917385-48917583
  misc_feature 1..198: note = Hypo
  source 1..198: mol_type = genomic DNA

SEQ ID NO: 121490 - DNA, 37 bp, Homo sapiens; identical to SEQ ID NO: 89746
  misc_feature 1..37: note = chr22:48919191-48919228
  misc_feature 1..37: note = Hypo
  source 1..37: mol_type = genomic DNA

SEQ ID NO: 121491 - DNA, 241 bp, Homo sapiens; identical to SEQ ID NO: 46795
  misc_feature 1..241: note = chr22:48931827-48932068
  misc_feature 1..241: note = Hypo
  source 1..241: mol_type = genomic DNA

SEQ ID NO: 121492 - DNA, 40 bp, Homo sapiens; identical to SEQ ID NO: 89748
  misc_feature 1..40: note = chr22:48939361-48939401
  misc_feature 1..40: note = Hypo
  source 1..40: mol_type = genomic DNA

SEQ ID NO: 121493 - DNA, 30 bp, Homo sapiens; identical to SEQ ID NO: 89749
  misc_feature 1..30: note = chr22:48947525-48947555
  misc_feature 1..30: note = Hypo
  source 1..30: mol_type = genomic DNA

SEQ ID NO: 121494 - DNA, 94 bp, Homo sapiens; identical to SEQ ID NO: 89750
  misc_feature 1..94: note = chr22:48958660-48958754
  misc_feature 1..94: note = Hypo
  source 1..94: mol_type = genomic DNA

SEQ ID NO: 121495 - DNA, 1907 bp, Homo sapiens
  misc_feature 1..1907: note = chr22:48970842-48972749
  misc_feature 1..1907: note = Hyper
  source 1..1907: mol_type = genomic DNA
tccaggcagatgtgccgttttcagaagccgcgggaccagcctcctccgagccctcccagccgctggtcgggcccggctggggcggtacctgggcctggggtttccctgtctctcctggggccttgggtgcgagggaggctgggcgccactcgaggccccgcgtccggtctcccgcgccagcagggccggctctgcagtgaggcccctgcgcacctaggtggagcccgacccgcagttttcggctgggccggccccacctgacccgccggcgcgccaggcgggggcgctgcagggcggggtccccggggtccctcgcggcccagtgcgcatccgcggctccgcggccgggaggagcgcagacggcggcgggcgcgggccggagtccgaggctgcgcgggcccggccacctgggccggcagcgactgcgccgcgctccccctcccgccgcctcccccgaggagccggcgccgagccgagcgggcgggcgcgcgcctccaggccggagcagcggcgtcccgcgggcggcgaggcgcgcagcgtcgccggccccacctgtaggcgcggcagccaccggcaccggcaccgacaccggcagcggcggcccagcgtgggcagcccaggggcgcggtgggcccggacctagtcccggccgcggcggcggaggcgcgggctgctgggagcgcagaggccggcaccgtccggtggggaccggcccgccagccccgggccgcgcaagttcgatcgccgcgggctcggccgggccgcgcggaccccggcggcggcgatggtgcggcagccccgcgcccggcgcgcagccccggccccgagcctggcccgccgcggcggcggtggcggcggcggcgcggcggccccctgagccccgggccggagcgagcgcgggcggcggaggaggcggcggcggcggaggaagaggaggaggaggaaggcgacgccgagcagcgggcggtgggggccgacaggcggaggagggggccggggccgcgccggaccccccccccccccgcgccgcccggccgttgcgcaatccgcggcccgccgtccgggccctgctggcggtgcggctccgggggcggcggcggggctgattcatggggccgcggcggccgccccccggcgccccgcagccagcgatggtggccgagtggtcggagcggcggccgccgcggcccgagactttctgctaacctccccgcccccgcccgccccctccgcggcgcccccctccccccgcccgctcccctcccccctgcccagaaagacacaaatcgcctcccggagtggcgcctccagtcgcggcggagcgcggcgttggcggcggatggagggcgcgagcgggcggccgcggaggctgcacccggcggggcgctgatgcggcgcctggaccttcgctgcgcgacttcgggggcgtcggccgagttgggactccgcgatgcagctcctgaaggcgctctgggcactggcaggggccgcgctctgctgcttcctcgtcctagtgatccacgcgcagttcctcaaagaaggtaattgtccccgggcgcgcggaccggtcctccgcgctctgcccggctcgcggcggctccggcgcccgacccggcttccagcacgttccgctgccgccgcgctcggctgaggctcgtggagcgccactgcgggcccggagcggccggcggcgcgaccctaccaggagcccgaccccccgcggatctcgctgccccgcgcccatcggggctcaccggcagggcgcggggtcggggcgcgctgcgttctcggtgcctctggcgccgccccggatccccagcccaagccgaggctgccgttcccatcccctgccccactgggctcggtggcagcggcgcccgcccgcacgccgccgggccctcggtaga

SEQ ID NO: 121496 - DNA, 106 bp, Homo sapiens; identical to SEQ ID NO: 46796
  misc_feature 1..106: note = chr22:48976157-48976263
  misc_feature 1..106: note = Hypo
  source 1..106: mol_type = genomic DNA

SEQ ID NO: 121497 - DNA, 144 bp, Homo sapiens; identical to SEQ ID NO: 46797
  misc_feature 1..144: note = chr22:48987212-48987356
  misc_feature 1..144: note = Hypo
  source 1..144: mol_type = genomic DNA

SEQ ID NO: 121498 - DNA, 72 bp, Homo sapiens; identical to SEQ ID NO: 89758
  misc_feature 1..72: note = chr22:48996677-48996749
  misc_feature 1..72: note = Hypo
  source 1..72: mol_type = genomic DNA

SEQ ID NO: 121499 - DNA, 30 bp, Homo sapiens; identical to SEQ ID NO: 89759
  misc_feature 1..30: note = chr22:48997695-48997725
  misc_feature 1..30: note = Hypo
  source 1..30: mol_type = genomic DNA

SEQ ID NO: 121500 - DNA, 152 bp, Homo sapiens; identical to SEQ ID NO: 89760
  misc_feature 1..152: note = chr22:49013333-49013485
  misc_feature 1..152: note = Hypo
  source 1..152: mol_type = genomic DNA

SEQ ID NO: 121501 - DNA, 30 bp, Homo sapiens; identical to SEQ ID NO: 89761
  misc_feature 1..30: note = chr22:49039051-49039081
  misc_feature 1..30: note = Hypo
  source 1..30: mol_type = genomic DNA

SEQ ID NO: 121502 - DNA, 186 bp, Homo sapiens; identical to SEQ ID NO: 89762
  misc_feature 1..186: note = chr22:49048024-49048210
  misc_feature 1..186: note = Hypo
  source 1..186: mol_type = genomic DNA

SEQ ID NO: 121503 - DNA, 52 bp, Homo sapiens; identical to SEQ ID NO: 89763
  misc_feature 1..52: note = chr22:49063305-49063357
  misc_feature 1..52: note = Hypo
  source 1..52: mol_type = genomic DNA

SEQ ID NO: 121504 - DNA, 30 bp, Homo sapiens; identical to SEQ ID NO: 89764
  misc_feature 1..30: note = chr22:49070079-49070109
  misc_feature 1..30: note = Hypo
  source 1..30: mol_type = genomic DNA

SEQ ID NO: 121505 - DNA, 194 bp, Homo sapiens; identical to SEQ ID NO: 89765
  misc_feature 1..194: note = chr22:49115630-49115824
  misc_feature 1..194: note = Hypo
  source 1..194: mol_type = genomic DNA

SEQ ID NO: 121506 - DNA, 84 bp, Homo sapiens; identical to SEQ ID NO: 89766
  misc_feature 1..84: note = chr22:49117075-49117159
  misc_feature 1..84: note = Hypo
  source 1..84: mol_type = genomic DNA

SEQ ID NO: 121507 - DNA, 146 bp, Homo sapiens; identical to SEQ ID NO: 89767
  misc_feature 1..146: note = chr22:49132497-49132643
  misc_feature 1..146: note = Hypo
  source 1..146: mol_type = genomic DNA

SEQ ID NO: 121508 - DNA, 30 bp, Homo sapiens; identical to SEQ ID NO: 46801
  misc_feature 1..30: note = chr22:49138471-49138501
  misc_feature 1..30: note = Hypo
  source 1..30: mol_type = genomic DNA

SEQ ID NO: 121509 - DNA, 30 bp, Homo sapiens; identical to SEQ ID NO: 89769
  misc_feature 1..30: note = chr22:49139651-49139681
  misc_feature 1..30: note = Hypo
  source 1..30: mol_type = genomic DNA

SEQ ID NO: 121510 - DNA, 210 bp, Homo sapiens; identical to SEQ ID NO: 89770
  misc_feature 1..210: note = chr22:49145839-49146049
  misc_feature 1..210: note = Hypo
  source 1..210: mol_type = genomic DNA

SEQ ID NO: 121511 - DNA, 243 bp, Homo sapiens; identical to SEQ ID NO: 89771
  misc_feature 1..243: note = chr22:49147007-49147250
  misc_feature 1..243: note = Hypo
  source 1..243: mol_type = genomic DNA

SEQ ID NO: 121512 - DNA, 73 bp, Homo sapiens; identical to SEQ ID NO: 89772
  misc_feature 1..73: note = chr22:49149757-49149830
  misc_feature 1..73: note = Hypo
  source 1..73: mol_type = genomic DNA

SEQ ID NO: 121513 - DNA, 30 bp, Homo sapiens; identical to SEQ ID NO: 89773
  misc_feature 1..30: note = chr22:49153919-49153949
  misc_feature 1..30: note = Hypo
  source 1..30: mol_type = genomic DNA

SEQ ID NO: 121514 - DNA, 16 bp, Homo sapiens
  misc_feature 1..16: note = chr22:49170462-49170478
  misc_feature 1..16: note = Hypo
  source 1..16: mol_type = genomic DNA
gcgtttttatagagct

SEQ ID NO: 121515 - DNA, 30 bp, Homo sapiens; identical to SEQ ID NO: 89775
  misc_feature 1..30: note = chr22:49175177-49175207
  misc_feature 1..30: note = Hypo
  source 1..30: mol_type = genomic DNA

SEQ ID NO: 121516 - DNA, 30 bp, Homo sapiens; identical to SEQ ID NO: 89776
  misc_feature 1..30: note = chr22:49177385-49177415
  misc_feature 1..30: note = Hypo
  source 1..30: mol_type = genomic DNA

SEQ ID NO: 121517 - DNA, 30 bp, Homo sapiens; identical to SEQ ID NO: 89777
  misc_feature 1..30: note = chr22:49195092-49195122
  misc_feature 1..30: note = Hypo
  source 1..30: mol_type = genomic DNA

SEQ ID NO: 121518 - DNA, 63 bp, Homo sapiens; identical to SEQ ID NO: 89778
  misc_feature 1..63: note = chr22:49198381-49198444
  misc_feature 1..63: note = Hypo
  source 1..63: mol_type = genomic DNA

SEQ ID NO: 121519 - DNA, 30 bp, Homo sapiens; identical to SEQ ID NO: 89779
  misc_feature 1..30: note = chr22:49233404-49233434
  misc_feature 1..30: note = Hypo
  source 1..30: mol_type = genomic DNA

SEQ ID NO: 121520 - DNA, 102 bp, Homo sapiens; identical to SEQ ID NO: 89780
  misc_feature 1..102: note = chr22:49247239-49247341
  misc_feature 1..102: note = Hypo
  source 1..102: mol_type = genomic DNA

SEQ ID NO: 121521 - DNA, 30 bp, Homo sapiens; identical to SEQ ID NO: 89781
  misc_feature 1..30: note = chr22:49257599-49257629
  misc_feature 1..30: note = Hypo
  source 1..30: mol_type = genomic DNA

SEQ ID NO: 121522 - DNA, 78 bp, Homo sapiens; identical to SEQ ID NO: 89782
  misc_feature 1..78: note = chr22:49277436-49277514
  misc_feature 1..78: note = Hypo
  source 1..78: mol_type = genomic DNA

SEQ ID NO: 121523 - DNA, 30 bp, Homo sapiens; identical to SEQ ID NO: 89783
  misc_feature 1..30: note = chr22:49282479-49282509
  misc_feature 1..30: note = Hypo
  source 1..30: mol_type = genomic DNA

SEQ ID NO: 121524 - DNA, 30 bp, Homo sapiens; identical to SEQ ID NO: 89784
  misc_feature 1..30: note = chr22:49295585-49295615
  misc_feature 1..30: note = Hypo
  source 1..30: mol_type = genomic DNA

SEQ ID NO: 121525 - DNA, 30 bp, Homo sapiens; identical to SEQ ID NO: 89785
  misc_feature 1..30: note = chr22:49297953-49297983
  misc_feature 1..30: note = Hypo
  source 1..30: mol_type = genomic DNA

SEQ ID NO: 121526 - DNA, 52 bp, Homo sapiens; identical to SEQ ID NO: 89786
  misc_feature 1..52: note = chr22:49340964-49341016
  misc_feature 1..52: note = Hypo
  source 1..52: mol_type = genomic DNA

SEQ ID NO: 121527 - DNA, 87 bp, Homo sapiens; identical to SEQ ID NO: 89787
  misc_feature 1..87: note = chr22:49387604-49387691
  misc_feature 1..87: note = Hypo
  source 1..87: mol_type = genomic DNA

SEQ ID NO: 121528 - DNA, 150 bp, Homo sapiens; identical to SEQ ID NO: 89788
  misc_feature 1..150: note = chr22:49388460-49388610
  misc_feature 1..150: note = Hypo
  source 1..150: mol_type = genomic DNA

SEQ ID NO: 121529 - DNA, 155 bp, Homo sapiens; identical to SEQ ID NO: 89789
  misc_feature 1..155: note = chr22:49404122-49404277
  misc_feature 1..155: note = Hypo
  source 1..155: mol_type = genomic DNA

SEQ ID NO: 121530 - DNA, 191 bp, Homo sapiens; identical to SEQ ID NO: 89790
  misc_feature 1..191: note = chr22:49416905-49417096
  misc_feature 1..191: note = Hypo
  source 1..191: mol_type = genomic DNA

SEQ ID NO: 121531 - DNA, 84 bp, Homo sapiens; identical to SEQ ID NO: 89791
  misc_feature 1..84: note = chr22:49447288-49447372
  misc_feature 1..84: note = Hypo
  source 1..84: mol_type = genomic DNA

SEQ ID NO: 121532 - DNA, 98 bp, Homo sapiens; identical to SEQ ID NO: 89792
  misc_feature 1..98: note = chr22:49491699-49491797
  misc_feature 1..98: note = Hypo
  source 1..98: mol_type = genomic DNA

SEQ ID NO: 121533 - DNA, 134 bp, Homo sapiens; identical to SEQ ID NO: 89793
  misc_feature 1..134: note = chr22:49508009-49508143
  misc_feature 1..134: note = Hypo
  source 1..134: mol_type = genomic DNA

SEQ ID NO: 121534 - DNA, 30 bp, Homo sapiens; identical to SEQ ID NO: 46810
  misc_feature 1..30: note = chr22:49510169-49510199
  misc_feature 1..30: note = Hypo
  source 1..30: mol_type = genomic DNA

SEQ ID NO: 121535 - DNA, 36 bp, Homo sapiens; identical to SEQ ID NO: 89795
  misc_feature 1..36: note = chr22:49524652-49524688
  misc_feature 1..36: note = Hypo
  source 1..36: mol_type = genomic DNA

SEQ ID NO: 121536 - DNA, 30 bp, Homo sapiens; identical to SEQ ID NO: 89796
  misc_feature 1..30: note = chr22:49557840-49557870
  misc_feature 1..30: note = Hypo
  source 1..30: mol_type = genomic DNA

SEQ ID NO: 121537 - DNA, 30 bp, Homo sapiens; identical to SEQ ID NO: 89797
  misc_feature 1..30: note = chr22:49578631-49578661
  misc_feature 1..30: note = Hypo
  source 1..30: mol_type = genomic DNA

SEQ ID NO: 121538 - DNA, 30 bp, Homo sapiens; identical to SEQ ID NO: 89798
  misc_feature 1..30: note = chr22:49584808-49584838
  misc_feature 1..30: note = Hypo
  source 1..30: mol_type = genomic DNA

SEQ ID NO: 121539 - DNA, 30 bp, Homo sapiens; identical to SEQ ID NO: 89799
  misc_feature 1..30: note = chr22:49632704-49632734
  misc_feature 1..30: note = Hypo
  source 1..30: mol_type = genomic DNA

SEQ ID NO: 121540 - DNA, 253 bp, Homo sapiens; identical to SEQ ID NO: 46811
  misc_feature 1..253: note = chr22:49637528-49637781
  misc_feature 1..253: note = Hypo
  source 1..253: mol_type = genomic DNA

SEQ ID NO: 121541 - DNA, 39 bp, Homo sapiens; identical to SEQ ID NO: 89801
  misc_feature 1..39: note = chr22:49683091-49683130
  misc_feature 1..39: note = Hypo
  source 1..39: mol_type = genomic DNA

SEQ ID NO: 121542 - DNA, 203 bp, Homo sapiens; identical to SEQ ID NO: 89802
  misc_feature 1..203: note = chr22:49691277-49691480
  misc_feature 1..203: note = Hypo
  source 1..203: mol_type = genomic DNA

SEQ ID NO: 121543 - DNA, 153 bp, Homo sapiens; identical to SEQ ID NO: 89803
  misc_feature 1..153: note = chr22:49694454-49694607
  misc_feature 1..153: note = Hypo
  source 1..153: mol_type = genomic DNA

SEQ ID NO: 121544 - DNA, 182 bp, Homo sapiens; identical to SEQ ID NO: 89804
  misc_feature 1..182: note = chr22:49694859-49695041
  misc_feature 1..182: note = Hypo
  source 1..182: mol_type = genomic DNA

SEQ ID NO: 121545 - DNA, 30 bp, Homo sapiens; identical to SEQ ID NO: 89805
  misc_feature 1..30: note = chr22:49704081-49704111
  misc_feature 1..30: note = Hypo
  source 1..30: mol_type = genomic DNA

SEQ ID NO: 121546 - DNA, 37 bp, Homo sapiens; identical to SEQ ID NO: 89806
  misc_feature 1..37: note = chr22:49722594-49722631
  misc_feature 1..37: note = Hypo
  source 1..37: mol_type = genomic DNA

SEQ ID NO: 121547 - DNA, 30 bp, Homo sapiens; identical to SEQ ID NO: 89807
  misc_feature 1..30: note = chr22:49729017-49729047
  misc_feature 1..30: note = Hypo
  source 1..30: mol_type = genomic DNA

SEQ ID NO: 121548 - DNA, 30 bp, Homo sapiens; identical to SEQ ID NO: 89808
  misc_feature 1..30: note = chr22:49745207-49745237
  misc_feature 1..30: note = Hypo
  source 1..30: mol_type = genomic DNA

SEQ ID NO: 121549 - DNA, 32 bp, Homo sapiens; identical to SEQ ID NO: 89809
  misc_feature 1..32: note = chr22:49748891-49748923
  misc_feature 1..32: note = Hypo
  source 1..32: mol_type = genomic DNA

SEQ ID NO: 121550 - DNA, 57 bp, Homo sapiens; identical to SEQ ID NO: 89810
  misc_feature 1..57: note = chr22:49785322-49785379
  misc_feature 1..57: note = Hypo
  source 1..57: mol_type = genomic DNA

SEQ ID NO: 121551 - DNA, 115 bp, Homo sapiens; identical to SEQ ID NO: 89811
  misc_feature 1..115: note = chr22:49814611-49814726
  misc_feature 1..115: note = Hypo
  source 1..115: mol_type = genomic DNA

SEQ ID NO: 121552 - DNA, 30 bp, Homo sapiens; identical to SEQ ID NO: 89812
  misc_feature 1..30: note = chr22:49827331-49827361
  misc_feature 1..30: note = Hypo
  source 1..30: mol_type = genomic DNA

SEQ ID NO: 121553 - DNA, 87 bp, Homo sapiens; identical to SEQ ID NO: 89813
  misc_feature 1..87: note = chr22:49828938-49829025
  misc_feature 1..87: note = Hypo
  source 1..87: mol_type = genomic DNA

SEQ ID NO: 121554 - DNA, 122 bp, Homo sapiens; identical to SEQ ID NO: 89814
  misc_feature 1..122: note = chr22:49831405-49831527
  misc_feature 1..122: note = Hypo
  source 1..122: mol_type = genomic DNA

SEQ ID NO: 121555 - DNA, 138 bp, Homo sapiens; identical to SEQ ID NO: 89815
  misc_feature 1..138: note = chr22:49831849-49831987
  misc_feature 1..138: note = Hypo
  source 1..138: mol_type = genomic DNA

SEQ ID NO: 121556 - DNA, 30 bp, Homo sapiens; identical to SEQ ID NO: 89816
  misc_feature 1..30: note = chr22:49832454-49832484
  misc_feature 1..30: note = Hypo
  source 1..30: mol_type = genomic DNA

SEQ ID NO: 121557 - DNA, 30 bp, Homo sapiens; identical to SEQ ID NO: 89817
  misc_feature 1..30: note = chr22:49833286-49833316
  misc_feature 1..30: note = Hypo
  source 1..30: mol_type = genomic DNA

SEQ ID NO: 121558 - DNA, 96 bp, Homo sapiens; identical to SEQ ID NO: 89818
  misc_feature 1..96: note = chr22:49836808-49836904
  misc_feature 1..96: note = Hypo
  source 1..96: mol_type = genomic DNA

SEQ ID NO: 121559 - DNA, 30 bp, Homo sapiens; identical to SEQ ID NO: 89819
  misc_feature 1..30: note = chr22:49849362-49849392
  misc_feature 1..30: note = Hypo
  source 1..30: mol_type = genomic DNA

SEQ ID NO: 121560 - DNA, 180 bp, Homo sapiens; identical to SEQ ID NO: 89820
  misc_feature 1..180: note = chr22:49851733-49851913
  misc_feature 1..180: note = Hypo
  source 1..180: mol_type = genomic DNA

SEQ ID NO: 121561 - DNA, 274 bp, Homo sapiens; identical to SEQ ID NO: 89821
  misc_feature 1..274: note = chr22:49852443-49852717
  misc_feature 1..274: note = Hypo
  source 1..274: mol_type = genomic DNA

SEQ ID NO: 121562 - DNA, 30 bp, Homo sapiens; identical to SEQ ID NO: 89822
  misc_feature 1..30: note = chr22:49863553-49863583
  misc_feature 1..30: note = Hypo
  source 1..30: mol_type = genomic DNA

SEQ ID NO: 121563 - DNA, 57 bp, Homo sapiens; identical to SEQ ID NO: 89823
  misc_feature 1..57: note = chr22:49864413-49864470
  misc_feature 1..57: note = Hypo
  source 1..57: mol_type = genomic DNA

SEQ ID NO: 121564 - DNA, 149 bp, Homo sapiens; identical to SEQ ID NO: 46819
  misc_feature 1..149: note = chr22:49864707-49864856
  misc_feature 1..149: note = Hypo
  source 1..149: mol_type = genomic DNA

SEQ ID NO: 121565 - DNA, 112 bp, Homo sapiens; identical to SEQ ID NO: 89825
  misc_feature 1..112: note = chr22:49868073-49868185
  misc_feature 1..112: note = Hypo
  source 1..112: mol_type = genomic DNA

SEQ ID NO: 121566 - DNA, 39 bp, Homo sapiens; identical to SEQ ID NO: 46821
  misc_feature 1..39: note = chr22:49888284-49888323
  misc_feature 1..39: note = Hypo
  source 1..39: mol_type = genomic DNA

SEQ ID NO: 121567 - DNA, 80 bp, Homo sapiens; identical to SEQ ID NO: 89827
  misc_feature 1..80: note = chr22:49911506-49911586
  misc_feature 1..80: note = Hypo
  source 1..80: mol_type = genomic DNA

SEQ ID NO: 121568 - DNA, 667 bp, Homo sapiens; identical to SEQ ID NO: 89828
  misc_feature 1..667: note = chr22:49934713-49935380
  misc_feature 1..667: note = Hypo
  source 1..667: mol_type = genomic DNA

SEQ ID NO: 121569 - DNA, 184 bp, Homo sapiens; identical to SEQ ID NO: 89829
  misc_feature 1..184: note = chr22:49937697-49937881
  misc_feature 1..184: note = Hypo
  source 1..184: mol_type = genomic DNA

SEQ ID NO: 121570 - DNA, 69 bp, Homo sapiens; identical to SEQ ID NO: 89830
  misc_feature 1..69: note = chr22:49941794-49941863
  misc_feature 1..69: note = Hypo
  source 1..69: mol_type = genomic DNA

SEQ ID NO: 121571 - DNA, 196 bp, Homo sapiens; identical to SEQ ID NO: 89831
  misc_feature 1..196: note = chr22:49943168-49943364
  misc_feature 1..196: note = Hypo
  source 1..196: mol_type = genomic DNA

SEQ ID NO: 121572 - DNA, 42 bp, Homo sapiens; identical to SEQ ID NO: 89832
  misc_feature 1..42: note = chr22:49948578-49948620
  misc_feature 1..42: note = Hypo
  source 1..42: mol_type = genomic DNA

SEQ ID NO: 121573 - DNA, 109 bp, Homo sapiens; identical to SEQ ID NO: 89833
  misc_feature 1..109: note = chr22:49959096-49959205
  misc_feature 1..109: note = Hypo
  source 1..109: mol_type = genomic DNA

SEQ ID NO: 121574 - DNA, 130 bp, Homo sapiens; identical to SEQ ID NO: 89834
  misc_feature 1..130: note = chr22:49963301-49963431
  misc_feature 1..130: note = Hypo
  source 1..130: mol_type = genomic DNA

SEQ ID NO: 121575 - DNA, 43 bp, Homo sapiens; identical to SEQ ID NO: 89835
  misc_feature 1..43: note = chr22:49963875-49963918
  misc_feature 1..43: note = Hypo
  source 1..43: mol_type = genomic DNA

SEQ ID NO: 121576 - DNA, 198 bp, Homo sapiens; identical to SEQ ID NO: 89836
  misc_feature 1..198: note = chr22:49967979-49968177
  misc_feature 1..198: note = Hypo
  source 1..198: mol_type = genomic DNA

SEQ ID NO: 121577 - DNA, 145 bp, Homo sapiens; identical to SEQ ID NO: 89837
  misc_feature 1..145: note = chr22:49970518-49970663
  misc_feature 1..145: note = Hypo
  source 1..145: mol_type = genomic DNA

SEQ ID NO: 121578 - DNA, 189 bp, Homo sapiens; identical to SEQ ID NO: 89838
  misc_feature 1..189: note = chr22:49977647-49977836
  misc_feature 1..189: note = Hypo
  source 1..189: mol_type = genomic DNA

SEQ ID NO: 121579 - DNA, 144 bp, Homo sapiens; identical to SEQ ID NO: 89839
  misc_feature 1..144: note = chr22:49979613-49979757
  misc_feature 1..144: note = Hypo
  source 1..144: mol_type = genomic DNA

SEQ ID NO: 121580 - DNA, 461 bp, Homo sapiens; identical to SEQ ID NO: 89840
  misc_feature 1..461: note = chr22:49980160-49980621
  misc_feature 1..461: note = Hypo
  source 1..461: mol_type = genomic DNA

SEQ ID NO: 121581 - DNA, 123 bp, Homo sapiens; identical to SEQ ID NO: 89841
  misc_feature 1..123: note = chr22:49982542-49982665
  misc_feature 1..123: note = Hypo
  source 1..123: mol_type = genomic DNA

SEQ ID NO: 121582 - DNA, 179 bp, Homo sapiens; identical to SEQ ID NO: 89842
  misc_feature 1..179: note = chr22:49982979-49983158
  misc_feature 1..179: note = Hypo
  source 1..179: mol_type = genomic DNA

SEQ ID NO: 121583 - DNA, 205 bp, Homo sapiens; identical to SEQ ID NO: 89843
  misc_feature 1..205: note = chr22:49983668-49983873
  misc_feature 1..205: note = Hypo
  source 1..205: mol_type = genomic DNA

SEQ ID NO: 121584 - DNA, 149 bp, Homo sapiens; identical to SEQ ID NO: 89844
  misc_feature 1..149: note = chr22:49992130-49992279
  misc_feature 1..149: note = Hypo
  source 1..149: mol_type = genomic DNA

SEQ ID NO: 121585 - DNA, 44 bp, Homo sapiens; identical to SEQ ID NO: 89845
  misc_feature 1..44: note = chr22:49992716-49992760
  misc_feature 1..44: note = Hypo
  source 1..44: mol_type = genomic DNA

SEQ ID NO: 121586 - DNA, 112 bp, Homo sapiens; identical to SEQ ID NO: 89846
  misc_feature 1..112: note = chr22:49994187-49994299
  misc_feature 1..112: note = Hypo
  source 1..112: mol_type = genomic DNA

SEQ ID NO: 121587 - DNA, 30 bp, Homo sapiens; identical to SEQ ID NO: 46839
  misc_feature 1..30: note = chr22:49996899-49996929
  misc_feature 1..30: note = Hypo
  source 1..30: mol_type = genomic DNA

SEQ ID NO: 121588 - DNA, 30 bp, Homo sapiens; identical to SEQ ID NO: 46840
  misc_feature 1..30: note = chr22:50000658-50000688
  misc_feature 1..30: note = Hypo
  source 1..30: mol_type = genomic DNA

SEQ ID NO: 121589 - DNA, 196 bp, Homo sapiens; identical to SEQ ID NO: 89849
  misc_feature 1..196: note = chr22:50001634-50001830
  misc_feature 1..196: note = Hypo
  source 1..196: mol_type = genomic DNA

SEQ ID NO: 121590 - DNA, 357 bp, Homo sapiens; identical to SEQ ID NO: 89850
  misc_feature 1..357: note = chr22:50002462-50002819
  misc_feature 1..357: note = Hypo
  source 1..357: mol_type = genomic DNA

SEQ ID NO: 121591 - DNA, 225 bp, Homo sapiens; identical to SEQ ID NO: 89851
  misc_feature 1..225: note = chr22:50003057-50003282
  misc_feature 1..225: note = Hypo
  source 1..225: mol_type = genomic DNA

SEQ ID NO: 121592 - DNA, 176 bp, Homo sapiens; identical to SEQ ID NO: 46844
  misc_feature 1..176: note = chr22:50007867-50008043
  misc_feature 1..176: note = Hypo
  source 1..176: mol_type = genomic DNA

SEQ ID NO: 121593 - DNA, 226 bp, Homo sapiens; identical to SEQ ID NO: 89853
  misc_feature 1..226: note = chr22:50008747-50008973
  misc_feature 1..226: note = Hypo
  source 1..226: mol_type = genomic DNA

SEQ ID NO: 121594 - DNA, 147 bp, Homo sapiens; identical to SEQ ID NO: 89854
  misc_feature 1..147: note = chr22:50009183-50009330
  misc_feature 1..147: note = Hypo
  source 1..147: mol_type = genomic DNA

SEQ ID NO: 121595 - DNA, 44 bp, Homo sapiens; identical to SEQ ID NO: 89855
  misc_feature 1..44: note = chr22:50009619-50009663
  misc_feature 1..44: note = Hypo
  source 1..44: mol_type = genomic DNA

SEQ ID NO: 121596 - DNA, 717 bp, Homo sapiens; identical to SEQ ID NO: 89856
  misc_feature 1..717: note = chr22:50010081-50010798
  misc_feature 1..717: note = Hypo
  source 1..717: mol_type = genomic DNA

SEQ ID NO: 121597 - DNA, 46 bp, Homo sapiens; identical to SEQ ID NO: 46848
  misc_feature 1..46: note = chr22:50013222-50013268
  misc_feature 1..46: note = Hypo
  source 1..46: mol_type = genomic DNA

SEQ ID NO: 121598 - DNA, 179 bp, Homo sapiens; identical to SEQ ID NO: 89858
  misc_feature 1..179: note = chr22:50015584-50015763
  misc_feature 1..179: note = Hypo
  source 1..179: mol_type = genomic DNA

SEQ ID NO: 121599 - DNA, 176 bp, Homo sapiens; identical to SEQ ID NO: 89859
  misc_feature 1..176: note = chr22:50015975-50016151
  misc_feature 1..176: note = Hypo
  source 1..176: mol_type = genomic DNA

SEQ ID NO: 121600 - DNA, 173 bp, Homo sapiens; identical to SEQ ID NO: 89860
  misc_feature 1..173: note = chr22:50023940-50024113
  misc_feature 1..173: note = Hypo
  source 1..173: mol_type = genomic DNA

SEQ ID NO: 121601 - DNA, 30 bp, Homo sapiens; identical to SEQ ID NO: 46851
  misc_feature 1..30: note = chr22:50025118-50025148
  misc_feature 1..30: note = Hypo
  source 1..30: mol_type = genomic DNA

SEQ ID NO: 121602 - DNA, 177 bp, Homo sapiens; identical to SEQ ID NO: 89862
  misc_feature 1..177: note = chr22:50025502-50025679
  misc_feature 1..177: note = Hypo
  source 1..177: mol_type = genomic DNA

SEQ ID NO: 121603 - DNA, 37 bp, Homo sapiens; identical to SEQ ID NO: 89863
  misc_feature 1..37: note = chr22:50030437-50030474
  misc_feature 1..37: note = Hypo
  source 1..37: mol_type = genomic DNA

SEQ ID NO: 121604 - DNA, 130 bp, Homo sapiens; identical to SEQ ID NO: 89864
  misc_feature 1..130: note = chr22:50031124-50031254
  misc_feature 1..130: note = Hypo
  source 1..130: mol_type = genomic DNA

SEQ ID NO: 121605 - DNA, 213 bp, Homo sapiens; identical to SEQ ID NO: 89865
  misc_feature 1..213: note = chr22:50031666-50031879
  misc_feature 1..213: note = Hypo
  source 1..213: mol_type = genomic DNA

SEQ ID NO: 121606 - DNA, 198 bp, Homo sapiens; identical to SEQ ID NO: 89866
  misc_feature 1..198: note = chr22:50032291-50032489
  misc_feature 1..198: note = Hypo
  source 1..198: mol_type = genomic DNA

SEQ ID NO: 121607 - DNA, 52 bp, Homo sapiens; identical to SEQ ID NO: 89867
  misc_feature 1..52: note = chr22:50039630-50039682
  misc_feature 1..52: note = Hypo
  source 1..52: mol_type = genomic DNA

SEQ ID NO: 121608 - DNA, 35 bp, Homo sapiens; identical to SEQ ID NO: 89868
  misc_feature 1..35: note = chr22:50041968-50042003
  misc_feature 1..35: note = Hypo
  source 1..35: mol_type = genomic DNA

SEQ ID NO: 121609 - DNA, 248 bp, Homo sapiens; identical to SEQ ID NO: 89869
  misc_feature 1..248: note = chr22:50054387-50054635
  misc_feature 1..248: note = Hypo
  source 1..248: mol_type = genomic DNA

SEQ ID NO: 121610 - DNA, 201 bp, Homo sapiens; identical to SEQ ID NO: 89870
  misc_feature 1..201: note = chr22:50056957-50057158
  misc_feature 1..201: note = Hypo
  source 1..201: mol_type = genomic DNA

SEQ ID NO: 121611 - DNA, 30 bp, Homo sapiens; identical to SEQ ID NO: 89871
  misc_feature 1..30: note = chr22:50075250-50075280
  misc_feature 1..30: note = Hypo
  source 1..30: mol_type = genomic DNA

SEQ ID NO: 121612 - DNA, 30 bp, Homo sapiens; identical to SEQ ID NO: 89872
  misc_feature 1..30: note = chr22:50084890-50084920
  misc_feature 1..30: note = Hypo
  source 1..30: mol_type = genomic DNA

SEQ ID NO: 121613 - DNA, 60 bp, Homo sapiens; identical to SEQ ID NO: 46858
  misc_feature 1..60: note = chr22:50119416-50119476
  misc_feature 1..60: note = Hypo
  source 1..60: mol_type = genomic DNA

SEQ ID NO: 121614 - DNA, 46 bp, Homo sapiens; identical to SEQ ID NO: 89874
  misc_feature 1..46: note = chr22:50147751-50147797
  misc_feature 1..46: note = Hypo
  source 1..46: mol_type = genomic DNA

SEQ ID NO: 121615 - DNA, 204 bp, Homo sapiens; identical to SEQ ID NO: 89875
  misc_feature 1..204: note = chr22:50149266-50149470
  misc_feature 1..204: note = Hypo
  source 1..204: mol_type = genomic DNA

SEQ ID NO: 121616 - DNA, 207 bp, Homo sapiens; identical to SEQ ID NO: 89876
  misc_feature 1..207: note = chr22:50170583-50170790
  misc_feature 1..207: note = Hypo
  source 1..207: mol_type = genomic DNA

SEQ ID NO: 121617 - DNA, 51 bp, Homo sapiens; identical to SEQ ID NO: 89877
  misc_feature 1..51: note = chr22:50177248-50177299
  misc_feature 1..51: note = Hypo
  source 1..51: mol_type = genomic DNA

SEQ ID NO: 121618 - DNA, 45 bp, Homo sapiens; identical to SEQ ID NO: 89878
  misc_feature 1..45: note = chr22:50191581-50191626
  misc_feature 1..45: note = Hypo
  source 1..45: mol_type = genomic DNA

SEQ ID NO: 121619 - DNA, 86 bp, Homo sapiens; identical to SEQ ID NO: 89879
  misc_feature 1..86: note = chr22:50225678-50225764
  misc_feature 1..86: note = Hypo
  source 1..86: mol_type = genomic DNA

SEQ ID NO: 121620 - DNA, 218 bp, Homo sapiens; identical to SEQ ID NO: 89880
  misc_feature 1..218: note = chr22:50242294-50242512
  misc_feature 1..218: note = Hyper
  source 1..218: mol_type = genomic DNA

SEQ ID NO: 121621 - DNA, 966 bp, Homo sapiens
  misc_feature 1..966: note = chr22:50242712-50243678
  misc_feature 1..966: note = Hyper
  source 1..966: mol_type = genomic DNA
tcctggggaggtgcccggtgtggggtgtttctggttcgcccggggacagtgcgcgtcccctcgcccgcggcgcccgccctgcccgtcccaccgaggtcccccgggagcgtctgggcccacggcttcggggggtttctccgagacctgggcgctgttctgggggagcaggggcccgggccaccaaggttcgtgcggaccgtggggtgtcccacgcccaggccgggggatcccagagccccgcttccctcaagggcgccgcgccccggactgcaggtggagacggggaccggccccgcggggtcgccgacaggcgcggggcgggacagggtgggaggcggcggggcgcagagtcctccggtcgccggcgcgatccgggcaccttcctggaggcggcgggagcgcggtcgcggcgcctccggggtggggtccaggttggaggctccggggcgcaccgccctagccccaccccggccgggtccccgcgctgcctctgcggagagggaggaaggaaggaaggcagggagggaggggacggccggcaggcgtggggtccgcggcgtcagggctccttcctcccgtccgctccatcctgcaacccgtagcccgggcggggtctcgctgccccctccccgaacacagccgccttttcctccctccccaaccccgagcgcctcccttcccgaatgcgggagtccatagtgcacgggaagcctcttcccctccccaccgaggctgcccgacgccccttccaccctccgaccccccgcaaccatccctcaaatgccccggcggccagcagggctggggtgggcgcaggagaaccaggggtcctgcccgcatgcaggggtttggggtcggtgtggccgaatgaacgcgcgggttcagacgagcctgtgatgcccccgctttccatctcctcgcgacctggccccagaagacagtctgagaggccggtggccgcggatc

SEQ ID NO: 121622 - DNA, 89 bp, Homo sapiens; identical to SEQ ID NO: 89883
  misc_feature 1..89: note = chr22:50251106-50251195
  misc_feature 1..89: note = Hypo
  source 1..89: mol_type = genomic DNA

SEQ ID NO: 121623 - DNA, 218 bp, Homo sapiens; identical to SEQ ID NO: 89884
  misc_feature 1..218: note = chr22:50294626-50294844
  misc_feature 1..218: note = Hypo
  source 1..218: mol_type = genomic DNA

SEQ ID NO: 121624 - DNA, 30 bp, Homo sapiens; identical to SEQ ID NO: 89885
  misc_feature 1..30: note = chr22:50297116-50297146
  misc_feature 1..30: note = Hypo
  source 1..30: mol_type = genomic DNA

SEQ ID NO: 121625 - DNA, 30 bp, Homo sapiens; identical to SEQ ID NO: 89886
  misc_feature 1..30: note = chr22:50297790-50297820
  misc_feature 1..30: note = Hypo
  source 1..30: mol_type = genomic DNA

SEQ ID NO: 121626 - DNA, 30 bp, Homo sapiens; identical to SEQ ID NO: 89887
  misc_feature 1..30: note = chr22:50310723-50310753
  misc_feature 1..30: note = Hypo
  source 1..30: mol_type = genomic DNA

SEQ ID NO: 121627 - DNA, 65 bp, Homo sapiens; identical to SEQ ID NO: 89888
  misc_feature 1..65: note = chr22:50316873-50316938
  misc_feature 1..65: note = Hypo
  source 1..65: mol_type = genomic DNA

SEQ ID NO: 121628 - DNA, 180 bp, Homo sapiens; identical to SEQ ID NO: 89889
  misc_feature 1..180: note = chr22:50421861-50422041
  misc_feature 1..180: note = Hyper
  source 1..180: mol_type = genomic DNA

SEQ ID NO: 121629 - DNA, 30 bp, Homo sapiens; identical to SEQ ID NO: 89890
  misc_feature 1..30: note = chr22:50436010-50436040
  misc_feature 1..30: note = Hypo
  source 1..30: mol_type = genomic DNA

SEQ ID NO: 121630 - DNA, 45 bp, Homo sapiens; identical to SEQ ID NO: 89891
  misc_feature 1..45: note = chr22:50436676-50436721
  misc_feature 1..45: note = Hypo
  source 1..45: mol_type = genomic DNA

SEQ ID NO: 121631 - DNA, 30 bp, Homo sapiens; identical to SEQ ID NO: 46862
  misc_feature 1..30: note = chr22:50439060-50439090
  misc_feature 1..30: note = Hypo
  source 1..30: mol_type = genomic DNA

SEQ ID NO: 121632 - DNA, 30 bp, Homo sapiens; identical to SEQ ID NO: 89893
  misc_feature 1..30: note = chr22:50447897-50447927
  misc_feature 1..30: note = Hypo
  source 1..30: mol_type = genomic DNA

SEQ ID NO: 121633 - DNA, 82 bp, Homo sapiens; identical to SEQ ID NO: 89894
  misc_feature 1..82: note = chr22:50453457-50453539
  misc_feature 1..82: note = Hyper
  source 1..82: mol_type = genomic DNA

SEQ ID NO: 121634 - DNA, 275 bp, Homo sapiens; identical to SEQ ID NO: 89895
  misc_feature 1..275: note = chr22:50466770-50467045
  misc_feature 1..275: note = Hypo
  source 1..275: mol_type = genomic DNA

SEQ ID NO: 121635 - DNA, 300 bp, Homo sapiens; identical to SEQ ID NO: 89896
  misc_feature 1..300: note = chr22:50469755-50470055
  misc_feature 1..300: note = Hypo
  source 1..300: mol_type = genomic DNA

SEQ ID NO: 121636 - DNA, 268 bp, Homo sapiens; identical to SEQ ID NO: 89897
  misc_feature 1..268: note = chr22:50470497-50470765
  misc_feature 1..268: note = Hypo
  source 1..268: mol_type = genomic DNA

SEQ ID NO: 121637 - DNA, 42 bp, Homo sapiens; identical to SEQ ID NO: 89898
  misc_feature 1..42: note = chr22:50482195-50482237
  misc_feature 1..42: note = Hypo
  source 1..42: mol_type = genomic DNA

SEQ ID NO: 121638 - DNA, 110 bp, Homo sapiens; identical to SEQ ID NO: 89899
  misc_feature 1..110: note = chr22:50484380-50484490
  misc_feature 1..110: note = Hypo
  source 1..110: mol_type = genomic DNA

SEQ ID NO: 121639 - DNA, 48 bp, Homo sapiens; identical to SEQ ID NO: 89900
  misc_feature 1..48: note = chr22:50484839-50484887
  misc_feature 1..48: note = Hypo
  source 1..48: mol_type = genomic DNA

SEQ ID NO: 121640 - DNA, 106 bp, Homo sapiens; identical to SEQ ID NO: 89901
  misc_feature 1..106: note = chr22:50488454-50488560
  misc_feature 1..106: note = Hypo
  source 1..106: mol_type = genomic DNA

SEQ ID NO: 121641 - DNA, 655 bp, Homo sapiens
  misc_feature 1..655: note = chr22:50496728-50497383
  misc_feature 1..655: note = Hyper
  source 1..655: mol_type = genomic DNA
cggggcgtggggctgcgcgggcggcggggggcgcgggggcgcggggagctgcggcgtgcggggggcgcgggccccgacgggcagcagtcatcagcgcttgggctgggcccgggttggggtccgggtcccgggctgctgtcggagcaggcgcggctgcggggtcggcggcgcgggacggtgcgcgccatggtgtccgccgggggagggcccgagtgtagccccgggtcacgcgctgcggccccgcgcccccctgtggaggtcacactccatcccccaccaggtcacaaagacccgcgggtcacatcctgcccctccccctcgggccccccaggcccgccaggccttctcgccctccccggggccctcatgccgccctctgtccctgggcccttccccgacgcgaggctggagcggcggggtgaggaggccgcgggcgctgggctcctcccgggctgcgcgctgcgggtcctggcggatgggggcgacggggtgaccgtatcagcgccccccgtcctgcggcggaacttgggagggccttggtatccgcagaaccactcgtggggtcccacgccgctgccccccggggggttctgagcccacccaggtccacacggcccctgtcgtttccccccgcaccccgcggatcaccccgcca

SEQ ID NO: 121642 - DNA, 160 bp, Homo sapiens; identical to SEQ ID NO: 89904
  misc_feature 1..160: note = chr22:50506998-50507158
  misc_feature 1..160: note = Hypo
  source 1..160: mol_type = genomic DNA

SEQ ID NO: 121643 - DNA, 102 bp, Homo sapiens; identical to SEQ ID NO: 89905
  misc_feature 1..102: note = chr22:50509901-50510003
  misc_feature 1..102: note = Hypo
  source 1..102: mol_type = genomic DNA

SEQ ID NO: 121644 - DNA, 57 bp, Homo sapiens; identical to SEQ ID NO: 46867
  misc_feature 1..57: note = chr22:50512688-50512745
  misc_feature 1..57: note = Hypo
  source 1..57: mol_type = genomic DNA

SEQ ID NO: 121645 - DNA, 30 bp, Homo sapiens; identical to SEQ ID NO: 89907
  misc_feature 1..30: note = chr22:50513114-50513144
  misc_feature 1..30: note = Hypo
  source 1..30: mol_type = genomic DNA

SEQ ID NO: 121646 - DNA, 30 bp, Homo sapiens; identical to SEQ ID NO: 89908
  misc_feature 1..30: note = chr22:50519234-50519264
  misc_feature 1..30: note = Hypo
  source 1..30: mol_type = genomic DNA

SEQ ID NO: 121647 - DNA, 30 bp, Homo sapiens; identical to SEQ ID NO: 46868
  misc_feature 1..30: note = chr22:50526328-50526358
  misc_feature 1..30: note = Hypo
  source 1..30: mol_type = genomic DNA

SEQ ID NO: 121648 - DNA, 102 bp, Homo sapiens; identical to SEQ ID NO: 89910
  misc_feature 1..102: note = chr22:50529523-50529625
  misc_feature 1..102: note = Hypo
  source 1..102: mol_type = genomic DNA

SEQ ID NO: 121649 - DNA, 30 bp, Homo sapiens; identical to SEQ ID NO: 89911
  misc_feature 1..30: note = chr22:50529892-50529922
  misc_feature 1..30: note = Hypo
  source 1..30: mol_type = genomic DNA

SEQ ID NO: 121650 - DNA, 53 bp, Homo sapiens; identical to SEQ ID NO: 89912
  misc_feature 1..53: note = chr22:50582627-50582680
  misc_feature 1..53: note = Hypo
  source 1..53: mol_type = genomic DNA

SEQ ID NO: 121651 - DNA, 30 bp, Homo sapiens; identical to SEQ ID NO: 89913
  misc_feature 1..30: note = chr22:50587368-50587398
  misc_feature 1..30: note = Hypo
  source 1..30: mol_type = genomic DNA

SEQ ID NO: 121652 - DNA, 30 bp, Homo sapiens; identical to SEQ ID NO: 89914
  misc_feature 1..30: note = chr22:50596623-50596653
  misc_feature 1..30: note = Hypo
  source 1..30: mol_type = genomic DNA

SEQ ID NO: 121653 - DNA, 30 bp, Homo sapiens; identical to SEQ ID NO: 38621
  misc_feature 1..30: note = chr22:50609166-50609196
  misc_feature 1..30: note = Hyper
  source 1..30: mol_type = genomic DNA

SEQ ID NO: 121654 - DNA, 440 bp, Homo sapiens
  misc_feature 1..440: note = chr22:50623582-50624022
  misc_feature 1..440: note = Hyper
  source 1..440: mol_type = genomic DNA
acagcgagagtctagcgtcggcgtggctgcggccagccgggtccccctggaggcctccggacgatcggaagtgactgagcgtccgggtccgtgaggccgggggtcggcccgccctaagactcccacctggtcccggttctccgtccgctaggctggccgcggggcccctggggcccgaccttcccggggtgccccaacctgcggcaaggccgaggtcccgctgaggcatgagtcccgggtcggggaccgctctgggccgacccccggaggacggactaggccgatccccagagggaagggggccaggccgaggccatggcagcgcgttccctgatcccgtgttctcggctcctcgcgtcccactatcggctgtccctttcgtgcgggactgacggctcacagaacagttacatttcaatatcattcgactgaaaaccatc

SEQ ID NO: 121655 - DNA, 59 bp, Homo sapiens; identical to SEQ ID NO: 89918
  misc_feature 1..59: note = chr22:50656906-50656965
  misc_feature 1..59: note = Hypo
  source 1..59: mol_type = genomic DNA

SEQ ID NO: 121656 - DNA, 457 bp, Homo sapiens; identical to SEQ ID NO: 89919
  misc_feature 1..457: note = chr22:50686455-50686912
  misc_feature 1..457: note = Hypo
  source 1..457: mol_type = genomic DNA

SEQ ID NO: 121657 - DNA, 225 bp, Homo sapiens; identical to SEQ ID NO: 89920
  misc_feature 1..225: note = chr22:50695326-50695551
  misc_feature 1..225: note = Hypo
  source 1..225: mol_type = genomic DNA

SEQ ID NO: 121658 - DNA, 30 bp, Homo sapiens; identical to SEQ ID NO: 89921
  misc_feature 1..30: note = chr22:50697675-50697705
  misc_feature 1..30: note = Hypo
  source 1..30: mol_type = genomic DNA

SEQ ID NO: 121659 - DNA, 229 bp, Homo sapiens; identical to SEQ ID NO: 89922
  misc_feature 1..229: note = chr22:50721136-50721365
  misc_feature 1..229: note = Hypo
  source 1..229: mol_type = genomic DNA

SEQ ID NO: 121660 - DNA, 44 bp, Homo sapiens; identical to SEQ ID NO: 89923
  misc_feature 1..44: note = chr22:50721828-50721872
  misc_feature 1..44: note = Hypo
  source 1..44: mol_type = genomic DNA

SEQ ID NO: 121661 - DNA, 30 bp, Homo sapiens; identical to SEQ ID NO: 89924
  misc_feature 1..30: note = chr22:50755701-50755731
  misc_feature 1..30: note = Hypo
  source 1..30: mol_type = genomic DNA

SEQ ID NO: 121662 - DNA, 126 bp, Homo sapiens; identical to SEQ ID NO: 89925
  misc_feature 1..126: note = chr22:50764712-50764838
  misc_feature 1..126: note = Hypo
  source 1..126: mol_type = genomic DNA

SEQ ID NO: 121663 - DNA, 19 bp, Homo sapiens
  misc_feature 1..19: note = chr22:50766201-50766220
  misc_feature 1..19: note = Hypo
  source 1..19: mol_type = genomic DNA
cacgtgttggccagacgcg

SEQ ID NO: 121664 - DNA, 78 bp, Homo sapiens; identical to SEQ ID NO: 89927
  misc_feature 1..78: note = chr22:50766520-50766598
  misc_feature 1..78: note = Hypo
  source 1..78: mol_type = genomic DNA

SEQ ID NO: 121665 - DNA, 30 bp, Homo sapiens; identical to SEQ ID NO: 89928
  misc_feature 1..30: note = chr22:50873974-50874004
  misc_feature 1..30: note = Hypo
  source 1..30: mol_type = genomic DNA

SEQ ID NO: 121666 - DNA, 690 bp, Homo sapiens; identical to SEQ ID NO: 89929
  misc_feature 1..690: note = chr22:50899018-50899708
  misc_feature 1..690: note = Hypo
  source 1..690: mol_type = genomic DNA

SEQ ID NO: 121667 - DNA, 30 bp, Homo sapiens; identical to SEQ ID NO: 89930
  misc_feature 1..30: note = chr22:50900202-50900232
  misc_feature 1..30: note = Hypo
  source 1..30: mol_type = genomic DNA

SEQ ID NO: 121668 - DNA, 70 bp, Homo sapiens; identical to SEQ ID NO: 89931
  misc_feature 1..70: note = chr22:50900758-50900828
  misc_feature 1..70: note = Hypo
  source 1..70: mol_type = genomic DNA

SEQ ID NO: 121669 - DNA, 32 bp, Homo sapiens; identical to SEQ ID NO: 89932
  misc_feature 1..32: note = chr22:50909774-50909806
  misc_feature 1..32: note = Hypo
  source 1..32: mol_type = genomic DNA

SEQ ID NO: 121670 - DNA, 40 bp, Homo sapiens; identical to SEQ ID NO: 89933
  misc_feature 1..40: note = chr22:50919589-50919629
  misc_feature 1..40: note = Hyper
  source 1..40: mol_type = genomic DNA

SEQ ID NO: 121671 - DNA, 58 bp, Homo sapiens; identical to SEQ ID NO: 89934
  misc_feature 1..58: note = chr22:50922605-50922663
  misc_feature 1..58: note = Hypo
  source 1..58: mol_type = genomic DNA

SEQ ID NO: 121672 - DNA, 204 bp, Homo sapiens; identical to SEQ ID NO: 89935
  misc_feature 1..204: note = chr22:50927887-50928091
  misc_feature 1..204: note = Hypo
  source 1..204: mol_type = genomic DNA

SEQ ID NO: 121673 - DNA, 169 bp, Homo sapiens; identical to SEQ ID NO: 89936
  misc_feature 1..169: note = chr22:50935672-50935841
  misc_feature 1..169: note = Hypo
  source 1..169: mol_type = genomic DNA

SEQ ID NO: 121674 - DNA, 242 bp, Homo sapiens; identical to SEQ ID NO: 89937
  misc_feature 1..242: note = chr22:50943170-50943412
  misc_feature 1..242: note = Hypo
  source 1..242: mol_type = genomic DNA

SEQ ID NO: 121675 - DNA, 351 bp, Homo sapiens; identical to SEQ ID NO: 89938
  misc_feature 1..351: note = chr22:50944365-50944716
  misc_feature 1..351: note = Hypo
  source 1..351: mol_type = genomic DNA

SEQ ID NO: 121676 - DNA, 32 bp, Homo sapiens; identical to SEQ ID NO: 89939
  misc_feature 1..32: note = chr22:50948627-50948659
  misc_feature 1..32: note = Hypo
  source 1..32: mol_type = genomic DNA

SEQ ID NO: 121677 - DNA, 30 bp, Homo sapiens; identical to SEQ ID NO: 89940
  misc_feature 1..30: note = chr22:50954437-50954467
  misc_feature 1..30: note = Hypo
  source 1..30: mol_type = genomic DNA

SEQ ID NO: 121678 - DNA, 69 bp, Homo sapiens; identical to SEQ ID NO: 46878
  misc_feature 1..69: note = chr22:50954977-50955046
  misc_feature 1..69: note = Hypo
  source 1..69: mol_type = genomic DNA

SEQ ID NO: 121679 - DNA, 41 bp, Homo sapiens; identical to SEQ ID NO: 46879
  misc_feature 1..41: note = chr22:50977129-50977170
  misc_feature 1..41: note = Hypo
  source 1..41: mol_type = genomic DNA

SEQ ID NO: 121680 - DNA, 69 bp, Homo sapiens
  misc_feature 1..69: note = chr22:50987052-50987121
  misc_feature 1..69: note = Hyper
  source 1..69: mol_type = genomic DNA
accctcaaggggaggcgccgggggaggggggcagccctgccggccgcagcggggcgctcacggaaaagc

SEQ ID NO: 121681 - DNA, 521 bp, Homo sapiens
  misc_feature 1..521: note = chr22:51042260-51042781
  misc_feature 1..521: note = Hyper
  source 1..521: mol_type = genomic DNA
gcccagcagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgccgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctca

SEQ ID NO: 121682 - DNA, 32 bp, Homo sapiens; identical to SEQ ID NO: 89946
  misc_feature 1..32: note = chr22:51049120-51049152
  misc_feature 1..32: note = Hypo
  source 1..32: mol_type = genomic DNA

SEQ ID NO: 121683 - DNA, 434 bp, Homo sapiens
  misc_feature 1..434: note = chr22:51111883-51112317
  misc_feature 1..434: note = Hyper
  source 1..434: mol_type = genomic DNA
agtgcaggacagttccgagaggccgctcagggctggggggcctggtgcaccccgatggggcggcggtgcctgagctcgtttctttactgagctcccccctcctccgcccactcatcaccccctcccgcgttgccacgacaacgcgtaaaactaaaattcacttcccagtcgcaggtggagactagtagcgccccctcccctaggcccttccccgtaggtcgcgcccccatcccgccgtcgctaaggtgacggggagggggcgacaggcgttggatccggaccggccaggggtccttggggggaagtccggagcaaactccccaaactaggctggcgtgggggagccgcgccgaacacgccagggcgcggtcgaaagggttaattcggagggcctctcgccgaggcggtgggaagggccccgggccctccccggt

SEQ ID NO: 121684 - DNA, 46 bp, Homo sapiens; identical to SEQ ID NO: 89949
  misc_feature 1..46: note = chr22:51113404-51113450
  misc_feature 1..46: note = Hyper
  source 1..46: mol_type = genomic DNA

SEQ ID NO: 121685 - DNA, 110 bp, Homo sapiens; identical to SEQ ID NO: 89950
  misc_feature 1..110: note = chr22:51144325-51144435
  misc_feature 1..110: note = Hypo
  source 1..110: mol_type = genomic DNA

SEQ ID NO: 121686 - DNA, 45 bp, Homo sapiens; identical to SEQ ID NO: 89951
  misc_feature 1..45: note = chr22:51181429-51181474
  misc_feature 1..45: note = Hypo
  source 1..45: mol_type = genomic DNA

SEQ ID NO: 121687 - DNA, 2067 bp, Homo sapiens
  misc_feature 1..2067: note = chr3:238195-240262
  misc_feature 1..2067: note = Hyper
  source 1..2067: mol_type = genomic DNA
gtgtgcaacatgaaccgagtgaaaccatcggggagggggtggggggcgtttcttttaaatgtcgcttttgcagataaacgagcagggatcctacctcttttgaccggagatgttgaaaagcacgaccaaagtttttggcttggtctcttgctttccacaacgagataaagtctgaagcctgtaactctccctgtcccgcgggagcgtgcaaagggagggaagataagcggcgtgggtgaggggtggcggcgcagaacccaggaagggagcagaggcgagagccagcctccggcaggagggcgtagaccccggtgccagccagaacggctccagccttcccgcggccagagagccagcggcgggaggggacgggcgggacctccgcggacagccccgggtgcggaccagcgggcagcggccggcgagaccctccctggatccgcccagagcttaccggaccctgcgcgcccccgtcccggctcccggccggctcgggggagaaggcgcccgaggggaggcgccggacagatcgcgtttcggaggcggcgcaggtgtgtcaggggtgggggtccgctggcatctctcgtgccggcgctgggggggtctcccgtggaggaagggctgaaggtgctccgggaggggtccactcgttatggaaaggaagcggggcgcggtcagggtccctcgtccgcagtgggggtggtccgggcccctcagcctgcacccgggaggagacgcccccttttcacgccccgcccccggtggccgaggccggattcggacagctcggggtcagtcgacggagcacaccgggcgcccgaatccgccgggtcccactcacgcccgccggccgccggtaggttggccctcccgcttccagcctccgccaccccatccctcgctgctctctgaggaggattccagacccccccgtagatctccgccctctctcgggtggggctccgaggtctagctggtctgggggtcagtcccggcctctgtctcccaccgcgcccctcgctcccctggacaccgcctggtgtgtggggctcagacccccccagtccactgcccctgtgtggctcctcctctcaggagaggattctagatcccagcccggggggggttccgaaaatgccgccagcctggagcggggaatccatggaccgtggggttgtggggttggggagcacgaaaacccagagaggggctagagctccacctccccagaccgccgaggggcgagagggcgcgccgggggccgtggttgccatggctcctggtagcggagcccggggggctggagatgccggtcgcggatggtcccttcttcctctttgtgcctctctctttctctcgctttttttttttttttggagtgtgagtgtgcgtggggaggcagcacggagaaagtgattaatttggggagcagggattggagccgggaggctggggaaagccagcccctccgttcccactctccgggctcgctgcgagccacagtgtctcagccaggggcagggccggggaactcctgcgaaaaaccacgggccggaggagcagcagccgcgcgggcccaggtacccccgccccagacggccagcagggtggagcgcagggtgggcgtttgggctgctgggcgggaaggcgggcggggaaggggtgggaggccggcggcggagggcaggtgtgcgtcggcagggctgggtggcccggcagagagggcgccccaggttcagcccctcctcgaagggcgccggcgtccagtcccgctcgtgggagccgcggagcagccccagggccggcgagcggctgccctgccaggcgcgtgcgcgagggcgcgctcccgcgggaacgcgccgtgcgcggggagatttgcgcgtgcgcgtggcgatggtaactggtgggccccccgggctcgctctaggcggaggctcccgggacgcccacgtggcttcgaattccagctccaccatcactgtgatgcgtcactctggactaggcatttaactacgtgcctcagtttccctttctcaataatacggagattatcgataccctctatac

SEQ ID NO: 121688 - DNA, 30 bp, Homo sapiens; identical to SEQ ID NO: 39848
  misc_feature 1..30: note = chr3:1741068-1741098
  misc_feature 1..30: note = Hypo
  source 1..30: mol_type = genomic DNA

SEQ ID NO: 121689 - DNA, 1687 bp, Homo sapiens
  misc_feature 1..1687: note = chr3:2139709-2141396
  misc_feature 1..1687: note = Hyper
  source 1..1687: mol_type = genomic DNA
gaataacaaggctttcgacatgccccacccccgcgcacaacacaccacaaattgatccttgtacctaatttacagcaactgttccctctgacctccccccgcccccgccccacattccaacctgaaagcactttgcgtggatgagacttcaggtgtgtaacgcagcctgtccagccagtgtcctccgcctaaggacaggcaggtaaaaacctaccaaagccccctcttctggcctaagttcaatgccacccgcccacccacattccccggttcagcaattttcagcccagacgcagaagcatctgtttccctggccagggcgccttaacgatcccccgaattccgcgtctcccggaggccagaggtttgggtacccaggaaggtcgcgcctcctcgtgccccgatactcgggttgtaaagggaggagacatcgcctcggcgcatccctggccgctgaacaacgcaacccctacgtccccgcacgggaatccggctgataatctcctcttgcctgagaatcgggccaggcgccctttactaatttcgcgcgctggggacctggggctgccgcctctcggccgcgcggggcaggtgctgcgtccccagcgctcgcctcctccggccgcgcactgagcatgcgcgggctccgggcctccggcgcgtctccccgtccccgctcgtctcccgcccgttcccacccgcccgcgcctctccccttccccgagcgtctcccccgccccgcggctaaggagccggcagcccgaactccggcgcgccaggtttttccagccgccgcgagcgccgggagggagggcagcgccgcgccagacggagcccggggttcgacgccaggattggctgcaagtagggagctttcgccgccgccccgggcccctcggactgtgccggcgccgcacccgaggctctcgccagcccggcgccccggtgctgaggtaagtgaggcggcagctgtgcgggtccggctcctgcgtgggcgcgcgatgccccggggacgcggtcgcgggtgtgggggggaaagggcagggtccgcgcgggttgcccgaaggacaggggcgcttcccggggctctgactcccgcggggccgggcagcgtctgcggggccgtccagctcagagcccggaagccctgcagggtcggggagcgggagctgaacgcctgagcgcggaggactcagggccccgacgacgccaccgtcaccccacagcgacccttcttctccttctcagccggaaaataagtttgttgcgctgcgaggcagccacaaaacaaggaaccgagagcccggaatgctgcgggaagccttcaagtcagctcctccgactggttcgggctactgccccctctccgtgcgccctggcctctggcgccgggttcccggcggggcttttcttctgacagcccagtcacagcccgcagcagagggacgcgaacctggggagtggagggacctgggactaaaggaacaggagcccgtagccgtggtggaaggagccgcgtggagacggaggctgatgtctgtggcgcccgctgggtgccgggctggctgctgagcgctgaggctgcggcggcgagcgacaggccaggtgcctgctcttagggaaggtacctggcttccccagtctctgccgcgggagcctgttgggtggcattcgtttccagcaactt

SEQ ID NO: 121690 - DNA, 30 bp, Homo sapiens; identical to SEQ ID NO: 90976
  misc_feature 1..30: note = chr3:2523208-2523238
  misc_feature 1..30: note = Hypo
  source 1..30: mol_type = genomic DNA

SEQ ID NO: 121691 - DNA, 191 bp, Homo sapiens; identical to SEQ ID NO: 39849
  misc_feature 1..191: note = chr3:2909417-2909608
  misc_feature 1..191: note = Hypo
  source 1..191: mol_type = genomic DNA

SEQ ID NO: 121692 - DNA, 18 bp, Homo sapiens
  misc_feature 1..18: note = chr3:3100258-3100276
  misc_feature 1..18: note = Hypo
  source 1..18: mol_type = genomic DNA
acccggcccttaaggccc

SEQ ID NO: 121693 - DNA, 78 bp, Homo sapiens; identical to SEQ ID NO: 90999
  misc_feature 1..78: note = chr3:3167655-3167733
  misc_feature 1..78: note = Hypo
  source 1..78: mol_type = genomic DNA

SEQ ID NO: 121694 - DNA, 30 bp, Homo sapiens; identical to SEQ ID NO: 39851
  misc_feature 1..30: note = chr3:3167988-3168018
  misc_feature 1..30: note = Hypo
  source 1..30: mol_type = genomic DNA

SEQ ID NO: 121695 - DNA, 2178 bp, Homo sapiens; identical to SEQ ID NO: 91044
  misc_feature 1..2178: note = chr3:3840430-3842608
  misc_feature 1..2178: note = Hyper
  source 1..2178: mol_type = genomic DNA

SEQ ID NO: 121696 - DNA, 30 bp, Homo sapiens; identical to SEQ ID NO: 91056
  misc_feature 1..30: note = chr3:4071112-4071142
  misc_feature 1..30: note = Hypo
  source 1..30: mol_type = genomic DNA

SEQ ID NO: 121697 - DNA, 30 bp, Homo sapiens; identical to SEQ ID NO: 91117
  misc_feature 1..30: note = chr3:4697393-4697423
  misc_feature 1..30: note = Hypo
  source 1..30: mol_type = genomic DNA

SEQ ID NO: 121698 - DNA, 30 bp, Homo sapiens; identical to SEQ ID NO: 39852
  misc_feature 1..30: note = chr3:4755974-4756004
  misc_feature 1..30: note = Hypo
  source 1..30: mol_type = genomic DNA

SEQ ID NO: 121699 - DNA, 125 bp, Homo sapiens; identical to SEQ ID NO: 91127
  misc_feature 1..125: note = chr3:4799808-4799933
  misc_feature 1..125: note = Hypo
  source 1..125: mol_type = genomic DNA

SEQ ID NO: 121700 - DNA, 262 bp, Homo sapiens; identical to SEQ ID NO: 28034
  misc_feature 1..262: note = chr3:4910288-4910550
  misc_feature 1..262: note = Hyper
  source 1..262: mol_type = genomic DNA

SEQ ID NO: 121701 - DNA, 30 bp, Homo sapiens; identical to SEQ ID NO: 91156
  misc_feature 1..30: note = chr3:4992934-4992964
  misc_feature 1..30: note = Hypo
  source 1..30: mol_type = genomic DNA

SEQ ID NO: 121702 - DNA, 147 bp, Homo sapiens; identical to SEQ ID NO: 91159
  misc_feature 1..147: note = chr3:5018985-5019132
  misc_feature 1..147: note = Hyper
  source 1..147: mol_type = genomic DNA

SEQ ID NO: 121703 - DNA, 240 bp, Homo sapiens; identical to SEQ ID NO: 91176
  misc_feature 1..240: note = chr3:5137779-5138019
  misc_feature 1..240: note = Hyper
  source 1..240: mol_type = genomic DNA

SEQ ID NO: 121704 - DNA, 30 bp, Homo sapiens; identical to SEQ ID NO: 91207
  misc_feature 1..30: note = chr3:5442940-5442970
  misc_feature 1..30: note = Hypo
  source 1..30: mol_type = genomic DNA

SEQ ID NO: 121705 - DNA, 195 bp, Homo sapiens; identical to SEQ ID NO: 91208
  misc_feature 1..195: note = chr3:5496299-5496494
  misc_feature 1..195: note = Hypo
  source 1..195: mol_type = genomic DNA

SEQ ID NO: 121706 - DNA, 91 bp, Homo sapiens; identical to SEQ ID NO: 91226
  misc_feature 1..91: note = chr3:5831049-5831140
  misc_feature 1..91: note = Hypo
  source 1..91: mol_type = genomic DNA

SEQ ID NO: 121707 - DNA, 30 bp, Homo sapiens; identical to SEQ ID NO: 39854
  misc_feature 1..30: note = chr3:5970953-5970983
  misc_feature 1..30: note = Hypo
  source 1..30: mol_type = genomic DNA

SEQ ID NO: 121708 - DNA, 66 bp, Homo sapiens; identical to SEQ ID NO: 91283
  misc_feature 1..66: note = chr3:6901993-6902059
  misc_feature 1..66: note = Hyper
  source 1..66: mol_type = genomic DNA

SEQ ID NO: 121709 - DNA, 351 bp, Homo sapiens; identical to SEQ ID NO: 91284
  misc_feature 1..351: note = chr3:6902321-6902672
  misc_feature 1..351: note = Hyper
  source 1..351: mol_type = genomic DNA

SEQ ID NO: 121710 - DNA, 147 bp, Homo sapiens
  misc_feature 1..147: note = chr3:6902969-6903116
  misc_feature 1..147: note = Hyper
  source 1..147: mol_type = genomic DNA
gcccctgggctttcccggaggagctcgccctgaagggcccggacctcggcgagcccaccaccgttccctccagcgccgccgccgccaccgcagcagccggagcagcatggtccagctgaggaagctgctccgcgtcctgactttgat

SEQ ID NO: 121711 - DNA, 122 bp, Homo sapiens; identical to SEQ ID NO: 91286
  misc_feature 1..122: note = chr3:6903588-6903710
  misc_feature 1..122: note = Hyper
  source 1..122: mol_type = genomic DNA

SEQ ID NO: 121712 - DNA, 378 bp, Homo sapiens
  misc_feature 1..378: note = chr3:6904142-6904520
  misc_feature 1..378: note = Hyper
  source 1..378: mol_type = genomic DNA
ctcgggctgatttcccgacctgtagccagcctccgcgagagcccagggcgcgaggtgctgggaccttcctcaggtggagagatgctgcccgcagacgtgacccccggttggtttgctccgggcaatattttgcaccgtctaaattacatgtgcgatccggccactggccggagctgggcgatcagctttccactcctgccacttcagacctcagcccagggatgagctcacgcgaaacgaaatcgctctccctgcctcctccctcctcccccccgcccccctcacccactatctccctgacgcagaccccaagccaaatcctcggcttggaggacgattcccggagcgaggcatgaaggcgcccgttgggaggcagag

SEQ ID NO: 121713 - DNA, 43 bp, Homo sapiens; identical to SEQ ID NO: 91312
  misc_feature 1..43: note = chr3:7271788-7271831
  misc_feature 1..43: note = Hypo
  source 1..43: mol_type = genomic DNA

SEQ ID NO: 121714 - DNA, 30 bp, Homo sapiens; identical to SEQ ID NO: 91326
  misc_feature 1..30: note = chr3:7630527-7630557
  misc_feature 1..30: note = Hypo
  source 1..30: mol_type = genomic DNA

SEQ ID NO: 121715 - DNA, 20 bp, Homo sapiens
  misc_feature 1..20: note = chr3:7690771-7690791
  misc_feature 1..20: note = Hypo
  source 1..20: mol_type = genomic DNA
tttgagatggagtctcgctc

SEQ ID NO: 121716 - DNA, 905 bp, Homo sapiens
  misc_feature 1..905: note = chr3:8809378-8810283
  misc_feature 1..905: note = Hyper
  source 1..905: mol_type = genomic DNA
caggcagccgagccacgtggcgagcactgccaggcggtcggtgcggcggcgcagcgagcgcagcggctggcagatggccaggcagcggtccagggacatgagcagcagcaggtaggtggaggcgaacatgcccaccacctgcaagtacttgaccaggcggcacagcaggtcgggcccgtagaagcggaaggtgatgtcccacagcaactgcggcagcacctgaaacactgccaccaccaggtcggcgatgcttaggtgcttcatgaagaagaagaggcgcgagtgcttctggcgtgtggtgcgcagcgccagcagcacacacgcgttcccgctcagcgccaggagcaggatgagacacagcaccgccacctccacgcgcgccagggcctcgttgcgccgcgggggtccggcggtgcggttgccctcggcccccggcggcgcggcgctggcgttggctgcctcggcgctccagttggctgcgagcgcgccctccatgaccctggcggcagcggtgcgccccggccttcgagccctttacggcttggcgcggctgggccggatccggcgtgtcggagggtgtaggggcgcccggggctccactcctggagactccacggacggatctgctgggtccaccctgaaacaaaccgggagggccgtgaggagaccgccgcgtttctcttccgacgcgggtagggcgtgcttgtcccattcccaggaacccaactcatctgaaacaacagggcacaaccgccggcctcgggttgctcagccgccaccccagaaatccccgttggaggtacctcctctgagccactgcaaatgagcgggaatcctctaccggccacaagcccagagcccccagcgtgccagttcctcgggatgttcagcggcttccactgggg

SEQ ID NO: 121717 - DNA, 693 bp, Homo sapiens; identical to SEQ ID NO: 91356
  misc_feature 1..693: note = chr3:8810758-8811451
  misc_feature 1..693: note = Hyper
  source 1..693: mol_type = genomic DNA

SEQ ID NO: 121718 - DNA, 30 bp, Homo sapiens; identical to SEQ ID NO: 39855
  misc_feature 1..30: note = chr3:9006374-9006404
  misc_feature 1..30: note = Hypo
  source 1..30: mol_type = genomic DNA

SEQ ID NO: 121719 - DNA, 322 bp, Homo sapiens
  misc_feature 1..322: note = chr3:9177880-9178202
  misc_feature 1..322: note = Hyper
  source 1..322: mol_type = genomic DNA
cacaaaagactcgtgcgctgcccggacacgggctccccattgccgcccttctcctagcctcctgtacaccgagaggcggcttccgggacggccccgagggtccgcaggatccgtgcgcccagcgccggggctggaggcagcagatgccgggccggggtcagccgccgcgcgccgttgccacggcaaccgtcgctgggaccccccccccccccgaccgccccgccccgccccgcgcgccacgtgcagcagccggggtggctgaaagcgggctcctaagccatctcttcggattccttcttcgcagacgcgagcaagctcctgg

SEQ ID NO: 121720 - DNA, 680 bp, Homo sapiens; identical to SEQ ID NO: 91367
  misc_feature 1..680: note = chr3:9541700-9542380
  misc_feature 1..680: note = Hyper
  source 1..680: mol_type = genomic DNA

SEQ ID NO: 121721 - DNA, 118 bp, Homo sapiens
  misc_feature 1..118: note = chr3:9550635-9550753
  misc_feature 1..118: note = Hyper
  source 1..118: mol_type = genomic DNA
ctggtcgtccattcccgtggtgccagaggcgcgggtcctgcagtagtcggtggctcccgccaggagcatccccgtctccgtggaaaccgggcctgcatcccggcgctcccagctgcgc

SEQ ID NO: 121722 - DNA, 93 bp, Homo sapiens; identical to SEQ ID NO: 91369
  misc_feature 1..93: note = chr3:9593963-9594056
  misc_feature 1..93: note = Hyper
  source 1..93: mol_type = genomic DNA

SEQ ID NO: 121723 - DNA, 77 bp, Homo sapiens; identical to SEQ ID NO: 91370
  misc_feature 1..77: note = chr3:9594366-9594443
  misc_feature 1..77: note = Hyper
  source 1..77: mol_type = genomic DNA

SEQ ID NO: 121724 - DNA, 30 bp, Homo sapiens; identical to SEQ ID NO: 91371
  misc_feature 1..30: note = chr3:9594966-9594996
  misc_feature 1..30: note = Hyper
  source 1..30: mol_type = genomic DNA

SEQ ID NO: 121725 - DNA, 432 bp, Homo sapiens
  misc_feature 1..432: note = chr3:9595249-9595681
  misc_feature 1..432: note = Hyper
  source 1..432: mol_type = genomic DNA
cggggggctggggagcggccgggcccgagtagggccggggttgggggggcggctgccccgcgcccaggccggacgcgcgcgaggctgcggccgcggggaaagggtgcggggagaccaacctgggcacggccggaggcagcggatccgggactggcacggcctaggcgccgcggctcggcgctcccagcagcggctgcctcggcccaggcggcggcctctgcgcggcctccatcttgctcgggttctccccggggcgcgctcccgcgccgaggcgcgcgctctcgtgcaccggcgcggcccggcggaggcgcgctcccgagcgggcgtgcgggacggggcggggcggaaccggggaagggtgctcctggttctggcagttggggggaagggtggccacgatacctggggtcccccagccggggcagcaagcac

SEQ ID NO: 121726 - DNA, 470 bp, Homo sapiens; identical to SEQ ID NO: 91378
  misc_feature 1..470: note = chr3:9745353-9745823
  misc_feature 1..470: note = Hyper
  source 1..470: mol_type = genomic DNA

SEQ ID NO: 121727 - DNA, 55 bp, Homo sapiens; identical to SEQ ID NO: 91379
  misc_feature 1..55: note = chr3:9746288-9746343
  misc_feature 1..55: note = Hyper
  source 1..55: mol_type = genomic DNA

SEQ ID NO: 121728 - DNA, 29 bp, Homo sapiens
  misc_feature 1..29: note = chr3:9886216-9886245
  misc_feature 1..29: note = Hypo
  source 1..29: mol_type = genomic DNA
agcttccccagctcacgattgtccaacct

SEQ ID NO: 121729 - DNA, 489 bp, Homo sapiens; identical to SEQ ID NO: 91395
  misc_feature 1..489: note = chr3:9904219-9904708
  misc_feature 1..489: note = Hyper
  source 1..489: mol_type = genomic DNA

SEQ ID NO: 121730 - DNA, 41 bp, Homo sapiens; identical to SEQ ID NO: 91397
  misc_feature 1..41: note = chr3:9941469-9941510
  misc_feature 1..41: note = Hypo
  source 1..41: mol_type = genomic DNA

SEQ ID NO: 121731 - DNA, 1064 bp, Homo sapiens; identical to SEQ ID NO: 91398
  misc_feature 1..1064: note = chr3:9956682-9957746
  misc_feature 1..1064: note = Hyper
  source 1..1064: mol_type = genomic DNA

SEQ ID NO: 121732 - DNA, 414 bp, Homo sapiens
  misc_feature 1..414: note = chr3:9993715-9994129
  misc_feature 1..414: note = Hyper
  source 1..414: mol_type = genomic DNA
ggctgtggggggtggcggatctctctgccgcagggactggggagaggccggcctgggggcagggcgaggccgttgcggggcagcctcggagctggtccatctcgggttacctctcctcctcctcctcctcctcctccgtctcctctctccctggctccgcgccttcccgcagtgtcctggatgggggtgggcgccgtgcaggcctggtcgcctgcgcccgcgacgggggcagcaggccacgctccccgtcggggtcccgccatcgccccctccctgggccagctcctcacctgcgcgccgcagcccccgtgttcaccttgcgcgcgtccctgcagccgatcgccgcgccgcatcctccgagatgctcagactcggctaacagagcccggcgctgccgatcgcgagcccgcccac

SEQ ID NO: 121733 - DNA, 30 bp, Homo sapiens; identical to SEQ ID NO: 39857
  misc_feature 1..30: note = chr3:10127378-10127408
  misc_feature 1..30: note = Hypo
  source 1..30: mol_type = genomic DNA

SEQ ID NO: 121734 - DNA, 30 bp, Homo sapiens; identical to SEQ ID NO: 89958
  misc_feature 1..30: note = chr3:10129903-10129933
  misc_feature 1..30: note = Hypo
  source 1..30: mol_type = genomic DNA

SEQ ID NO: 121735 - DNA, 24 bp, Homo sapiens
  misc_feature 1..24: note = chr3:10156881-10156905
  misc_feature 1..24: note = Hypo
  source 1..24: mol_type = genomic DNA
gcaagactccgtctcaaaaaaaca

SEQ ID NO: 121736 - DNA, 78 bp, Homo sapiens
  misc_feature 1..78: note = chr3:10182839-10182917
  misc_feature 1..78: note = Hypo
  source 1..78: mol_type = genomic DNA
ttgtactttataagcgtgatgattgggtgttcccgtgtgagatgcgccaccctcgaaccttgttacgacgtcggcaca

SEQ ID NO: 121737 - DNA, 29 bp, Homo sapiens
  misc_feature 1..29: note = chr3:10183321-10183350
  misc_feature 1..29: note = Hyper
  source 1..29: mol_type = genomic DNA
cgcctccgttacaacggcctacggtgctg

SEQ ID NO: 121738 - DNA, 29 bp, Homo sapiens
  misc_feature 1..29: note = chr3:10183706-10183735
  misc_feature 1..29: note = Hyper
  source 1..29: mol_type = genomic DNA
cgcggcccgtgctgcgctcggtgaactcg

SEQ ID NO: 121739 - DNA, 444 bp, Homo sapiens; identical to SEQ ID NO: 89962
  misc_feature 1..444: note = chr3:10206755-10207199
  misc_feature 1..444: note = Hyper
  source 1..444: mol_type = genomic DNA

SEQ ID NO: 121740 - DNA, 25 bp, Homo sapiens
  misc_feature 1..25: note = chr3:10210615-10210640
  misc_feature 1..25: note = Hypo
  source 1..25: mol_type = genomic DNA
tcaggggaaccagcccgcagtattt

SEQ ID NO: 121741 - DNA, 30 bp, Homo sapiens; identical to SEQ ID NO: 89965
  misc_feature 1..30: note = chr3:10332154-10332184
  misc_feature 1..30: note = Hypo
  source 1..30: mol_type = genomic DNA

SEQ ID NO: 121742 - DNA, 30 bp, Homo sapiens; identical to SEQ ID NO: 89966
  misc_feature 1..30: note = chr3:10373144-10373174
  misc_feature 1..30: note = Hypo
  source 1..30: mol_type = genomic DNA

SEQ ID NO: 121743 - DNA, 36 bp, Homo sapiens; identical to SEQ ID NO: 89967
  misc_feature 1..36: note = chr3:10434940-10434976
  misc_feature 1..36: note = Hypo
  source 1..36: mol_type = genomic DNA

SEQ ID NO: 121744 - DNA, 55 bp, Homo sapiens; identical to SEQ ID NO: 89969
  misc_feature 1..55: note = chr3:10452238-10452293
  misc_feature 1..55: note = Hypo
  source 1..55: mol_type = genomic DNA

SEQ ID NO: 121745 - DNA, 102 bp, Homo sapiens; identical to SEQ ID NO: 89970
  misc_feature 1..102: note = chr3:10547163-10547265
  misc_feature 1..102: note = Hyper
  source 1..102: mol_type = genomic DNA

SEQ ID NO: 121746 - DNA, 744 bp, Homo sapiens; identical to SEQ ID NO: 89980
  misc_feature 1..744: note = chr3:10749201-10749945
  misc_feature 1..744: note = Hyper
  source 1..744: mol_type = genomic DNA

SEQ ID NO: 121747 - DNA, 794 bp, Homo sapiens
  misc_feature 1..794: note = chr3:10857625-10858419
  misc_feature 1..794: note = Hyper
  source 1..794: mol_type = genomic DNA
ggagccggcctaggccggaatgggcgcttccactcttggcccagcaggccagtgggcagggccgcgggaaggacgggcgctgcaggggctccgcgcgctcaaggtgctcgcgggctcccgggcccagccgggctgaggtggcgtgggcgccctgcgggccgggcctccgcggcgcgtcccagtcccagtctccgcgctggtctggcccggtccctcagctccaccccctgcctccccctcccgcccgctcgcgcctcctgaaaagccagctcgcccggggcggcggcgcagagccgggccggcgcacgaggcagccagcgcggccatgacggcggagaaggcgctgcccctgggcaatgggaaggctgctgaggaggcgcgggagtccgaggcgccgggtggcggctgcagcagcgggggcgcggcgcccgcgcgccacccgcgcgtcaagcgcgacaaggcggtccacgagcgcggccactggaacaacaaggtggagttcgtgctgagcgtggccggggagatcattgggctgggcaacgtgtggcgcttcccctacctgtgctacaagaacggaggaggtgaggtgatagtgaggagaaggggagggggcgccaaccgcccggtgggggcggggagccaggggcgagcgcgagaccccctcccgcgcctgcgtggagcggaacccgagcggagaacctcgactccaggcacctcgcgtgtgagctcgccccggagcgcggcccacctgtgccagtgcgcacgcgcacgtgccaattcgcacctgagggttc

SEQ ID NO: 121748 - DNA, 41 bp, Homo sapiens; identical to SEQ ID NO: 89990
  misc_feature 1..41: note = chr3:11033835-11033876
  misc_feature 1..41: note = Hyper
  source 1..41: mol_type = genomic DNA

SEQ ID NO: 121749 - DNA, 1288 bp, Homo sapiens
  misc_feature 1..1288: note = chr3:11034146-11035434
  misc_feature 1..1288: note = Hyper
  source 1..1288: mol_type = genomic DNA
ggagggagaagagagcgggagaatgcgagaggaaagaagggagaggggaggcgtagaaggggagaggaggtgaagggaaaaggagagagcctgctggcggcgaagctgcaagaggcagctgcggagggagcgcgcggcgggcctgggggagcgctgggcgggggcgggcggtgcgggcagggctatacccgagctgggcgggctccgggcgccgcgggccctgccctccccctccatccctccggactcgctcccccctcctctcccttccccgcgaccctccgcccgccctcggaagaccgagacagcggagaggttgcgggtgagctgcgctgagcccaggagccgaggagtcgggagcgcagtagcgctgagcccgagcccgagcggccccgcgtcccgagcgcatcggagcggccgagccgcccggatgcagcgcctgtcccgggcagcgcagccccggccgcaggtaggaaagggcggccggcgtcggggcgcggggcgcagagcctgggataacggcgcaggaacggccagagccccgagccgctgccgcgagccgggccgggtggggggcggacacctcgagattcaagcccccgcgccgcaccttccctgagccacatgaaggagcagaggcgccgctcggaccccgacgtgcgcccaggccatccgtcccctgggacactcgggaggcaggagggctggaacagaggcgagagttgcatgccccttccctcccgcggtgccccactggccccgcaagttggcactggattctgctggagccgtcgaagctccctattcattccccagggcatggaggggacgcggagtgaatgacacgagcagcgttggggggccgtgcgccactttcccaatcctggggtcagctgagccgagttagagctatgcccctcatttgttctctgcgggctacggcggggtcgggtgcgacttgaggatgggacgtctctgggacagcccgagctctcagaaacgttggcttaaaagcacaccggggcttgggctgagtgcaccggagctaagcctagtgcaccagagctcgcgccgcgctctcccagccccgactttctccaagagatgtggggtgcgggcggtcccttagagggctggaggacggtgcctccttgctgcttcgggaactgcgctccccttcttgcttttggtctctgcgtgtactccccggcgcgacaccgctcaccacggtagcctcgggcagtgcccattgggttctgagcacacgtccccacgggtggcacccaca

SEQ ID NO: 121750 - DNA, 51 bp, Homo sapiens; identical to SEQ ID NO: 89994
  misc_feature 1..51: note = chr3:11062025-11062076
  misc_feature 1..51: note = Hypo
  source 1..51: mol_type = genomic DNA

SEQ ID NO: 121751 - DNA, 360 bp, Homo sapiens; identical to SEQ ID NO: 89999
  misc_feature 1..360: note = chr3:11196531-11196891
  misc_feature 1..360: note = Hyper
  source 1..360: mol_type = genomic DNA

SEQ ID NO: 121752 - DNA, 94 bp, Homo sapiens; identical to SEQ ID NO: 90016
  misc_feature 1..94: note = chr3:11581322-11581416
  misc_feature 1..94: note = Hypo
  source 1..94: mol_type = genomic DNA

SEQ ID NO: 121753 - DNA, 56 bp, Homo sapiens; identical to SEQ ID NO: 90017
  misc_feature 1..56: note = chr3:11600778-11600834
  misc_feature 1..56: note = Hypo
  source 1..56: mol_type = genomic DNA

SEQ ID NO: 121754 - DNA, 35 bp, Homo sapiens; identical to SEQ ID NO: 90020
  misc_feature 1..35: note = chr3:11658975-11659010
  misc_feature 1..35: note = Hypo
  source 1..35: mol_type = genomic DNA

SEQ ID NO: 121755 - DNA, 30 bp, Homo sapiens; identical to SEQ ID NO: 90021
  misc_feature 1..30: note = chr3:11683213-11683243
  misc_feature 1..30: note = Hyper
  source 1..30: mol_type = genomic DNA

SEQ ID NO: 121756 - DNA, 37 bp, Homo sapiens; identical to SEQ ID NO: 90023
  misc_feature 1..37: note = chr3:11706859-11706896
  misc_feature 1..37: note = Hypo
  source 1..37: mol_type = genomic DNA

SEQ ID NO: 121757 - DNA, 218 bp, Homo sapiens; identical to SEQ ID NO: 90024
  misc_feature 1..218: note = chr3:11763029-11763247
  misc_feature 1..218: note = Hypo
  source 1..218: mol_type = genomic DNA

SEQ ID NO: 121758 - DNA, 30 bp, Homo sapiens; identical to SEQ ID NO: 39861
  misc_feature 1..30: note = chr3:12039968-12039998
  misc_feature 1..30: note = Hypo
  source 1..30: mol_type = genomic DNA

SEQ ID NO: 121759 - DNA, 951 bp, Homo sapiens
  misc_feature 1..951: note = chr3:12045681-12046632
  misc_feature 1..951: note = Hyper
  source 1..951: mol_type = genomic DNA
gctggaggcctgggtcgccccctcctgcaagccccgagagtcgccagacgcgcggctaggtgccctccgtgagcggggcggggccgcctctgcggcgcggggcgggggctatctctggccccgcccctgccccgcccgctccctctccgcgagcctcgcgccgcgcgggttgcctggcccagaccgccgctgctgtctgcggggtctggtgccggggcctgagtctctgctggctaagccgacgcctcagccgcctcagtcgcctcaatctcgccttccgccctcgctctccctccgcgccaccggaccccgtagccccgcgcgcccccagacctttaagccagatgatgaacttcctgcggcgccggctgtcggacagcagcttcatcgccaatctgcccaacggctacatgaccgacctgcagcggcccgagccccagcaagcgccgacgccgccgccccccggcccgggcgccgcctcggcctaggcggcgcccccgaccgcctcgccgggaccggagcggacgccgccggccgcctaggcgcccgcgccgtaagacgcgccgaagaccgcgcccccccccccgcgcgaacaccgtcggtgggcagcagcttattcagctcgctgtcccaagcggtaaagcagacggccgcctcggctggcctggtggacgcgcccggtgccgcgccggcagccgccaggaaggccaaggtgctgctggtggtcgacgagccgcacgccgactggtaggtgccgggcgccttcgccctcgggggtcggggtccgccggcagccgcaggccaggagaggacggtcccaggtcgccgaggaaacgtttcagaccaataaaaaggagggtccccgaggtcccgctgggaggaggtgcgggctgagcgcgcgcgcgtttgcggggtgagggagggcatccatcagcccggaaaggcgaaccc

SEQ ID NO: 121760 - DNA, 543 bp, Homo sapiens; identical to SEQ ID NO: 90076
  misc_feature 1..543: note = chr3:12329482-12330025
  misc_feature 1..543: note = Hyper
  source 1..543: mol_type = genomic DNA

SEQ ID NO: 121761 - DNA, 30 bp, Homo sapiens; identical to SEQ ID NO: 14520
  misc_feature 1..30: note = chr3:12586227-12586257
  misc_feature 1..30: note = Hypo
  source 1..30: mol_type = genomic DNA

SEQ ID NO: 121762 - DNA, 26 bp, Homo sapiens
  misc_feature 1..26: note = chr3:12596518-12596544
  misc_feature 1..26: note = Hypo
  source 1..26: mol_type = genomic DNA
gtggcatgggctgggcgcggtggctc

SEQ ID NO: 121763 - DNA, 102 bp, Homo sapiens; identical to SEQ ID NO: 90111
  misc_feature 1..102: note = chr3:12673087-12673189
  misc_feature 1..102: note = Hypo
  source 1..102: mol_type = genomic DNA

SEQ ID NO: 121764 - DNA, 240 bp, Homo sapiens; identical to SEQ ID NO: 90153
  misc_feature 1..240: note = chr3:12837883-12838123
  misc_feature 1..240: note = Hyper
  source 1..240: mol_type = genomic DNA

SEQ ID NO: 121765 - DNA, 30 bp, Homo sapiens
  misc_feature 1..30: note = chr3:12838460-12838490
  misc_feature 1..30: note = Hyper
  source 1..30: mol_type = genomic DNA
cactggagctccggccgttctcccctaggg

SEQ ID NO: 121766 - DNA, 82 bp, Homo sapiens; identical to SEQ ID NO: 90155
  misc_feature 1..82: note = chr3:12851610-12851692
  misc_feature 1..82: note = Hyper
  source 1..82: mol_type = genomic DNA

SEQ ID NO: 121767 - DNA, 382 bp, Homo sapiens; identical to SEQ ID NO: 90159
  misc_feature 1..382: note = chr3:12867117-12867499
  misc_feature 1..382: note = Hypo
  source 1..382: mol_type = genomic DNA

SEQ ID NO: 121768 - DNA, 36 bp, Homo sapiens; identical to SEQ ID NO: 90160
  misc_feature 1..36: note = chr3:12870958-12870994
  misc_feature 1..36: note = Hypo
  source 1..36: mol_type = genomic DNA

SEQ ID NO: 121769 - DNA, 36 bp, Homo sapiens; identical to SEQ ID NO: 90180
  misc_feature 1..36: note = chr3:12915182-12915218
  misc_feature 1..36: note = Hypo
  source 1..36: mol_type = genomic DNA

SEQ ID NO: 121770 - DNA, 170 bp, Homo sapiens; identical to SEQ ID NO: 90181
  misc_feature 1..170: note = chr3:12917547-12917717
  misc_feature 1..170: note = Hyper
  source 1..170: mol_type = genomic DNA

SEQ ID NO: 121771 - DNA, 30 bp, Homo sapiens; identical to SEQ ID NO: 90193
  misc_feature 1..30: note = chr3:12977045-12977075
  misc_feature 1..30: note = Hypo
  source 1..30: mol_type = genomic DNA

SEQ ID NO: 121772 - DNA, 85 bp, Homo sapiens; identical to SEQ ID NO: 90197
  misc_feature 1..85: note = chr3:13008938-13009023
  misc_feature 1..85: note = Hyper
  source 1..85: mol_type = genomic DNA

SEQ ID NO: 121773 - DNA, 162 bp, Homo sapiens; identical to SEQ ID NO: 90198
  misc_feature 1..162: note = chr3:13009525-13009687
  misc_feature 1..162: note = Hyper
  source 1..162: mol_type = genomic DNA

SEQ ID NO: 121774 - DNA, 42 bp, Homo sapiens; identical to SEQ ID NO: 90199
  misc_feature 1..42: note = chr3:13021222-13021264
  misc_feature 1..42: note = Hypo
  source 1..42: mol_type = genomic DNA

SEQ ID NO: 121775 - DNA, 30 bp, Homo sapiens; identical to SEQ ID NO: 90203
  misc_feature 1..30: note = chr3:13028860-13028890
  misc_feature 1..30: note = Hypo
  source 1..30: mol_type = genomic DNA

SEQ ID NO: 121776 - DNA, 46 bp, Homo sapiens; identical to SEQ ID NO: 90209
  misc_feature 1..46: note = chr3:13083152-13083198
  misc_feature 1..46: note = Hypo
  source 1..46: mol_type = genomic DNA

SEQ ID NO: 121777 - DNA, 120 bp, Homo sapiens; identical to SEQ ID NO: 90210
  misc_feature 1..120: note = chr3:13083986-13084106
  misc_feature 1..120: note = Hypo
  source 1..120: mol_type = genomic DNA

SEQ ID NO: 121778 - DNA, 61 bp, Homo sapiens; identical to SEQ ID NO: 90211
  misc_feature 1..61: note = chr3:13096348-13096409
  misc_feature 1..61: note = Hypo
  source 1..61: mol_type = genomic DNA

SEQ ID NO: 121779 - DNA, 30 bp, Homo sapiens; identical to SEQ ID NO: 90218
  misc_feature 1..30: note = chr3:13177731-13177761
  misc_feature 1..30: note = Hypo
  source 1..30: mol_type = genomic DNA

SEQ ID NO: 121780 - DNA, 1519 bp, Homo sapiens
  misc_feature 1..1519: note = chr3:13323423-13324942
  misc_feature 1..1519: note = Hyper
  source 1..1519: mol_type = genomic DNA
cctgccccagatgggcgcccgaaggtccacacggtgaggctgctccgggtttcgacaccgacactcatgggaggcaaacgggaacccggctggcgggctgcgagccggtagggacgctggggtccagggctgctggacagccccgccctgtacctctccccatccctcacttaatcctgggtccgaaatagccccgggtaatcccagggcgaggcagtcgggaattaaccccagccttgaagtaagagacagaggcgtccacagaagagggctctgcgcgtcccggactggacacagcgcagagtccattccagggacaccgcaacccgcaagcgacccaggcccgctccagggcgggatccgcgcggcccgcgacccctccctaccggtctcgggatctctgggtcggaagttctcgccctgctgctccgagacctaggtccgctccccggacagacctccgcccggctcgtccgagccccgggggtcgccaaccctgagtccgcgccgcagcgcagagccaggccggcgggagcgctgagcagctccctggagcccttttccagggaacccagtccccacccgagatcgagctccggatctgggcggcgaccccgccagagaatcccagggagcccctgggggtctggcggcgggtgtgggcgctcccgggccggccacgcgccctcccgcacccgcccacctccccgccaagccccgagggaagccgcggaccccaagaagttcccacgtccccgacacgcccgccgccccgggccccgcttacttgtcgcggcggccgccgagctccgggatggcgccgagcggctgcgggccggggccggggcccgggtcggggcggcgggcgcacgcggccaggtgtcgccggtgtcgctccagcaggccggcgttctcccggctcagccgcgccacttggcgctccagctcctcgatgcgccgtcgccggcgcgccagcagctcctgctgcgcggcgacgatccgggtcagctcctgcaggtactcggccgcctggccggggggctcggcggcgctggccatggccccccgcccggaggccggccgcgcctcaggcgagcgggcggcggggcggcggcggcgcggccatggctgcgcggcggggacggcggctcggcgcggcgcggggctgccgcggccccgcctcggctcccgcctccgccggcgccgcccccggggcccccgcgcctcctgctccccgcgccgccgcgctccgccgcccgctgccccgcggacgcgccggggcggcagggcgcggagctgcggccgcagcgggcaggcgaggagttttgcaaagtgccggccgcggcgcgggaagagggcggggagggcgccgcctgctgggaccgcccctgggtcccgcgcccccgcaccaggcgtcgggggacagctccatccttctccggccgcctcgggcgccttaaatcggaagcgattccgtgaaatacatctcgaatccatcagcggacgattttaggaaaag

SEQ ID NO: 121781 - DNA, 68 bp, Homo sapiens; identical to SEQ ID NO: 90234
  misc_feature 1..68: note = chr3:13357887-13357955
  misc_feature 1..68: note = Hypo
  source 1..68: mol_type = genomic DNA

SEQ ID NO: 121782 - DNA, 72 bp, Homo sapiens; identical to SEQ ID NO: 90235
  misc_feature 1..72: note = chr3:13359589-13359661
  misc_feature 1..72: note = Hypo
  source 1..72: mol_type = genomic DNA

SEQ ID NO: 121783 - DNA, 52 bp, Homo sapiens; identical to SEQ ID NO: 90241
  misc_feature 1..52: note = chr3:13367368-13367420
  misc_feature 1..52: note = Hypo
  source 1..52: mol_type = genomic DNA

SEQ ID NO: 121784 - DNA, 42 bp, Homo sapiens; identical to SEQ ID NO: 39868
  misc_feature 1..42: note = chr3:13373208-13373250
  misc_feature 1..42: note = Hypo
  source 1..42: mol_type = genomic DNA

SEQ ID NO: 121785 - DNA, 86 bp, Homo sapiens; identical to SEQ ID NO: 90256
  misc_feature 1..86: note = chr3:13442743-13442829
  misc_feature 1..86: note = Hypo
  source 1..86: mol_type = genomic DNA

SEQ ID NO: 121786 - DNA, 152 bp, Homo sapiens; identical to SEQ ID NO: 90265
  misc_feature 1..152: note = chr3:13546000-13546152
  misc_feature 1..152: note = Hypo
  source 1..152: mol_type = genomic DNA

SEQ ID NO: 121787 - DNA, 635 bp, Homo sapiens
  misc_feature 1..635: note = chr3:13590416-13591051
  misc_feature 1..635: note = Hyper
  source 1..635: mol_type = genomic DNA
ggcgcagggagggtgcgggctccgcagcgagcgcgccgggcggcctctaggagccgggtcagcgagtctgggctctgagcgagcggcgccggcccggccccctctccggcgggcggccgagaccccgccccggaggcggaggcggagtcaggggagggggccgggggccggctggtcccgcctctcgcgcctccgccccgccccgcgcgcacacagccaggggccgcccgggctctcgacgcgccgacggccgggcggacggacggacggacgccgagcgcagtgccccgcggtgagtgcacgcggcccctcccgcccggactcatccccgtcggtccgcgcctcgcagctcaggactcgggggcgctcggacgcaccgacggctcggcggaccctcggacgcgcctcgcgggctgcccgcgcctccacccgcgccgccggtccgaccgggtctcgctctcccggtcccagcgcggggacggcccgcgagcgccgcgacccagtgtacagatgcgggcacagaggccggcgcggggtgggggccaggggtccgcgggcgggttcccccaccccaggtccgcagcttcctccgctctgggtttcacttctcccccctgggccggctcccaccagtc

SEQ ID NO: 121788 - DNA, 332 bp, Homo sapiens; identical to SEQ ID NO: 90271
  misc_feature 1..332: note = chr3:13612009-13612341
  misc_feature 1..332: note = Hypo
  source 1..332: mol_type = genomic DNA

SEQ ID NO: 121789 - DNA, 312 bp, Homo sapiens; identical to SEQ ID NO: 90278
  misc_feature 1..312: note = chr3:13679132-13679444
  misc_feature 1..312: note = Hypo
  source 1..312: mol_type = genomic DNA

SEQ ID NO: 121790 - DNA, 30 bp, Homo sapiens; identical to SEQ ID NO: 14522
  misc_feature 1..30: note = chr3:13680779-13680809
  misc_feature 1..30: note = Hypo
  source 1..30: mol_type = genomic DNA

SEQ ID NO: 121791 - DNA, 410 bp, Homo sapiens
  misc_feature 1..410: note = chr3:13696612-13697022
  misc_feature 1..410: note = Hyper
  source 1..410: mol_type = genomic DNA
caggtagccccaggacggcgctgcagcaggagtgtccctgatcccgggtggtcgctctccagcccgccaggctctccgacgggctcaacccgcagcccctggccggggctggggccgggacgccaggcccctgtggggacggttccctccagcagttggcgaggctcggccggccaaggggccggttcctcccgctggcagccgcccggccgccgccttccgcccttgcccgcccgcggccgtccccgagccgctcccggccgggccttgagcgccttttcctcttcccggcgccccggccgcccggcgcgtccagctaagcaggaagggcccgcccgcgcccaaggccagggcctcagccggaggtcgcccgccgccaggggccgctgcggcgccggggacgcgcgagg

SEQ ID NO: 121792 - DNA, 163 bp, Homo sapiens; identical to SEQ ID NO: 90306
  misc_feature 1..163: note = chr3:13860677-13860840
  misc_feature 1..163: note = Hypo
  source 1..163: mol_type = genomic DNA

SEQ ID NO: 121793 - DNA, 1122 bp, Homo sapiens; identical to SEQ ID NO: 90329
  misc_feature 1..1122: note = chr3:13919657-13920779
  misc_feature 1..1122: note = Hyper
  source 1..1122: mol_type = genomic DNA

SEQ ID NO: 121794 - DNA, 923 bp, Homo sapiens; identical to SEQ ID NO: 90330
  misc_feature 1..923: note = chr3:13920980-13921903
  misc_feature 1..923: note = Hyper
  source 1..923: mol_type = genomic DNA

SEQ ID NO: 121795 - DNA, 30 bp, Homo sapiens; identical to SEQ ID NO: 90332
  misc_feature 1..30: note = chr3:13937220-13937250
  misc_feature 1..30: note = Hyper
  source 1..30: mol_type = genomic DNA

SEQ ID NO: 121796 - DNA, 99 bp, Homo sapiens; identical to SEQ ID NO: 90337
  misc_feature 1..99: note = chr3:13975514-13975613
  misc_feature 1..99: note = Hypo
  source 1..99: mol_type = genomic DNA

SEQ ID NO: 121797 - DNA, 30 bp, Homo sapiens; identical to SEQ ID NO: 39874
  misc_feature 1..30: note = chr3:14197900-14197930
  misc_feature 1..30: note = Hypo
  source 1..30: mol_type = genomic DNA

SEQ ID NO: 121798 - DNA, 161 bp, Homo sapiens; identical to SEQ ID NO: 39875
  misc_feature 1..161: note = chr3:14443179-14443340
  misc_feature 1..161: note = Hypo
  source 1..161: mol_type = genomic DNA

SEQ ID NO: 121799 - DNA, 30 bp, Homo sapiens; identical to SEQ ID NO: 90397
  misc_feature 1..30: note = chr3:14552752-14552782
  misc_feature 1..30: note = Hypo
  source 1..30: mol_type = genomic DNA

SEQ ID NO: 121800 - DNA, 39 bp, Homo sapiens; identical to SEQ ID NO: 90404
  misc_feature 1..39: note = chr3:14615548-14615587
  misc_feature 1..39: note = Hypo
  source 1..39: mol_type = genomic DNA

SEQ ID NO: 121801 - DNA, 883 bp, Homo sapiens; identical to SEQ ID NO: 90407
  misc_feature 1..883: note = chr3:14643752-14644635
  misc_feature 1..883: note = Hyper
  source 1..883: mol_type = genomic DNA

SEQ ID NO: 121802 - DNA, 30 bp, Homo sapiens; identical to SEQ ID NO: 39876
  misc_feature 1..30: note = chr3:14676121-14676151
  misc_feature 1..30: note = Hypo
  source 1..30: mol_type = genomic DNA

SEQ ID NO: 121803 - DNA, 1192 bp, Homo sapiens
  misc_feature 1..1192: note = chr3:14851814-14853006
  misc_feature 1..1192: note = Hyper
  source 1..1192: mol_type = genomic DNA
cccagaaacccaactcgctgagttctcgtccttcgaacccccagcgcctcccgcggtgcccatggccacggcccctttaaatgtgcgcagggacgccccggccctcgcctccctgaatctctgaccgagcaggggaaaaaaaaatccttcctcttcgggagcggaggaaatgtctaggagggggtggaggcgcggctgcggcgcaggcagaggcgcaggcggaggcacggcggccagagcgcagcgcgcccggagccgggagcggacgcgacgcccggcgctgccccagccgccgcccccgcgctcgcgccccctcctcctcccccgccccgcgcccccgcccggcggccccgccccggaggctcgcggctcgcgcccccactgccctgcgcgccgcgcggagtccgaggcgcgccggggccgggcgggcgccagggggtgcgggccccgcggggcggccgcggagggaggcggtgtgcggagtcgcactgggacccgcggacggactgaaacgccgacggcggcccgggccccgcgcgctgaagatgaacagagcaggtaggaggcccggcgacctccggcgccgaggcacgagcgcgagggaccccggccgggcgctccaagttggagctcccggggagcccggggctagctgcccgaaatcctccgaccttccagtgccgctcggcctcggccaaagcatgcgcggctccggggtcctctcgccgaggaggctgagaaccgggggtccccgtccgaagcgccctgcctcagggaccttctcagccttggcgaggccgcgccctggccgtgcgcgccagtatcccactcgcacggcgttccccggagtgagggtcccttccacgacgaagaaagacgcccctttcgcaaaagcgacttcgtctggccccaaaacctttgccctccattccccagcgtcccggaccggtccttgctcatctctcaggggcaacacctgacccacggggcccgtcccggagctctcttcgactccgggaccagttcccagcccttcagtactcggcataccggaaggaggattcctgctcccttctctcctcctagaccccgaggcttggagcttactctccagatgagactaaaaagccctaaattaatccccctatagcgcacccctccctcgcagcgccctggtcgggggcctccattg

SEQ ID NO: 121804 - DNA, 257 bp, Homo sapiens; identical to SEQ ID NO: 90463
  misc_feature 1..257: note = chr3:14963819-14964076
  misc_feature 1..257: note = Hypo
  source 1..257: mol_type = genomic DNA

SEQ ID NO: 121805 - DNA, 37 bp, Homo sapiens; identical to SEQ ID NO: 90476
  misc_feature 1..37: note = chr3:15105526-15105563
  misc_feature 1..37: note = Hypo
  source 1..37: mol_type = genomic DNA

SEQ ID NO: 121806 - DNA, 55 bp, Homo sapiens; identical to SEQ ID NO: 90554
  misc_feature 1..55: note = chr3:16220336-16220391
  misc_feature 1..55: note = Hypo
  source 1..55: mol_type = genomic DNA

SEQ ID NO: 121807 - DNA, 30 bp, Homo sapiens; identical to SEQ ID NO: 90561
  misc_feature 1..30: note = chr3:16498958-16498988
  misc_feature 1..30: note = Hypo
  source 1..30: mol_type = genomic DNA

SEQ ID NO: 121808 - DNA, 1448 bp, Homo sapiens
  misc_feature 1..1448: note = chr3:16553978-16555426
  misc_feature 1..1448: note = Hyper
  source 1..1448: mol_type = genomic DNA
actgacaccacccagcgtccctagggatcacccataaccacacagggcagctgagggcaagcacagagtcacagacagacagcagggagcgtgcctggttctacaaccttggcctccacgcggttcttgctgccaaaggcagcgacaccggaggtgaagggcaccagccctggcctaggactggggtgcgcgtgcctgacaacggggcttcccgaaatacacaaccacctcctcctcgcccagacccatatccatcctggcgtcccttgagtctagagaagtgggttaagacaagggaagaaaatcccttacagaagaggagatccccgttttcagtgctggggactctcggcacccgcgtccctgtgcttctggtggttccggcgcttcctcggagcgcgcggcatgtctgctcctacacgtccagcacctctgtccccagagcaaacccacctcccagggcacacgcagaggggcagtcaggcaccgcctccaccctgccccacccaggccgcgcgcaccccggaaacctggactccgcgaccagctccctcctgttcttttccgaggaccccagcggcagtgtgtcctggacccacctgtagcctccaagctcccccacctctgcgtccttcctaggcgcttctgagcctgcagagcctacgacccccaacaggctgctccgaagtgcctctccctacatcgctccaggaatgactcccctacacccgttccccgcaaaaaaaagttggcccaagatccaggcgtcccaaggatcagcccaggtccccatccgacgcgggccagggggtgctgctctggcagctccggagccccggcaaagagcaacctgcagggaggcgccacgcgcggttcccactacccgccagagacccggtccatggggccaaacggaggggcctgtgccggtcgacaccccaagccctgtcgcgccccccccgccgcctaccgtatgggaccggcggaggagaaggcgcggtcgcgggctccctgaggcagcgtgttccgtcccgggaggaaagtttgtgccatacagaggaggcggcgcggggaggacttgggcgccggtgggtggaggcgtgggcggtggcgccgcgtggtcgtgtgtctgtccctccggcgatcggtgcgtctgtccctcgccggagcccgcggccgccgcgctctcgctcgctgcgcccagcgcccggcgcgctccggctccagccccgacgcgcccccgccgccgccgccgcgcgtccgccggctacacttcctcttcctctgaactcatgtgcaaaatatgctacgctgcatcttcagggaaagcctcgcggcccctgacagcagccgctggagcggtgggcccgcccagctctccccgcgccccctcggagttccgcccggtcacctccacgcggccgagctgcaagcgaccctggcagcct

SEQ ID NO: 121809 - DNA, 30 bp, Homo sapiens; identical to SEQ ID NO: 90569
  misc_feature 1..30: note = chr3:16727103-16727133
  misc_feature 1..30: note = Hypo
  source 1..30: mol_type = genomic DNA

SEQ ID NO: 121810 - DNA, 134 bp, Homo sapiens; identical to SEQ ID NO: 90581
  misc_feature 1..134: note = chr3:16889114-16889248
  misc_feature 1..134: note = Hypo
  source 1..134: mol_type = genomic DNA

SEQ ID NO: 121811 - DNA, 37 bp, Homo sapiens; identical to SEQ ID NO: 90582
  misc_feature 1..37: note = chr3:16892948-16892985
  misc_feature 1..37: note = Hypo
  source 1..37: mol_type = genomic DNA

SEQ ID NO: 121812 - DNA, 202 bp, Homo sapiens; identical to SEQ ID NO: 90583
  misc_feature 1..202: note = chr3:16894319-16894521
  misc_feature 1..202: note = Hypo
  source 1..202: mol_type = genomic DNA

SEQ ID NO: 121813 - DNA, 49 bp, Homo sapiens; identical to SEQ ID NO: 90585
  misc_feature 1..49: note = chr3:16925656-16925705
  misc_feature 1..49: note = Hyper
  source 1..49: mol_type = genomic DNA

SEQ ID NO: 121814 - DNA, 30 bp, Homo sapiens; identical to SEQ ID NO: 90586
  misc_feature 1..30: note = chr3:16925935-16925965
  misc_feature 1..30: note = Hyper
  source 1..30: mol_type = genomic DNA

SEQ ID NO: 121815 - DNA, 104 bp, Homo sapiens; identical to SEQ ID NO: 90597
  misc_feature 1..104: note = chr3:16952388-16952492
  misc_feature 1..104: note = Hypo
  source 1..104: mol_type = genomic DNA

SEQ ID NO: 121816 - DNA, 38 bp, Homo sapiens; identical to SEQ ID NO: 39880
  misc_feature 1..38: note = chr3:17001303-17001341
  misc_feature 1..38: note = Hypo
  source 1..38: mol_type = genomic DNA

SEQ ID NO: 121817 - DNA, 31 bp, Homo sapiens; identical to SEQ ID NO: 90611
  misc_feature 1..31: note = chr3:17048624-17048655
  misc_feature 1..31: note = Hypo
  source 1..31: mol_type = genomic DNA

SEQ ID NO: 121818 - DNA, 66 bp, Homo sapiens; identical to SEQ ID NO: 14524
  misc_feature 1..66: note = chr3:17499802-17499868
  misc_feature 1..66: note = Hypo
  source 1..66: mol_type = genomic DNA

SEQ ID NO: 121819 - DNA, 79 bp, Homo sapiens; identical to SEQ ID NO: 90715
  misc_feature 1..79: note = chr3:18299771-18299850
  misc_feature 1..79: note = Hypo
  source 1..79: mol_type = genomic DNA

SEQ ID NO: 121820 - DNA, 526 bp, Homo sapiens; identical to SEQ ID NO: 90768
  misc_feature 1..526: note = chr3:18485126-18485652
  misc_feature 1..526: note = Hyper
  source 1..526: mol_type = genomic DNA

SEQ ID NO: 121821 - DNA, 231 bp, Homo sapiens; identical to SEQ ID NO: 28092
  misc_feature 1..231: note = chr3:18486970-18487201
  misc_feature 1..231: note = Hyper
  source 1..231: mol_type = genomic DNA

SEQ ID NO: 121822 - DNA, 35 bp, Homo sapiens; identical to SEQ ID NO: 90809
  misc_feature 1..35: note = chr3:18735758-18735793
  misc_feature 1..35: note = Hypo
  source 1..35: mol_type = genomic DNA

SEQ ID NO: 121823 - DNA, 148 bp, Homo sapiens; identical to SEQ ID NO: 90827
  misc_feature 1..148: note = chr3:19188145-19188293
  misc_feature 1..148: note = Hyper
  source 1..148: mol_type = genomic DNA

SEQ ID NO: 121824 - DNA, 799 bp, Homo sapiens; identical to SEQ ID NO: 90828
  misc_feature 1..799: note = chr3:19189373-19190172
  misc_feature 1..799: note = Hyper
  source 1..799: mol_type = genomic DNA

SEQ ID NO: 121825 - DNA, 34 bp, Homo sapiens; identical to SEQ ID NO: 90944
  misc_feature 1..34: note = chr3:19790965-19790999
  misc_feature 1..34: note = Hypo
  source 1..34: mol_type = genomic DNA

SEQ ID NO: 121826 - DNA, 106 bp, Homo sapiens; identical to SEQ ID NO: 90945
  misc_feature 1..106: note = chr3:19791264-19791370
  misc_feature 1..106: note = Hypo
  source 1..106: mol_type = genomic DNA

SEQ ID NO: 121827 - DNA, 16 bp, Homo sapiens
  misc_feature 1..16: note = chr3:19911550-19911566
  misc_feature 1..16: note = Hypo
  source 1..16: mol_type = genomic DNA
gcgtgagctaccacac

SEQ ID NO: 121828 - DNA, 39 bp, Homo sapiens; identical to SEQ ID NO: 90947
  misc_feature 1..39: note = chr3:20013231-20013270
  misc_feature 1..39: note = Hypo
  source 1..39: mol_type = genomic DNA

SEQ ID NO: 121829 - DNA, 20 bp, Homo sapiens
  misc_feature 1..20: note = chr3:20139710-20139730
  misc_feature 1..20: note = Hypo
  source 1..20: mol_type = genomic DNA
gacaacgtcccaaattaaaa

SEQ ID NO: 121830 - DNA, 225 bp, Homo sapiens; identical to SEQ ID NO: 90953
  misc_feature 1..225: note = chr3:21447375-21447600
  misc_feature 1..225: note = Hypo
  source 1..225: mol_type = genomic DNA

SEQ ID NO: 121831 - DNA, 41 bp, Homo sapiens; identical to SEQ ID NO: 90954
  misc_feature 1..41: note = chr3:21973359-21973400
  misc_feature 1..41: note = Hypo
  source 1..41: mol_type = genomic DNA

SEQ ID NO: 121832 - DNA, 22 bp, Homo sapiens
  misc_feature 1..22: note = chr3:22241703-22241725
  misc_feature 1..22: note = Hypo
  source 1..22: mol_type = genomic DNA
tcctggcaagattatcggggaa

SEQ ID NO: 121833 - DNA, 91 bp, Homo sapiens; identical to SEQ ID NO: 39887
  misc_feature 1..91: note = chr3:22370592-22370683
  misc_feature 1..91: note = Hypo
  source 1..91: mol_type = genomic DNA

SEQ ID NO: 121834 - DNA, 730 bp, Homo sapiens
  misc_feature 1..730: note = chr3:22413593-22414323
  misc_feature 1..730: note = Hyper
  source 1..730: mol_type = genomic DNA
gaaccaggctgacctcgcccccccgcctcggcctcccctgccccttggttctcggcaatgagctgtgacctgagaccctccagctccgcgctcttcactctggccccgcaacctcacatctcttctccttggcaccgagaagaggctggggtgtgtggaccgatagtgcgggataccgaaaaggtggtccaaggtctgggcggtgcgaacgcccattccgcgccccccatgcgagccccagcccctcgcgcctggtatcccgcaggggcgcaaccctagctccttgcccggcgccccaacgaactccgccacctgaaccgagacacctctttttgcactcaacttaccgcggctgggctgagctttcggcgcccccaggagcttttctctccttcctcccaccgagctcttcattctcctgctggcggccgcccggcgccctggccctggcatccgggaggagcagccgccggggctggctgtcccgggagacgcacggctgcccgcctgcagcttcaacggcggtggtcgccgcgagccgtgagcggcggccaaggagaacggtctccgttgcgcagcgcgtgctgtccctccggcacgggctggaggtggcagtcagcgcgcctctgcctccgccgcgctcgcggcgctccgcacgagtcccgagccggcgtcagcccaggtgcaccaggctggggagaggtgcgagcccgcgcgaagggaggggccc

SEQ ID NO: 121835 - DNA, 45 bp, Homo sapiens; identical to SEQ ID NO: 90960
  misc_feature 1..45: note = chr3:22587374-22587419
  misc_feature 1..45: note = Hypo
  source 1..45: mol_type = genomic DNA

SEQ ID NO: 121836 - DNA, 30 bp, Homo sapiens; identical to SEQ ID NO: 90961
  misc_feature 1..30: note = chr3:23032111-23032141
  misc_feature 1..30: note = Hypo
  source 1..30: mol_type = genomic DNA

SEQ ID NO: 121837 - DNA, 82 bp, Homo sapiens; identical to SEQ ID NO: 90962
  misc_feature 1..82: note = chr3:23111021-23111103
  misc_feature 1..82: note = Hypo
  source 1..82: mol_type = genomic DNA

SEQ ID NO: 121838 - DNA, 30 bp, Homo sapiens; identical to SEQ ID NO: 90963
  misc_feature 1..30: note = chr3:23245806-23245836
  misc_feature 1..30: note = Hyper
  source 1..30: mol_type = genomic DNA

SEQ ID NO: 121839 - DNA, 134 bp, Homo sapiens; identical to SEQ ID NO: 90964
  misc_feature 1..134: note = chr3:23726999-23727133
  misc_feature 1..134: note = Hypo
  source 1..134: mol_type = genomic DNA

SEQ ID NO: 121840 - DNA, 141 bp, Homo sapiens; identical to SEQ ID NO: 90969
  misc_feature 1..141: note = chr3:24535454-24535595
  misc_feature 1..141: note = Hyper
  source 1..141: mol_type = genomic DNA

SEQ ID NO: 121841 - DNA, 85 bp, Homo sapiens
  misc_feature 1..85: note = chr3:24535903-24535988
  misc_feature 1..85: note = Hyper
  source 1..85: mol_type = genomic DNA
cagcctgccgccgcgcggtgcccgaacacgagagggcacctcctcccagatccggggcgcagaagccccgcggaggcaggtaatc

SEQ ID NO: 121842 - DNA, 118 bp, Homo sapiens; identical to SEQ ID NO: 90971
  misc_feature 1..118: note = chr3:24563619-24563737
  misc_feature 1..118: note = Hyper
  source 1..118: mol_type = genomic DNA

SEQ ID NO: 121843 - DNA, 258 bp, Homo sapiens; identical to SEQ ID NO: 90972
  misc_feature 1..258: note = chr3:24870586-24870844
  misc_feature 1..258: note = Hyper
  source 1..258: mol_type = genomic DNA

SEQ ID NO: 121844 - DNA, 123 bp, Homo sapiens
  misc_feature 1..123: note = chr3:24871069-24871192
  misc_feature 1..123: note = Hyper
  source 1..123: mol_type = genomic DNA
ttggggggtctgcagcgggagcccgcgaccgatcccaggacatctggactcgcggacaactttgcgcagcagtcctcttccaagttccctttattgctattgtcttagcgcctgtctgacagt

SEQ ID NO: 121845 - DNA, 97 bp, Homo sapiens; identical to SEQ ID NO: 28100
  misc_feature 1..97: note = chr3:24871789-24871886
  misc_feature 1..97: note = Hyper
  source 1..97: mol_type = genomic DNA

SEQ ID NO: 121846 - DNA, 156 bp, Homo sapiens; identical to SEQ ID NO: 28101
  misc_feature 1..156: note = chr3:24871946-24872102
  misc_feature 1..156: note = Hyper
  source 1..156: mol_type = genomic DNA

SEQ ID NO: 121847 - DNA, 100 bp, Homo sapiens
  misc_feature 1..100: note = chr3:25469358-25469458
  misc_feature 1..100: note = Hyper
  source 1..100: mol_type = genomic DNA
ggctggggggcgaggcggtgggcgggaggcgagcgggcgcaggcggaacaccgttttccaagctaagccgccgcaaataaaaaggcgtaaagggagagaa

SEQ ID NO: 121848 - DNA, 195 bp, Homo sapiens
  misc_feature 1..195: note = chr3:25469679-25469874
  misc_feature 1..195: note = Hyper
  source 1..195: mol_type = genomic DNA
gaaggttagcagcccgggtagggttcaccgaaagttcactcgcatatattaggcaattcaatctttcattctgtgtgacagaagtagtaggaagtgagctgttcagaggcaggagggtctattctttgccaaaggggggaccagaattcccccatgcgagctgtttgaggactgggatgccgagaacgcgagcga

SEQ ID NO: 121849 - DNA, 1650 bp, Homo sapiens; identical to SEQ ID NO: 90980
  misc_feature 1..1650: note = chr3:26664032-26665682
  misc_feature 1..1650: note = Hyper
  source 1..1650: mol_type = genomic DNA

SEQ ID NO: 121850 - DNA, 474 bp, Homo sapiens
  misc_feature 1..474: note = chr3:27410605-27411079
  misc_feature 1..474: note = Hyper
  source 1..474: mol_type = genomic DNA
tggctcccgaggcttcggggccgctccacagggacctgaggacgtctccccggagaccctgactcaagctgctcgccggcacagccgagcaccggctcccgcctactcaccgcgcgggagggacggtccctccttcaggccaatctccttatcattgtccctgctgctgtcacctgctgctgcagaccgggggtcccgtccagtctcagcccgtcccgtcctccccccagcctattcccggtcccctcaacctcagggacaccgcggccagctgcaccgttggttttccaatcaaatcctcctccaggccaccaaccagcgctggccaggccaatgccgacaattcttcctccgccacctggggcgcctcagccaatcgggagcagccatgctgcgcagtgcagaacgccatagcgacggatgacgcctgccggggaatcgccgtagcaaccagagacgcgctagatccaccac

SEQ ID NO: 121851 - DNA, 920 bp, Homo sapiens; identical to SEQ ID NO: 90983
  misc_feature 1..920: note = chr3:27754008-27754928
  misc_feature 1..920: note = Hyper
  source 1..920: mol_type = genomic DNA

SEQ ID NO: 121852 - DNA, 155 bp, Homo sapiens; identical to SEQ ID NO: 90984
  misc_feature 1..155: note = chr3:27756087-27756242
  misc_feature 1..155: note = Hyper
  source 1..155: mol_type = genomic DNA

SEQ ID NO: 121853 - DNA, 62 bp, Homo sapiens; identical to SEQ ID NO: 90985
  misc_feature 1..62: note = chr3:27756653-27756715
  misc_feature 1..62: note = Hyper
  source 1..62: mol_type = genomic DNA

SEQ ID NO: 121854 - DNA, 1826 bp, Homo sapiens; identical to SEQ ID NO: 90986
  misc_feature 1..1826: note = chr3:27762336-27764162
  misc_feature 1..1826: note = Hyper
  source 1..1826: mol_type = genomic DNA

SEQ ID NO: 121855 - DNA, 267 bp, Homo sapiens
  misc_feature 1..267: note = chr3:27764407-27764674
  misc_feature 1..267: note = Hyper
  source 1..267: mol_type = genomic DNA
ataatcaatcctggtgtctgtaatttcgccggaatttagggggacaaagtttggggtctccatagcggtgtccacccttggcgcattagtcatctcagccctccgctggaggaatgagatggctggagcagattttagaggccagagagagaaagactcttcaagctgatagcttgcagggaagcgcccgtcccggaggctggggaaactggggcaagttggagacaggcccaaggaagtctctttcctcgtcggaagctgtaactt

SEQ ID NO: 121856 - DNA, 644 bp, Homo sapiens
  misc_feature 1..644: note = chr3:27764898-27765542
  misc_feature 1..644: note = Hyper
  source 1..644: mol_type = genomic DNA
aagagtgaaactaagcgagctaacaccaacttcatactcacgccaacacaactgctttcggggagacagtcacttttattccccacaatttaaaatcctttctgctcagttttcctgatcccggattccgtcccttcaccaccatcttcagttaggcctgacaccaagaaacaaagcttccctaacagccccacagttaggattccctgcgcctctgctctgcggcaaatacagaaggtagaataattagtgaaataatcagtttgatattgaattaaactccagctgcttgtttcttcgctgcgtttcctcagatagattcaagagcggggccgtcatattttatcgtttcattattacggaagcggggggcacgtttcgttgcggataaggagaagcctgaatattcgctgttaataagcaattacagacgccgccagtaatcgctccgggagcgcattttccggctgagatgtcgggactctgcttccccaaccgaacgcgatcacacgggaaactcttcgcccacaacagatgagatggccaaaggattgctgagtgcgcacacgcaagtgtagaacagtgcgaagctttccaacccagttttccaaccacagcagcaccaacatcggcatgtctggggt

SEQ ID NO: 121857 - DNA, 30 bp, Homo sapiens; identical to SEQ ID NO: 90991
  misc_feature 1..30: note = chr3:27765844-27765874
  misc_feature 1..30: note = Hyper
  source 1..30: mol_type = genomic DNA

SEQ ID NO: 121858 - DNA, 580 bp, Homo sapiens; identical to SEQ ID NO: 90992
  misc_feature 1..580: note = chr3:27771471-27772051
  misc_feature 1..580: note = Hyper
  source 1..580: mol_type = genomic DNA

SEQ ID NO: 121859 - DNA, 1321 bp, Homo sapiens
  misc_feature 1..1321: note = chr3:28616662-28617983
  misc_feature 1..1321: note = Hyper
  source 1..1321: mol_type = genomic DNA
acggcgcccagctggcgcccgccccgggcacattgcagtaaatgcctggcagcgacttctcgcttctccttcctcctaccccatcgaccctctgttgccgacctttacgccaaactccggcgcgccgcgagactcgcgtcctcgctgtccccgaggggccccaccccttcccggttctaacctgcgacctggccagaggcaagggtaggtcgacttcctgcccggaatttgccgttggcttctccttctctactccagttctttagtgcagggctgtgcggcgcggagccgccagcggcagaacagaccccggagcggagctctgggatacacacacgcgcagcccggagggactgaccccggaggcgcgctcggccgggagagggaggggaccagggccagcgcggaggcgggggtcacctggggttgggggtgggcgcaccagccctccgcacgctcctctctttctagtcctcgccgccaccacctcgcacaggtcggagatccctcctttccttggctcctttgcgttggggagggggtaaggctgagggtcggcgcttggtcagcgggcggggaaggtagatttcacttgcacctgagagtccctattcttgccagcttcgccgggcaaagcccggcgaccaggttggttcttccagcaactttgttcagaaggttggtagggaggagaaacgccaaggggccccaagagacgctggaaagcggctaggagcgtgggccgggctggagagcaagtacccaagcggccctgaggctgggagcgcggctgggaggcgccgccgccgccgccgccgccgccgccgggatgcgctctgcttagcgggactgccgggggcgcctgaaggccagcgctccaaggacacgcggccacccgctcctcgcgcaccccggcccagacgccgccagggccggagccaagcaggcgagcggagctgcggggagcgggggcgaagggtggcagaagggagggcgcgcgggaggcggcccctcctcggcgagccatgcgtgccacgggcagctgagtagctgccgggcgccgctgccaagtctccactccgcttttgtcttgccctccagtgaatgggaagatggagatggatgttgagggagtttctccgcgcccggagcccatcccccgctcccagggggctggcggagcctgccaggcgccgccacagccgccccagccccagccgccgcctcagcagctggctcaggatgaactgcccggcgagagtgcaggcgctgaggacagcgacgatcccgagacgagacccaacggcgagaaaggagagag

SEQ ID NO: 121860 - DNA, 127 bp, Homo sapiens; identical to SEQ ID NO: 90995
  misc_feature 1..127: note = chr3:28618197-28618324
  misc_feature 1..127: note = Hyper
  source 1..127: mol_type = genomic DNA

SEQ ID NO: 121861 - DNA, 86 bp, Homo sapiens; identical to SEQ ID NO: 90997
  misc_feature 1..86: note = chr3:29322482-29322568
  misc_feature 1..86: note = Hyper
  source 1..86: mol_type = genomic DNA

SEQ ID NO: 121862 - DNA, 139 bp, Homo sapiens; identical to SEQ ID NO: 91001
  misc_feature 1..139: note = chr3:32151266-32151405
  misc_feature 1..139: note = Hypo
  source 1..139: mol_type = genomic DNA

SEQ ID NO: 121863 - DNA, 53 bp, Homo sapiens; identical to SEQ ID NO: 91002
  misc_feature 1..53: note = chr3:32433612-32433665
  misc_feature 1..53: note = Hyper
  source 1..53: mol_type = genomic DNA

SEQ ID NO: 121864 - DNA, 203 bp, Homo sapiens; identical to SEQ ID NO: 91003
  misc_feature 1..203: note = chr3:32433865-32434068
  misc_feature 1..203: note = Hyper
  source 1..203: mol_type = genomic DNA

SEQ ID NO: 121865 - DNA, 495 bp, Homo sapiens
  misc_feature 1..495: note = chr3:32443015-32443510
  misc_feature 1..495: note = Hyper
  source 1..495: mol_type = genomic DNA
attccctgtgtgggccggtgtatttatttaaattcccgttgcagcgaaggccgcccttctgtcttcctgccagccctggcgcttcctgtgcagcgccactggacagccatctgtttcctcccctctgccatctgcctcgcgccgggcccagcgtgcggccctggaagcctggctcggccgccgcccgcgcacgctggccttctttgttactactttggctcagtggtttcctgggctcgctgctcattccctggcagggctcgcggcgtccgcggcgactcctgggatcggcaggggcctggcttccagcccagcgccggcagcagcccgggggctgcggagcggaaagggggctgggacgcggtcactgctccagccacccggcgctcctgggcggaaatcgcgagcagagcccttctcagcctcctgcagaaaacgcgcctcacctgacttgtgtttaaatcagcaagggcagtgacgcggctcttccttttc

SEQ ID NO: 121866 - DNA, 2559 bp, Homo sapiens
  misc_feature 1..2559: note = chr3:32857718-32860277
  misc_feature 1..2559: note = Hyper
  source 1..2559: mol_type = genomic DNA
gagttctttaaaaaacgtaaaaagaaaaaaagaaaaggtgggtaaaaaccgagatctcccgggcagtggatatgtctcggttgagccagggattcagaatgaaatcttttcttttcttttttaaataaacggaagagtcgttctctgctcctcgctcagaaggtttcaaaggtcgtcacactgaagcccgggggcgttcatctccccagcggccgggagaagggaggaggttggagggcggagggagggagcacacaaaagcgggccgtgctgagagggctaatgtttcctgtttgcctggagccccctcccctgcctcccctcccccagccccctcccagcactcgggcggaagtgagtttgctcctttggagattaaaaggattccgaattccgatcagtcccaataaccggcgtactgaagagaagaggaggaggaggaggaggcagaggcggcaaagcagagaaagagggggcgcgcgcgcgcgcacgcaacccgaactgggggagttgtgcaaagccccaggaggccggggcacggcgggagcaaagctcggtaggcgcagcgcggccgaggccacccgcgtccggatcggcgactcctttcagaaagaagatgacgcgggcgcgagccggcggcgttggccacgcggctcccgagctcgccgcgcggggctgttgccggttccactgattccagcgcgcccgagaggagcctccatccccgaggctcgggatcggaggggggaccaaggcgagggcgaaatggcccgatgacaaaggaaatgtgatcccccttctctgccaaggtttcagagaggacggacgtgaggaggaggaggggcgcagggcgcgcgcggagctcggatagcattgcacgacggcccgcgcggagcgggtacatctaatatcttcctgccgatgaataattcagggcggcccgcggggacctgcggccccgcgcgctaagccgaaggggaaggagcgtgcgtgaggcgcccaggccaggcgaggcgggggcacgagggctccgggccgcgtggggcgcgcgtgcgtgttaagcgcgggcagccgcggcccggctgggcaggcgcgcggaagactcgaggcgcgtgggacgcgcgtgcgtactgcacgcgtgcggccgcggctgggccaccacgagctgcagctgctgcggggcccaccgccctgcaggggaggccgtgcctggctgtgcgcaagccccaagcgcagcacgccgggccacccaggagcccctggccgccgcgtcatgcggcggggcagccgacgtcgcgcggggagacaccggcttggcgacgcaccgctcccgcctttactagtttggggctccttcccctcccaagaacagactaaatccgtttaaagaaaagcaacgcaccaaatactcgtggaaccaaattctgctctcgccgggactgggactgcacagcgaactctccttttgggaactcctttcgtctatcgcgaagggaagcctcagctgctccagggagtcttccgacctccctgcccccgctcgcccctcgcctgtcggggcttgttccggcgttccctcttcggaaggcacgcggcccccaagttatccggaggaatctgtgtcgccgctggatagtggcatttaatgcctgcagtgtcgggggtggcagcgctcgggccggacgtggcgaggccaagcgggcagcgctgctctggtgccggctcccggattgcaggcctaatcgatgcatttttctgagtgagtcggtgactcccccacccacctcgtccgctctctcctcctcctcctcctcttcctctctggtctcctccctcctccgggctgggttgcaaatggcttcgttccccgagaccgatttccagatctgcttgctgtgcaaggagatgtgcggctcgccggcgccgctctcctccaactcgtccgcgtcgtcgtcctcctcgcagacgtccacgtcgtcggggggcggcggcgggggccctggggcggcggcgcgccgcctacacgtcctgccctgcctgcacgccttctgccgcccctgcctcgaggcgcaccggctgccggcggcgggcggcggcgcggcgggagagccgctcaagctgcgctgccccgtgtgcgaccagaaagtagtgctagccgaggcggcgggtatggacgcgctgccttcgtccgccttcctgcttagcaacctgctcgacgcggtggtggccactgccgacgagccgccgcccaagaacgggcgcgccggcgctccggcgggagcgggcggccacagcaaccaccggcaccacgctcaccacgcgcacccgcgcgcgtccgcctccgcgccgccactcccgcaggcgccgcagccgcccgcgccttcccgctcggcacccggcggccctgccgcttccccgtcggcgctgctgctccgccgtcctcacggctgcagctcgtgcgatgagggcaacgcagcttcttcgcgctgcctcgactgccaggagcacctgtgcgacaactgcgtccgagcgcaccagcgcgtgcgcctcaccaaggac

SEQ ID NO: 121867 - DNA, 39 bp, Homo sapiens; identical to SEQ ID NO: 91009
  misc_feature 1..39: note = chr3:33136909-33136948
  misc_feature 1..39: note = Hypo
  source 1..39: mol_type = genomic DNA

SEQ ID NO: 121868 - DNA, 1100 bp, Homo sapiens; identical to SEQ ID NO: 91010
  misc_feature 1..1100: note = chr3:33259696-33260796
  misc_feature 1..1100: note = Hyper
  source 1..1100: mol_type = genomic DNA

SEQ ID NO: 121869 - DNA, 235 bp, Homo sapiens; identical to SEQ ID NO: 91011
  misc_feature 1..235: note = chr3:33318803-33319038
  misc_feature 1..235: note = Hyper
  source 1..235: mol_type = genomic DNA

SEQ ID NO: 121870 - DNA, 57 bp, Homo sapiens; identical to SEQ ID NO: 91012
  misc_feature 1..57: note = chr3:33319265-33319322
  misc_feature 1..57: note = Hyper
  source 1..57: mol_type = genomic DNA

SEQ ID NO: 121871 - DNA, 270 bp, Homo sapiens; identical to SEQ ID NO: 91013
  misc_feature 1..270: note = chr3:33841087-33841357
  misc_feature 1..270: note = Hypo
  source 1..270: mol_type = genomic DNA

SEQ ID NO: 121872 - DNA, 89 bp, Homo sapiens; identical to SEQ ID NO: 91014
  misc_feature 1..89: note = chr3:33841657-33841746
  misc_feature 1..89: note = Hypo
  source 1..89: mol_type = genomic DNA

SEQ ID NO: 121873 - DNA, 29 bp, Homo sapiens
  misc_feature 1..29: note = chr3:34246970-34246999
  misc_feature 1..29: note = Hypo
  source 1..29: mol_type = genomic DNA
aaacacctggctgggcgcggtgactcacg

SEQ ID NO: 121874 - DNA, 190 bp, Homo sapiens; identical to SEQ ID NO: 91016
  misc_feature 1..190: note = chr3:34690946-34691136
  misc_feature 1..190: note = Hypo
  source 1..190: mol_type = genomic DNA

SEQ ID NO: 121875 - DNA, 126 bp, Homo sapiens; identical to SEQ ID NO: 91017
  misc_feature 1..126: note = chr3:35204511-35204637
  misc_feature 1..126: note = Hypo
  source 1..126: mol_type = genomic DNA

SEQ ID NO: 121876 - DNA, 866 bp, Homo sapiens
  misc_feature 1..866: note = chr3:35680775-35681641
  misc_feature 1..866: note = Hyper
  source 1..866: mol_type = genomic DNA
ggatgctcccagtggcgcagaggcggcgacactggcaggcgtccggctgccgccacctcccgggtgtggcgggtctggggcccggggtctccggccagagcagctgtggagccacgtgcaacacgcgcgttgccctcagcccgggcggggaccggacgcatccggagctgcggggaggagccgggcgccgcccccggcggcagtgccagccgcgtgggagggcacggaccggcggaggggcagacgacggaggcggccaagctggaggaacgggaccgagggatcgaccgaggctggctggctaggggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgc

SEQ ID NO: 121877 - DNA, 194 bp, Homo sapiens; identical to SEQ ID NO: 91019
  misc_feature 1..194: note = chr3:35740310-35740504
  misc_feature 1..194: note = Hypo
  source 1..194: mol_type = genomic DNA

SEQ ID NO: 121878 - DNA, 19 bp, Homo sapiens
  misc_feature 1..19: note = chr3:35866142-35866161
  misc_feature 1..19: note = Hypo
  source 1..19: mol_type = genomic DNA
agaccggagctgttcctat

SEQ ID NO: 121879 - DNA, 23 bp, Homo sapiens
  misc_feature 1..23: note = chr3:36407036-36407059
  misc_feature 1..23: note = Hypo
  source 1..23: mol_type = genomic DNA
cgagactccgtcccaaaaaaaaa

SEQ ID NO: 121880 - DNA, 30 bp, Homo sapiens; identical to SEQ ID NO: 28126
  misc_feature 1..30: note = chr3:36421872-36421902
  misc_feature 1..30: note = Hyper
  source 1..30: mol_type = genomic DNA

SEQ ID NO: 121881 - DNA, 41 bp, Homo sapiens; identical to SEQ ID NO: 91023
  misc_feature 1..41: note = chr3:36422182-36422223
  misc_feature 1..41: note = Hyper
  source 1..41: mol_type = genomic DNA

SEQ ID NO: 121882 - DNA, 29 bp, Homo sapiens
  misc_feature 1..29: note = chr3:36805450-36805479
  misc_feature 1..29: note = Hyper
  source 1..29: mol_type = genomic DNA
caggtggtgtacacccgcacgcgcgcgcg

SEQ ID NO: 121883 - DNA, 688 bp, Homo sapiens
  misc_feature 1..688: note = chr3:36805539-36806227
  misc_feature 1..688: note = Hyper
  source 1..688: mol_type = genomic DNA
tacacccacgcggggtctggcactgctgctacatcccgcacggagcggggtccagagttagggcgaatgagtcctcccgcccccgccaaggtggcgcccagaacgggtcggtgccggagcgcacggtactcacccggggcaggccgcgccgggcaggctggggctggccgggccgggggcggcggcggctgcggggctggagtggcggcgggcatggcgcggcggcgggctcggggagagcctggagcagaggtggcagcgcggggacgcggctcgacggtcgagcaggcgcgggaaggcggggcgagacgagcagccacgagcccgcgccgactctccctcttctctccctcccgccgcccgccgcccgcctgccagccccgcgccgcgcagcgcccggcgacagccaccgggaacgtctccgggggcgcgggacttagcaaccgcgcaccagctgcagccgccctctctgcgccggtcccgccatgcgcgccgctcctggccctggaggccgggcggggccgggctttgaacttgctcccacaccccctgcttctccagtgagcgcccaaaggcggtcccgcctctccccggtcagcggagtccagcctttctgctctccttccccgcgcagttccgcggtggaacctggctgcgctgggttttgaacgtgcgctttgcccctgtt

SEQ ID NO: 121884 - DNA, 602 bp, Homo sapiens; identical to SEQ ID NO: 91027
  misc_feature 1..602: note = chr3:36985811-36986413
  misc_feature 1..602: note = Hyper
  source 1..602: mol_type = genomic DNA

SEQ ID NO: 121885 - DNA, 57 bp, Homo sapiens; identical to SEQ ID NO: 28130
  misc_feature 1..57: note = chr3:36986663-36986720
  misc_feature 1..57: note = Hyper
  source 1..57: mol_type = genomic DNA

SEQ ID NO: 121886 - DNA, 17 bp, Homo sapiens
  misc_feature 1..17: note = chr3:37296942-37296959
  misc_feature 1..17: note = Hypo
  source 1..17: mol_type = genomic DNA
cacgcctgacctttata

SEQ ID NO: 121887 - DNA, 898 bp, Homo sapiens
  misc_feature 1..898: note = chr3:37493519-37494417
  misc_feature 1..898: note = Hyper
  source 1..898: mol_type = genomic DNA
acggcccgcagggggcgctgccgcgccgtccagccgccgccgcccgggccgcccacctcgcgggcgcgcccctccgcagaccagcgccgcccggcccgggacccgctcgcgcagacttctcgggcggactgaggacgccgccgctcggggccgcccctgtgctcgccttcagcgcccgctcagcccgccgtccgcgccccggtggcgggcccgacgcccgcattccgcccgtgtccaggcgcagagctcccgccccggggagcttcctggccgtcggcgggccccgcggcccgcgcgctcggcgccctgctcgccgggcagaggggaaggcggcggccggctggggatgggcggcccggctgcgccgaggggcgccgggaggctccgcgcgctgctgctggcgctggtggtcgcggggatccccgcgggcgcctacaacctcgacccgcagcgccccgtgcacttccagggccccgctgactcgttcttcggctacgcagttctggagcatttccacgacaacacgcgctggtgagtgcccgcccgactccgcgaccctggcccgcgcggccaccgccccggcccccaggccagcgccgccgccgcctttccggtctcttccacgccgccgtcccgagggggcgatttaaatgtctccgttgcgcgcggctcggccgccgggggacggcgggagaagggaggacgccgtccggggcccgctaaggtcggggtcggcgcctggaggcgggcgggggcgtccgggtgcctccctggggtcccagcccagagcgtggggggagagccgctagagttgtctcctccgccgcccagctagactcggcttcactctctgaatcgaaaagtaacttggctcctctgcctccgggcggccgccgct

SEQ ID NO: 121888 - DNA, 43 bp, Homo sapiens; identical to SEQ ID NO: 91031
  misc_feature 1..43: note = chr3:37876198-37876241
  misc_feature 1..43: note = Hypo
  source 1..43: mol_type = genomic DNA

SEQ ID NO: 121889 - DNA, 49 bp, Homo sapiens; identical to SEQ ID NO: 91032
  misc_feature 1..49: note = chr3:37902046-37902095
  misc_feature 1..49: note = Hyper
  source 1..49: mol_type = genomic DNA

SEQ ID NO: 121890 - DNA, 66 bp, Homo sapiens; identical to SEQ ID NO: 91033
  misc_feature 1..66: note = chr3:37902518-37902584
  misc_feature 1..66: note = Hyper
  source 1..66: mol_type = genomic DNA

SEQ ID NO: 121891 - DNA, 30 bp, Homo sapiens; identical to SEQ ID NO: 91034
  misc_feature 1..30: note = chr3:38030684-38030714
  misc_feature 1..30: note = Hypo
  source 1..30: mol_type = genomic DNA

SEQ ID NO: 121892 - DNA, 372 bp, Homo sapiens; identical to SEQ ID NO: 91035
  misc_feature 1..372: note = chr3:38032099-38032471
  misc_feature 1..372: note = Hypo
  source 1..372: mol_type = genomic DNA

SEQ ID NO: 121893 - DNA, 448 bp, Homo sapiens
  misc_feature 1..448: note = chr3:38035626-38036074
  misc_feature 1..448: note = Hyper
  source 1..448: mol_type = genomic DNA
ccacttcctgatctccgcggaagcccctgcctagcgtctccccatggcccttggtacatcctccccttctccacccgcacctccgtcttccccgcaacacatatacacaaacacccggaccctaggtcccccagagcccgaaggccacgcagggggcgtccagcgacctgcactactgggtcgggaagcaggcgggtgcggaagcgcagggcgctgcggaggccttccagcagcgcctacaggacgagctggggggccagaccgtgctgcaccgcgaggcgcagggccacgagtccgactgcttctgcagctacttccgcccgggaatcatgtgagtgcgggggcgaccggggcaggagggagccgtggaggcggtgccttggctggggcagtcttgggatggccatcgtccacatccctgaatggggcaagccgggaggggttgggt

SEQ ID NO: 121894 - DNA, 50 bp, Homo sapiens; identical to SEQ ID NO: 91037
  misc_feature 1..50: note = chr3:38041092-38041142
  misc_feature 1..50: note = Hypo
  source 1..50: mol_type = genomic DNA

SEQ ID NO: 121895 - DNA, 871 bp, Homo sapiens
  misc_feature 1..871: note = chr3:38070703-38071574
  misc_feature 1..871: note = Hyper
  source 1..871: mol_type = genomic DNA
caggacaagggggtccgcgaggcggagggaagtctttagacccgtaccgcccgcccacccaccccccgggctagatctcggacaagcctggaaacgcccagggtcgtgcccggcagtcccacccagggagccgcgggctgagattttcccagtccggagaaggggcagagaggcgggcccggggtggtgtggaggcggccgaaggagctgggggctccctgtccagggcccggaacagctttccaggggtccacccctgcagggtctcccgctcgcgcgggccaggcactcaccgtgcagggtcaggaagtcccggcccgagtccatgcccgacgggcggcgcggcgggaggggcaccgcgggactcacttgagtagcgacagcaccggcggcctggggtccgagcggagtgcggtgcagggacctgaatggaccgcggtgggaggaggccgggggtggtcccgggacaccgccccgcccccgctgccctgcgcccccgccccctgagcccgccaaccctcgtctctccccgcccccttctggggacgcgagagggagggcagagctgggggcccggaggactggccaaccctggcccgggccagcgggcgcgccccgaccagaaatagccagattcctccagcttcctccgccgccgccacccacgggccgcgggccctgtcattaccgcgggcggccgggccccacgccctgttgtgggcgcctcgctggggtcggggtgatgctggaaagaatccggcgtcatcccggggaagggatcgtgtaaggtccgacgcccagccgggctgctgcgctagggagacgcggcgtccaggcttccagccgcagctcccagcgttcgcattccctt

SEQ ID NO: 121896 - DNA, 734 bp, Homo sapiens
  misc_feature 1..734: note = chr3:38080619-38081353
  misc_feature 1..734: note = Hyper
  source 1..734: mol_type = genomic DNA
tgaccacagcgatgacgggatccgagagaaaggcaaggcggaaggggtgaggccggaagccgaagtgccgcagggagttagcggcgtctcggttgccatggagaccaggagctccaaaacgcggaggtctttagcgtcccggaccaacgagtgccaggggacaatgtgggcgccaacttcgccaccagccgggtccagcagccccagccagcccacctggaagtcctccttgtattcctccctcgcctactctgaggccttccactacagcttcgcagcccggccccgccgcctcacgcagcttgcgctggcgcagcgtcccgagcctcagctgcttcgtctgcgcccctcctcgctgcgcacccaagatatctcgcacttgctcaccggcgtcttccgcaacttgtactcagccgaggtcatcggcgacgaagtgagcgcaagcttgatcaaggcccgcggcagcgagaatgagcgccacgaggagttcgtggaccagctgcagcaggtaacgtggcggtggcgtcgcgtctgcggacggtgccggggtctcagcgctcggcacgcgtcagcacctgccaggtgccaggcgctgttccaggatctggggctgcagttgagaaacagcccatcatgccgaagtgggcccgacattctagtggaaggacgctctatccatacacacacatgcgcaaataccacacataccacacaacgtgcggcatatatctgta

SEQ ID NO: 121897 - DNA, 20 bp, Homo sapiens
  misc_feature 1..20: note = chr3:38207993-38208013
  misc_feature 1..20: note = Hypo
  source 1..20: mol_type = genomic DNA
gtaagaagggctgggcgtgg

SEQ ID NO: 121898 - DNA, 30 bp, Homo sapiens; identical to SEQ ID NO: 91043
  misc_feature 1..30: note = chr3:38350133-38350163
  misc_feature 1..30: note = Hypo
  source 1..30: mol_type = genomic DNA

SEQ ID NO: 121899 - DNA, 147 bp, Homo sapiens; identical to SEQ ID NO: 39897
  misc_feature 1..147: note = chr3:38627339-38627486
  misc_feature 1..147: note = Hypo
  source 1..147: mol_type = genomic DNA

SEQ ID NO: 121900 - DNA, 169 bp, Homo sapiens; identical to SEQ ID NO: 91046
  misc_feature 1..169: note = chr3:38631185-38631354
  misc_feature 1..169: note = Hypo
  source 1..169: mol_type = genomic DNA

SEQ ID NO: 121901 - DNA, 30 bp, Homo sapiens; identical to SEQ ID NO: 91047
  misc_feature 1..30: note = chr3:38640456-38640486
  misc_feature 1..30: note = Hypo
  source 1..30: mol_type = genomic DNA

SEQ ID NO: 121902 - DNA, 319 bp, Homo sapiens; identical to SEQ ID NO: 91048
  misc_feature 1..319: note = chr3:38690443-38690762
  misc_feature 1..319: note = Hyper
  source 1..319: mol_type = genomic DNA

SEQ ID NO: 121903 - DNA, 55 bp, Homo sapiens; identical to SEQ ID NO: 91049
  misc_feature 1..55: note = chr3:38691089-38691144
  misc_feature 1..55: note = Hyper
  source 1..55: mol_type = genomic DNA

SEQ ID NO: 121904 - DNA, 122 bp, Homo sapiens
  misc_feature 1..122: note = chr3:38691404-38691526
  misc_feature 1..122: note = Hyper
  source 1..122: mol_type = genomic DNA
acagccacagacagccgcacacgcggccgcggacagacagacataggcgggggtacacacacggcgacccggcgacgcttcaccacagatggccacccacgcggacgcggacaggctcacat

SEQ ID NO: 121905 - DNA, 30 bp, Homo sapiens; identical to SEQ ID NO: 39898
  misc_feature 1..30: note = chr3:38950258-38950288
  misc_feature 1..30: note = Hypo
  source 1..30: mol_type = genomic DNA

SEQ ID NO: 121906 - DNA, 33 bp, Homo sapiens; identical to SEQ ID NO: 91052
  misc_feature 1..33: note = chr3:39167780-39167813
  misc_feature 1..33: note = Hypo
  source 1..33: mol_type = genomic DNA

SEQ ID NO: 121907 - DNA, 42 bp, Homo sapiens; identical to SEQ ID NO: 91053
  misc_feature 1..42: note = chr3:39850324-39850366
  misc_feature 1..42: note = Hyper
  source 1..42: mol_type = genomic DNA

SEQ ID NO: 121908 - DNA, 792 bp, Homo sapiens; identical to SEQ ID NO: 91054
  misc_feature 1..792: note = chr3:39851235-39852027
  misc_feature 1..792: note = Hyper
  source 1..792: mol_type = genomic DNA

SEQ ID NO: 121909 - DNA, 40 bp, Homo sapiens; identical to SEQ ID NO: 91055
  misc_feature 1..40: note = chr3:40501052-40501092
  misc_feature 1..40: note = Hypo
  source 1..40: mol_type = genomic DNA

SEQ ID NO: 121910 - DNA, 52 bp, Homo sapiens; identical to SEQ ID NO: 39900
  misc_feature 1..52: note = chr3:41289147-41289199
  misc_feature 1..52: note = Hypo
  source 1..52: mol_type = genomic DNA

SEQ ID NO: 121911 - DNA, 30 bp, Homo sapiens; identical to SEQ ID NO: 91058
  misc_feature 1..30: note = chr3:42056206-42056236
  misc_feature 1..30: note = Hyper
  source 1..30: mol_type = genomic DNA

SEQ ID NO: 121912 - DNA, 20 bp, Homo sapiens
  misc_feature 1..20: note = chr3:42162758-42162778
  misc_feature 1..20: note = Hypo
  source 1..20: mol_type = genomic DNA
tttttttttttgagacggag

SEQ ID NO: 121913 - DNA, 149 bp, Homo sapiens; identical to SEQ ID NO: 39901
  misc_feature 1..149: note = chr3:42200630-42200779
  misc_feature 1..149: note = Hypo
  source 1..149: mol_type = genomic DNA

SEQ ID NO: 121914 - DNA, 18 bp, Homo sapiens
  misc_feature 1..18: note = chr3:42222719-42222737
  misc_feature 1..18: note = Hypo
  source 1..18: mol_type = genomic DNA
ttgcattgaaatgtgcgt

SEQ ID NO: 121915 - DNA, 438 bp, Homo sapiens; identical to SEQ ID NO: 91062
  misc_feature 1..438: note = chr3:42304950-42305388
  misc_feature 1..438: note = Hyper
  source 1..438: mol_type = genomic DNA

SEQ ID NO: 121916 - DNA, 553 bp, Homo sapiens; identical to SEQ ID NO: 91063
  misc_feature 1..553: note = chr3:42543027-42543580
  misc_feature 1..553: note = Hyper
  source 1..553: mol_type = genomic DNA

SEQ ID NO: 121917 - DNA, 44 bp, Homo sapiens; identical to SEQ ID NO: 91064
  misc_feature 1..44: note = chr3:42631036-42631080
  misc_feature 1..44: note = Hypo
  source 1..44: mol_type = genomic DNA

SEQ ID NO: 121918 - DNA, 120 bp, Homo sapiens; identical to SEQ ID NO: 91065
  misc_feature 1..120: note = chr3:42640754-42640874
  misc_feature 1..120: note = Hypo
  source 1..120: mol_type = genomic DNA

SEQ ID NO: 121919 - DNA, 29 bp, Homo sapiens
  misc_feature 1..29: note = chr3:42696559-42696588
  misc_feature 1..29: note = Hyper
  source 1..29: mol_type = genomic DNA
gattcgggatgacccgggccaagggggtg

SEQ ID NO: 121920 - DNA, 860 bp, Homo sapiens; identical to SEQ ID NO: 28144
  misc_feature 1..860: note = chr3:42814258-42815118
  misc_feature 1..860: note = Hyper
  source 1..860: mol_type = genomic DNA

SEQ ID NO: 121921 - DNA, 108 bp, Homo sapiens; identical to SEQ ID NO: 91067
  misc_feature 1..108: note = chr3:42850925-42851033
  misc_feature 1..108: note = Hypo
  source 1..108: mol_type = genomic DNA

SEQ ID NO: 121922 - DNA, 592 bp, Homo sapiens
  misc_feature 1..592: note = chr3:42947369-42947961
  misc_feature 1..592: note = Hyper
  source 1..592: mol_type = genomic DNA
gtctagtgaagtacccgctacctcctatcagcaaatatctgtccacctagggtgcagcgagctggagaggaaggggtggcctagagcgcaggggaaggattcctccccagccgcctgcacccctaccccggtagcggtccctgggatcgtccgtgtctccaggagaaccggaccgctctcccctccctccccgagcgagaaaggaggaccacagagatgcggcgccctccgccgtcctagagcaaccggagcggcccgagccccggcctcccggatgctggggcctggcgggtgtggagcacggggagtcgggcgtggggcgggcagggagtggagtcggggtcttactccggtggctgcagggcgcagggtagccgtgtcaggcctgcccaggtgcagagcgctcttccgcgaccccaacagcctctggtccggtctggcgcgccctcgctttcccagagggcgacctgggctatggcggccgtggcgctggcgagcgggacacgcctcggccttgtcctcgagctgctcccgggacagcccgcgctgccccgggcgcgccgggtgagtgcggggccggagcctggaagca

SEQ ID NO: 121923 - DNA, 575 bp, Homo sapiens; identical to SEQ ID NO: 91070
  misc_feature 1..575: note = chr3:43020896-43021471
  misc_feature 1..575: note = Hyper
  source 1..575: mol_type = genomic DNA

SEQ ID NO: 121924 - DNA, 326 bp, Homo sapiens; identical to SEQ ID NO: 91071
  misc_feature 1..326: note = chr3:43147281-43147607
  misc_feature 1..326: note = Hyper
  source 1..326: mol_type = genomic DNA

SEQ ID NO: 121925 - DNA, 38 bp, Homo sapiens; identical to SEQ ID NO: 91072
  misc_feature 1..38: note = chr3:43633110-43633148
  misc_feature 1..38: note = Hypo
  source 1..38: mol_type = genomic DNA

SEQ ID NO: 121926 - DNA, 30 bp, Homo sapiens; identical to SEQ ID NO: 91073
  misc_feature 1..30: note = chr3:43655462-43655492
  misc_feature 1..30: note = Hypo
  source 1..30: mol_type = genomic DNA

SEQ ID NO: 121927 - DNA, 30 bp, Homo sapiens; identical to SEQ ID NO: 91074
  misc_feature 1..30: note = chr3:43664372-43664402
  misc_feature 1..30: note = Hypo
  source 1..30: mol_type = genomic DNA

SEQ ID NO: 121928 - DNA, 29 bp, Homo sapiens
  misc_feature 1..29: note = chr3:43664642-43664671
  misc_feature 1..29: note = Hypo
  source 1..29: mol_type = genomic DNA
ccaccgcgccctgccggctttaagtgttt

SEQ ID NO: 121929 - DNA, 32 bp, Homo sapiens; identical to SEQ ID NO: 91076
  misc_feature 1..32: note = chr3:43749395-43749427
  misc_feature 1..32: note = Hypo
  source 1..32: mol_type = genomic DNA

SEQ ID NO: 121930 - DNA, 204 bp, Homo sapiens; identical to SEQ ID NO: 91077
  misc_feature 1..204: note = chr3:43828321-43828525
  misc_feature 1..204: note = Hypo
  source 1..204: mol_type = genomic DNA

SEQ ID NO: 121931 - DNA, 385 bp, Homo sapiens; identical to SEQ ID NO: 91078
  misc_feature 1..385: note = chr3:43935797-43936182
  misc_feature 1..385: note = Hyper
  source 1..385: mol_type = genomic DNA

SEQ ID NO: 121932 - DNA, 2754 bp, Homo sapiens
  misc_feature 1..2754: note = chr3:44036168-44038922
  misc_feature 1..2754: note = Hyper
  source 1..2754: mol_type = genomic DNA
tcactttgctgtcagcgacgtgatgtgctctgcagtgctggaattgagagttcaagagagagataccggtcctggcctctcggtgttcaggtgtgtgtataggtgggcgttggtgtgagaacgagcgagagaaagcgggagcaagagcgagagctatgcctcccttagtgtcagggagggtggccggctgatgaaggtgctgtgcagaaagccggggaagggcttaaagagggtgctggcgcctcgggaacgccctcccgctgcaccctacaggaggtcgtgggcggtggcttaacagccccagtgcagagcttgaaccccaccgtccagaaggaaaggtgagtgggggacccgggcgggaggtgaggcctgccggcagcggccctcaggcgtgctgggcagcacggctagcagaggcggcgcctggtcttggatgctgcagcggagacgccaaggagactgaatgcagggagcgaggcgtagcggccgcggagggtggggccgcccggaaatccaggcggcgccagccttgtagcatctgcaggccgggggcgcgcacacgaggggcacgtgggtgtggaggaaccggcgcggcggggcctccttcctgcagcgccgcggcggtcgagtgcccgtgctggaggaacggcgagtggggtgcctgccccgcgcaggcggtacccgccgccccagctccgcacacagcaggcacggccagggaccgggaccgtggcccagcgcctggaggcgctctccacgcgcatctttcccgatgccggggcgggaagccgagtggctttgtccggagatgccaggggatgtgggcaggggacgaagaggtttcccaactggccaaaccctggcttgaggaaagactgaggtggtcattgacccgtgggagcgccctggggcttcgagggaacggcagccgagcccgggagactggtgttgggtacccgcgggggccggcgggttccacgtgggtggaccccgagctgagggcagggtagggtcgcggatcgctgacctatgagctcccctactcccgcacaaggacacctgcacatggacccgggcttccacccgcttctggctgggttggcgccgggagcgcgcaggggagggacggcggcggagtgcggggtttggcgggtgaggtgggtgaggtgtggccgcgggggagggggcgaaggcactagaaggctgcggtcgcgctgtcgctgctgttcccaccgtcggcgcggggcgcggagggggcgaagaggtgcctgccagtcgcactgcggtctaggggtgaaaggaaaagggtccatgtaaaggagaaagggcaggcagagactcttgctggtgccagcaggcacggaaggatgtggccgcggggacttggagtttagagggcaacgctgggtgtcataatgccggagatgaccccgggtgcagaggcgattccagttgggtagagctacagagaacgtggcccgagaaggggagcttccttaaattagacatatcctgtgttgtcctaaacctagcatttaccctctcccaccccgctcccacaacctccagggtcctagcggagtcatttaagcgctcagtactaccagcttcattttaggtaaaaatcaagactaattctgcactttattaacctcctcgtacccaagtcaccacggggcagcttttcacagccctaaggcgtggtcacttcaagcccacagcgagttgctcgtgtcctcggcttctgctccgcaaatctcggacgatgccaccggaggacgctgaaggcaaaggctggtggggccaggcgccggcgagactgccgcgctagcacagcttccgcgggagccgagtgctgacgggcctcgcgaccccctcccgagggcaaacggctcggccctccagggacacttggtcagtgtcactctctccctaccgggtgtcgcgcattttctcaacagaacgtgaccccgtagacggatgaactcggaatcggcaaaacccgcctgcccttgtctagtctctctgccccaccacaccactgcccttcactgcggactgcgccgtgtgcgctccgggaccgcccctgcacctttgcccacagcttcccattaccaaggcagccggaggaagacctttccgagttacctgtctcacgtcagcagccacaccgaggcggtccccctcgcaccactccccaagtgcagagcccctgaaagtccgaggctcctgtgccacgcaccctcccccctgcggggcgaccccgcgtatgcgtgtgtgtgtcacgcgtttaatcgcacagagtaattcccagacgtgcaagacaaagcatttcaagcaaagatggtccagagttcaaattggaaagcacatctcgaggcgctgaatctgttctcgccgtctgcctcggtctctggggcgtcgcatccaggagaagggttttaactccctgccagatccgctcggaattagctcttctggcggtgcagcaacaagtggccccgccgcctcccttgtgcactcggagggactacatcctcctcctctcccagcccctagtccaaacgggagtaggtaatggcggggaaagggggaggtgacgagagcggggagaaggaagtacatattttttaattgtgaaattgtctgtctgcgtgctgtgctctgggattctcttgtctcaatcaacttcaattttaacgtggccgtaacgttaagattaagacctagaaatgaaaacgtacccacctttct

SEQ ID NO: 121933 - DNA, 1793 bp, Homo sapiens
  misc_feature 1..1793: note = chr3:44039357-44041150
  misc_feature 1..1793: note = Hyper
  source 1..1793: mol_type = genomic DNA
gagggacgtgttgcccgactggtctaaataaggaaagaaagtggagtaccaaagaatcaagggcctctgttcctccccatcccgccaccaccaccaccggtccccgggctctgctgagcgctgcggcggtcttggctgaaaactgcgtccccgcccaaatcgagcgcaaaactcccttggacagaagtttgaaagaatccagtgtagaaacagacttctccgtccaatttggttttaatcagtaatcatataagtatacccacataaccacctaagtggagagcagacgcccagattcacggtccccacgtgttgctggagttggcgcagacgcgtgtgcgggcatagcggcggacgtgacaccgcattttctccgaattcctgccatctagggtggtgccgccccaagagggggccgtggggaggtggggtaataggctgcgcaatccacttgctctgggggagcttagggttcagagcagagcgcaactccggggggctgtcgcacagccccattctcccacaccagaagagcaatgctccttatggatgattaatagccgggcttctcctgaccatgcggcgcgtccctgccggcaccacttagttgttttaatttgacctttattagcaacgtgctcccagaggctgcgagttggattcgcaccacgataacggccctctccccttccacccggccggcttcctgggaaggatcggggactgcagctcccgcgacgcctcctcctcctgcgcagggagcaggcctgagttcctccacgtaatgacctgggagacctcaggcatcccggggcctggtcggagggtcttcgggccctggagctgggcggtgtctgcagtgcaccgccgtgagtttctctcgggtacaatgtgctggtgtgcagagaggaggaaaggaaaaaaaaaaaacccaacaccactcttaagtggcactggcatctatgaagtggcagtggtctacactgagcgtgcccttgcctggaggtgtagggggcggttactgcagccgaggggagggtactgcggccaagggcagggcgagaggacagtcaaggccggctggccgcgtgggagcctttcctctccgggttcagcggccggaatcaccagcactgcggctaaaggggctggtaggctctcctgcaccccgcgtgctcctccgccttctctgtgtcccccggcttttccaggaggaagatggggtgcccatcgcgaatggggcgcgccgggccgcctggccgggcggtcacgtgtcccccctcccccgccactgcggcgggagttccaatcagagcgcgccagggggctcctcccgggcaggaaccacccggctcggcggcggagggtgggccgccgtcacctgaccgcccgcccccgccccccgcgagtaaggggcggtggtagcgtctgctcggttacaaatggcccctcccgcccggctcgcccgctcgctcgggctcggcgcggacccgcctgggcgtgctcctcccgccggctccaggcgtcccaccgccctgcccggcgccagcccgcggtcccagccactcctgagggcgcgccgggcacccagcgcgtaggctcgcccacggaggtcgacacggaagtctggaccgccgaggcgtgtggctcgtctaccggcaggtgagcgtgcaccgcgggcgtgggatgctgtggggacagtgcgggggacgtgtggggtcttcggatgcgaacgcgagtccgtgcgatgcccaggtcaagtttgcagagagagtctgcggtgtctgtctcct

SEQ ID NO: 121934 - DNA, 830 bp, Homo sapiens; identical to SEQ ID NO: 91083
  misc_feature 1..830: note = chr3:44063273-44064103
  misc_feature 1..830: note = Hyper
  source 1..830: mol_type = genomic DNA

SEQ ID NO: 121935 - DNA, 236 bp, Homo sapiens; identical to SEQ ID NO: 91084
  misc_feature 1..236: note = chr3:44481308-44481544
  misc_feature 1..236: note = Hyper
  source 1..236: mol_type = genomic DNA

SEQ ID NO: 121936 - DNA, 567 bp, Homo sapiens; identical to SEQ ID NO: 28155
  misc_feature 1..567: note = chr3:44596464-44597031
  misc_feature 1..567: note = Hyper
  source 1..567: mol_type = genomic DNA

SEQ ID NO: 121937 - DNA, 398 bp, Homo sapiens
  misc_feature 1..398: note = chr3:44626341-44626739
  misc_feature 1..398: note = Hyper
  source 1..398: mol_type = genomic DNA
ggggcttctgaggggcggggggactccagcccgcgggcacagagatgtggaaacctcacgaagcctagaagggccggagggacaggctgggagttagctgggagttgctgacgcagttccttctgcgctttgttcaagatgtgggtctggcgctttcggtgaggggtgctctacagtctggcgtggggggtcgggccgggttctgggagcgtgtgggagacgcaagccaggaggccagggctcctctgcggctgcccgctgctgagatgggcgcggcagccaaggggtcgttgtgggcctcccctttctctcgttcagtgctgcccctttgtcttgggtccagtctctgactcctcgtagctgctcgcttggaccaggctggccgtggtgacagcact

SEQ ID NO: 121938 - DNA, 30 bp, Homo sapiens; identical to SEQ ID NO: 91088
  misc_feature 1..30: note = chr3:44690145-44690175
  misc_feature 1..30: note = Hyper
  source 1..30: mol_type = genomic DNA

SEQ ID NO: 121939 - DNA, 59 bp, Homo sapiens; identical to SEQ ID NO: 91089
  misc_feature 1..59: note = chr3:44690430-44690489
  misc_feature 1..59: note = Hyper
  source 1..59: mol_type = genomic DNA

SEQ ID NO: 121940 - DNA, 404 bp, Homo sapiens
  misc_feature 1..404: note = chr3:44726846-44727250
  misc_feature 1..404: note = Hyper
  source 1..404: mol_type = genomic DNA
ggtataaatatgaccgcaaaactgcccttcaagcagttgacgagcgactttccccttacatcaagtgcacagtaagcccaagcgccggggccgcggggattcccgccagtcactcccgccactaccgccacccggccccgccgccagcgcagcccgcagccccggcaagcctgcgcccgctcggccccggtctctttcgctcaccagaggctacggggcgcccggccccgcacacccaagaaacactgccaccgcgacgcgcctgcccccaggatcctctcgcgagcttcagtacccaaggaagatgggccgtcccggaagtgcggccggggcgacttgcaggcccctcgccgaccgctctaggaatctcggaggtcttttgacctcgacgcctccttacctgg

SEQ ID NO: 121941 - DNA, 30 bp, Homo sapiens; identical to SEQ ID NO: 91092
  misc_feature 1..30: note = chr3:44750897-44750927
  misc_feature 1..30: note = Hypo
  source 1..30: mol_type = genomic DNA

SEQ ID NO: 121942 - DNA, 38 bp, Homo sapiens; identical to SEQ ID NO: 91093
  misc_feature 1..38: note = chr3:44754084-44754122
  misc_feature 1..38: note = Hyper
  source 1..38: mol_type = genomic DNA

SEQ ID NO: 121943 - DNA, 71 bp, Homo sapiens; identical to SEQ ID NO: 91094
  misc_feature 1..71: note = chr3:44754341-44754412
  misc_feature 1..71: note = Hyper
  source 1..71: mol_type = genomic DNA

SEQ ID NO: 121944 - DNA, 172 bp, Homo sapiens; identical to SEQ ID NO: 91095
  misc_feature 1..172: note = chr3:44770921-44771093
  misc_feature 1..172: note = Hyper
  source 1..172: mol_type = genomic DNA

SEQ ID NO: 121945 - DNA, 102 bp, Homo sapiens; identical to SEQ ID NO: 91096
  misc_feature 1..102: note = chr3:44938757-44938859
  misc_feature 1..102: note = Hypo
  source 1..102: mol_type = genomic DNA

SEQ ID NO: 121946 - DNA, 34 bp, Homo sapiens; identical to SEQ ID NO: 39907
  misc_feature 1..34: note = chr3:44999995-45000029
  misc_feature 1..34: note = Hypo
  source 1..34: mol_type = genomic DNA

SEQ ID NO: 121947 - DNA, 30 bp, Homo sapiens; identical to SEQ ID NO: 91098
  misc_feature 1..30: note = chr3:45153808-45153838
  misc_feature 1..30: note = Hypo
  source 1..30: mol_type = genomic DNA

SEQ ID NO: 121948 - DNA, 90 bp, Homo sapiens
  misc_feature 1..90: note = chr3:45187296-45187386
  misc_feature 1..90: note = Hyper
  source 1..90: mol_type = genomic DNA
tgctttcaagaatcccggcaaagaccctggggcgcacggcgcgccaccttggacatgtcgcctgggatcggctaccgggagctccttttc

SEQ ID NO: 121949 - DNA, 96 bp, Homo sapiens; identical to SEQ ID NO: 91100
  misc_feature 1..96: note = chr3:45266369-45266465
  misc_feature 1..96: note = Hyper
  source 1..96: mol_type = genomic DNA

SEQ ID NO: 121950 - DNA, 30 bp, Homo sapiens; identical to SEQ ID NO: 39908
  misc_feature 1..30: note = chr3:45821641-45821671
  misc_feature 1..30: note = Hypo
  source 1..30: mol_type = genomic DNA

SEQ ID NO: 121951 - DNA, 751 bp, Homo sapiens; identical to SEQ ID NO: 91102
  misc_feature 1..751: note = chr3:45837489-45838240
  misc_feature 1..751: note = Hyper
  source 1..751: mol_type = genomic DNA

SEQ ID NO: 121952 - DNA, 30 bp, Homo sapiens; identical to SEQ ID NO: 14530
  misc_feature 1..30: note = chr3:45885052-45885082
  misc_feature 1..30: note = Hypo
  source 1..30: mol_type = genomic DNA

SEQ ID NO: 121953 - DNA, 30 bp, Homo sapiens; identical to SEQ ID NO: 91104
  misc_feature 1..30: note = chr3:46009746-46009776
  misc_feature 1..30: note = Hypo
  source 1..30: mol_type = genomic DNA

SEQ ID NO: 121954 - DNA, 30 bp, Homo sapiens; identical to SEQ ID NO: 91105
  misc_feature 1..30: note = chr3:46245355-46245385
  misc_feature 1..30: note = Hypo
  source 1..30: mol_type = genomic DNA

SEQ ID NO: 121955 - DNA, 30 bp, Homo sapiens; identical to SEQ ID NO: 91106
  misc_feature 1..30: note = chr3:46464272-46464302
  misc_feature 1..30: note = Hypo
  source 1..30: mol_type = genomic DNA

SEQ ID NO: 121956 - DNA, 30 bp, Homo sapiens; identical to SEQ ID NO: 91107
  misc_feature 1..30: note = chr3:46480817-46480847
  misc_feature 1..30: note = Hypo
  source 1..30: mol_type = genomic DNA

SEQ ID NO: 121957 - DNA, 23 bp, Homo sapiens
  misc_feature 1..23: note = chr3:46584785-46584808
  misc_feature 1..23: note = Hypo
  source 1..23: mol_type = genomic DNA
ttccctttaccataccgggcaca

SEQ ID NO: 121958 - DNA, 38 bp, Homo sapiens; identical to SEQ ID NO: 91109
  misc_feature 1..38: note = chr3:46586155-46586193
  misc_feature 1..38: note = Hypo
  source 1..38: mol_type = genomic DNA

SEQ ID NO: 121959 - DNA, 39 bp, Homo sapiens; identical to SEQ ID NO: 91110
  misc_feature 1..39: note = chr3:46592147-46592186
  misc_feature 1..39: note = Hypo
  source 1..39: mol_type = genomic DNA

SEQ ID NO: 121960 - DNA, 49 bp, Homo sapiens; identical to SEQ ID NO: 91111
  misc_feature 1..49: note = chr3:46607725-46607774
  misc_feature 1..49: note = Hyper
  source 1..49: mol_type = genomic DNA

SEQ ID NO: 121961 - DNA, 58 bp, Homo sapiens; identical to SEQ ID NO: 91112
  misc_feature 1..58: note = chr3:46853945-46854003
  misc_feature 1..58: note = Hyper
  source 1..58: mol_type = genomic DNA

SEQ ID NO: 121962 - DNA, 1399 bp, Homo sapiens; identical to SEQ ID NO: 91113
  misc_feature 1..1399: note = chr3:46922878-46924277
  misc_feature 1..1399: note = Hyper
  source 1..1399: mol_type = genomic DNA

SEQ ID NO: 121963 - DNA, 250 bp, Homo sapiens; identical to SEQ ID NO: 91114
  misc_feature 1..250: note = chr3:46924989-46925239
  misc_feature 1..250: note = Hyper
  source 1..250: mol_type = genomic DNA

SEQ ID NO: 121964 - DNA, 40 bp, Homo sapiens; identical to SEQ ID NO: 91115
  misc_feature 1..40: note = chr3:46934058-46934098
  misc_feature 1..40: note = Hyper
  source 1..40: mol_type = genomic DNA

SEQ ID NO: 121965 - DNA, 230 bp, Homo sapiens; identical to SEQ ID NO: 91116
  misc_feature 1..230: note = chr3:46948863-46949093
  misc_feature 1..230: note = Hypo
  source 1..230: mol_type = genomic DNA

SEQ ID NO: 121966 - DNA, 30 bp, Homo sapiens; identical to SEQ ID NO: 91118
  misc_feature 1..30: note = chr3:46985725-46985755
  misc_feature 1..30: note = Hypo
  source 1..30: mol_type = genomic DNA

SEQ ID NO: 121967 - DNA, 22 bp, Homo sapiens
  misc_feature 1..22: note = chr3:47018686-47018708
  misc_feature 1..22: note = Hypo
  source 1..22: mol_type = genomic DNA
gggcgcggtggctcacgcctgt

SEQ ID NO: 121968 - DNA, 20 bp, Homo sapiens
  misc_feature 1..20: note = chr3:47020175-47020195
  misc_feature 1..20: note = Hypo
  source 1..20: mol_type = genomic DNA
tctgtaaaacagagccggcc

SEQ ID NO: 121969 - DNA, 20 bp, Homo sapiens
  misc_feature 1..20: note = chr3:47521018-47521038
  misc_feature 1..20: note = Hypo
  source 1..20: mol_type = genomic DNA
gggcgcggtggctcacgcct

SEQ ID NO: 121970 - DNA, 22 bp, Homo sapiens
  misc_feature 1..22: note = chr3:47555871-47555893
  misc_feature 1..22: note = Hypo
  source 1..22: mol_type = genomic DNA
gccgacacggaattatatcttg

SEQ ID NO: 121971 - DNA, 41 bp, Homo sapiens; identical to SEQ ID NO: 91124
  misc_feature 1..41: note = chr3:47588423-47588464
  misc_feature 1..41: note = Hypo
  source 1..41: mol_type = genomic DNA

SEQ ID NO: 121972 - DNA, 38 bp, Homo sapiens; identical to SEQ ID NO: 91125
  misc_feature 1..38: note = chr3:47843707-47843745
  misc_feature 1..38: note = Hypo
  source 1..38: mol_type = genomic DNA

SEQ ID NO: 121973 - DNA, 37 bp, Homo sapiens; identical to SEQ ID NO: 91126
  misc_feature 1..37: note = chr3:47845756-47845793
  misc_feature 1..37: note = Hypo
  source 1..37: mol_type = genomic DNA

SEQ ID NO: 121974 - DNA, 40 bp, Homo sapiens; identical to SEQ ID NO: 91128
  misc_feature 1..40: note = chr3:48227765-48227805
  misc_feature 1..40: note = Hypo
  source 1..40: mol_type = genomic DNA

SEQ ID NO: 121975 - DNA, 77 bp, Homo sapiens; identical to SEQ ID NO: 91129
  misc_feature 1..77: note = chr3:48236476-48236553
  misc_feature 1..77: note = Hypo
  source 1..77: mol_type = genomic DNA

SEQ ID NO: 121976 - DNA, 459 bp, Homo sapiens; identical to SEQ ID NO: 39915
  misc_feature 1..459: note = chr3:48636676-48637135
  misc_feature 1..459: note = Hypo
  source 1..459: mol_type = genomic DNA

SEQ ID NO: 121977 - DNA, 118 bp, Homo sapiens; identical to SEQ ID NO: 91131
  misc_feature 1..118: note = chr3:48689342-48689460
  misc_feature 1..118: note = Hypo
  source 1..118: mol_type = genomic DNA

SEQ ID NO: 121978 - DNA, 973 bp, Homo sapiens
  misc_feature 1..973: note = chr3:48693262-48694235
  misc_feature 1..973: note = Hyper
  source 1..973: mol_type = genomic DNA
gctctgctgcactgtcgcgaacctgggcggggtgggagggggttgcgggggtgggagcgtcaggagcagggtaccacttcacacccaccatccctgcgaggagaaggggctggggcgagagaggaagcgacgagggacggcgggaccgaccggggggacgcgggtgcagcgaggtcaggagaccccgggcggggcgtcaggggaggggcggtgtctcatggggatgccaggacggggcagtcaggaatctgagtcagggcgggtaggtgggggcggcggggaggcgctcagacacggggcgggcacctacgagagggacagcgtaaggtggaatcgctgccgcaggccgcgaaacatgacgaacgaactgggcgggaaggagcgcgcagccacctcgcagcgcgggccctcgaaggcgccgcctgccgggcactggcagcgaaagccgccgttgggcgcgtcggtgcaggtgcccccgttgcggcagacgcccggcacgcagcggccggcctcggtgtccagctcgcagtcctctcctgggggccaagccgcggtcagaggcggtcacgcccacgcccgcccctgctccggccccttcaaagaccgcgcgcccagaggccgggtgccaagacccccgaaaggtcgccctcttcggtggacacgccccttccgtctggccccgccccctccccagtctcatcgctgcctcggcggcggccccttccggccacgctctacggcttctggcctaagcgcgtccataccaggccgtggcctcagaagtgactcccagtactcactcgcattgtggtcccgcccccagccttggcccgtgcttcccccagctctggcccggcgccctgctcaccggtgaagcgcgggcggcagacgcacgtgtagcctccctcgcgccgcgcgcaggctccgccgttgcgacatgggttggagtagcagaggtcgagctcggtctcgc

SEQ ID NO: 121979 - DNA, 1882 bp, Homo sapiens
  misc_feature 1..1882: note = chr3:48698801-48700683
  misc_feature 1..1882: note = Hyper
  source 1..1882: mol_type = genomic DNA
tgtcacggccaccatcgtggtggccgagaggcgcggcgacccgtggtcctgcgcggtcacacgcaggtagtgacgctccatgctctcgcggtccagagctgccgccgtacggataaggccgctctgcgggtcgatgctgaacagctccagcgagcggctgttcatgagtgccgccagcgagtagactaggcgcccggcctcgccggcgtccgggtcctgagcaaccacgcgtagcaccgcggtgcctgctgcctcattctccggcaccagcgtctggtagttgtactgcggaaactgcgggtggcggtttgcggcgcgacgaaagcgtgcccggttcgccgaggttactttcctggcttcaggacgggccgggagtcccgggggacgcggcccggggcgctgcgggaggaagcggcagcggaagagaccccgggagcgcatgcgcttgggcgccggctcgggagctgtccgagactcgcggggtgctgaacctgatgcaggagctgtcctcgccgtgcgtggtgctgaatccagctcggggccagatcccgaggcccctggaagacagttccgccggggggctgtcctttctgctccggatgtcgtggctctctcgccctgacccttgctccctgttgcccataattccccacagcagcgcgcggtgcccactcttttgcgggagcctgtcccagcgttccgctgggaggacaccggcttgggaccgtggtgccgaatcaaaaagtctgaagggaggggcgagctgttccccgagcccgggacccctgaggacagagcccctggtgacagactacctctttgcaaaggtcctgtccgcccgcaagaggagacctctgggcgccagtataacacagaccctggtccctgtcctgtctctcgttcgcggctgcccaatggctggacgccgtgttcaatccccagctcctcattcggctgctcagggggccctcgactattccgggcgctttgccttctccctcggagccccacgaagataggctccctgacccccaggccaggccccccatcctcccggaccccggaagactccggacaaagagctaaggctccgccaccgatatgcgcccttggccccgtagtggcagctaagcctgggtcccagccctggtgcccaccgccccccagctcctcctggctgagggggaacaaagagaggagaaggagcaggagtatgggggtcgaccgtcccccgaggccccgccacggcggccgcctcgccatcatcccccgcctccctgcacggcctccaccgccccccgccccggtccgggccttgggctggccccgccgctcgggccccctcccgggcccctgccgccgccccgggcccccgcccctccgcctgtctctccgcacccccgccgccctctgggcaccatctactccgcggccggagcccctccggcgtgcggccctggctttttccgcccccaccacagcatccccgacgctgctgccgcctcccgccgctccaacatggctcccggccgccccgatggttcgctccacctctgccccggcgcccgaaacacggtggtacaacccatcgcgcatggcagctctgaggaccgaagatgttgccgccatctttattgaggacgtgagcgttgctcctggtgctgaacagagcgcgaaggttcgccgtcgttgggtccgccctccccactttcggtcgccgccttcacccacctccctccttctagggcgctgtcccagctccgtctcccagcctttttctgtccttccagatctcttgttcccccttcctgaccactagttctgaaccgtgtcccggattttggtctgaaattttggtgcccatgagcgttctcatagctct

SEQ ID NO: 121980 - DNA, 46 bp, Homo sapiens; identical to SEQ ID NO: 91138
  misc_feature 1..46: note = chr3:48701213-48701259
  misc_feature 1..46: note = Hyper
  source 1..46: mol_type = genomic DNA

SEQ ID NO: 121981 - DNA, 105 bp, Homo sapiens; identical to SEQ ID NO: 91139
  misc_feature 1..105: note = chr3:48701471-48701576
  misc_feature 1..105: note = Hyper
  source 1..105: mol_type = genomic DNA

SEQ ID NO: 121982 - DNA, 18 bp, Homo sapiens
  misc_feature 1..18: note = chr3:48884018-48884036
  misc_feature 1..18: note = Hypo
  source 1..18: mol_type = genomic DNA
aagcgatatttcctcctc

SEQ ID NO: 121983 - DNA, 99 bp, Homo sapiens; identical to SEQ ID NO: 91141
  misc_feature 1..99: note = chr3:48948428-48948527
  misc_feature 1..99: note = Hypo
  source 1..99: mol_type = genomic DNA

SEQ ID NO: 121984 - DNA, 111 bp, Homo sapiens; identical to SEQ ID NO: 91142
  misc_feature 1..111: note = chr3:49034204-49034315
  misc_feature 1..111: note = Hypo
  source 1..111: mol_type = genomic DNA

SEQ ID NO: 121985 - DNA, 26 bp, Homo sapiens
  misc_feature 1..26: note = chr3:49056918-49056944
  misc_feature 1..26: note = Hypo
  source 1..26: mol_type = genomic DNA
tttttttttttgagacggagtttcgc

SEQ ID NO: 121986 - DNA, 146 bp, Homo sapiens; identical to SEQ ID NO: 91144
  misc_feature 1..146: note = chr3:49057184-49057330
  misc_feature 1..146: note = Hypo
  source 1..146: mol_type = genomic DNA

SEQ ID NO: 121987 - DNA, 30 bp, Homo sapiens; identical to SEQ ID NO: 39921
  misc_feature 1..30: note = chr3:49140985-49141015
  misc_feature 1..30: note = Hypo
  source 1..30: mol_type = genomic DNA

SEQ ID NO: 121988 - DNA, 31 bp, Homo sapiens; identical to SEQ ID NO: 91147
  misc_feature 1..31: note = chr3:49189534-49189565
  misc_feature 1..31: note = Hypo
  source 1..31: mol_type = genomic DNA

SEQ ID NO: 121989 - DNA, 30 bp, Homo sapiens; identical to SEQ ID NO: 91148
  misc_feature 1..30: note = chr3:49540372-49540402
  misc_feature 1..30: note = Hypo
  source 1..30: mol_type = genomic DNA

SEQ ID NO: 121990 - DNA, 73 bp, Homo sapiens; identical to SEQ ID NO: 91149
  misc_feature 1..73: note = chr3:49592444-49592517
  misc_feature 1..73: note = Hyper
  source 1..73: mol_type = genomic DNA

SEQ ID NO: 121991 - DNA, 54 bp, Homo sapiens; identical to SEQ ID NO: 91150
  misc_feature 1..54: note = chr3:49722997-49723051
  misc_feature 1..54: note = Hypo
  source 1..54: mol_type = genomic DNA

SEQ ID NO: 121992 - DNA, 58 bp, Homo sapiens; identical to SEQ ID NO: 91151
  misc_feature 1..58: note = chr3:49755535-49755593
  misc_feature 1..58: note = Hypo
  source 1..58: mol_type = genomic DNA

SEQ ID NO: 121993 - DNA, 45 bp, Homo sapiens; identical to SEQ ID NO: 91152
  misc_feature 1..45: note = chr3:49756360-49756405
  misc_feature 1..45: note = Hyper
  source 1..45: mol_type = genomic DNA

SEQ ID NO: 121994 - DNA, 216 bp, Homo sapiens; identical to SEQ ID NO: 91153
  misc_feature 1..216: note = chr3:49851237-49851453
  misc_feature 1..216: note = Hyper
  source 1..216: mol_type = genomic DNA

SEQ ID NO: 121995 - DNA, 409 bp, Homo sapiens; identical to SEQ ID NO: 91154
  misc_feature 1..409: note = chr3:49906970-49907379
  misc_feature 1..409: note = Hyper
  source 1..409: mol_type = genomic DNA

SEQ ID NO: 121996 - DNA, 33 bp, Homo sapiens; identical to SEQ ID NO: 91155
  misc_feature 1..33: note = chr3:49920459-49920492
  misc_feature 1..33: note = Hypo
  source 1..33: mol_type = genomic DNA

SEQ ID NO: 121997 - DNA, 907 bp, Homo sapiens; identical to SEQ ID NO: 91157
  misc_feature 1..907: note = chr3:49939687-49940594
  misc_feature 1..907: note = Hypo
  source 1..907: mol_type = genomic DNA

SEQ ID NO: 121998 - DNA, 146 bp, Homo sapiens; identical to SEQ ID NO: 91158
  misc_feature 1..146: note = chr3:49941293-49941439
  misc_feature 1..146: note = Hyper
  source 1..146: mol_type = genomic DNA

SEQ ID NO: 121999 - DNA, 94 bp, Homo sapiens; identical to SEQ ID NO: 91160
  misc_feature 1..94: note = chr3:50232113-50232207
  misc_feature 1..94: note = Hyper
  source 1..94: mol_type = genomic DNA

SEQ ID NO: 122000 - DNA, 848 bp, Homo sapiens; identical to SEQ ID NO: 91161
  misc_feature 1..848: note = chr3:50242714-50243562
  misc_feature 1..848: note = Hyper
  source 1..848: mol_type = genomic DNA

SEQ ID NO: 122001 - DNA, 29 bp, Homo sapiens
  misc_feature 1..29: note = chr3:50374655-50374684
  misc_feature 1..29: note = Hyper
  source 1..29: mol_type = genomic DNA
tcgagctccgagtccgagtcctcttggct

SEQ ID NO: 122002 - DNA, 29 bp, Homo sapiens
  misc_feature 1..29: note = chr3:50374917-50374946
  misc_feature 1..29: note = Hyper
  source 1..29: mol_type = genomic DNA
tggggcaggaacgccggggcggggacacg

SEQ ID NO: 122003 - DNA, 388 bp, Homo sapiens
  misc_feature 1..388: note = chr3:50375179-50375567
  misc_feature 1..388: note = Hyper
  source 1..388: mol_type = genomic DNA
cctcccagcccccgcgcagaattagcctctctgtgccgccgggaaatcggcaattagaacgctccttgcgcgcggcacccaggcagccctcgagaatgcctgcactgtggcctgcccatcctcgcccttcccatacgccctcggccccgcgctcaccacgttcgtgtcccgctccaccgcgggttcccagcccaggtcccggggcccgcaacagtccaggcagacgagcgcgcggcagcggtagtggcaggtgaacttgcaatctgcagagaggcctggcggtgaggcggaggagctccaggtcggggaaatgtcccggagattgaagggaagccccagggagagggccgctgctcgccaggctccgcaggcccgacctatctcagtg

SEQ ID NO: 122004 - DNA, 30 bp, Homo sapiens; identical to SEQ ID NO: 14538
  misc_feature 1..30: note = chr3:50395506-50395536
  misc_feature 1..30: note = Hypo
  source 1..30: mol_type = genomic DNA

SEQ ID NO: 122005 - DNA, 923 bp, Homo sapiens; identical to SEQ ID NO: 91164
  misc_feature 1..923: note = chr3:50402120-50403043
  misc_feature 1..923: note = Hyper
  source 1..923: mol_type = genomic DNA

SEQ ID NO: 122006 - DNA, 75 bp, Homo sapiens; identical to SEQ ID NO: 91165
  misc_feature 1..75: note = chr3:50416271-50416346
  misc_feature 1..75: note = Hypo
  source 1..75: mol_type = genomic DNA

SEQ ID NO: 122007 - DNA, 385 bp, Homo sapiens; identical to SEQ ID NO: 91166
  misc_feature 1..385: note = chr3:50425370-50425755
  misc_feature 1..385: note = Hypo
  source 1..385: mol_type = genomic DNA

SEQ ID NO: 122008 - DNA, 111 bp, Homo sapiens; identical to SEQ ID NO: 91167
  misc_feature 1..111: note = chr3:50426562-50426673
  misc_feature 1..111: note = Hypo
  source 1..111: mol_type = genomic DNA

SEQ ID NO: 122009 - DNA, 192 bp, Homo sapiens; identical to SEQ ID NO: 39928
  misc_feature 1..192: note = chr3:50433950-50434142
  misc_feature 1..192: note = Hypo
  source 1..192: mol_type = genomic DNA

SEQ ID NO: 122010 - DNA, 30 bp, Homo sapiens; identical to SEQ ID NO: 91169
  misc_feature 1..30: note = chr3:50472586-50472616
  misc_feature 1..30: note = Hypo
  source 1..30: mol_type = genomic DNA

SEQ ID NO: 122011 - DNA, 398 bp, Homo sapiens; identical to SEQ ID NO: 91170
  misc_feature 1..398: note = chr3:50540230-50540628
  misc_feature 1..398: note = Hyper
  source 1..398: mol_type = genomic DNA

SEQ ID NO: 122012 - DNA, 56 bp, Homo sapiens; identical to SEQ ID NO: 91171
  misc_feature 1..56: note = chr3:50567928-50567984
  misc_feature 1..56: note = Hyper
  source 1..56: mol_type = genomic DNA

SEQ ID NO: 122013 - DNA, 33 bp, Homo sapiens; identical to SEQ ID NO: 91172
  misc_feature 1..33: note = chr3:50575602-50575635
  misc_feature 1..33: note = Hypo
  source 1..33: mol_type = genomic DNA

SEQ ID NO: 122014 - DNA, 451 bp, Homo sapiens; identical to SEQ ID NO: 91173
  misc_feature 1..451: note = chr3:50604981-50605432
  misc_feature 1..451: note = Hyper
  source 1..451: mol_type = genomic DNA

SEQ ID NO: 122015 - DNA, 291 bp, Homo sapiens; identical to SEQ ID NO: 91174
  misc_feature 1..291: note = chr3:50712086-50712377
  misc_feature 1..291: note = Hyper
  source 1..291: mol_type = genomic DNA

SEQ ID NO: 122016 - DNA, 25 bp, Homo sapiens
  misc_feature 1..25: note = chr3:50953960-50953985
  misc_feature 1..25: note = Hypo
  source 1..25: mol_type = genomic DNA
tgtcttggccaggcacggtggctca

SEQ ID NO: 122017 - DNA, 511 bp, Homo sapiens
  misc_feature 1..511: note = chr3:51989989-51990500
  misc_feature 1..511: note = Hyper
  source 1..511: mol_type = genomic DNA
gcacttggcctggcacgctaccgcctcatcgtgcacccgctgcggccaggctcgcggccgccgcctgtgctcgtgctcaccgccgtgtgggccgcggcgggactgctgggcgcgctctccctgctcggcacgccgcccgcaccgccccctgctcctgctcgctgctcggtcctggctgggggcctcgggcccttccggccgctctgggccctgctggccttcgcgctgcccgccctcctgctgctcggcgcctacggcggcatcttcgtggtggcgcgtcgcgctgccctgaggcccccacggccggcgcgcgggtcccgactccactcggactctctggatagccgcctttccatcttgccgccgctccggcctcgcctgcccgggggcaaggcggccctggccccagcgctggccgtgggccaatttgcagcctgctggctgccttatggctgcgcgtgcctggcgcccgcagcgcgggccgcggaagccgaagcggctgtcacctggg

SEQ ID NO: 122018 - DNA, 30 bp, Homo sapiens; identical to SEQ ID NO: 91179
  misc_feature 1..30: note = chr3:52009663-52009693
  misc_feature 1..30: note = Hyper
  source 1..30: mol_type = genomic DNA

SEQ ID NO: 122019 - DNA, 30 bp, Homo sapiens; identical to SEQ ID NO: 91180
  misc_feature 1..30: note = chr3:52117389-52117419
  misc_feature 1..30: note = Hypo
  source 1..30: mol_type = genomic DNA

SEQ ID NO: 122020 - DNA, 28 bp, Homo sapiens
  misc_feature 1..28: note = chr3:52352343-52352371
  misc_feature 1..28: note = Hypo
  source 1..28: mol_type = genomic DNA
gagccactgcgcccggcctggaggtgca

SEQ ID NO: 122021 - DNA, 149 bp, Homo sapiens; identical to SEQ ID NO: 91182
  misc_feature 1..149: note = chr3:52415830-52415979
  misc_feature 1..149: note = Hypo
  source 1..149: mol_type = genomic DNA

SEQ ID NO: 122022 - DNA, 30 bp, Homo sapiens; identical to SEQ ID NO: 39932
  misc_feature 1..30: note = chr3:52429714-52429744
  misc_feature 1..30: note = Hypo
  source 1..30: mol_type = genomic DNA

SEQ ID NO: 122023 - DNA, 30 bp, Homo sapiens; identical to SEQ ID NO: 39933
  misc_feature 1..30: note = chr3:52537738-52537768
  misc_feature 1..30: note = Hypo
  source 1..30: mol_type = genomic DNA

SEQ ID NO: 122024 - DNA, 30 bp, Homo sapiens; identical to SEQ ID NO: 91185
  misc_feature 1..30: note = chr3:52539389-52539419
  misc_feature 1..30: note = Hypo
  source 1..30: mol_type = genomic DNA

SEQ ID NO: 122025 - DNA, 52 bp, Homo sapiens; identical to SEQ ID NO: 91186
  misc_feature 1..52: note = chr3:52548283-52548335
  misc_feature 1..52: note = Hypo
  source 1..52: mol_type = genomic DNA

SEQ ID NO: 122026 - DNA, 84 bp, Homo sapiens; identical to SEQ ID NO: 14542
  misc_feature 1..84: note = chr3:52552577-52552661
  misc_feature 1..84: note = Hypo
  source 1..84: mol_type = genomic DNA

SEQ ID NO: 122027 - DNA, 240 bp, Homo sapiens; identical to SEQ ID NO: 14543
  misc_feature 1..240: note = chr3:52553207-52553447
  misc_feature 1..240: note = Hypo
  source 1..240: mol_type = genomic DNA

SEQ ID NO: 122028 - DNA, 70 bp, Homo sapiens; identical to SEQ ID NO: 91189
  misc_feature 1..70: note = chr3:52558829-52558899
  misc_feature 1..70: note = Hypo
  source 1..70: mol_type = genomic DNA

SEQ ID NO: 122029 - DNA, 38 bp, Homo sapiens; identical to SEQ ID NO: 91190
  misc_feature 1..38: note = chr3:52568630-52568668
  misc_feature 1..38: note = Hypo
  source 1..38: mol_type = genomic DNA

SEQ ID NO: 122030 - DNA, 37 bp, Homo sapiens; identical to SEQ ID NO: 91191
  misc_feature 1..37: note = chr3:52569926-52569963
  misc_feature 1..37: note = Hypo
  source 1..37: mol_type = genomic DNA

SEQ ID NO: 122031 - DNA, 30 bp, Homo sapiens; identical to SEQ ID NO: 39936
  misc_feature 1..30: note = chr3:52599737-52599767
  misc_feature 1..30: note = Hypo
  source 1..30: mol_type = genomic DNA

SEQ ID NO: 122032 - DNA, 30 bp, Homo sapiens; identical to SEQ ID NO: 91193
  misc_feature 1..30: note = chr3:52900469-52900499
  misc_feature 1..30: note = Hypo
  source 1..30: mol_type = genomic DNA

SEQ ID NO: 122033 - DNA, 135 bp, Homo sapiens; identical to SEQ ID NO: 39937
  misc_feature 1..135: note = chr3:52900714-52900849
  misc_feature 1..135: note = Hypo
  source 1..135: mol_type = genomic DNA

SEQ ID NO: 122034 - DNA, 31 bp, Homo sapiens; identical to SEQ ID NO: 39938
  misc_feature 1..31: note = chr3:53032137-53032168
  misc_feature 1..31: note = Hypo
  source 1..31: mol_type = genomic DNA

SEQ ID NO: 122035 - DNA, 837 bp, Homo sapiens; identical to SEQ ID NO: 39939
  misc_feature 1..837: note = chr3:53032798-53033635
  misc_feature 1..837: note = Hypo
  source 1..837: mol_type = genomic DNA

SEQ ID NO: 122036 - DNA, 30 bp, Homo sapiens; identical to SEQ ID NO: 39940
  misc_feature 1..30: note = chr3:53217535-53217565
  misc_feature 1..30: note = Hypo
  source 1..30: mol_type = genomic DNA

SEQ ID NO: 122037 - DNA, 120 bp, Homo sapiens; identical to SEQ ID NO: 91198
  misc_feature 1..120: note = chr3:53879666-53879786
  misc_feature 1..120: note = Hyper
  source 1..120: mol_type = genomic DNA

SEQ ID NO: 122038 - DNA, 30 bp, Homo sapiens; identical to SEQ ID NO: 91199
  misc_feature 1..30: note = chr3:53880694-53880724
  misc_feature 1..30: note = Hyper
  source 1..30: mol_type = genomic DNA

SEQ ID NO: 122039 - DNA, 53 bp, Homo sapiens; identical to SEQ ID NO: 91200
  misc_feature 1..53: note = chr3:54121997-54122050
  misc_feature 1..53: note = Hyper
  source 1..53: mol_type = genomic DNA

SEQ ID NO: 122040 - DNA, 267 bp, Homo sapiens; identical to SEQ ID NO: 91201
  misc_feature 1..267: note = chr3:54154739-54155006
  misc_feature 1..267: note = Hyper
  source 1..267: mol_type = genomic DNA

SEQ ID NO: 122041 - DNA, 931 bp, Homo sapiens
  misc_feature 1..931: note = chr3:54155224-54156155
  misc_feature 1..931: note = Hyper
  source 1..931: mol_type = genomic DNA
cccaggtgtctggtgcgccgggagccccggcgacgttaggagcgcactccttgctggggtcaccggagttgcgcttggccgggcaaggatgactcagcctcactccggtcggtctttaccgccagcctgcgcgagggctccacaaagttcccaatcacaccccatacctcgcacgggggagaggggttctgcaagctgggtcccggggtgggggcagcggcgagagaggcggggagaagcctggttcccagaacgcgcaggggcttctccggcttcctttctcctcgcccctgagggcggcgagaaggcgcctcctccggcgctcactgcctcctgcccagtgcggtgggcgccggagtggggagcaggcaatcccccaggctcggagaaatcttttatcccgaaatccagggtgtcccccggtcaggatcgactcggcgccgcgttggcttcctcgctcaaccctgacatcccggtccccaccagtcaccgcagccgggcggactccgaaggcagcggccgctggggagccccggggcctgggtcgggcgcgcagggggccgctgcgctgcggccggatgccgggagccccgcgctggtgcgcccaagccgtggtggcagcaccgccctccgtgctttcccctgtcgggcgccgcggccggaggagcagctgcgggcggtcacgcagcgctgccctagccagagccccgagctcccacccagtcccatccccagcccgatccgccccgcgtgcgatcccgcctgccgccgcgagcctgtgctcctttctgagatttctgcttcttccccagctccctccccgcaggagaatcgcgcggcgggggcggagggcgcgccccctttaggttccgcggcccccgaccccgcccggcccaggggcggagcgggcatgctacgccctctcctagca

SEQ ID NO: 122042 - DNA, 718 bp, Homo sapiens
  misc_feature 1..718: note = chr3:54156356-54157074
  misc_feature 1..718: note = Hyper
  source 1..718: mol_type = genomic DNA
gagtttccgagtccccgcccgcgcggcgcctcctgccccgccgccctcccgccgcggcccgccggactccccggggccgccgaggcggggccgggcggctgctgctgctagaggcgcgtctcgctgcctcctcccccgcccgcctccctccccacctctcctccctccctccccacctctcctccctccctctcctctccgccctccccgccccccccacccgctcctttttctgctccccaagtgagccgggcgcgcgagaggcaggcggggcggcgcggagcggagcaggcagccccgcgcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtgtaagtgccggctcctgcgccgcccggggaggggaccttgccgcctgcgacccactgtgcccaagtttgggcgcctgcaggtgcggctgggcaggacccgccgcgggcgtcggcctcgccgctcgcacctgcctttcgggacccgcgtcgggcggcgaggccggggtgggatgctctggcccctgcccgcaggttgccgagtgagatctgga

SEQ ID NO: 122043 - DNA, 606 bp, Homo sapiens; identical to SEQ ID NO: 91206
  misc_feature 1..606: note = chr3:54157313-54157919
  misc_feature 1..606: note = Hyper
  source 1..606: mol_type = genomic DNA

SEQ ID NO: 122044 - DNA, 67 bp, Homo sapiens; identical to SEQ ID NO: 91209
  misc_feature 1..67: note = chr3:55519074-55519141
  misc_feature 1..67: note = Hyper
  source 1..67: mol_type = genomic DNA

SEQ ID NO: 122045 - DNA, 107 bp, Homo sapiens; identical to SEQ ID NO: 91210
  misc_feature 1..107: note = chr3:55519516-55519623
  misc_feature 1..107: note = Hyper
  source 1..107: mol_type = genomic DNA

SEQ ID NO: 122046 - DNA, 1065 bp, Homo sapiens; identical to SEQ ID NO: 91211
  misc_feature 1..1065: note = chr3:55520325-55521390
  misc_feature 1..1065: note = Hyper
  source 1..1065: mol_type = genomic DNA

SEQ ID NO: 122047 - DNA, 621 bp, Homo sapiens; identical to SEQ ID NO: 91212
  misc_feature 1..621: note = chr3:55521736-55522357
  misc_feature 1..621: note = Hyper
  source 1..621: mol_type = genomic DNA

SEQ ID NO: 122048 - DNA, 695 bp, Homo sapiens; identical to SEQ ID NO: 28195
  misc_feature 1..695: note = chr3:55522595-55523290
  misc_feature 1..695: note = Hyper
  source 1..695: mol_type = genomic DNA

SEQ ID NO: 122049 - DNA, 28 bp, Homo sapiens
  misc_feature 1..28: note = chr3:55573369-55573397
  misc_feature 1..28: note = Hypo
  source 1..28: mol_type = genomic DNA
ggagattttctaagacgtattttctttt

SEQ ID NO: 122050 - DNA, 30 bp, Homo sapiens; identical to SEQ ID NO: 91215
  misc_feature 1..30: note = chr3:55577421-55577451
  misc_feature 1..30: note = Hypo
  source 1..30: mol_type = genomic DNA

SEQ ID NO: 122051 - DNA, 203 bp, Homo sapiens; identical to SEQ ID NO: 91216
  misc_feature 1..203: note = chr3:56500452-56500655
  misc_feature 1..203: note = Hypo
  source 1..203: mol_type = genomic DNA

SEQ ID NO: 122052 - DNA, 1123 bp, Homo sapiens
  misc_feature 1..1123: note = chr3:56501705-56502828
  misc_feature 1..1123: note = Hyper
  source 1..1123: mol_type = genomic DNA
tcccctagccctccccgataaatcggcttcattttccctgacacgggttttttaaaaaaaaatatgctcccctctgaacccacccaggcggccagccaccccacccccgggcgggggctccacctttctccactttgttctgcttaggattgctcaagacccccgaccccgcgaacaccccacccctcgaggcaagaggggacgccaggcagaagagggggatctgagagaagaaaggcgatggcagtgagggtggctgccggagagggactgcgggaggtggcccgggcagccggggctagcgagcggcgcccgcgcgctggaggaaaccgtgcacttgttccaatccgggggtttatacatcagggcaaagcctcccttaggccgccccatccctccccccgcccaagaaagccccgtaggaggcggatggttcacccttaggctccccacgataacgcattgcagctccccacgagcgagggggacccggcacgaggaatgcccgggcacgggcgccccgagggagccgggcaccaggcggccccggccccggcgtcggcgtctcacctttccgatgctcgccccggggccgtcccacatggatttttacaacctctcgtcgccttggccccgggcggccaggaggagcaggagccggcgccggagccggagaccgagcgagcaggagcgggaggcggaggaagaggaggagaagcggggcggggaacagggagggaggaaagaagggaaggaggaggacactgctcggagggccagggccaggcgcggggccgggcggggccggcggccgagggggcggcacccgccgcagtcccgagacgcgcgctcgcgcggcgctgccaggcgctgcgctcggcggggcccccacccggccggccggcacgctcgcccgctcgcagaggccctgactcacattcccagcattcccgaggagccgctaggggggacggggctggggcccgggcgcctccgctgggggcagcagaaagcgcccggcatgggcgggggtcttcgcagcgcctcctcccggcaggccgcggcgcgaagcacctgtccccaatcttccatccccgacgccccttcccgggtacccccctcc

SEQ ID NO: 122053 - DNA, 38 bp, Homo sapiens; identical to SEQ ID NO: 39941
  misc_feature 1..38: note = chr3:56718243-56718281
  misc_feature 1..38: note = Hypo
  source 1..38: mol_type = genomic DNA

SEQ ID NO: 122054 - DNA, 35 bp, Homo sapiens; identical to SEQ ID NO: 91220
  misc_feature 1..35: note = chr3:57040464-57040499
  misc_feature 1..35: note = Hypo
  source 1..35: mol_type = genomic DNA

SEQ ID NO: 122055 - DNA, 32 bp, Homo sapiens; identical to SEQ ID NO: 91221
  misc_feature 1..32: note = chr3:57198549-57198581
  misc_feature 1..32: note = Hyper
  source 1..32: mol_type = genomic DNA

SEQ ID NO: 122056 - DNA, 54 bp, Homo sapiens; identical to SEQ ID NO: 91222
  misc_feature 1..54: note = chr3:57204154-57204208
  misc_feature 1..54: note = Hyper
  source 1..54: mol_type = genomic DNA

SEQ ID NO: 122057 - DNA, 28 bp, Homo sapiens
  misc_feature 1..28: note = chr3:57740997-57741025
  misc_feature 1..28: note = Hypo
  source 1..28: mol_type = genomic DNA
gagccaccgcgcccggcctaattgctac

SEQ ID NO: 122058 - DNA, 205 bp, Homo sapiens; identical to SEQ ID NO: 91224
  misc_feature 1..205: note = chr3:57882410-57882615
  misc_feature 1..205: note = Hypo
  source 1..205: mol_type = genomic DNA

SEQ ID NO: 122059 - DNA, 35 bp, Homo sapiens; identical to SEQ ID NO: 91225
  misc_feature 1..35: note = chr3:57978698-57978733
  misc_feature 1..35: note = Hypo
  source 1..35: mol_type = genomic DNA

SEQ ID NO: 122060 - DNA, 187 bp, Homo sapiens; identical to SEQ ID NO: 39943
  misc_feature 1..187: note = chr3:58456517-58456704
  misc_feature 1..187: note = Hypo
  source 1..187: mol_type = genomic DNA

SEQ ID NO: 122061 - DNA, 140 bp, Homo sapiens; identical to SEQ ID NO: 91228
  misc_feature 1..140: note = chr3:58571263-58571403
  misc_feature 1..140: note = Hyper
  source 1..140: mol_type = genomic DNA

SEQ ID NO: 122062 - DNA, 106 bp, Homo sapiens
  misc_feature 1..106: note = chr3:58572688-58572794
  misc_feature 1..106: note = Hyper
  source 1..106: mol_type = genomic DNA
cagcactgctggccccgcgagcgcacagcaggagcgtagtccggagccgaagcgcctccgcgacggtgacgcggccccaagtcccaaaccccgctgagggtcaagt

SEQ ID NO: 122063 - DNA, 30 bp, Homo sapiens; identical to SEQ ID NO: 91229
  misc_feature 1..30: note = chr3:59034636-59034666
  misc_feature 1..30: note = Hypo
  source 1..30: mol_type = genomic DNA

SEQ ID NO: 122064 - DNA, 182 bp, Homo sapiens; identical to SEQ ID NO: 91230
  misc_feature 1..182: note = chr3:59223755-59223937
  misc_feature 1..182: note = Hypo
  source 1..182: mol_type = genomic DNA

SEQ ID NO: 122065 - DNA, 30 bp, Homo sapiens; identical to SEQ ID NO: 91231
  misc_feature 1..30: note = chr3:59690756-59690786
  misc_feature 1..30: note = Hypo
  source 1..30: mol_type = genomic DNA

SEQ ID NO: 122066 - DNA, 30 bp, Homo sapiens; identical to SEQ ID NO: 91233
  misc_feature 1..30: note = chr3:61341365-61341395
  misc_feature 1..30: note = Hypo
  source 1..30: mol_type = genomic DNA

SEQ ID NO: 122067 - DNA, 30 bp, Homo sapiens; identical to SEQ ID NO: 91234
  misc_feature 1..30: note = chr3:61546138-61546168
  misc_feature 1..30: note = Hyper
  source 1..30: mol_type = genomic DNA

SEQ ID NO: 122068 - DNA, 60 bp, Homo sapiens; identical to SEQ ID NO: 91235
  misc_feature 1..60: note = chr3:61548153-61548213
  misc_feature 1..60: note = Hyper
  source 1..60: mol_type = genomic DNA

SEQ ID NO: 122069 - DNA, 91 bp, Homo sapiens; identical to SEQ ID NO: 28200
  misc_feature 1..91: note = chr3:61548917-61549008
  misc_feature 1..91: note = Hyper
  source 1..91: mol_type = genomic DNA

SEQ ID NO: 122070 - DNA, 42 bp, Homo sapiens; identical to SEQ ID NO: 91237
  misc_feature 1..42: note = chr3:61550498-61550540
  misc_feature 1..42: note = Hyper
  source 1..42: mol_type = genomic DNA

SEQ ID NO: 122071 - DNA, 92 bp, Homo sapiens; identical to SEQ ID NO: 91238
  misc_feature 1..92: note = chr3:62305001-62305093
  misc_feature 1..92: note = Hyper
  source 1..92: mol_type = genomic DNA

SEQ ID NO: 122072 - DNA, 32 bp, Homo sapiens; identical to SEQ ID NO: 91239
  misc_feature 1..32: note = chr3:62351431-62351463
  misc_feature 1..32: note = Hyper
  source 1..32: mol_type = genomic DNA

SEQ ID NO: 122073 - DNA, 1760 bp, Homo sapiens
  misc_feature 1..1760: note = chr3:62353296-62355056
  misc_feature 1..1760: note = Hyper
  source 1..1760: mol_type = genomic DNA
ccaagatctcccagacgtaatggggggagagcgctaataagacactattgtactatatgaggacaaggaaagggagctgactccttaaaccggcctgcagtctccctggggatagatgtctgggaaaagcaaggcgatattttcatatccttagccgccaagtcctcctcgcccatcctggggtttcctggggtttgtggcatccaccgagatttcggagttaaatctgcatattcctctgggtcccaatctcccctaagcgaactgcagccagaacgagctaacatttaaattccccctcgcttcctcttcccccctcccctggctgcgtcttcctagacttgaggggaggaggggaggaatacaaaaaaacgaggacgctctcctttcaggaaatggaattctaatgtacgcgttcctatttctgaatcggaggtactaaaaatacccccgcgacagcctgaggaagctgtcgccgtcctctgtgcaaacaaaatcgacaattctccttccccgcgcaatgggtctgcgaattgggcggcgggcggggacagaaccgttggctgaccaggacacaacctccatcctgccccagagcgtctttctccgagccccaaccccgagattcttcctccactgaagcgcaggcctcctaaaacccccggagttcgaattcctgctctaccaagcctggtgaccccaggcatgtcacatagttcatctctgcctctatttctccgtctgtagagtgggaataatcatgcccagcttgagggttgtagtcaccgttcgagaggatgtgtgttaagttcctggcatagagcaagccctcgggagatgacagggttttcgctagtggaaaccactggcactctcagcactgagcgcctactgtataccaggtgttgggcaaacccgcactccagtcactttctgagttacttggcggagtgagggggtgccctttgcgttaagcatctttcccttcaaatagtcgcctcccgccgtggaaatacgcgtggggtcagctcccagccacactcgccccctcaatggggaggttgcgtggaagcgcactcccgggccccgcgccgcacttcctcctggcgctggggaacattgttccaagagacgtgggctgaatcgccgcgcggatattaaaagtgtgtgtggggggaggcccggagcgacgcgccagtaatccgagctcttgattatccagattcggatcaaacggggcggcggcggccggccccctcctgggaatgattagatgattaatgtaatgctgtttgaagggtctctgttttctctcttaatttgggtcattacttagaaagcaagcgtgagatcatttcatcagcgtgctcggcagcagagatagctattcaggaaatgggctaacggagcggtaatcaggacccaggaggcggcggcggcggcggcagcgagctcggggagcccgggcgcgccctccggcggcagggctcagggcaccgggaggccagccccagaccgagagcgcaggccagtgagccccgaggctctggctggcctgggggacccttaccctccagttctcgccgccaagggagattgggagcggtggttgccctccttaggtctcccggagaaggggacgcgcccagaagctctccggtggggtagggcgtagatcgcttaccctcgcggggcgtggcgctttgctcaaggacgctcccaaaagctgctccccaacacccagtcgcttttaacccttt

SEQ ID NO: 122074 - DNA, 3324 bp, Homo sapiens
  misc_feature 1..3324: note = chr3:62355300-62358624
  misc_feature 1..3324: note = Hyper
  source 1..3324: mol_type = genomic DNA
ttgctgagctgacctcgccgcgaggggagagggggaaaaaaacgcgcactaatgattctgtttattgagttatatatgtatatattccgtgttcgcttgtacaggaggatttacatggctgtataaagatggctaggggcgccgcgctcttctggggcgctcacggtgacaggctggggttaaaactggctgccccaggagaagcggaggcctggaattaaatacgtttcggcgcactggatttaaataagtttcctgaatatacaaaggtgggggccacgagtttgctgccagtcatcgaggaaacatttagctttccaaaaatatgctggtttcgataaatagattttagcctctctgctatagtttttttttcttttaattttagaaataagtttatatgtgtgatctgttttcaggtggtacagggagggaaggaagggcaaggcagtagctctcagctctgcactgtcctagtcaggtcctttgcggagggggcagcagggcccacgctgtcgtggagtttgcgcacatgtttctttaagtcaaagtttctgcaaaaccctttgccgcaagtggcgcacgtgaaaggcttcttgtcgttgtgggtgtgcatatggaaggttaggttgtagacctggtggaaggccttgttgcagatggtacatttgtactgcttctcgccgctgtgggtcagcttgtggttcttgtagttccctacaacagatcaagaacaaaaaacgtgggggtatggagtagaatggtggggaggaagaggcgggcgtcccaggggcagcccaggtgcctgctcaaaaaaggcgacgcttggctaggcgggcgcgacctcttcgagtgaagaagttgtcaaacttcgtaagcgtcaagccgggtgctctcccgacaagaccgagactgagtcccgcggagccgctctgcgctcctgctctgcccgccacagaggctggtgcagcttccctcccgccgcgctccgcgggccgggaaacttttgcgtagcccagagacgcaccgagtccttctcctggctgatgcctcgctagaagaaattcgcacgaacccgggcttcatcctttttcttttcccccttctcatttttaaagttacttctttctcgccccccaactaccaactgaagatccaaaagtgccttggaaaatccgatccaggggccaaggatcataccggtttcccccaatcttagattgttcccgggagggttattttgcctccaatatttttcatttgaaagggaagttccggatacaaaaggaacctttttctatagggcaataccctctccttttcctacatcctttccttctgtccccgtgcttccttcgacctctcgaattcggagtctctcagtgcacccagcctgcatacagcgtggtctactaaccccgctaggagagcttccccctacaccaggcacaacccgattctaaagaaatgctgcgcccgcgcctgcagatttcgccttctctctccagatccctctttgccttcctgccagccagccgcgacccgagtcctgaggtgaggtgagaagagaaggcctcgcctggcacgttacctttttggtgaaagcctttgccgcaaaattcgcagacgaagggcttgtagcccgcgtggatgcggatatgcgtgttgagcgtggagctgcggttgaacgctttgccgcactggttgcatttatgtggcttttcctgaggaaaggggcgagtgcacagtaaggagaggccacctcgggaacacctggaagggacatcccccccacccccactcaaccctagagggtaagggataatctttggccatcgtatccccggtgttatcactaagattctgggggttgcgcgcgggctaggcccgacccgggggccacgtacctgggtgtggataattttgtgcctgcagagcgtgctggcctggcgaaagcctttgccgcagactttgcacacgaacggtctggctccggtgtggaccggcatgtggcgggtgagattatagtgagcgttaaacacctatggaaagacatggggggccttgtggtgcgtctgtccgagggcctacaatcagccccgggggggccacagcctacctcccccaaccaacacccccttcagaaaccagagcctttttcagtttgtaaagtgctgcccaaactcctgcttacaccaatactgtgtggccgctgacaagggcatccccattttacagaataggaaactgaggcccaacgaggctcccagtttgggtagtcaactactggggagctcctcagcttgaaaaaggggcattccaggctgccccaaggaagccgccgccgccgatcgcccctcccggcccccctcgccgaaccctgggcctcaccttgccgcacacctcgcaggtgaagtttttgggcttgccatctgcggagcctcctggcagcttgctgtggcccttgacgcctccgcgctcggcagtcagggccgagttttccttcagtacctgctccagcggcgccggcaagcgctccttatggggatagggagccgggtgggggaacttgtccgcagccaggccggccagcttggcgttctccagcagaaagagcttggggtgagcagccagggcggcgggggcctgcgcattgaggaggccagacgggaagaggtggccgctgaggagctcagacggcgggtacgcggtcgagtccaggtagttgaagtagtagagcgagccgctggccggcagccccacagcctggttgatgacctgcggcttgatgaccctgcccgcgggcagcgcggacggcgccaggcccagctcggccttgcagcacacgccacagttggttttgcacaagccgctggcgccgcacactggggcccccccgccgccgccgccgccaccgccgccgccgcctccgccgccgcccgcccggaggctgcttttccagagctccgagtaactgagcagtgtctttgacggcacctcgtagcctaggggctggagggggatcatacagggcagcggcgagcagaggttgagcagtttcttgccctggctgccgtccgcctctagcgctccaggccggggctcaaagggcgcacggggctccgacgtcttggccatgatgcgctcgatggaaaaggccagtgtcttggaagtggccggcgacgctccggcgcgcgggcaggccgggggcaccatggtctccagggaagccgagcttgccatggcgcgcggagctgagccgagccaggctgggccagggcgcagcctctctcctctaagtctgcattccggaaaaggcagggg

SEQ ID NO: 122075 - DNA, 1777 bp, Homo sapiens
  misc_feature 1..1777: note = chr3:62358858-62360635
  misc_feature 1..1777: note = Hyper
  source 1..1777: mol_type = genomic DNA
gcccttccctggacccgggcctctgccacgcgtgctgggagctggacagtgaaggggcaaagttaaagaggaccggagagccacctcgcatttacctctttcccccaccaccaaggagatgcgttccgagccatgcagcgtgtctcttctgtcacattttgatggcaaacatcttcccctccgcgtgagatcactgtcttttacattcagctgacatcacatgaagtcacttgaagtggaatgacatgggcggcggcgcggctcccgtagcggcccctgtgttcccccgcgcctgccggccgccgccaccaccgcccctcaaactttaaaaggaggcaactggcgcccgcgctcctctcgggaaagtgcgagcggtttgcgaatagggaaagagggaagagacgggagggggagggggaggaatcgtgatggttttgccggtggaaggaaagggggggggggacccaaacccaaacctaggcagagttccgtgcgtgattcacaactttggaggcctgcaggtttgggggacgcggggagggcggagggtcccggacgcggcgcccccaaagggcccctgggtatcagtctagtagccgaagtatcccttagccctccgcagccgagctgggcatcgtgctaataaactgccatttacccacggaaccggcgccagccccgaacacgcgcaaatgataattacctcattaggatgtggcgcatggacgcgggcgccgcgtttggaggggggaacttgttaatggggaaatattaatttatgcaaaagcaatgagctcgccttggctggcgtcggaggtcgggagaaagctcccactgactaaggacgaccccgaagcgtcacggagagcaaggccgctcgccggcatctcgggggcctcggcgccgcgcaggtgcgcctccagctttatggccagctctgggtctgaggctgggggagactaaaccgagagctggaagactttcggagatcctaatagatcagaattgttgatttatgatcgggtttctgaggcaaagccgagttctgcttctggtttagggctgcgtgcggggaggattcggagggcagctctcccagctgatgggtacttactgtttgtataattgagaaggtcccatctccacctgtttaaggagcagattgaaacagcagaacctccccctggatcctattaaaacgtttttcctcctaaggccattcagtcgaaccaattttccgaagtgattcatagagctgaattctgccaaggcagctctttcacttttagccactaaagcaccgcgtggaaccgggttttgtgtttttctaaaataaagagaaggattatcagagaggagagggagggggcctgaagggggacgggcagagacttagtgtggccagaggtacaagcagagggaagaaaagacccttttctagacaggccccaagtaagttcggaggaattcagcgttttgtgcctggcgcacaaaagcagcgcgctccgcgcttggtttggaggggctgaattcatctgtttgcagaccattccacctgcgtatcacaacaaactgctcaaagacgctccagcactttcaacaggccgggtgctcttggcgacaacaaaagtggtcgaggctgagggttcttacggaggggggtggtggtggctagcaagagagcgagcgagagaattaggtttaggaaagggggaggactgggtgcaagggttttttgaaaagttttggctggttttgttcgcgggacaattatatc

SEQ ID NO: 122076 - DNA, 415 bp, Homo sapiens
  misc_feature 1..415: note = chr3:62362698-62363113
  misc_feature 1..415: note = Hyper
  source 1..415: mol_type = genomic DNA
gccctgtgtaatccccgggcgcccaggcccgtggccttccgattcgctccatggcgtgggttgcagcccgtcacgcacggccgccgggcccgaatccaccttggcgccttccctagcccgaggcctcagccccaggcctatttcacttggagcgcctcagcctagagccggacgctttggcttcttcgccatctggccctaggttgggcctcaaactcccggcggcggtagggaaacagacgatcacagttaggcctgaggcccctcggcggcctgtgtccttcccacgccgaagaacaaggcgccaaggccgggcgcgtccgctgctctgcggggcctgaccggggcggcgacctctgggatccgcggcggtgcgacgccgcgccctggccaagcaacccgcacaccactgact

SEQ ID NO: 122077 - DNA, 1702 bp, Homo sapiens
  misc_feature 1..1702: note = chr3:62363424-62365126
  misc_feature 1..1702: note = Hyper
  source 1..1702: mol_type = genomic DNA
aaaatccctttcttgcgcaaaaagctcacacatttgcaccacggaagaaaaaggcaagcatttccactccaaaaagtgttccaatttcagcccctgtggcatgcatatcttggttctggatgacaaggggcactattattttaaaaaccgttattattttttcatctggttgcaatacataacacagcgccctatgtatgccatctccccagggagccgagcagcttgggaggagaaggcttgcttgcggctcccgagtttggggaaacacgggcactggggaccccgctccttcctgactttttttttttgggggggggggaggaaccaatcctgaaacaaacaaactttatggtttaaggaatgtcttttcttattccctccctccttccctccctccctccctccttcttccctccagctctccttccttcctcctttcctttcttttcttccttctttccaaaggaacatttagaatctgatttacttggtgccgcgcttaaccgctgctgaaaatagattaacttctgaagagaaattcttttgctatcctctcttttttccccaggaagcattttattgaaaacattcgaactggcttgcccgtggcgggcttgtccaaagcacaggggcctccgccttcggtgcgcgttgttctcaggattagtgctgttgggagacaaagagccccagatacccgaggctgggagcgccggagagctcccaggtttcgggtaccctcccggagcacgcaagcacagtcccaggcctttagggacagatgggccagagccgtctgcatctgcccgcatcctttgggaggctgcgatgatcgcagccagggtggccgagcgcccggcccactgcacccggcggctgttttgcagcgcccctggcattcagggaatggtttgcaaatctcaatgcaccacagactagttttcaccgtggagcaggaaaggcgcctattagccaggggcaaccggctttgcagacctgggcgggggcgtagggggaggggcggtggtgcaaacctatcgtgatttccaggatcctcccaactccctccgctatcacatcagaggacattcgctgactcttcggaaatctgggcagcgaatacacttctaggccagaagaattctcctaaaagagcagatctgcagtctatccgtgcaagcttagtactctcctctctgccctggatgcatatatattcacaaacatatatatgcatatcatatatatgcatattgtttatatgtatgtatgtatatacttatatactatcggcaacccatcactagaaatgctatttaattaggaatctgatccaatacccgcgtgcagcaatttgccagcagacgtgtcattttgtaaggcgcagtgagggaaggaagtcgtctcgcctacctgggttttccacttgctacgcgattttggtgtgcaacccaaaggaaataatcgtttatagagaacgatgatgatgtatttttatatatgatataacacacacatccgtgtatgcatatttgaaattaaaaggcgttttggtgactgactggccctgcgtagttgagagatgtcggtttccgactccctgggaagacggcttaggatcctccgcgttatttaacttggcagctggttaaactccgcggtggagcctgcccaaaggtattagcgttaagtgctgaga

SEQ ID NO: 122078 - DNA, 73 bp, Homo sapiens; identical to SEQ ID NO: 91256
  misc_feature 1..73: note = chr3:62859891-62859964
  misc_feature 1..73: note = Hyper
  source 1..73: mol_type = genomic DNA

SEQ ID NO: 122079 - DNA, 1156 bp, Homo sapiens
  misc_feature 1..1156: note = chr3:62860169-62861325
  misc_feature 1..1156: note = Hyper
  source 1..1156: mol_type = genomic DNA
cctcctcgccagctgcgccgccagctcccattgttcaccccgcccgcctggcgacgtccgggtgctgctccctgggcctcccaggcgcacctaccttctgctgccggcgagccatgtcggtgggctgcttggcattaaaggggtaggcgatgcagcgcatcacgaacacatacagctgcagcctcttcttcctctcctcctcctctttctgcagccgctccaactcttccttctccttctcgctcaccaccgacgggctggggctggagggccggccgccgccagcgcggctgctgggttgcagccccccggccccgccgccgctgctcgcgccgctgcccccgccgccgcctgcacccaccccggctccggcgccggcgccgccgccccccagcccggcgctgccggccgagccctcgctggtacggctgggagacaggcgcgcgccggacggggccgagccgagcacctccttgccgctctcctcctccacgatctcatccgattcttcttcgctggacgaagggtccagcatagtggcgcctggggagcggggtctctggagcccccggcttggagtgcaaaaggtggggggcgctggaggcagccggggatcagctctcccgggtgggcgcttctccccaggtcagggagcgagagcgctgctgctcagcctcggccgccgcgactgatcctctgcccggcggtcgcgagctgggctcagacccagaagcgcgaagggaggaggggaagggagaggtgcgtccgtggactcgaggtgggcaagggggagaatcaattgcgagccccgagcccgcagccggatgccatctgcggctgctgaaggaggcgcctccagaaaagatgccgagtgttgcaagctgtcgatgcagccaagagccgaagaggcatcttgccgattggggagggagcggcgcttacgtgtttattggcttaactctcccgtgtccgcggcgtaaagggctgctgcagagggctggaggggggagagcgcggagcgtcctcagagcctcagtacttctgaccccaataccttgccaccctcctcccctgccggcttcgtggataatttttttgttgatatctggctctcattgcctcaaccccttttcccctcccgcggacaaaaagttct

SEQ ID NO: 122080 - DNA, 127 bp, Homo sapiens
  misc_feature 1..127: note = chr3:62861812-62861939
  misc_feature 1..127: note = Hyper
  source 1..127: mol_type = genomic DNA
accctaagaactcagcggcgtcaacatctaatgcgtcgactgtcgcactctgttcacccctgcctctcgggtaaactattaatacaaagcagcagatggtgcctgccttccccgtgctcctttcact

SEQ ID NO: 122081 - DNA, 271 bp, Homo sapiens
  misc_feature 1..271: note = chr3:63263759-63264030
  misc_feature 1..271: note = Hyper
  source 1..271: mol_type = genomic DNA
tgatggtgccaagcccgctttcccaaaccaacagacccaaagtttccccggagccagagggcaccgggcgcacggctgagcctgcaccaatgtctgtgggccctgcctcgcccacctcctcgccctcccctctggagcgcggctggccaatgacagccttcccctggctccatgggtttccccctcccctgttgtatctaccctgccccagctcttccctgcccacccctcgctgactcgcttcgcttccccgacgcgctgggttcccgga

SEQ ID NO: 122082 - DNA, 586 bp, Homo sapiens; identical to SEQ ID NO: 28224
  misc_feature 1..586: note = chr3:63264254-63264840
  misc_feature 1..586: note = Hyper
  source 1..586: mol_type = genomic DNA

SEQ ID NO: 122083 - DNA, 169 bp, Homo sapiens; identical to SEQ ID NO: 91262
  misc_feature 1..169: note = chr3:64007991-64008160
  misc_feature 1..169: note = Hypo
  source 1..169: mol_type = genomic DNA

SEQ ID NO: 122084 - DNA, 335 bp, Homo sapiens; identical to SEQ ID NO: 28225
  misc_feature 1..335: note = chr3:64430570-64430905
  misc_feature 1..335: note = Hyper
  source 1..335: mol_type = genomic DNA

SEQ ID NO: 122085 - DNA, 30 bp, Homo sapiens; identical to SEQ ID NO: 91264
  misc_feature 1..30: note = chr3:64670902-64670932
  misc_feature 1..30: note = Hyper
  source 1..30: mol_type = genomic DNA

SEQ ID NO: 122086 - DNA, 77 bp, Homo sapiens; identical to SEQ ID NO: 91265
  misc_feature 1..77: note = chr3:64671655-64671732
  misc_feature 1..77: note = Hyper
  source 1..77: mol_type = genomic DNA

SEQ ID NO: 122087 - DNA, 375 bp, Homo sapiens; identical to SEQ ID NO: 91266
  misc_feature 1..375: note = chr3:64672038-64672413
  misc_feature 1..375: note = Hyper
  source 1..375: mol_type = genomic DNA

SEQ ID NO: 122088 - DNA, 156 bp, Homo sapiens; identical to SEQ ID NO: 91267
  misc_feature 1..156: note = chr3:64673263-64673419
  misc_feature 1..156: note = Hyper
  source 1..156: mol_type = genomic DNA

SEQ ID NO: 122089 - DNA, 30 bp, Homo sapiens; identical to SEQ ID NO: 91268
  misc_feature 1..30: note = chr3:64674179-64674209
  misc_feature 1..30: note = Hyper
  source 1..30: mol_type = genomic DNA

SEQ ID NO: 122090 - DNA, 30 bp, Homo sapiens; identical to SEQ ID NO: 91269
  misc_feature 1..30: note = chr3:64785423-64785453
  misc_feature 1..30: note = Hypo
  source 1..30: mol_type = genomic DNA

SEQ ID NO: 122091 - DNA, 398 bp, Homo sapiens
  misc_feature 1..398: note = chr3:65534983-65535381
  misc_feature 1..398: note = Hyper
  source 1..398: mol_type = genomic DNA
cctcttcctcattcccgcccagtctccttcctcccttcctaaccccctcccctcccctcttcctgctgtcacttccaaacccaaggacaaaaccgttacctgcgggccccggagcggccccggagttcgcctcggtcactgccggagcccaggcgcgcgctcggtggccgcccgcctcatccccgcgcgtctgagcggcccggcggcagctgctccttttatggggctcgcaggcagtaggctcggccagggtgtccccagcccgctcgggcggcagcggcgtcaatgcgcgctattcacactccgggctgcggctggtacccctctacacgccccccgggagtgcgcgactgcctgcccgcccccatcctcagggccttggacgggggtaggggtgg

SEQ ID NO: 122092 - DNA, 66 bp, Homo sapiens; identical to SEQ ID NO: 91273
  misc_feature 1..66: note = chr3:66025440-66025506
  misc_feature 1..66: note = Hyper
  source 1..66: mol_type = genomic DNA

SEQ ID NO: 122093 - DNA, 26 bp, Homo sapiens
  misc_feature 1..26: note = chr3:66618027-66618053
  misc_feature 1..26: note = Hypo
  source 1..26: mol_type = genomic DNA
acctttggccaggtgcggtgactcac

SEQ ID NO: 122094 - DNA, 30 bp, Homo sapiens; identical to SEQ ID NO: 39944
  misc_feature 1..30: note = chr3:67047776-67047806
  misc_feature 1..30: note = Hypo
  source 1..30: mol_type = genomic DNA

SEQ ID NO: 122095 - DNA, 30 bp, Homo sapiens; identical to SEQ ID NO: 91276
  misc_feature 1..30: note = chr3:67066758-67066788
  misc_feature 1..30: note = Hypo
  source 1..30: mol_type = genomic DNA

SEQ ID NO: 122096 - DNA, 276 bp, Homo sapiens; identical to SEQ ID NO: 91277
  misc_feature 1..276: note = chr3:68056904-68057180
  misc_feature 1..276: note = Hyper
  source 1..276: mol_type = genomic DNA

SEQ ID NO: 122097 - DNA, 30 bp, Homo sapiens; identical to SEQ ID NO: 91278
  misc_feature 1..30: note = chr3:68777755-68777785
  misc_feature 1..30: note = Hypo
  source 1..30: mol_type = genomic DNA

SEQ ID NO: 122098 - DNA, 1280 bp, Homo sapiens
  misc_feature 1..1280: note = chr3:68980768-68982048
  misc_feature 1..1280: note = Hyper
  source 1..1280: mol_type = genomic DNA
atctgagatgcctcccgcggaaagagacgcaacttccagacccgctccagttctccacttgggcgggaagctttgcgctcccagctggaagacgcctcccaagcgctcgctgcgcccttcaagcaagatcctagcaaccagagcttcagggtgggggtgggggcggggggacgctgaccggctcccacctgcttgctcctagaaagatcctagctcagattaaagggatgaagcgctaaggtcgacttgtccagaaaagagctcacggtgagttcaccaccccctataccaattcatcgagtggcctcctccgcatcagcagagcacccccggggattctgtcagacatgaaccccgaaactggaagcggccgctgcctctctccagccacacatccttacttcggagtgccccttccaacttcgggttgcacgccgacctcagcacaggcactctccccggcgccccagagagccgggatgaggggagctgcaccgagctgagttaactcggtaccagccgagaggcagcggctgcccacgagacagcacctaaatacagggtccaaatccacccccaccccatcctctcgcccctccttatcccttccaacccttcttactcgactagagccggcatccaagtcggaccggcgcgtccggaactaggtactgatcgccgcaccggagcccgaggacgctcaccgtgccgcctccccgcgggagccccgggagcggcccatcacctctgcagcctcgccaggagaagaaaagttcccacgtctctaccaggagaagcccgaagctcctgcgggagaagcctgaagctgctgctggagaagcggcagctgaggcaggactcccgatgtttgcccgcagccgcgcgcgcagtcggtgcgccccgtccagggcggcgcgcagctagcagtgcggagccgagcccagctagcgcgctgaccaggaggggccgggcccgccgcggaacgcgctgattggccgggccgcccggctgctcctgtccctgcctggccccgcggtccacgtgggccggccttctccccgccccgcacccctgctcaggcggcgcgcccccactgccggcctccaggcgcctctcccgagcgcctcgctgtggccaccactccgcaggtgctgagcaaaaggtattcttcctgaatacctgagagtcgcgttgagctccacataaggaagacggatttagggttcggctctcactcgaaaccattctccacgcaggacccaaagcggtttgcaagcagg

SEQ ID NO: 122099 - DNA, 30 bp, Homo sapiens; identical to SEQ ID NO: 91288
  misc_feature 1..30: note = chr3:69313995-69314025
  misc_feature 1..30: note = Hypo
  source 1..30: mol_type = genomic DNA

SEQ ID NO: 122100 - DNA, 511 bp, Homo sapiens; identical to SEQ ID NO: 91289
  misc_feature 1..511: note = chr3:69435147-69435658
  misc_feature 1..511: note = Hyper
  source 1..511: mol_type = genomic DNA

SEQ ID NO: 122101 - DNA, 228 bp, Homo sapiens; identical to SEQ ID NO: 91290
  misc_feature 1..228: note = chr3:69459574-69459802
  misc_feature 1..228: note = Hyper
  source 1..228: mol_type = genomic DNA

SEQ ID NO: 122102 - DNA, 1320 bp, Homo sapiens
  misc_feature 1..1320: note = chr3:69590888-69592208
  misc_feature 1..1320: note = Hyper
  source 1..1320: mol_type = genomic DNA
aaaagggcagccaaacgaaacccttagtgtcctctgctaactccagggatttcccccccctcttttcgctgccttttagaagtatctctgggggccagatctgggcttcatcagcttttctcccgacctcccacgaacgcgcggcaaccgaagcacgcggtccccggcggcgcgtttgcaaaccccaccaacgccaacgcctcgaaaccgccaaacttcctgtctccataccaccaaagcgaccaaagcgccgtgccaagtgccccagggactccagcggaggctgcactagacctcgagccccagggcggggttttccgctctcccaaactcctgggacccgcacctccgctgggggtctccaaacgtgcgcgctgcgcccggggcgcaccgggcgcgcccgtggccgcgtcttgcggcctcgccctggcagcacgcttggggagcccggggcggtcgcccacctacctgctccgccacctcctccctgcggcgctccggggctgtagacggctactttattgtctcggctgcgcaccgcgcgggacctggggacccggctctgcgccagtcctgcaagtccactctgcgctgtgccttccccggcggcggctgccttcctcttcttcctcttcctctctgtccaagctccagctcagcacgtgagctacgcagcccgactcccgggctctctgggcagccagcgcctgccgcatcccccggcccgggtctgcaggtcgcccccgccaccgccgctcgccgtgcgtcctcgctttgctccacacttacagctgtgccccgggccgcctttctcgcgtccttccgtcctgcctgcctcctctcgctgtcagccggggctttcggctccctctctccccagcagcccccgcccgccgcctctccgggggctggggcggccgctgccaatgaggctcggctgatgcgctgttccggcccagtcattgtatcgggagggaaggaaggggagggggagagggaggaagggagggggcgccctcggcccccgccgcacggggctgcgggctgggctagccttccccggcagagaaagggcgccggtgccaggaggcgcggagcggtgcctgccaggaggaggggaaagagggggtcaccagcccgcgcctctccatcgctccctccgactcctccaagctctgggcggaacttgattctgcctcaccggcttcaggcatcccaggacctgagtgctgttagaataaagggtatgaggcaccggtggcagagggaggcgcagaatgcacccagccacccaagaggggctggcgaaatgactcctga

SEQ ID NO: 122103 - DNA, 81 bp, Homo sapiens; identical to SEQ ID NO: 39946
  misc_feature 1..81: note = chr3:69741003-69741084
  misc_feature 1..81: note = Hypo
  source 1..81: mol_type = genomic DNA

SEQ ID NO: 122104 - DNA, 30 bp, Homo sapiens; identical to SEQ ID NO: 91296
  misc_feature 1..30: note = chr3:69937866-69937896
  misc_feature 1..30: note = Hypo
  source 1..30: mol_type = genomic DNA

SEQ ID NO: 122105 - DNA, 27 bp, Homo sapiens
  misc_feature 1..27: note = chr3:70083704-70083731
  misc_feature 1..27: note = Hypo
  source 1..27: mol_type = genomic DNA
ttttgttctgccaggcgtggtggctca

SEQ ID NO: 122106 - DNA, 304 bp, Homo sapiens; identical to SEQ ID NO: 91298
  misc_feature 1..304: note = chr3:71179297-71179601
  misc_feature 1..304: note = Hyper
  source 1..304: mol_type = genomic DNA

SEQ ID NO: 122107 - DNA, 30 bp, Homo sapiens; identical to SEQ ID NO: 91299
  misc_feature 1..30: note = chr3:71187389-71187419
  misc_feature 1..30: note = Hypo
  source 1..30: mol_type = genomic DNA

SEQ ID NO: 122108 - DNA, 36 bp, Homo sapiens; identical to SEQ ID NO: 91300
  misc_feature 1..36: note = chr3:71510928-71510964
  misc_feature 1..36: note = Hypo
  source 1..36: mol_type = genomic DNA

SEQ ID NO: 122109 - DNA, 219 bp, Homo sapiens
  misc_feature 1..219: note = chr3:71802569-71802788
  misc_feature 1..219: note = Hyper
  source 1..219: mol_type = genomic DNA
ccaccgtgaccccagcgcgggcgccgccgccggacccccgttacctggggccaaacgcgacttgtcgccaccttgcgtcctgggccctgcctccctcccggccgcctcccgaccccgcggctgctgcggaggcgcccccagcccagccgggcccaggcggtgcgggatgcctcggcggggctggcggcggcggccgcgctgcgcgctccggcggagggg

SEQ ID NO: 122110 - DNA, 1179 bp, Homo sapiens
  misc_feature 1..1179: note = chr3:71802848-71804027
  misc_feature 1..1179: note = Hyper
  source 1..1179: mol_type = genomic DNA
ggcggggggcagagccaagaggcgcggcggcagcagcggaggagtaggaggagacggaggaggatgcggggggctgcggacggtggcgaggccctgtccgcagtgaagcccgcggcgcctagggcgcagggagtggccgcctcctcctgcgcgcaccattcctgagatggcggcggcggcacagcggcggctcggggagcccaggaggggccggccgggagcgggctgagccccgcaggacggggagctcgcccagggccggcggagcggcggagctcgggccgggcggcctgcgggagcggcgaggcaggggacggccccggggcggagcgcacggcctggtgaggccgcgatggcgaacgcgagcgagccgggtggcagcggcggcggcgaggcggccgccctgggcctcaagctggccacgctcagcctgctgctgtgcgtgagcctagcgggcaacgtgctgttcgcgctgctgatcgtgcgggagcgcagcctgcaccgcgccccgtactacctgctgctcgacctgtgcctggccgacgggctgcgcgcgctcgcctgcctcccggccgtcatgctggcggcgcggcgtgcggcggccgcggcgggggcgccgccgggcgcgctgggctgcaagctgctcgccttcctggccgcgctcttctgcttccacgccgccttcctgctgctgggcgtgggcgtcacccgctacctggccatcgcgcaccaccgcttctatgcagagcgcctggccggctggccgtgcgccgccatgctggtgtgcgccgcctgggcgctggcgctggccgcggccttcccgccagtgctggacggcggtggcgacgacgaggacgcgccgtgcgccctggagcagcggcccgacggcgcccccggcgcgctgggcttcctgctgctgctggccgtggtggtgggcgccacgcacctcgtctacctccgcctgctcttcttcatccacgaccgccgcaagatgcggcccgcgcgcctggtgcccgccgtcagccacgactggaccttccacggcccgggcgccaccggccaggcggccgccaactggacggcgggcttcggccgcgggcccacgccgcccgcgcttgtgggcatccggcccgcagggccgggccgcggcgcgcgccgcctcctcgtgctggaagaatt

SEQ ID NO: 122111 - DNA, 185 bp, Homo sapiens; identical to SEQ ID NO: 91306
  misc_feature 1..185: note = chr3:71833566-71833751
  misc_feature 1..185: note = Hyper
  source 1..185: mol_type = genomic DNA

SEQ ID NO: 122112 - DNA, 769 bp, Homo sapiens; identical to SEQ ID NO: 91307
  misc_feature 1..769: note = chr3:71833976-71834745
  misc_feature 1..769: note = Hyper
  source 1..769: mol_type = genomic DNA

SEQ ID NO: 122113 - DNA, 119 bp, Homo sapiens; identical to SEQ ID NO: 91308
  misc_feature 1..119: note = chr3:72149958-72150077
  misc_feature 1..119: note = Hyper
  source 1..119: mol_type = genomic DNA

SEQ ID NO: 122114 - DNA, 30 bp, Homo sapiens; identical to SEQ ID NO: 39948
  misc_feature 1..30: note = chr3:72305951-72305981
  misc_feature 1..30: note = Hypo
  source 1..30: mol_type = genomic DNA

SEQ ID NO: 122115 - DNA, 30 bp, Homo sapiens; identical to SEQ ID NO: 91310
  misc_feature 1..30: note = chr3:72321838-72321868
  misc_feature 1..30: note = Hypo
  source 1..30: mol_type = genomic DNA

SEQ ID NO: 122116 - DNA, 188 bp, Homo sapiens; identical to SEQ ID NO: 91311
  misc_feature 1..188: note = chr3:72647815-72648003
  misc_feature 1..188: note = Hypo
  source 1..188: mol_type = genomic DNA

SEQ ID NO: 122117 - DNA, 30 bp, Homo sapiens; identical to SEQ ID NO: 91313
  misc_feature 1..30: note = chr3:72742498-72742528
  misc_feature 1..30: note = Hypo
  source 1..30: mol_type = genomic DNA

SEQ ID NO: 122118 - DNA, 30 bp, Homo sapiens; identical to SEQ ID NO: 39949
  misc_feature 1..30: note = chr3:72773579-72773609
  misc_feature 1..30: note = Hypo
  source 1..30: mol_type = genomic DNA

SEQ ID NO: 122119 - DNA, 369 bp, Homo sapiens; identical to SEQ ID NO: 91315
  misc_feature 1..369: note = chr3:72787939-72788308
  misc_feature 1..369: note = Hyper
  source 1..369: mol_type = genomic DNA

SEQ ID NO: 122120 - DNA, 81 bp, Homo sapiens; identical to SEQ ID NO: 91316
  misc_feature 1..81: note = chr3:73045023-73045104
  misc_feature 1..81: note = Hypo
  source 1..81: mol_type = genomic DNA

SEQ ID NO: 122121 - DNA, 81 bp, Homo sapiens; identical to SEQ ID NO: 91317
  misc_feature 1..81: note = chr3:73045524-73045605
  misc_feature 1..81: note = Hypo
  source 1..81: mol_type = genomic DNA

SEQ ID NO: 122122 - DNA, 172 bp, Homo sapiens; identical to SEQ ID NO: 91318
  misc_feature 1..172: note = chr3:73498616-73498788
  misc_feature 1..172: note = Hypo
  source 1..172: mol_type = genomic DNA

SEQ ID NO: 122123 - DNA, 320 bp, Homo sapiens
  misc_feature 1..320: note = chr3:73673904-73674224
  misc_feature 1..320: note = Hyper
  source 1..320: mol_type = genomic DNA
gaccttgtggcacagcgcgcacttcaggtccgggtccacgtcgccgtcgaagcggtccagctcgaagcccatggtggcggccaggccccggggtcgccgccgggcggccgggcgccccctccctccccacgaggcggcccagacaggccggctacgccgcccgcgcgctcgctggctctccccggactgagcctaattgatccagacttcctcggaaaatgcccgaggaacaggactcctccggccgtatttgcgcgagcgcgagcgcacatacatcgtgccttggatgcctcccgccagccccccgaaaaagggaggag

SEQ ID NO: 122124 - DNA, 30 bp, Homo sapiens; identical to SEQ ID NO: 91320
  misc_feature 1..30: note = chr3:73674657-73674687
  misc_feature 1..30: note = Hyper
  source 1..30: mol_type = genomic DNA

SEQ ID NO: 122125 - DNA, 367 bp, Homo sapiens
  misc_feature 1..367: note = chr3:74663814-74664181
  misc_feature 1..367: note = Hyper
  source 1..367: mol_type = genomic DNA
gtgcctccgccactccggctccggctccggctccgacgcggacgctggagggaggggagaccgggcggactggagggagggaggggcggggagcgcggcggagcagccaactgggtcccgagcctcgcgtctgcggcgcccccagcgcctctgcgccggccggaccccgcgcggccctgcgctcggccgcgtgcacccacgtgtgtccggcctccgcagggccctgggcggcggcgcgggctgggcggcggtcaccgtgtcacctccgggtggcctcgtgccacgcagttagggccctcggaacacggggttaaggcaggaattccacttctagaaaagcctcctgcagctgcgctcccacaagtgc

SEQ ID NO: 122126 - DNA, 629 bp, Homo sapiens
  misc_feature 1..629: note = chr3:75955796-75956425
  misc_feature 1..629: note = Hyper
  source 1..629: mol_type = genomic DNA
gaccgggaggagcctcgagcctgctcattagtagcacgggcagctcgcgcgctggaggagggaggcggaaggacagcgctgcgccaccacccggaggagggagcgcggtagctgcaggcaggggagggagaggaaagaaaaggaaggacggctcccagacagagagtgggagaaaccggggagcagcgggagcagcaggtccggggggagctgttccgctgcgctgccctcgttattcacacggacgctgcggagcttcccagggctgcttccctgtccccctgggtggaggctgccgtctaaacctgactccaggtgagttcggcaaagaggtgaaccgaggggtctcgaaccagagacgtggcattggcgaggctgctcagctcccccaagcgctgctgcctttatatttcccaaattcacggaaggtcttggcggtggctgcacaggctgggagggggcggagggtcggtgggtggttgcgatcctcacggccagcgtgggggcattcggatggaattagcttaagtgaatggggttttaggaaatgtccccaaaggcacgcgttatatatgtgtttctagacaagcttttaagacggaaatttggtttcccggatgccctttttg

SEQ ID NO: 122127 - DNA, 67 bp, Homo sapiens; identical to SEQ ID NO: 91328
  misc_feature 1..67: note = chr3:77089144-77089211
  misc_feature 1..67: note = Hyper
  source 1..67: mol_type = genomic DNA

SEQ ID NO: 122128 - DNA, 60 bp, Homo sapiens; identical to SEQ ID NO: 28251
  misc_feature 1..60: note = chr3:77089428-77089488
  misc_feature 1..60: note = Hyper
  source 1..60: mol_type = genomic DNA

SEQ ID NO: 122129 - DNA, 170 bp, Homo sapiens; identical to SEQ ID NO: 91330
  misc_feature 1..170: note = chr3:77918482-77918652
  misc_feature 1..170: note = Hypo
  source 1..170: mol_type = genomic DNA

SEQ ID NO: 122130 - DNA, 33 bp, Homo sapiens; identical to SEQ ID NO: 91331
  misc_feature 1..33: note = chr3:79067168-79067201
  misc_feature 1..33: note = Hyper
  source 1..33: mol_type = genomic DNA

SEQ ID NO: 122131 - DNA, 194 bp, Homo sapiens; identical to SEQ ID NO: 91332
  misc_feature 1..194: note = chr3:79068137-79068331
  misc_feature 1..194: note = Hyper
  source 1..194: mol_type = genomic DNA

SEQ ID NO: 122132 - DNA, 448 bp, Homo sapiens; identical to SEQ ID NO: 91333
  misc_feature 1..448: note = chr3:79815465-79815913
  misc_feature 1..448: note = Hyper
  source 1..448: mol_type = genomic DNA

SEQ ID NO: 122133 - DNA, 136 bp, Homo sapiens; identical to SEQ ID NO: 91334
  misc_feature 1..136: note = chr3:79816272-79816408
  misc_feature 1..136: note = Hyper
  source 1..136: mol_type = genomic DNA

SEQ ID NO: 122134 - DNA, 222 bp, Homo sapiens; identical to SEQ ID NO: 91335
  misc_feature 1..222: note = chr3:79816778-79817000
  misc_feature 1..222: note = Hyper
  source 1..222: mol_type = genomic DNA

SEQ ID NO: 122135 - DNA, 142 bp, Homo sapiens; identical to SEQ ID NO: 91336
  misc_feature 1..142: note = chr3:79817216-79817358
  misc_feature 1..142: note = Hyper
  source 1..142: mol_type = genomic DNA

SEQ ID NO: 122136 - DNA, 30 bp, Homo sapiens; identical to SEQ ID NO: 91337
  misc_feature 1..30: note = chr3:85000786-85000816
  misc_feature 1..30: note = Hypo
  source 1..30: mol_type = genomic DNA

SEQ ID NO: 122137 - DNA, 1088 bp, Homo sapiens
  misc_feature 1..1088: note = chr3:85007729-85008817
  misc_feature 1..1088: note = Hyper
  source 1..1088: mol_type = genomic DNA
tgcgcagaagaacctcgcacccaggacctggcccaggcaccacgaattccagaacatgctggggacacggctaaccccgccccctcgcggtggcgattggctgaacccttcctgagtgcaaagcgctgattaatgaaggcagttgtctcgcctgcaagttcgggcgagacatctctaaagaggtaagatccgccaggggtgctgaatgggggcttcagttcttcctgcccgaagggtccttgagaagcctgtttgtttttcccggcgcttgtctccacccatccccttctctcattggccagacctggtgggcgggggagtttccattggccggggggcggtgtctgtccctggccggggtgggggcggggcctccgccgctctgagcttgcccttgtgtctggtgcttcgtagagctgccgccgtcgccgctgccgctgccgccacagccgccgctgcagccggagcatccgggagccgccactgccgccgccgctgccgctgctaccgccactagcgctgcttccactgcttctacctcccctcccaggaccccgagacaccccgggcgcgagcggcagtgctgcttgcttgctcctcctctcccccagcccttcccctccgtgacctacccactccttgcagccctcgcccgcaccttctccaacaccccggcatccctgcaccacctgctcgggcagccccggcgggctctgggacttgctgtgcgcgccgagaggaaggcaagctccaaacccctgcctggaagacgggctgtcgcggctgcaccaccagcaggaggaggaggagaagaaactatttcgcgataccccattctgcgggtgctttgccgctgccgcttctgctgccgccgatccgagtccgcgggttcgaacaccgcagcggtggggacggtgggtccggcgggcgccgggaggaggacaccagcggagccctgcactctcgtgccccgctcaccagcatctacttgccccctcgttccttccccagccctttagagaagggaccatgatttggaaacgcagcgccgttctccgcttctacagtgtctgcgggctcctgctaca

SEQ ID NO: 122138 - DNA, 104 bp, Homo sapiens; identical to SEQ ID NO: 91340
  misc_feature 1..104: note = chr3:85009234-85009338
  misc_feature 1..104: note = Hyper
  source 1..104: mol_type = genomic DNA

SEQ ID NO: 122139 - DNA, 96 bp, Homo sapiens; identical to SEQ ID NO: 28259
  misc_feature 1..96: note = chr3:85009769-85009865
  misc_feature 1..96: note = Hyper
  source 1..96: mol_type = genomic DNA

SEQ ID NO: 122140 - DNA, 40 bp, Homo sapiens; identical to SEQ ID NO: 28260
  misc_feature 1..40: note = chr3:85010590-85010630
  misc_feature 1..40: note = Hyper
  source 1..40: mol_type = genomic DNA

SEQ ID NO: 122141 - DNA, 30 bp, Homo sapiens; identical to SEQ ID NO: 91343
  misc_feature 1..30: note = chr3:85393239-85393269
  misc_feature 1..30: note = Hypo
  source 1..30: mol_type = genomic DNA

SEQ ID NO: 122142 - DNA, 145 bp, Homo sapiens; identical to SEQ ID NO: 91344
  misc_feature 1..145: note = chr3:86061726-86061871
  misc_feature 1..145: note = Hypo
  source 1..145: mol_type = genomic DNA

SEQ ID NO: 122143 - DNA, 86 bp, Homo sapiens; identical to SEQ ID NO: 91345
  misc_feature 1..86: note = chr3:86960155-86960241
  misc_feature 1..86: note = Hypo
  source 1..86: mol_type = genomic DNA

SEQ ID NO: 122144 - DNA, 892 bp, Homo sapiens; identical to SEQ ID NO: 91346
  misc_feature 1..892: note = chr3:87039656-87040548
  misc_feature 1..892: note = Hyper
  source 1..892: mol_type = genomic DNA

SEQ ID NO: 122145 - DNA, 30 bp, Homo sapiens; identical to SEQ ID NO: 91347
  misc_feature 1..30: note = chr3:87128365-87128395
  misc_feature 1..30: note = Hypo
  source 1..30: mol_type = genomic DNA

SEQ ID NO: 122146 - DNA, 38 bp, Homo sapiens; identical to SEQ ID NO: 91348
  misc_feature 1..38: note = chr3:87226517-87226555
  misc_feature 1..38: note = Hypo
  source 1..38: mol_type = genomic DNA

SEQ ID NO: 122147 - DNA, 163 bp, Homo sapiens; identical to SEQ ID NO: 14551
  misc_feature 1..163: note = chr3:87782694-87782857
  misc_feature 1..163: note = Hypo
  source 1..163: mol_type = genomic DNA

SEQ ID NO: 122148 - DNA, 395 bp, Homo sapiens; identical to SEQ ID NO: 91350
  misc_feature 1..395: note = chr3:87841397-87841792
  misc_feature 1..395: note = Hyper
  source 1..395: mol_type = genomic DNA

SEQ ID NO: 122149 - DNA, 354 bp, Homo sapiens
  misc_feature 1..354: note = chr3:87842058-87842412
  misc_feature 1..354: note = Hyper
  source 1..354: mol_type = genomic DNA
gaaggggtgtggggacgtggggagtgggaggctggacagcgcttgctctcggcggaaacgctgggaagccggcgccaagtcctttcccacactactttgatctaacagcgcaggaattcaagaattgccctttcccttttctgcccacaacctctgctccctgggggcgaagttctgtggtgctaggcggagatagtggtcaaggctgggaggaagggaggggtctgacccgggcccaagggcgaggggtggcggtccaagccggcgagaccccacttagggcgcaggctcctggcgctcctacctcgggaagccgctggggtggagagagacggggcacgggccagaatccag

SEQ ID NO: 122150 - DNA, 38 bp, Homo sapiens; identical to SEQ ID NO: 91353
  misc_feature 1..38: note = chr3:87881745-87881783
  misc_feature 1..38: note = Hypo
  source 1..38: mol_type = genomic DNA

SEQ ID NO: 122151 - DNA, 27 bp, Homo sapiens
  misc_feature 1..27: note = chr3:88248022-88248049
  misc_feature 1..27: note = Hypo
  source 1..27: mol_type = genomic DNA
accccgcccgcccgattctttaacatt

SEQ ID NO: 122152 - DNA, 22 bp, Homo sapiens
  misc_feature 1..22: note = chr3:89098883-89098905
  misc_feature 1..22: note = Hypo
  source 1..22: mol_type = genomic DNA
gggcgcggtggctcacgcctgt

SEQ ID NO: 122153 - DNA, 73 bp, Homo sapiens; identical to SEQ ID NO: 28266
  misc_feature 1..73: note = chr3:89156550-89156623
  misc_feature 1..73: note = Hyper
  source 1..73: mol_type = genomic DNA

SEQ ID NO: 122154 - DNA, 44 bp, Homo sapiens; identical to SEQ ID NO: 91360
  misc_feature 1..44: note = chr3:89157055-89157099
  misc_feature 1..44: note = Hyper
  source 1..44: mol_type = genomic DNA

SEQ ID NO: 122155 - DNA, 25 bp, Homo sapiens
  misc_feature 1..25: note = chr3:89219100-89219125
  misc_feature 1..25: note = Hypo
  source 1..25: mol_type = genomic DNA
ttgagattatagcctcggcggggcg

SEQ ID NO: 122156 - DNA, 40 bp, Homo sapiens; identical to SEQ ID NO: 91365
  misc_feature 1..40: note = chr3:93698209-93698249
  misc_feature 1..40: note = Hypo
  source 1..40: mol_type = genomic DNA

SEQ ID NO: 122157 - DNA, 30 bp, Homo sapiens; identical to SEQ ID NO: 39959
  misc_feature 1..30: note = chr3:93801136-93801166
  misc_feature 1..30: note = Hypo
  source 1..30: mol_type = genomic DNA

SEQ ID NO: 122158 - DNA, 160 bp, Homo sapiens; identical to SEQ ID NO: 91374
  misc_feature 1..160: note = chr3:96147753-96147913
  misc_feature 1..160: note = Hypo
  source 1..160: mol_type = genomic DNA

SEQ ID NO: 122159 - DNA, 1704 bp, Homo sapiens; identical to SEQ ID NO: 91375
  misc_feature 1..1704: note = chr3:96532078-96533782
  misc_feature 1..1704: note = Hyper
  source 1..1704: mol_type = genomic DNA

SEQ ID NO: 122160 - DNA, 61 bp, Homo sapiens; identical to SEQ ID NO: 28271
  misc_feature 1..61: note = chr3:96534035-96534096
  misc_feature 1..61: note = Hyper
  source 1..61: mol_type = genomic DNA

SEQ ID NO: 122161 - DNA, 113 bp, Homo sapiens; identical to SEQ ID NO: 91377
  misc_feature 1..113: note = chr3:97200376-97200489
  misc_feature 1..113: note = Hypo
  source 1..113: mol_type = genomic DNA

SEQ ID NO: 122162 - DNA, 31 bp, Homo sapiens; identical to SEQ ID NO: 39961
  misc_feature 1..31: note = chr3:98029454-98029485
  misc_feature 1..31: note = Hypo
  source 1..31: mol_type = genomic DNA

SEQ ID NO: 122163 - DNA, 16 bp, Homo sapiens
  misc_feature 1..16: note = chr3:98161422-98161438
  misc_feature 1..16: note = Hypo
  source 1..16: mol_type = genomic DNA
gcgtgagccaccgcgc

SEQ ID NO: 122164 - DNA, 42 bp, Homo sapiens; identical to SEQ ID NO: 91382
  misc_feature 1..42: note = chr3:98170629-98170671
  misc_feature 1..42: note = Hypo
  source 1..42: mol_type = genomic DNA

SEQ ID NO: 122165 - DNA, 42 bp, Homo sapiens; identical to SEQ ID NO: 91383
  misc_feature 1..42: note = chr3:98313028-98313070
  misc_feature 1..42: note = Hypo
  source 1..42: mol_type = genomic DNA

SEQ ID NO: 122166 - DNA, 102 bp, Homo sapiens; identical to SEQ ID NO: 91384
  misc_feature 1..102: note = chr3:98313310-98313412
  misc_feature 1..102: note = Hypo
  source 1..102: mol_type = genomic DNA

SEQ ID NO: 122167 - DNA, 61 bp, Homo sapiens; identical to SEQ ID NO: 91385
  misc_feature 1..61: note = chr3:98450986-98451047
  misc_feature 1..61: note = Hyper
  source 1..61: mol_type = genomic DNA

SEQ ID NO: 122168 - DNA, 109 bp, Homo sapiens; identical to SEQ ID NO: 91386
  misc_feature 1..109: note = chr3:98451370-98451479
  misc_feature 1..109: note = Hyper
  source 1..109: mol_type = genomic DNA

SEQ ID NO: 122169 - DNA, 686 bp, Homo sapiens; identical to SEQ ID NO: 91387
  misc_feature 1..686: note = chr3:98451685-98452371
  misc_feature 1..686: note = Hyper
  source 1..686: mol_type = genomic DNA

SEQ ID NO: 122170 - DNA, 186 bp, Homo sapiens; identical to SEQ ID NO: 91388
  misc_feature 1..186: note = chr3:98452640-98452826
  misc_feature 1..186: note = Hyper
  source 1..186: mol_type = genomic DNA

SEQ ID NO: 122171 - DNA, 41 bp, Homo sapiens; identical to SEQ ID NO: 91389
  misc_feature 1..41: note = chr3:98471752-98471793
  misc_feature 1..41: note = Hypo
  source 1..41: mol_type = genomic DNA

SEQ ID NO: 122172 - DNA, 30 bp, Homo sapiens; identical to SEQ ID NO: 91390
  misc_feature 1..30: note = chr3:98555269-98555299
  misc_feature 1..30: note = Hypo
  source 1..30: mol_type = genomic DNA

SEQ ID NO: 122173 - DNA, 41 bp, Homo sapiens; identical to SEQ ID NO: 91391
  misc_feature 1..41: note = chr3:98613834-98613875
  misc_feature 1..41: note = Hypo
  source 1..41: mol_type = genomic DNA

SEQ ID NO: 122174 - DNA, 1072 bp, Homo sapiens; identical to SEQ ID NO: 91392
  misc_feature 1..1072: note = chr3:98620054-98621126
  misc_feature 1..1072: note = Hyper
  source 1..1072: mol_type = genomic DNA

SEQ ID NO: 122175 - DNA, 19 bp, Homo sapiens
  misc_feature 1..19: note = chr3:98902515-98902534
  misc_feature 1..19: note = Hypo
  source 1..19: mol_type = genomic DNA
tttgagacggagtctcgct

SEQ ID NO: 122176 - DNA, 116 bp, Homo sapiens; identical to SEQ ID NO: 28277
  misc_feature 1..116: note = chr3:99356783-99356899
  misc_feature 1..116: note = Hyper
  source 1..116: mol_type = genomic DNA

SEQ ID NO: 122177 - DNA, 423 bp, Homo sapiens; identical to SEQ ID NO: 91399
  misc_feature 1..423: note = chr3:99594891-99595314
  misc_feature 1..423: note = Hyper
  source 1..423: mol_type = genomic DNA

SEQ ID NO: 122178 - DNA, 41 bp, Homo sapiens; identical to SEQ ID NO: 89952
  misc_feature 1..41: note = chr3:100211005-100211046
  misc_feature 1..41: note = Hyper
  source 1..41: mol_type = genomic DNA

SEQ ID NO: 122179 - DNA, 34 bp, Homo sapiens; identical to SEQ ID NO: 89953
  misc_feature 1..34: note = chr3:100989020-100989054
  misc_feature 1..34: note = Hypo
  source 1..34: mol_type = genomic DNA

SEQ ID NO: 122180 - DNA, 30 bp, Homo sapiens; identical to SEQ ID NO: 89954
  misc_feature 1..30: note = chr3:101021607-101021637
  misc_feature 1..30: note = Hypo
  source 1..30: mol_type = genomic DNA

SEQ ID NO: 122181 - DNA, 164 bp, Homo sapiens; identical to SEQ ID NO: 89955
  misc_feature 1..164: note = chr3:101230477-101230641
  misc_feature 1..164: note = Hypo
  source 1..164: mol_type = genomic DNA

SEQ ID NO: 122182 - DNA, 163 bp, Homo sapiens; identical to SEQ ID NO: 89956
  misc_feature 1..163: note = chr3:101230941-101231104
  misc_feature 1..163: note = Hypo
  source 1..163: mol_type = genomic DNA

SEQ ID NO: 122183 - DNA, 98 bp, Homo sapiens; identical to SEQ ID NO: 89959
  misc_feature 1..98: note = chr3:101397204-101397302
  misc_feature 1..98: note = Hypo
  source 1..98: mol_type = genomic DNA

SEQ ID NO: 122184 - DNA, 30 bp, Homo sapiens; identical to SEQ ID NO: 89964
  misc_feature 1..30: note = chr3:102435036-102435066
  misc_feature 1..30: note = Hypo
  source 1..30: mol_type = genomic DNA

SEQ ID NO: 122185 - DNA, 30 bp, Homo sapiens; identical to SEQ ID NO: 89968
  misc_feature 1..30: note = chr3:104512166-104512196
  misc_feature 1..30: note = Hypo
  source 1..30: mol_type = genomic DNA

SEQ ID NO: 122186 - DNA, 30 bp, Homo sapiens; identical to SEQ ID NO: 89971
  misc_feature 1..30: note = chr3:106136655-106136685
  misc_feature 1..30: note = Hypo
  source 1..30: mol_type = genomic DNA

SEQ ID NO: 122187 - DNA, 41 bp, Homo sapiens; identical to SEQ ID NO: 89972
  misc_feature 1..41: note = chr3:106732480-106732521
  misc_feature 1..41: note = Hypo
  source 1..41: mol_type = genomic DNA

SEQ ID NO: 122188 - DNA, 30 bp, Homo sapiens; identical to SEQ ID NO: 89973
  misc_feature 1..30: note = chr3:106824203-106824233
  misc_feature 1..30: note = Hypo
  source 1..30: mol_type = genomic DNA

SEQ ID NO: 122189 - DNA, 16 bp, Homo sapiens
  misc_feature 1..16: note = chr3:106835414-106835430
  misc_feature 1..16: note = Hypo
  source 1..16: mol_type = genomic DNA
gcgccctgccaaaggt

SEQ ID NO: 122190 - DNA, 38 bp, Homo sapiens; identical to SEQ ID NO: 89975
  misc_feature 1..38: note = chr3:106862938-106862976
  misc_feature 1..38: note = Hypo
  source 1..38: mol_type = genomic DNA

SEQ ID NO: 122191 - DNA, 33 bp, Homo sapiens; identical to SEQ ID NO: 89976
  misc_feature 1..33: note = chr3:106936157-106936190
  misc_feature 1..33: note = Hypo
  source 1..33: mol_type = genomic DNA

SEQ ID NO: 122192 - DNA, 67 bp, Homo sapiens; identical to SEQ ID NO: 89977
  misc_feature 1..67: note = chr3:107148996-107149063
  misc_feature 1..67: note = Hyper
  source 1..67: mol_type = genomic DNA

SEQ ID NO: 122193 - DNA, 280 bp, Homo sapiens; identical to SEQ ID NO: 89978
  misc_feature 1..280: note = chr3:107149774-107150054
  misc_feature 1..280: note = Hyper
  source 1..280: mol_type = genomic DNA

SEQ ID NO: 122194 - DNA, 30 bp, Homo sapiens; identical to SEQ ID NO: 89979
  misc_feature 1..30: note = chr3:107244633-107244663
  misc_feature 1..30: note = Hyper
  source 1..30: mol_type = genomic DNA

SEQ ID NO: 122195 - DNA, 50 bp, Homo sapiens; identical to SEQ ID NO: 89981
  misc_feature 1..50: note = chr3:107632014-107632064
  misc_feature 1..50: note = Hypo
  source 1..50: mol_type = genomic DNA

SEQ ID NO: 122196 - DNA, 215 bp, Homo sapiens; identical to SEQ ID NO: 89982
  misc_feature 1..215: note = chr3:107771800-107772015
  misc_feature 1..215: note = Hypo
  source 1..215: mol_type = genomic DNA

SEQ ID NO: 122197 - DNA, 39 bp, Homo sapiens; identical to SEQ ID NO: 89983
  misc_feature 1..39: note = chr3:107833994-107834033
  misc_feature 1..39: note = Hypo
  source 1..39: mol_type = genomic DNA

SEQ ID NO: 122198 - DNA, 91 bp, Homo sapiens; identical to SEQ ID NO: 89984
  misc_feature 1..91: note = chr3:108483736-108483827
  misc_feature 1..91: note = Hypo
  source 1..91: mol_type = genomic DNA

SEQ ID NO: 122199 - DNA, 84 bp, Homo sapiens; identical to SEQ ID NO: 89987
  misc_feature 1..84: note = chr3:108829148-108829232
  misc_feature 1..84: note = Hypo
  source 1..84: mol_type = genomic DNA

SEQ ID NO: 122200 - DNA, 30 bp, Homo sapiens; identical to SEQ ID NO: 89988
  misc_feature 1..30: note = chr3:109035016-109035046
  misc_feature 1..30: note = Hypo
  source 1..30: mol_type = genomic DNA

SEQ ID NO: 122201 - DNA, 30 bp, Homo sapiens; identical to SEQ ID NO: 89989
  misc_feature 1..30: note = chr3:109787249-109787279
  misc_feature 1..30: note = Hypo
  source 1..30: mol_type = genomic DNA

SEQ ID NO: 122202 - DNA, 280 bp, Homo sapiens; identical to SEQ ID NO: 89995
  misc_feature 1..280: note = chr3:110789454-110789734
  misc_feature 1..280: note = Hyper
  source 1..280: mol_type = genomic DNA

SEQ ID NO: 122203 - DNA, 30 bp, Homo sapiens; identical to SEQ ID NO: 89996
  misc_feature 1..30: note = chr3:110790641-110790671
  misc_feature 1..30: note = Hyper
  source 1..30: mol_type = genomic DNA

SEQ ID NO: 122204 - DNA, 215 bp, Homo sapiens; identical to SEQ ID NO: 89997
  misc_feature 1..215: note = chr3:110791320-110791535
  misc_feature 1..215: note = Hyper
  source 1..215: mol_type = genomic DNA

SEQ ID NO: 122205 - DNA, 30 bp, Homo sapiens; identical to SEQ ID NO: 89998
  misc_feature 1..30: note = chr3:111197729-111197759
  misc_feature 1..30: note = Hypo
  source 1..30: mol_type = genomic DNA

SEQ ID NO: 122206 - DNA, 34 bp, Homo sapiens; identical to SEQ ID NO: 39967
  misc_feature 1..34: note = chr3:111988003-111988037
  misc_feature 1..34: note = Hypo
  source 1..34: mol_type = genomic DNA

SEQ ID NO: 122207 - DNA, 64 bp, Homo sapiens; identical to SEQ ID NO: 28283
  misc_feature 1..64: note = chr3:112052498-112052562
  misc_feature 1..64: note = Hyper
  source 1..64: mol_type = genomic DNA

SEQ ID NO: 122208 - DNA, 183 bp, Homo sapiens
  misc_feature 1..183: note = chr3:112930328-112930511
  misc_feature 1..183: note = Hyper
  source 1..183: mol_type = genomic DNA
cctcctcctcctcctcgcacggtaatgggaggctcctaggcaggagaagcaaaagaaggaattgtttgcgagttcagtcatccaaaaagcttcttccatatggagggaccgggtgcgctgggcgcggcgtcccctgcgttgtcctcctgctgccgcccccgcggccgccgctttctgccgcgg

SEQ ID NO: 122209 - DNA, 468 bp, Homo sapiens; identical to SEQ ID NO: 90004
  misc_feature 1..468: note = chr3:112930806-112931274
  misc_feature 1..468: note = Hyper
  source 1..468: mol_type = genomic DNA

SEQ ID NO: 122210 - DNA, 58 bp, Homo sapiens; identical to SEQ ID NO: 90005
  misc_feature 1..58: note = chr3:112931566-112931624
  misc_feature 1..58: note = Hyper
  source 1..58: mol_type = genomic DNA

SEQ ID NO: 122211 - DNA, 18 bp, Homo sapiens
  misc_feature 1..18: note = chr3:113557458-113557476
  misc_feature 1..18: note = Hypo
  source 1..18: mol_type = genomic DNA
tttcgcacattggggcag

SEQ ID NO: 122212 - DNA, 208 bp, Homo sapiens; identical to SEQ ID NO: 90007
  misc_feature 1..208: note = chr3:113866148-113866356
  misc_feature 1..208: note = Hypo
  source 1..208: mol_type = genomic DNA

SEQ ID NO: 122213 - DNA, 44 bp, Homo sapiens; identical to SEQ ID NO: 90008
  misc_feature 1..44: note = chr3:113958201-113958245
  misc_feature 1..44: note = Hypo
  source 1..44: mol_type = genomic DNA

SEQ ID NO: 122214 - DNA, 30 bp, Homo sapiens; identical to SEQ ID NO: 90009
  misc_feature 1..30: note = chr3:114973219-114973249
  misc_feature 1..30: note = Hypo
  source 1..30: mol_type = genomic DNA

SEQ ID NO: 122215 - DNA, 330 bp, Homo sapiens
  misc_feature 1..330: note = chr3:115231485-115231815
  misc_feature 1..330: note = Hyper
  source 1..330: mol_type = genomic DNA
ggggctgcagaagcccgctgcgcgcctcctggtttctatggagaccctgcttgatgtcaatggcggctccggagcgcagggaaacctaagcgtttgtatttaaatgagggaaagtgggggaaggggaagtaaaagaggaagggaacagaagagaggatggtagaggtgagcgggcgggtgttgaactctggggactagaaaaatccagctgcgttactcagtcatctcatgctcgcggagaaatcagaggaagcagcagcgggcagaggggtgtttatttcttgcgtgagaaatatccgacttctttctgacatccgggagtaagggaca

SEQ ID NO: 122216 - DNA, 314 bp, Homo sapiens; identical to SEQ ID NO: 90012
  misc_feature 1..314: note = chr3:115377639-115377953
  misc_feature 1..314: note = Hyper
  source 1..314: mol_type = genomic DNA

SEQ ID NO: 122217 - DNA, 76 bp, Homo sapiens; identical to SEQ ID NO: 90013
  misc_feature 1..76: note = chr3:115502397-115502473
  misc_feature 1..76: note = Hypo
  source 1..76: mol_type = genomic DNA

SEQ ID NO: 122218 - DNA, 71 bp, Homo sapiens; identical to SEQ ID NO: 39971
  misc_feature 1..71: note = chr3:115752446-115752517
  misc_feature 1..71: note = Hypo
  source 1..71: mol_type = genomic DNA

SEQ ID NO: 122219 - DNA, 21 bp, Homo sapiens
  misc_feature 1..21: note = chr3:115789599-115789620
  misc_feature 1..21: note = Hypo
  source 1..21: mol_type = genomic DNA
tgtacctgccgggcacggtgg

SEQ ID NO: 122220 - DNA, 281 bp, Homo sapiens; identical to SEQ ID NO: 90018
  misc_feature 1..281: note = chr3:116163708-116163989
  misc_feature 1..281: note = Hyper
  source 1..281: mol_type = genomic DNA

SEQ ID NO: 122221 - DNA, 47 bp, Homo sapiens; identical to SEQ ID NO: 90019
  misc_feature 1..47: note = chr3:116583118-116583165
  misc_feature 1..47: note = Hyper
  source 1..47: mol_type = genomic DNA

SEQ ID NO: 122222 - DNA, 148 bp, Homo sapiens; identical to SEQ ID NO: 39972
  misc_feature 1..148: note = chr3:116990241-116990389
  misc_feature 1..148: note = Hypo
  source 1..148: mol_type = genomic DNA

SEQ ID NO: 122223 - DNA, 164 bp, Homo sapiens; identical to SEQ ID NO: 90025
  misc_feature 1..164: note = chr3:117715479-117715643
  misc_feature 1..164: note = Hyper
  source 1..164: mol_type = genomic DNA

SEQ ID NO: 122224 - DNA, 944 bp, Homo sapiens
  misc_feature 1..944: note = chr3:117715763-117716707
  misc_feature 1..944: note = Hyper
  source 1..944: mol_type = genomic DNA
cacacacacacacacacacacacacacacacaagccctggcttctttccccatcaacaccgatgttgcagcaagtctgtccgcacaatcccgcacgcctcaggacccagcctgggcgcagagctggcagggcagggagcgcaccgcaggacttgtaaataaaccctgttccatccagaaccggagcgcttcttactccaccgaccaccccggagcccggcggcagggaggagggggcgcaaggggtcagggaatcctccccctaccttgcaatgagaagagggacaggaaaaagcccagcacccagacgctgtgcagccagtaggtcctcatgtctccgctgcgctcgatgctccctcgcgcgctcctgctctcgcctcttccgctcgcgctctctctagtaaaacgcgccgctcctttccctcggtttccctctgggttctcctggttccggcaacccggacagacaagcctcttgccgcacgacggccggatcccagaacagccttgctctcctcttcgggagcgcaagccaggggccgggatggacgctcgtagcccgtgcctggtgtaaacacaccgagcccccttgtccctcgagctctcccgctttcctgcttcctatcctcctctccctcactcccctgcagcttcaactaaatgcgatgtacttaaacaagcagcgccttataggaccgcgaaccgagccgaaagggccccgctactgccatctagtgctcacagaacggcatcgccgcggctcttcttcgctgtgtgtctgtgccaagtctatccaacgccgccaaagtcccctctgctctcagcaaacacaggtgaagctcttgccttcttaaatccttgacttgaccttgctgtcccataagtcctgaatttctccttttcacgaggaagctcttggaacatgctagccgcacatcttcatca

SEQ ID NO: 122225 - DNA, 164 bp, Homo sapiens; identical to SEQ ID NO: 90029
  misc_feature 1..164: note = chr3:118864613-118864777
  misc_feature 1..164: note = Hypo
  source 1..164: mol_type = genomic DNA

SEQ ID NO: 122226 - DNA, 37 bp, Homo sapiens; identical to SEQ ID NO: 14558
  misc_feature 1..37: note = chr3:118976384-118976421
  misc_feature 1..37: note = Hypo
  source 1..37: mol_type = genomic DNA

SEQ ID NO: 122227 - DNA, 30 bp, Homo sapiens; identical to SEQ ID NO: 39974
  misc_feature 1..30: note = chr3:119055204-119055234
  misc_feature 1..30: note = Hypo
  source 1..30: mol_type = genomic DNA

SEQ ID NO: 122228 - DNA, 123 bp, Homo sapiens; identical to SEQ ID NO: 90032
  misc_feature 1..123: note = chr3:119298873-119298996
  misc_feature 1..123: note = Hyper
  source 1..123: mol_type = genomic DNA

SEQ ID NO: 122229 - DNA, 294 bp, Homo sapiens; identical to SEQ ID NO: 90033
  misc_feature 1..294: note = chr3:119421788-119422082
  misc_feature 1..294: note = Hyper
  source 1..294: mol_type = genomic DNA

SEQ ID NO: 122230 - DNA, 173 bp, Homo sapiens; identical to SEQ ID NO: 90034
  misc_feature 1..173: note = chr3:119517629-119517802
  misc_feature 1..173: note = Hypo
  source 1..173: mol_type = genomic DNA

SEQ ID NO: 122231 - DNA, 30 bp, Homo sapiens; identical to SEQ ID NO: 90035
  misc_feature 1..30: note = chr3:119771793-119771823
  misc_feature 1..30: note = Hypo
  source 1..30: mol_type = genomic DNA

SEQ ID NO: 122232 - DNA, 88 bp, Homo sapiens; identical to SEQ ID NO: 90036
  misc_feature 1..88: note = chr3:119815404-119815492
  misc_feature 1..88: note = Hypo
  source 1..88: mol_type = genomic DNA

SEQ ID NO: 122233 - DNA, 180 bp, Homo sapiens; identical to SEQ ID NO: 90037
  misc_feature 1..180: note = chr3:119815732-119815912
  misc_feature 1..180: note = Hypo
  source 1..180: mol_type = genomic DNA

SEQ ID NO: 122234 - DNA, 18 bp, Homo sapiens
  misc_feature 1..18: note = chr3:119817451-119817469
  misc_feature 1..18: note = Hypo
  source 1..18: mol_type = genomic DNA
aaacgctaggattactgg

SEQ ID NO: 122235 - DNA, 611 bp, Homo sapiens
  misc_feature 1..611: note = chr3:120003742-120004353
  misc_feature 1..611: note = Hyper
  source 1..611: mol_type = genomic DNA
tgagagtttctttaccggttccaaacaaactgcccagattctggaaagggagagaaagcccctccccctttccactttcacttaataattaagtgtttgaagttttgtggatccttaaggtcgctgtgctcacctcatcagcgtcggaccgccgagaagcgccaagcccgctgctatgtgcaggacgcccacggtcccccggcgtctcgcgcgttcgcggggctggaaggggcgggaaggggcgggccggggcagagacaggggcccgcgcccatcgccgcgccgggagcctggcgtggaggcggcgggacggcggcgcaggcctctgaggtgtgcgcggggcgccgggcgcctctggccggggcactggctgagccacgcctgcccgcccctccctggcgccgcccgcgtggcgcgcctcgaccctgctctcccgcgagggccgggagggctccgggaccttgcagactccacgcgcctcacggctcctccagctcctcggatctttctccttgcgtcgccgccgagtcccctggggcggccccgcctccggccgtctcctcagagaccttccctggggggcgccttcccctcagcgccccttcccgggc

SEQ ID NO: 122236 - DNA, 611 bp, Homo sapiens
  misc_feature 1..611: note = chr3:120169620-120170231
  misc_feature 1..611: note = Hyper
  source 1..611: mol_type = genomic DNA
gaaggcgccgggccccgcgctgacctgggaaacttgctcgggtcccgcaggctcgctccggccgcccaagcacccccggccgcccgaagagtccggcctccgcgccgtgcgccctgcgctcaccgtggtctggtccaggtctcctgggggcgcggggcaggacggcggcagcgagctgtaagcggaggtgggagctccgccgatcgccagcctcggaggaaatgcgacctcccctcgccgccccttaagacctctccttccccgcctgcctgcccccccagctcctccccattctcctcccccttctgctgcagcggcccccgcggctcccgctccccctccttccgacccctgctccggggagcccgcgggagtcctggcgccgccgaacccctctctccgcacggtccctcgtccggcgccccttcggccccctggacgtggagcggaggcagagggggtgtcccgtgggtccctgccacaaaggggtagggggaagggaaaccccaccccgggaggggctgctggctggcggcggcccgggcgggctgcggcggtggccaggtgggcggtgccgtggggggcccgggaaggtccgggactggaacctg

SEQ ID NO: 122237 - DNA, 393 bp, Homo sapiens; identical to SEQ ID NO: 90047
  misc_feature 1..393: note = chr3:120626865-120627258
  misc_feature 1..393: note = Hyper
  source 1..393: mol_type = genomic DNA

SEQ ID NO: 122238 - DNA, 693 bp, Homo sapiens; identical to SEQ ID NO: 90048
  misc_feature 1..693: note = chr3:120627318-120628011
  misc_feature 1..693: note = Hyper
  source 1..693: mol_type = genomic DNA

SEQ ID NO: 122239 - DNA, 30 bp, Homo sapiens; identical to SEQ ID NO: 28305
  misc_feature 1..30: note = chr3:120628354-120628384
  misc_feature 1..30: note = Hyper
  source 1..30: mol_type = genomic DNA

SEQ ID NO: 122240 - DNA, 39 bp, Homo sapiens; identical to SEQ ID NO: 90050
  misc_feature 1..39: note = chr3:121265940-121265979
  misc_feature 1..39: note = Hypo
  source 1..39: mol_type = genomic DNA

SEQ ID NO: 122241 - DNA, 28 bp, Homo sapiens
  misc_feature 1..28: note = chr3:121280181-121280209
  misc_feature 1..28: note = Hypo
  source 1..28: mol_type = genomic DNA
atgcccagggttggccgggcgtggtggc

SEQ ID NO: 122242 - DNA, 30 bp, Homo sapiens; identical to SEQ ID NO: 39979
  misc_feature 1..30: note = chr3:121438641-121438671
  misc_feature 1..30: note = Hypo
  source 1..30: mol_type = genomic DNA

SEQ ID NO: 122243 - DNA, 95 bp, Homo sapiens; identical to SEQ ID NO: 90053
  misc_feature 1..95: note = chr3:121563924-121564019
  misc_feature 1..95: note = Hypo
  source 1..95: mol_type = genomic DNA

SEQ ID NO: 122244 - DNA, 269 bp, Homo sapiens; identical to SEQ ID NO: 90054
  misc_feature 1..269: note = chr3:121637808-121638077
  misc_feature 1..269: note = Hypo
  source 1..269: mol_type = genomic DNA

SEQ ID NO: 122245 - DNA, 931 bp, Homo sapiens
  misc_feature 1..931: note = chr3:121902727-121903658
  misc_feature 1..931: note = Hyper
  source 1..931: mol_type = genomic DNA
aaattgtgccaccctcggcacagagaacgttggtggcgtcgtaagcgccctaagcttctttccatcgccaaggagtaggggtcagggaagaggacagcgggaacaggatttgagagccgggaacccctggctcggcacgggagagggcaggagaggacctaagcgcggggctcgccgtctgctggggacccgagccggcctgtggccctcggggaaccgaagacgcgccctcagcgaccctgaagagtcagctaagctctctgcgggctaaggagacggtgaaggaaccgggactaactggggtaggggttagaaggcagcccgcgagtgggctacgaggggagctgggctcggcagttggggaccccgagggggcaagcgggcggggagcaggagaggggcggagctccggggccggggccggggccgcagcggccgcccagagggtctgcgggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggccggagctgcctctgtgcgagggagccctggccgcggcgcaggtaggaccggggaacccaaggagggcgggaggaaagcgcccctggtgggggaggggccgtggcggggtctgggggccaagggctccgggccgaacgaggggcacacgccggagcagctccagcctgggagcattgggcgtgaacgtgggggaaagtagggaccagattacaggatcaaggctttccccggctcagaactggattgttcagtgcccctagaaggggcagcgggtcgcccacgcgaatgaacgggagcgcgcaccaaaacgcctgctgttggta

SEQ ID NO: 122246 - DNA, 30 bp, Homo sapiens; identical to SEQ ID NO: 39982
  misc_feature 1..30: note = chr3:121980857-121980887
  misc_feature 1..30: note = Hypo
  source 1..30: mol_type = genomic DNA

SEQ ID NO: 122247 - DNA, 144 bp, Homo sapiens; identical to SEQ ID NO: 90059
  misc_feature 1..144: note = chr3:122100925-122101069
  misc_feature 1..144: note = Hypo
  source 1..144: mol_type = genomic DNA

SEQ ID NO: 122248 - DNA, 26 bp, Homo sapiens
  misc_feature 1..26: note = chr3:122231241-122231267
  misc_feature 1..26: note = Hypo
  source 1..26: mol_type = genomic DNA
gtgaagaaacttctacgagaaccact

SEQ ID NO: 122249 - DNA, 35 bp, Homo sapiens; identical to SEQ ID NO: 90061
  misc_feature 1..35: note = chr3:122234211-122234246
  misc_feature 1..35: note = Hypo
  source 1..35: mol_type = genomic DNA

SEQ ID NO: 122250 - DNA, 94 bp, Homo sapiens; identical to SEQ ID NO: 90062
  misc_feature 1..94: note = chr3:122234546-122234640
  misc_feature 1..94: note = Hypo
  source 1..94: mol_type = genomic DNA

SEQ ID NO: 122251 - DNA, 20 bp, Homo sapiens
  misc_feature 1..20: note = chr3:122279526-122279546
  misc_feature 1..20: note = Hypo
  source 1..20: mol_type = genomic DNA
ctggtcgaaatgatttctaa

SEQ ID NO: 122252 - DNA, 367 bp, Homo sapiens
  misc_feature 1..367: note = chr3:122296447-122296814
  misc_feature 1..367: note = Hyper
  source 1..367: mol_type = genomic DNA
cagagaaaagaagttcgaggcacaagcctgttgggtggggcgcaactgcagtcccagcgagctgaggatggctgcgccaggcccccttcctgccgctgctctgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatggtgaggagcgcgggggacgggtgcgggaaggggacagcagggctgagcctggggcccgcaagacccagcagcccgagcgggcgcagagaccccacgccacgcacaaccctctct

SEQ ID NO: 122253 - DNA, 22 bp, Homo sapiens
  misc_feature 1..22: note = chr3:122511767-122511789
  misc_feature 1..22: note = Hypo
  source 1..22: mol_type = genomic DNA
aactattcgctccttgaagcat

SEQ ID NO: 122254 - DNA, 25 bp, Homo sapiens
  misc_feature 1..25: note = chr3:122573648-122573673
  misc_feature 1..25: note = Hypo
  source 1..25: mol_type = genomic DNA
gactcaaaggctgggcgcggtggct

SEQ ID NO: 122255 - DNA, 158 bp, Homo sapiens; identical to SEQ ID NO: 90067
  misc_feature 1..158: note = chr3:122702275-122702433
  misc_feature 1..158: note = Hypo
  source 1..158: mol_type = genomic DNA

SEQ ID NO: 122256 - DNA, 338 bp, Homo sapiens; identical to SEQ ID NO: 90068
  misc_feature 1..338: note = chr3:122745310-122745648
  misc_feature 1..338: note = Hyper
  source 1..338: mol_type = genomic DNA

SEQ ID NO: 122257 - DNA, 281 bp, Homo sapiens
  misc_feature 1..281: note = chr3:122745900-122746181
  misc_feature 1..281: note = Hyper
  source 1..281: mol_type = genomic DNA
gtgctgtttactagccggccctctctgagcctccatctccgcacctctgtccctccgtccctcagcctcactcgtccgtctccttctccaggcctgggtcccgggtccccatcgccgctgcagcccagatgcgccgaccacagccctggcagggcccagtgcaacccggacccaagctggctggcggcgggaacgcagcagcgatgagggctctcaagccgaggtggcagcgggaggcgcggaagccaggggaccccctgtcctcccgcccgcagcctcac

SEQ ID NO: 122258 - DNA, 141 bp, Homo sapiens; identical to SEQ ID NO: 90070
  misc_feature 1..141: note = chr3:122746828-122746969
  misc_feature 1..141: note = Hyper
  source 1..141: mol_type = genomic DNA

SEQ ID NO: 122259 - DNA, 30 bp, Homo sapiens; identical to SEQ ID NO: 90071
  misc_feature 1..30: note = chr3:123123913-123123943
  misc_feature 1..30: note = Hypo
  source 1..30: mol_type = genomic DNA

SEQ ID NO: 122260 - DNA, 1160 bp, Homo sapiens
  misc_feature 1..1160: note = chr3:123166942-123168102
  misc_feature 1..1160: note = Hyper
  source 1..1160: mol_type = genomic DNA
ctccgtcccgcccgccgaggcagccgccgccgccgagccgccgccgccgcccgcagggggcgcccgggtgctgcccccgctggccgcgccccgccgctgccggcggctgccgcgaccgcagtcgtcgccgccgcgctcctgccaggcggacttggagcggaagctgaagccgaagcccccggccagggggtcgtcaccgctcagcggaggatcgtcgtcgtcgtcgctgcgccagcggctggccaggcgctgctgctgctgcggggtcaccgcccccccgggtttcttggtggagccgcgggcagagcccccgggggcatgggggtagccattcgcgcgggaatcggcctcgccccacgcagagcggtgttcggggcctccccggggcgccggcgccgcagtcttctgcgccgcgtagcccggggggctcacgcttttggagccggacatccccccctcggcctcgtcgtctccttcctcctcccccggaagccgggccgggggtctccaaggggagggcggacggccgagcagggggaccaggctagggtcacacgtcgggggcggcccggggccctgcgctgcagcggggcatcttggcacccccgtcctgagcggaggaggagggcacagccccgaggtgagaagtagctgaggatccgcgtcagaagtcccaggtccgaaatggagttgcctccgaggtggggtcgcagggactggtctggctgctgctgcgccgcacgcggagagacgtccgggatcctggctcgcgtcgagctcgacgagggccggagttgcggacgagacgggacggagtggtgtccttgcgggcggtgcctcctcgggccggcagtgcccgggcgcggcgctcgctgattccgcctaagcggagcccagctgctctcggggctcggcggcggcgagggcggctcggcgggggtcccggcgaagagacactgcgggtgcgctttcctcgcagcggactgggagcgactgggaggtgcgggcgccagccagcattattttcttacgaggggtggggaggtgggatgggaggtggagaggacgggggagggggcgacgggcggagcaacagctccggagccccgggggggagggtcctggagcccgggggggccgttgcccgcatcccccacctc

SEQ ID NO: 122261 - DNA, 367 bp, Homo sapiens
  misc_feature 1..367: note = chr3:123168541-123168908
  misc_feature 1..367: note = Hyper
  source 1..367: mol_type = genomic DNA
gcgccatgcacgcttcgggccctgcgccgctccggccgctcgcgccgctcctcccttctcgcccgctcgccgccgccggagagccctccgcatcccctcctcccgctgcctccccgccccccgcgccgcccgggcctcggctcacagccgcgcgaggccgcctccgcccccggcctggccatggccccagcctcggcgccccgcgggcatcctcaggcctggccgcgggcaccccagttccccttcctcacctaaaattctcgctgcgcccctccctccctgggactaggagccgcatccagcctgcggtcccgtcaccagacctgggtggagcgcggtcttcccccgcccccggccagggctccag

SEQ ID NO: 122262 - DNA, 962 bp, Homo sapiens
  misc_feature 1..962: note = chr3:123602612-123603574
  misc_feature 1..962: note = Hyper
  source 1..962: mol_type = genomic DNA
gccaggtctggcactcgcgggccgccttccccgccctaccttcccggaatcacatttgggctggaaggaccttcacgtggcacccccttcccagaggccgtcaccgagtcctctagcgagggtctgggagctgggagaagggtccgcttctcctccgcccctcaaatcaaaggcacccccttcggatgattcctagaaaggcaatcgcatcagtgtccccaagcacttcatctccccaaaagaaaactcgtgcagcctggcgtcactggggtcgtctccttacgcccctgactcctcgccgcaccccggggcccctctccattaggggagtcgggaggcacagacggtgggggtcccagcccccacccagaactcccaccctcggagccttgacttccagggcccgcgcctggacaaaagcatggggcgggctcactcacccgcgcggcgaaggcggcccgggagccggggcaccggcgctcggcggggcgccccggccgcaggcgcacagcgcgggctccgagctcgctcagcgccctgctgccgaccgggcggcgcggggagcccgcgaggcgcgtccgggactgggcagggcggggcggggcggggcggggcgggggtgagcgaaccggcgagagagagagcaagtgggagagcggagagcggacgcgcgctgaggagagcgagtgagagcgcggcgctacggggtcaggactcaaaccacccgctccagcccccatgcactgatttgcatgacatttgcatagcgctcggggagtggacctgctgcccttcccgccacgcccacccgccttctgcctcggagtccggagcggagaatccgcagccaaacctagcgccagacccgggcccccctcgcacttatcctgcaccgccccagttaactcctcgcaggcggcggtcagcgggctggtactgtcttggtgcgtgtcttagtccta

SEQ ID NO: 122263 - DNA, 188 bp, Homo sapiens; identical to SEQ ID NO: 90079
  misc_feature 1..188: note = chr3:123752385-123752573
  misc_feature 1..188: note = Hyper
  source 1..188: mol_type = genomic DNA

SEQ ID NO: 122264 - DNA, 342 bp, Homo sapiens; identical to SEQ ID NO: 90080
  misc_feature 1..342: note = chr3:123752820-123753162
  misc_feature 1..342: note = Hyper
  source 1..342: mol_type = genomic DNA

SEQ ID NO: 122265 - DNA, 157 bp, Homo sapiens; identical to SEQ ID NO: 90081
  misc_feature 1..157: note = chr3:124606585-124606742
  misc_feature 1..157: note = Hyper
  source 1..157: mol_type = genomic DNA

SEQ ID NO: 122266 - DNA, 312 bp, Homo sapiens; identical to SEQ ID NO: 90082
  misc_feature 1..312: note = chr3:124773620-124773932
  misc_feature 1..312: note = Hyper
  source 1..312: mol_type = genomic DNA

SEQ ID NO: 122267 - DNA, 30 bp, Homo sapiens; identical to SEQ ID NO: 90083
  misc_feature 1..30: note = chr3:124875073-124875103
  misc_feature 1..30: note = Hypo
  source 1..30: mol_type = genomic DNA

SEQ ID NO: 122268 - DNA, 230 bp, Homo sapiens; identical to SEQ ID NO: 90084
  misc_feature 1..230: note = chr3:125366752-125366982
  misc_feature 1..230: note = Hypo
  source 1..230: mol_type = genomic DNA

SEQ ID NO: 122269 - DNA, 28 bp, Homo sapiens
  misc_feature 1..28: note = chr3:125434714-125434742
  misc_feature 1..28: note = Hypo
  source 1..28: mol_type = genomic DNA
cgcccctggatatgacgatggacatcgc

SEQ ID NO: 122270 - DNA, 39 bp, Homo sapiens; identical to SEQ ID NO: 14567
  misc_feature 1..39: note = chr3:125785793-125785832
  misc_feature 1..39: note = Hypo
  source 1..39: mol_type = genomic DNA

SEQ ID NO: 122271 - DNA, 978 bp, Homo sapiens; identical to SEQ ID NO: 90088
  misc_feature 1..978: note = chr3:125898647-125899625
  misc_feature 1..978: note = Hyper
  source 1..978: mol_type = genomic DNA

SEQ ID NO: 122272 - DNA, 66 bp, Homo sapiens; identical to SEQ ID NO: 90089
  misc_feature 1..66: note = chr3:125899826-125899892
  misc_feature 1..66: note = Hyper
  source 1..66: mol_type = genomic DNA

SEQ ID NO: 122273 - DNA, 54 bp, Homo sapiens; identical to SEQ ID NO: 90090
  misc_feature 1..54: note = chr3:125931966-125932020
  misc_feature 1..54: note = Hyper
  source 1..54: mol_type = genomic DNA

SEQ ID NO: 122274 - DNA, 371 bp, Homo sapiens; identical to SEQ ID NO: 90091
  misc_feature 1..371: note = chr3:125932252-125932623
  misc_feature 1..371: note = Hyper
  source 1..371: mol_type = genomic DNA

SEQ ID NO: 122275 - DNA, 231 bp, Homo sapiens; identical to SEQ ID NO: 90093
  misc_feature 1..231: note = chr3:125986509-125986740
  misc_feature 1..231: note = Hyper
  source 1..231: mol_type = genomic DNA

SEQ ID NO: 122276 - DNA, 470 bp, Homo sapiens; identical to SEQ ID NO: 90094
  misc_feature 1..470: note = chr3:126075183-126075653
  misc_feature 1..470: note = Hyper
  source 1..470: mol_type = genomic DNA

SEQ ID NO: 122277 - DNA, 104 bp, Homo sapiens; identical to SEQ ID NO: 90095
  misc_feature 1..104: note = chr3:126075959-126076063
  misc_feature 1..104: note = Hyper
  source 1..104: mol_type = genomic DNA

SEQ ID NO: 122278 - DNA, 114 bp, Homo sapiens; identical to SEQ ID NO: 90096
  misc_feature 1..114: note = chr3:126076540-126076654
  misc_feature 1..114: note = Hyper
  source 1..114: mol_type = genomic DNA

SEQ ID NO: 122279 - DNA, 333 bp, Homo sapiens
  misc_feature 1..333: note = chr3:126108034-126108367
  misc_feature 1..333: note = Hyper
  source 1..333: mol_type = genomic DNA
accgcgccccgcctgcgagctaggaactgtggggacccggcagcgggcgagcgagcccaggtcgcggcagcactgcctgcgcggtcgtcttgacgcctgaccagggccggttttcaacttgtttacaagcctgcgtcaccgggaacctttcaccgccgcctgggacaaaaggttcctctttgtaagtcccttctgggcagaaaggggattcgccgcccggcgcgctgacggtgcggggcgccacgccgtggcggatgcggacagcgcgcggccggttcgcccgtctgccccctagcgccctgctcttcccgccgagcgcgtagtctgcccata

SEQ ID NO: 122280 - DNA, 500 bp, Homo sapiens
  misc_feature 1..500: note = chr3:126113459-126113959
  misc_feature 1..500: note = Hyper
  source 1..500: mol_type = genomic DNA
cttcagtgcttggcacgtggcgaataaaccaatcaggatgaaaggagccaacccaagtgcggagtgttgaacctcagaggaagaaacccgcgttcaccaggcccaggcctgggccaggcgctgtcctggcggcgtcagggaggacatcgtgcccagagctcggacccagcagcccggccccgcgccctccctgtcccgcggcccgcaggcccagccctcaagcgcccagcctccgcggcctttgtggcgtcacagccagcctgaagaatggttgccttggagacgtaaacccaagagccctgctcctggagctgagaactgcagcgcggaggcttcggagcgagccggggcagtcggggtcggtgggtgcgctcgcggtccggggagagggggcgcgcggggtccgtgagggcgcgtgggggcggcggcaggggtgcgaaaccagggcccgaggggcgcgcgtggccgggagcggacttgcaaggcgccttccaaggctg

SEQ ID NO: 122281 - DNA, 126 bp, Homo sapiens; identical to SEQ ID NO: 90101
  misc_feature 1..126: note = chr3:126134579-126134705
  misc_feature 1..126: note = Hypo
  source 1..126: mol_type = genomic DNA

SEQ ID NO: 122282 - DNA, 51 bp, Homo sapiens; identical to SEQ ID NO: 90102
  misc_feature 1..51: note = chr3:126138969-126139020
  misc_feature 1..51: note = Hypo
  source 1..51: mol_type = genomic DNA

SEQ ID NO: 122283 - DNA, 167 bp, Homo sapiens; identical to SEQ ID NO: 39993
  misc_feature 1..167: note = chr3:126195886-126196053
  misc_feature 1..167: note = Hypo
  source 1..167: mol_type = genomic DNA

SEQ ID NO: 122284 - DNA, 30 bp, Homo sapiens; identical to SEQ ID NO: 90104
  misc_feature 1..30: note = chr3:126228677-126228707
  misc_feature 1..30: note = Hypo
  source 1..30: mol_type = genomic DNA

SEQ ID NO: 122285 - DNA, 197 bp, Homo sapiens; identical to SEQ ID NO: 90105
  misc_feature 1..197: note = chr3:126242861-126243058
  misc_feature 1..197: note = Hyper
  source 1..197: mol_type = genomic DNA

SEQ ID NO: 122286 - DNA, 76 bp, Homo sapiens; identical to SEQ ID NO: 90106
  misc_feature 1..76: note = chr3:126243385-126243461
  misc_feature 1..76: note = Hyper
  source 1..76: mol_type = genomic DNA

SEQ ID NO: 122287 - DNA, 34 bp, Homo sapiens; identical to SEQ ID NO: 90107
  misc_feature 1..34: note = chr3:126271443-126271477
  misc_feature 1..34: note = Hypo
  source 1..34: mol_type = genomic DNA

SEQ ID NO: 122288 - DNA, 69 bp, Homo sapiens; identical to SEQ ID NO: 90108
  misc_feature 1..69: note = chr3:126373464-126373533
  misc_feature 1..69: note = Hyper
  source 1..69: mol_type = genomic DNA

SEQ ID NO: 122289 - DNA, 72 bp, Homo sapiens; identical to SEQ ID NO: 28334
  misc_feature 1..72: note = chr3:126373752-126373824
  misc_feature 1..72: note = Hyper
  source 1..72: mol_type = genomic DNA

SEQ ID NO: 122290 - DNA, 21 bp, Homo sapiens
  misc_feature 1..21: note = chr3:126374476-126374497
  misc_feature 1..21: note = Hypo
  source 1..21: mol_type = genomic DNA
agtgactgagttagccggtca

SEQ ID NO: 122291 - DNA, 250 bp, Homo sapiens; identical to SEQ ID NO: 90112
  misc_feature 1..250: note = chr3:126756255-126756505
  misc_feature 1..250: note = Hypo
  source 1..250: mol_type = genomic DNA

SEQ ID NO: 122292 - DNA, 30 bp, Homo sapiens; identical to SEQ ID NO: 90113
  misc_feature 1..30: note = chr3:126848530-126848560
  misc_feature 1..30: note = Hypo
  source 1..30: mol_type = genomic DNA

SEQ ID NO: 122293 - DNA, 30 bp, Homo sapiens; identical to SEQ ID NO: 90114
  misc_feature 1..30: note = chr3:126853082-126853112
  misc_feature 1..30: note = Hypo
  source 1..30: mol_type = genomic DNA

SEQ ID NO: 122294 - DNA, 89 bp, Homo sapiens; identical to SEQ ID NO: 90115
  misc_feature 1..89: note = chr3:126854032-126854121
  misc_feature 1..89: note = Hypo
  source 1..89: mol_type = genomic DNA

SEQ ID NO: 122295 - DNA, 422 bp, Homo sapiens
  misc_feature 1..422: note = chr3:126854425-126854847
  misc_feature 1..422: note = Hyper
  source 1..422: mol_type = genomic DNA
tatcgcgcggacggtcgctcttcttcacgtaattggagaaacttttcccattacccgctgtctctgcgaggcggctctcccgcccccgcaccctccccgcggcccctctgccgtcacgcgggttcttttcctcctccttaagaggctgacctaatttccactctttgtcattttctcccgaccaaactcggagtcggctttctccaggagctgctaggagcctgggctcccactgagcaatccagagcagcgtctccatttcctgggctctccaggccatcgcagcccccggccctgccacgcaccggcgcagcccctgcactcgggcggccctgcctcggcgggatgagttcgtccgaggtgcatacaagatgagaaacagagcgccgggttgcagtgccaggcaccgagctgggctcccc

SEQ ID NO: 122296 - DNA, 86 bp, Homo sapiens; identical to SEQ ID NO: 90118
  misc_feature 1..86: note = chr3:127176157-127176243
  misc_feature 1..86: note = Hyper
  source 1..86: mol_type = genomic DNA

SEQ ID NO: 122297 - DNA, 30 bp, Homo sapiens; identical to SEQ ID NO: 90119
  misc_feature 1..30: note = chr3:127177694-127177724
  misc_feature 1..30: note = Hyper
  source 1..30: mol_type = genomic DNA

SEQ ID NO: 122298 - DNA, 30 bp, Homo sapiens; identical to SEQ ID NO: 90120
  misc_feature 1..30: note = chr3:127258523-127258553
  misc_feature 1..30: note = Hypo
  source 1..30: mol_type = genomic DNA

SEQ ID NO: 122299 - DNA, 46 bp, Homo sapiens; identical to SEQ ID NO: 90121
  misc_feature 1..46: note = chr3:127268781-127268827
  misc_feature 1..46: note = Hypo
  source 1..46: mol_type = genomic DNA

SEQ ID NO: 122300 - DNA, 233 bp, Homo sapiens; identical to SEQ ID NO: 90122
  misc_feature 1..233: note = chr3:127318268-127318501
  misc_feature 1..233: note = Hypo
  source 1..233: mol_type = genomic DNA

SEQ ID NO: 122301 - DNA, 263 bp, Homo sapiens; identical to SEQ ID NO: 90123
  misc_feature 1..263: note = chr3:127347860-127348123
  misc_feature 1..263: note = Hyper
  source 1..263: mol_type = genomic DNA

SEQ ID NO: 122302 - DNA, 146 bp, Homo sapiens; identical to SEQ ID NO: 90124
  misc_feature 1..146: note = chr3:127390301-127390447
  misc_feature 1..146: note = Hypo
  source 1..146: mol_type = genomic DNA

SEQ ID NO: 122303 - DNA, 77 bp, Homo sapiens; identical to SEQ ID NO: 39994
  misc_feature 1..77: note = chr3:127394832-127394909
  misc_feature 1..77: note = Hypo
  source 1..77: mol_type = genomic DNA

SEQ ID NO: 122304 - DNA, 85 bp, Homo sapiens; identical to SEQ ID NO: 90126
  misc_feature 1..85: note = chr3:127395891-127395976
  misc_feature 1..85: note = Hypo
  source 1..85: mol_type = genomic DNA

SEQ ID NO: 122305 - DNA, 30 bp, Homo sapiens; identical to SEQ ID NO: 90127
  misc_feature 1..30: note = chr3:127505428-127505458
  misc_feature 1..30: note = Hypo
  source 1..30: mol_type = genomic DNA

SEQ ID NO: 122306 - DNA, 68 bp, Homo sapiens; identical to SEQ ID NO: 39996
  misc_feature 1..68: note = chr3:127534964-127535032
  misc_feature 1..68: note = Hypo
  source 1..68: mol_type = genomic DNA

SEQ ID NO: 122307 - DNA, 136 bp, Homo sapiens; identical to SEQ ID NO: 90129
  misc_feature 1..136: note = chr3:127536709-127536845
  misc_feature 1..136: note = Hypo
  source 1..136: mol_type = genomic DNA

SEQ ID NO: 122308 - DNA, 30 bp, Homo sapiens; identical to SEQ ID NO: 90130
  misc_feature 1..30: note = chr3:127570998-127571028
  misc_feature 1..30: note = Hypo
  source 1..30: mol_type = genomic DNA

SEQ ID NO: 122309 - DNA, 403 bp, Homo sapiens
  misc_feature 1..403: note = chr3:127633909-127634312
  misc_feature 1..403: note = Hyper
  source 1..403: mol_type = genomic DNA
agtgtaaaagactaacgggaacaccggcatttttcaaagctcgatttccaaacctcctttaaacacttgtccccatcccctccccgcaggccttcagtcgctctggcacgcgggccagcgcgggaacactctgcgcaggcgcacagcgttccgcgggggacgctcagtagggtacgggacgcgcgcggggagaccctgtgcagcgacaccggggctgtagtcgccgtctggaaccagcgcgggaataggtgcgcaggcgcacagtggctggagggcagcggcggcgtggtctcgggccacttccaagcagagggcagcacctgtcccctcggaggcgctgccagcgccctccctcctcctccgcagggcgcgggacctctatttatatcgcccagccagcaca

SEQ ID NO: 122310 - DNA, 52 bp, Homo sapiens; identical to SEQ ID NO: 39998
  misc_feature 1..52: note = chr3:127637657-127637709
  misc_feature 1..52: note = Hypo
  source 1..52: mol_type = genomic DNA

SEQ ID NO: 122311 - DNA, 43 bp, Homo sapiens; identical to SEQ ID NO: 90134
  misc_feature 1..43: note = chr3:127731040-127731083
  misc_feature 1..43: note = Hypo
  source 1..43: mol_type = genomic DNA

SEQ ID NO: 122312 - DNA, 467 bp, Homo sapiens; identical to SEQ ID NO: 90135
  misc_feature 1..467: note = chr3:127794393-127794860
  misc_feature 1..467: note = Hyper
  source 1..467: mol_type = genomic DNA

SEQ ID NO: 122313 - DNA, 30 bp, Homo sapiens
  misc_feature 1..30: note = chr3:127795148-127795178
  misc_feature 1..30: note = Hyper
  source 1..30: mol_type = genomic DNA
cccaacagcatgacccgacccagggacgaa

SEQ ID NO: 122314 - DNA, 90 bp, Homo sapiens; identical to SEQ ID NO: 90137
  misc_feature 1..90: note = chr3:128102325-128102415
  misc_feature 1..90: note = Hypo
  source 1..90: mol_type = genomic DNA

SEQ ID NO: 122315 - DNA, 38 bp, Homo sapiens; identical to SEQ ID NO: 90138
  misc_feature 1..38: note = chr3:128145121-128145159
  misc_feature 1..38: note = Hyper
  source 1..38: mol_type = genomic DNA

SEQ ID NO: 122316 - DNA, 33 bp, Homo sapiens; identical to SEQ ID NO: 90139
  misc_feature 1..33: note = chr3:128152132-128152165
  misc_feature 1..33: note = Hyper
  source 1..33: mol_type = genomic DNA

SEQ ID NO: 122317 - DNA, 383 bp, Homo sapiens
  misc_feature 1..383: note = chr3:128202325-128202708
  misc_feature 1..383: note = Hyper
  source 1..383: mol_type = genomic DNA
cgaggagcttgtgagcggggctgtcggggagggctgagccacaaggaaaagtacttcatggccctatttttaaaaaagagctaagcagaggccagaggacaggagtccggcccgtggacactcaacttcggggatcccggagcagagtggggtggcgcaagggtgcccggtgggctccctatacccgaggaggaaatctggcccgaaagaatctggccagaaagagagacgaccccaactgacatcccagtgcttttcatgataaaagaggatttcaagcggcaaagcgtctgcatttgaaggagtttttttcccctgtaattaaccgccagctcctgcccagcagccccctcccagccacctgtgcccgctcctaccagtct

SEQ ID NO: 122318 - DNA, 30 bp, Homo sapiens; identical to SEQ ID NO: 90141
  misc_feature 1..30: note = chr3:128205103-128205133
  misc_feature 1..30: note = Hyper
  source 1..30: mol_type = genomic DNA

SEQ ID NO: 122319 - DNA, 1961 bp, Homo sapiens; identical to SEQ ID NO: 90142
  misc_feature 1..1961: note = chr3:128205402-128207363
  misc_feature 1..1961: note = Hyper
  source 1..1961: mol_type = genomic DNA

SEQ ID NO: 122320 - DNA, 1686 bp, Homo sapiens
  misc_feature 1..1686: note = chr3:128207713-128209399
  misc_feature 1..1686: note = Hyper
  source 1..1686: mol_type = genomic DNA
ggggagacggaggctcgaagggagccccgggccgaggagggaggtccaggacaaaggcattttgggggacctagacaggtgccgagtactggggggactcaacagcgtcctccagccctcttccctgttgggcccgaggctcccggggtagatgtccagagggcccccaggtgggtcgggggcaggaggagggctggggtcccggccacccccgggagagtgggggaggggcggcgggattgacagtcggtaattgggtaactggaggcggcttctccggccgggcggccccgccaccgcgacgccgagcccctgacgtcacccgattcgccaggaaatgaactttttaataatccgaggagggaggaaagccctcggtcccctcggctccgggggcgcccggctgggcccagctccgcgggcgcgcccccgtcaccccctcccaggccagttcagggcagcgccaaggggccgcgggctcaggctgaggcctcctcctgcctaggcgtctggcgtccgtttgtctgtccgaggcctcagcgcaggtaaagcgcggggctggggggcgcagagctccattgggctgggaaccagcgcgtctcgtgcccttgggggacccgcctgcccgagccgcctgctaagcctcccgctcccctccacgctggagcgcgcggagcccggtctgctcggaactccactctgcgggagcggaggccggcgccagcccgggaagccgcgcagggggcgggaggccgagcgcgaggcccttggcgccgggcctccgcggccaggccgggcaggtgagcagtctccgtgcctcccggttggcgttcccctcaacgcgtgcggtcccgccggggcccactgtctctccgtccgtctgtctctcaacttttcccatcctttagcttacgattcttcatcaactcgtaaaatgagatcgccgcggagctcgagcctatttggcgtctccggagactagcaagaccctctgaaagacaccgcgtccccagggataatcccccgtgtccggcaaagctgccccgctcgagcgcgaaccctgggacccagcgcgggaggcagaccagcagctggccgctgggctgtgaacgccaggaccgagcggaagcttcccgcccggccgcgatcggtgccgcggctctcagggaagtggctacgcgcgtccctcgggaaagcaggtaattcgcctttttctcccaccggcgcggtaaaaattaccctccccctccccgttccgtgtgtattcccagtttcagcgcagcgagctcggcgtctaacccctccgcggcagggtcccggccactgcggtagtggaggtggccagcctggctgagtcccctgcccaaacgtcagccctgtgctgccgcctgcctgacgcagagcggagcgagggaggggatttaattaccccgctcggcagctcagaaaatcgccgcacagaggggcttagcaggacggttaaggagtgcttgagcaggggcctcgggagacccgaaccagcctccttgcccgcaatccggtgtagaggaaaaaaaggaaacaggagttctgccaggtcctttcaggccttggggttgccttcctcgacaacgcaggcaggagccggcttgaccgaagcctccacctcggttgcaggtcctgcgtaggatgcgggactgctgcatt

SEQ ID NO: 122321 - DNA, 33 bp, Homo sapiens
  misc_feature 1..33: note = chr3:128216680-128216713
  misc_feature 1..33: note = Hyper
  source 1..33: mol_type = genomic DNA
ccagagtctattatacggcgggattagctcatc

SEQ ID NO: 122322 - DNA, 838 bp, Homo sapiens
  misc_feature 1..838: note = chr3:128273832-128274670
  misc_feature 1..838: note = Hyper
  source 1..838: mol_type = genomic DNA
cctcagggttgggggcgccgtggccggtgagggagtgaggtcagaggggaggggagggctggcatccttgggaaggctcgaatagaggggaggcttggtgtgaacgataccctgccggctgcgtgtggaggggaggctgtggcctgggcggaaggcaggagtcccgggaggggcagcggggacggggaccctgaggcccaggggattgggctcaggggccggattcaggatgctttccgcgcagagccagccgcagaaggggcatgggaaagagcctcatctacgcacgagaaaaccgggccgagagtcaagagccaaggcggggctgccgttccagggcgcgagccgggccgtcccccacctcgatcctgtgcgccctgcctcgggcggccagggtgcgcgcggcggccgcgggcgctgcggagagaccggcggaggccggggcacccggcgtgtttttcaggaaggaagccttcgctcctgtaacaggctggggcttggcccggcccgcggccgccccgccaggaagcgccccgtccgccccctcggggcgcgtccgcggcaggcacttttgaggacaggaaggggagaggtgacctgagcatccacgcagctgtggcattcggggacgggccgaggactgggtttcttgccatcctcagcgctgggggtgactccaagcccccgggtgggggtggggagtggccgggcatggcgcccggctccacaatgcatcgccttacccggccggaattcctgcaggacgctttgttctcagatggcagcgctgctagagccatcggacctgtgaggggggggcgcccggggcaggccagag

SEQ ID NO: 122323 - DNA, 30 bp, Homo sapiens; identical to SEQ ID NO: 90147
  misc_feature 1..30: note = chr3:128279869-128279899
  misc_feature 1..30: note = Hypo
  source 1..30: mol_type = genomic DNA

SEQ ID NO: 122324 - DNA, 30 bp, Homo sapiens; identical to SEQ ID NO: 90148
  misc_feature 1..30: note = chr3:128297409-128297439
  misc_feature 1..30: note = Hypo
  source 1..30: mol_type = genomic DNA

SEQ ID NO: 122325 - DNA, 95 bp, Homo sapiens; identical to SEQ ID NO: 90149
  misc_feature 1..95: note = chr3:128326970-128327065
  misc_feature 1..95: note = Hyper
  source 1..95: mol_type = genomic DNA

SEQ ID NO: 122326 - DNA, 141 bp, Homo sapiens; identical to SEQ ID NO: 90150
  misc_feature 1..141: note = chr3:128327456-128327597
  misc_feature 1..141: note = Hyper
  source 1..141: mol_type = genomic DNA

SEQ ID NO: 122327 - DNA, 35 bp, Homo sapiens; identical to SEQ ID NO: 90151
  misc_feature 1..35: note = chr3:128343672-128343707
  misc_feature 1..35: note = Hypo
  source 1..35: mol_type = genomic DNA

SEQ ID NO: 122328 - DNA, 30 bp, Homo sapiens; identical to SEQ ID NO: 39999
  misc_feature 1..30: note = chr3:128346689-128346719
  misc_feature 1..30: note = Hypo
  source 1..30: mol_type = genomic DNA

SEQ ID NO: 122329 - DNA, 573 bp, Homo sapiens; identical to SEQ ID NO: 90154
  misc_feature 1..573: note = chr3:128417048-128417621
  misc_feature 1..573: note = Hyper
  source 1..573: mol_type = genomic DNA

SEQ ID NO: 122330 - DNA, 81 bp, Homo sapiens; identical to SEQ ID NO: 90156
  misc_feature 1..81: note = chr3:128599545-128599626
  misc_feature 1..81: note = Hypo
  source 1..81: mol_type = genomic DNA

SEQ ID NO: 122331 - DNA, 34 bp, Homo sapiens; identical to SEQ ID NO: 40001
  misc_feature 1..34: note = chr3:128611894-128611928
  misc_feature 1..34: note = Hypo
  source 1..34: mol_type = genomic DNA

SEQ ID NO: 122332 - DNA, 30 bp, Homo sapiens; identical to SEQ ID NO: 90158
  misc_feature 1..30: note = chr3:128653973-128654003
  misc_feature 1..30: note = Hypo
  source 1..30: mol_type = genomic DNA

SEQ ID NO: 122333 - DNA, 1254 bp, Homo sapiens
  misc_feature 1..1254: note = chr3:128720061-128721315
  misc_feature 1..1254: note = Hyper
  source 1..1254: mol_type = genomic DNA
tcggagcgaactctccgcgccaggcgggcggggcggagggaggagggagttgagagtggacggccgggagtgggaggaaaagcgcagacgccaggaacgccccgtgagtgaggagaggagagcgtgggagtcacgcggagaagccagacccagacgccgaccgggcactggtggcgctgccggggtcccgggggttcctggaccccctaccccaggcccctccaaagcaactggggtaaaccagacgcactgtgaggccagcgcagctgctggacacggtccccggcgccgctccaaccagaccgcgaccgctaagcccctcctttcgagaaactctggggccgcccctggaagtggcggggcgaagggaccggaggagggaccggaggagcgaggcgcgcggcgcagcgatggagccggtcagcacgggcgcggaggccggcatggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtgctggggctgcgcgcggagggggccaccacggccgggcaggcagcaggtgacgggaactccagagatgtgacccccggggatgcggccgctgagttggccacggacggggactcagataccgatgaagaggcgcgcctggcgctgcgcgccgagccgccggagctcaccttccgccagttccacgcgcgcctctgtggctacttcggcacccgtgcggggccccggctgccccgcggcgctctcagcgagcacatcgagacgcagatccgcctgcgccgtccgcgccgccgccgccgcccgccctgcgcgcctggccccgacagcggtcctgactgtgagcgcgttgcgcggctggaggaggagaatagcagcttgcgcgagttggtggaggacctgcgcgccgcgctgcagagcagtgatgcgcgctgcctagcactgcaggtgcgcgccggccacgaagggagggtggtaacgcccgggagagggctcgaactaaaagctggctggctgcggagcccgacaggacagagtcagaggaaggggagacagagggcagccccacaccatcccactccgcatcagcacactt

SEQ ID NO: 122334 - DNA, 78 bp, Homo sapiens; identical to SEQ ID NO: 90166
  misc_feature 1..78: note = chr3:128733875-128733953
  misc_feature 1..78: note = Hypo
  source 1..78: mol_type = genomic DNA

SEQ ID NO: 122335 - DNA, 86 bp, Homo sapiens; identical to SEQ ID NO: 90167
  misc_feature 1..86: note = chr3:128746467-128746553
  misc_feature 1..86: note = Hypo
  source 1..86: mol_type = genomic DNA

SEQ ID NO: 122336 - DNA, 417 bp, Homo sapiens
  misc_feature 1..417: note = chr3:128764489-128764906
  misc_feature 1..417: note = Hyper
  source 1..417: mol_type = genomic DNA
aactacaatttgctccggcggaagtgaggagcaggcctgggccctaagggccgggcctcgaccccccgcaggtccccgcggtcccggtcccccgcccgggacatctgatggaccgagccgcgcccccgcggagcaccacttcggaggcctgagagcggcgaccgggcagggcgtggcctacatcccggagcctcgcgccttctcctgcgccgacttctgcagggcctccggctgctcgagccgccctgcgctgctcccgcgcctgcacccgaggctggggcagcggcggcgctgggtgacgccggagggggcgcccgacttgaaccaactgcggcggacccgggagccggggtccaggaatacagcccgaaccccaagaatacaacccgaaccccaagagtacgtgcccctcagaga

SEQ ID NO: 122337 - DNA, 68 bp, Homo sapiens; identical to SEQ ID NO: 90170
  misc_feature 1..68: note = chr3:128765883-128765951
  misc_feature 1..68: note = Hypo
  source 1..68: mol_type = genomic DNA

SEQ ID NO: 122338 - DNA, 30 bp, Homo sapiens; identical to SEQ ID NO: 90171
  misc_feature 1..30: note = chr3:128766505-128766535
  misc_feature 1..30: note = Hypo
  source 1..30: mol_type = genomic DNA

SEQ ID NO: 122339 - DNA, 30 bp, Homo sapiens; identical to SEQ ID NO: 90172
  misc_feature 1..30: note = chr3:128785960-128785990
  misc_feature 1..30: note = Hypo
  source 1..30: mol_type = genomic DNA

SEQ ID NO: 122340 - DNA, 41 bp, Homo sapiens; identical to SEQ ID NO: 40003
  misc_feature 1..41: note = chr3:128790177-128790218
  misc_feature 1..41: note = Hypo
  source 1..41: mol_type = genomic DNA

SEQ ID NO: 122341 - DNA, 30 bp, Homo sapiens; identical to SEQ ID NO: 90174
  misc_feature 1..30: note = chr3:129047343-129047373
  misc_feature 1..30: note = Hypo
  source 1..30: mol_type = genomic DNA

SEQ ID NO: 122342 - DNA, 33 bp, Homo sapiens; identical to SEQ ID NO: 90175
  misc_feature 1..33: note = chr3:129047805-129047838
  misc_feature 1..33: note = Hypo
  source 1..33: mol_type = genomic DNA

SEQ ID NO: 122343 - DNA, 32 bp, Homo sapiens; identical to SEQ ID NO: 90176
  misc_feature 1..32: note = chr3:129048078-129048110
  misc_feature 1..32: note = Hypo
  source 1..32: mol_type = genomic DNA

SEQ ID NO: 122344 - DNA, 178 bp, Homo sapiens; identical to SEQ ID NO: 90177
  misc_feature 1..178: note = chr3:129085333-129085511
  misc_feature 1..178: note = Hypo
  source 1..178: mol_type = genomic DNA

SEQ ID NO: 122345 - DNA, 16 bp, Homo sapiens
  misc_feature 1..16: note = chr3:129090469-129090485
  misc_feature 1..16: note = Hypo
  source 1..16: mol_type = genomic DNA
acgttcatgcagtcct

SEQ ID NO: 122346 - DNA, 30 bp, Homo sapiens; identical to SEQ ID NO: 90179
  misc_feature 1..30: note = chr3:129103767-129103797
  misc_feature 1..30: note = Hypo
  source 1..30: mol_type = genomic DNA

SEQ ID NO: 122347 - DNA, 30 bp, Homo sapiens; identical to SEQ ID NO: 90182
  misc_feature 1..30: note = chr3:129221988-129222018
  misc_feature 1..30: note = Hypo
  source 1..30: mol_type = genomic DNA

SEQ ID NO: 122348 - DNA, 30 bp, Homo sapiens; identical to SEQ ID NO: 90183
  misc_feature 1..30: note = chr3:129240328-129240358
  misc_feature 1..30: note = Hypo
  source 1..30: mol_type = genomic DNA

SEQ ID NO: 122349 - DNA, 30 bp, Homo sapiens; identical to SEQ ID NO: 90184
  misc_feature 1..30: note = chr3:129240597-129240627
  misc_feature 1..30: note = Hypo
  source 1..30: mol_type = genomic DNA

SEQ ID NO: 122350 - DNA, 30 bp, Homo sapiens; identical to SEQ ID NO: 90185
  misc_feature 1..30: note = chr3:129324172-129324202
  misc_feature 1..30: note = Hyper
  source 1..30: mol_type = genomic DNA

SEQ ID NO: 122351 - DNA, 92 bp, Homo sapiens; identical to SEQ ID NO: 28362
  misc_feature 1..92: note = chr3:129324567-129324659
  misc_feature 1..92: note = Hyper
  source 1..92: mol_type = genomic DNA

SEQ ID NO: 122352 - DNA, 152 bp, Homo sapiens; identical to SEQ ID NO: 90187
  misc_feature 1..152: note = chr3:129324893-129325045
  misc_feature 1..152: note = Hyper
  source 1..152: mol_type = genomic DNA

SEQ ID NO: 122353 - DNA, 126 bp, Homo sapiens; identical to SEQ ID NO: 90188
  misc_feature 1..126: note = chr3:129346438-129346564
  misc_feature 1..126: note = Hyper
  source 1..126: mol_type = genomic DNA

SEQ ID NO: 122354 - DNA, 163 bp, Homo sapiens; identical to SEQ ID NO: 90189
  misc_feature 1..163: note = chr3:129626946-129627109
  misc_feature 1..163: note = Hypo
  source 1..163: mol_type = genomic DNA

SEQ ID NO: 122355 - DNA, 1228 bp, Homo sapiens
  misc_feature 1..1228: note = chr3:129693071-129694299
  misc_feature 1..1228: note = Hyper
  source 1..1228: mol_type = genomic DNA
ccccattctctctctctctctctttctctctctctctctcttgctctactctcgcccgtctgcgttctacattggttctgcggccgtgtccctttcgtgtgtgtctgccctgtgtttctccgtcgtctccgtgtggatctcggtctttgtctcgccctctagctctctcgtgcgcctgtgtttaatcgtgcgcttctctcaatctctctgtccctccctttgccccctacacgcgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcaggtaaccgccccaacccctctccttccgcagacggtgtccgggagcactggaaagggagccctctcggcccgccctcaccttcggttctctgagagcttcctggagaacagggccggtgcacaggcgggcgctgtgctcgcacccccgggtcctccccgagcgcaggccggggacccgacgggaggcacggcgcgggcacatcggaggctctcgctgctgggcactcaggtcgccagagtccgcagcgcggggtgggagctccgcggcaccccctgcctgggtgccgccggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagttagaacgtggcgatggggacctttgggggagtcttggcggggacgcaaccgttagcgtcgcggctgtgcctggcgctgcaatctcaat

SEQ ID NO: 122356 - DNA, 60 bp, Homo sapiens
  misc_feature 1..60: note = chr3:129694504-129694564
  misc_feature 1..60: note = Hyper
  source 1..60: mol_type = genomic DNA
gctcccgcccctgcacgaggggcagtggtcctgcttctgggagggcggttgaactgtgcg

SEQ ID NO: 122357 - DNA, 71 bp, Homo sapiens; identical to SEQ ID NO: 90194
  misc_feature 1..71: note = chr3:129983032-129983103
  misc_feature 1..71: note = Hypo
  source 1..71: mol_type = genomic DNA

SEQ ID NO: 122358 - DNA, 397 bp, Homo sapiens
  misc_feature 1..397: note = chr3:130064451-130064848
  misc_feature 1..397: note = Hyper
  source 1..397: mol_type = genomic DNA
agttcatttggcagccggcggcttctctgaaacaaagccagcaaacagctggagcgtctctggacactcacattaaaacttgtgaagagttaaaagccccagggaagagccaggccaagggcacgggtcagcgccggcttaaaagaccctctcagggcacgaggcgttcgctgcgggaatccacctgcagctgtgcggcgcggaccagggcgtgcggcgcggaccagggcttccggcgcgcgctctatccaactgcgccgcgggcgcccgagaggcgcgcgtttactgcgctcaggagctcggtgcagcctcttctggagagttgggggcggtttccagggtccggagtgtcccctgaccccgggaaagctgggtaagtatgcggtgcggggacttg

SEQ ID NO: 122359 - DNA, 88 bp, Homo sapiens; identical to SEQ ID NO: 90200
  misc_feature 1..88: note = chr3:130235499-130235587
  misc_feature 1..88: note = Hyper
  source 1..88: mol_type = genomic DNA

SEQ ID NO: 122360 - DNA, 410 bp, Homo sapiens
  misc_feature 1..410: note = chr3:130235793-130236203
  misc_feature 1..410: note = Hyper
  source 1..410: mol_type = genomic DNA
ctttcttttctcccacggtcgggaccttagggtaggagtttcaagaggggagaagccggtggagcagtaacagccttcataatgtctccagtcccgcttccgtcacctccctaaggctgcgcccccctcctgggggacgtgcgctgggcccggggccgccggggcggggaagggtcgggcccggggcggggagaagcgtttatatgtcggcgaggggcgtgggagctgccacccgcttgcctgcgggacaccggagtcaagaggctgcccacgccgctgcctgtccgttccacggttccgaggtctccaccgtctccccgcgcgccgcaggcggcaccaaactctgcgctccccgcggtgcgccctgcccgcgcagtgcgcgtccagaggaaatccgccccgggctttcg

SEQ ID NO: 122361 - DNA, 34 bp, Homo sapiens; identical to SEQ ID NO: 90204
  misc_feature 1..34: note = chr3:130323372-130323406
  misc_feature 1..34: note = Hypo
  source 1..34: mol_type = genomic DNA

SEQ ID NO: 122362 - DNA, 28 bp, Homo sapiens
  misc_feature 1..28: note = chr3:130341407-130341435
  misc_feature 1..28: note = Hypo
  source 1..28: mol_type = genomic DNA
atacagactttgagccgggcgtggtggc

SEQ ID NO: 122363 - DNA, 227 bp, Homo sapiens; identical to SEQ ID NO: 90206
  misc_feature 1..227: note = chr3:130474409-130474636
  misc_feature 1..227: note = Hypo
  source 1..227: mol_type = genomic DNA

SEQ ID NO: 122364 - DNA, 35 bp, Homo sapiens; identical to SEQ ID NO: 90207
  misc_feature 1..35: note = chr3:130492203-130492238
  misc_feature 1..35: note = Hypo
  source 1..35: mol_type = genomic DNA

SEQ ID NO: 122365 - DNA, 39 bp, Homo sapiens; identical to SEQ ID NO: 40006
  misc_feature 1..39: note = chr3:130519901-130519940
  misc_feature 1..39: note = Hypo
  source 1..39: mol_type = genomic DNA

SEQ ID NO: 122366 - DNA, 33 bp, Homo sapiens; identical to SEQ ID NO: 90212
  misc_feature 1..33: note = chr3:131081158-131081191
  misc_feature 1..33: note = Hyper
  source 1..33: mol_type = genomic DNA

SEQ ID NO: 122367 - DNA, 40 bp, Homo sapiens; identical to SEQ ID NO: 90213
  misc_feature 1..40: note = chr3:131447460-131447500
  misc_feature 1..40: note = Hypo
  source 1..40: mol_type = genomic DNA

SEQ ID NO: 122368 - DNA, 21 bp, Homo sapiens
  misc_feature 1..21: note = chr3:131593216-131593237
  misc_feature 1..21: note = Hypo
  source 1..21: mol_type = genomic DNA
ccaccgcgcctggcctcagtt

SEQ ID NO: 122369 - DNA, 198 bp, Homo sapiens; identical to SEQ ID NO: 90215
  misc_feature 1..198: note = chr3:131752588-131752786
  misc_feature 1..198: note = Hyper
  source 1..198: mol_type = genomic DNA

SEQ ID NO: 122370 - DNA, 101 bp, Homo sapiens; identical to SEQ ID NO: 90216
  misc_feature 1..101: note = chr3:131753055-131753156
  misc_feature 1..101: note = Hyper
  source 1..101: mol_type = genomic DNA

SEQ ID NO: 122371 - DNA, 180 bp, Homo sapiens; identical to SEQ ID NO: 90217
  misc_feature 1..180: note = chr3:131753972-131754152
  misc_feature 1..180: note = Hyper
  source 1..180: mol_type = genomic DNA

SEQ ID NO: 122372 - DNA, 256 bp, Homo sapiens; identical to SEQ ID NO: 90219
  misc_feature 1..256: note = chr3:132440027-132440283
  misc_feature 1..256: note = Hypo
  source 1..256: mol_type = genomic DNA

SEQ ID NO: 122373 - DNA, 30 bp, Homo sapiens; identical to SEQ ID NO: 90220
  misc_feature 1..30: note = chr3:132502767-132502797
  misc_feature 1..30: note = Hypo
  source 1..30: mol_type = genomic DNA

SEQ ID NO: 122374 - DNA, 165 bp, Homo sapiens; identical to SEQ ID NO: 90221
  misc_feature 1..165: note = chr3:132756312-132756477
  misc_feature 1..165: note = Hypo
  source 1..165: mol_type = genomic DNA

SEQ ID NO: 122375 - DNA, 938 bp, Homo sapiens
  misc_feature 1..938: note = chr3:132756970-132757908
  misc_feature 1..938: note = Hyper
  source 1..938: mol_type = genomic DNA
gagaccctttgtgcccgcctcgcacccgctctgctaggtagcaaccgaacccccagagacatcggagcgggcgctgccgagggcaatttggtgattggctggtctcaccacgtgaccggcgctgagccttccgtgcgaccggattggctgtcgcggacgctgacggacaaggccggggcgggccagagcctggtcggaggggcgcgcgcgggggcccgaggggcgaaggcgcgagtgcgcgagagcgcgtgcgcgagcggtggggctttctcctgagccgtcggagggagccggagcgcttctcccgaggtaagcggcgctccggggcgtccccccagtccttcccatgctgggtcccggcaagcgggttaggctgggctgggcggggctcggggaggtgtggggtcagcttgccccgggagcccagcttcagggaggatgcagccccggttgccttggtttcccttttcctatcctctcaggcaccttcccatcctccccactgcgtgacgggtctgcccgaggggagttgcccacctggcagccctgcctccgcctttgtttcccgcctggagggttgctggcatgaaccccctccccaggtggagggtgcgggtgatggggcgcgggcgtcaggagcgctggacctgggctggggccgaggaggaggtggctttaatgcagggggacctgtcacatggggaaacgaagaagaagaaatgtagtgtcactttggccagcccgagggactcgaactaatcctgcggccgcgagcggagccgaattcctagcgcagctgtgcgaagagccctcctgcctaggtgccggcggcctcgccggggacggagcctccgtgctgcccgggaggttgctctgccggctggacctggcggttttcaccccagagttgcagcgaaattgaacgctttgagcctgct

SEQ ID NO: 122376 - DNA, 30 bp, Homo sapiens; identical to SEQ ID NO: 40007
  misc_feature 1..30: note = chr3:133101687-133101717
  misc_feature 1..30: note = Hypo
  source 1..30: mol_type = genomic DNA

SEQ ID NO: 122377 - DNA, 135 bp, Homo sapiens; identical to SEQ ID NO: 90225
  misc_feature 1..135: note = chr3:133217920-133218055
  misc_feature 1..135: note = Hypo
  source 1..135: mol_type = genomic DNA

SEQ ID NO: 122378 - DNA, 22 bp, Homo sapiens
  misc_feature 1..22: note = chr3:133332636-133332658
  misc_feature 1..22: note = Hypo
  source 1..22: mol_type = genomic DNA
tttttttttttgagacggagtc

SEQ ID NO: 122379 - DNA, 30 bp, Homo sapiens; identical to SEQ ID NO: 90231
  misc_feature 1..30: note = chr3:133545624-133545654
  misc_feature 1..30: note = Hypo
  source 1..30: mol_type = genomic DNA

SEQ ID NO: 122380 - DNA, 42 bp, Homo sapiens; identical to SEQ ID NO: 90232
  misc_feature 1..42: note = chr3:133556962-133557004
  misc_feature 1..42: note = Hypo
  source 1..42: mol_type = genomic DNA

SEQ ID NO: 122381 - DNA, 30 bp, Homo sapiens; identical to SEQ ID NO: 90233
  misc_feature 1..30: note = chr3:133560299-133560329
  misc_feature 1..30: note = Hypo
  source 1..30: mol_type = genomic DNA

SEQ ID NO: 122382 - DNA, 294 bp, Homo sapiens
  misc_feature 1..294: note = chr3:133613668-133613962
  misc_feature 1..294: note = Hyper
  source 1..294: mol_type = genomic DNA
agcagagacaggtgtcgctcttttctccccggtggctgtttgtcccacgccctggacgtgccctttcgcatggttcccagcagggtccgcagggaacacccctccagtgcagcggagtgaggcccggccagaccccagcttcgcttcgttctccaaggggggcgcccgtcgctctccccacccccgccagcacccagccacctgcgcggtcgcccgcagccggtgccgcagtgtgagctagccagcgagcccggttccttcacgccctggccagcgccgcggagccagccgccg

SEQ ID NO: 122383 - DNA, 66 bp, Homo sapiens; identical to SEQ ID NO: 90238
  misc_feature 1..66: note = chr3:133614601-133614667
  misc_feature 1..66: note = Hyper
  source 1..66: mol_type = genomic DNA

SEQ ID NO: 122384 - DNA, 114 bp, Homo sapiens; identical to SEQ ID NO: 90239
  misc_feature 1..114: note = chr3:133615019-133615133
  misc_feature 1..114: note = Hyper
  source 1..114: mol_type = genomic DNA

SEQ ID NO: 122385 - DNA, 160 bp, Homo sapiens; identical to SEQ ID NO: 90240
  misc_feature 1..160: note = chr3:133646291-133646451
  misc_feature 1..160: note = Hyper
  source 1..160: mol_type = genomic DNA

SEQ ID NO: 122386 - DNA, 98 bp, Homo sapiens; identical to SEQ ID NO: 90243
  misc_feature 1..98: note = chr3:133748007-133748105
  misc_feature 1..98: note = Hyper
  source 1..98: mol_type = genomic DNA

SEQ ID NO: 122387 - DNA, 46 bp, Homo sapiens; identical to SEQ ID NO: 90244
  misc_feature 1..46: note = chr3:133748648-133748694
  misc_feature 1..46: note = Hyper
  source 1..46: mol_type = genomic DNA

SEQ ID NO: 122388 - DNA, 376 bp, Homo sapiens; identical to SEQ ID NO: 90245
  misc_feature 1..376: note = chr3:134032195-134032571
  misc_feature 1..376: note = Hyper
  source 1..376: mol_type = genomic DNA

SEQ ID NO: 122389 - DNA, 79 bp, Homo sapiens; identical to SEQ ID NO: 90246
  misc_feature 1..79: note = chr3:134092564-134092643
  misc_feature 1..79: note = Hyper
  source 1..79: mol_type = genomic DNA

SEQ ID NO: 122390 - DNA, 30 bp, Homo sapiens; identical to SEQ ID NO: 90247
  misc_feature 1..30: note = chr3:134093118-134093148
  misc_feature 1..30: note = Hyper
  source 1..30: mol_type = genomic DNA

SEQ ID NO: 122391 - DNA, 578 bp, Homo sapiens; identical to SEQ ID NO: 90248
  misc_feature 1..578: note = chr3:134125220-134125798
  misc_feature 1..578: note = Hyper
  source 1..578: mol_type = genomic DNA

SEQ ID NO: 122392 - DNA, 37 bp, Homo sapiens; identical to SEQ ID NO: 90249
  misc_feature 1..37: note = chr3:134202929-134202966
  misc_feature 1..37: note = Hypo
  source 1..37: mol_type = genomic DNA

SEQ ID NO: 122393 - DNA, 220 bp, Homo sapiens; identical to SEQ ID NO: 40008
  misc_feature 1..220: note = chr3:134320427-134320647
  misc_feature 1..220: note = Hypo
  source 1..220: mol_type = genomic DNA

SEQ ID NO: 122394 - DNA, 747 bp, Homo sapiens
  misc_feature 1..747: note = chr3:134369449-134370196
  misc_feature 1..747: note = Hyper
  source 1..747: mol_type = genomic DNA
aaactggggcaatcacggggctgcgcgttgccacgggactgcgcgttgccacgggacgccggtgccactgcggggaagcgacggcagccatgggggagagggtcgggttcgctgacctcgttcgggggagcaatgggcgccccccggcgggcaggcccttgtggcaaggaggccaaggtgccgggggacccggggacccgggtcgggcgcgcgttacctcctccgcgctgcagcagcgagctcgggttcgcctgctggtctgagagcgtaccctgtgcggcgcgccgcttctccgagtgcacgatcagcagcatgtcgatagatacagcgttgatgtccttcttcagctccatgatgccgcctcctttccgacctgggcgccgcggccgcacgctaggctgcttgcgctgcaaatggccccgtgcgcgcagctgccccacacgggagagggcgagggcgcggaagagggcgctcccccgccgctggagccgcagggcgctgcttttcgctgactctgccaaacacgccattagggcccgcctgggagggcgctaccctaatgaagcggctctaagtcacctttgaaaggaaatccccgggcccaagccttgacctgcaccggggccatagtcagcaggggcggccggtccagagcctccctccctgcgcccctgcctcccgcccggtgcacttgaagcgctggtcctgggctccagggcttctctggctgagcgctgcctcatcccc

SEQ ID NO: 122395 - DNA, 718 bp, Homo sapiens; identical to SEQ ID NO: 90257
  misc_feature 1..718: note = chr3:134514070-134514788
  misc_feature 1..718: note = Hyper
  source 1..718: mol_type = genomic DNA

SEQ ID NO: 122396 - DNA, 1288 bp, Homo sapiens; identical to SEQ ID NO: 90258
  misc_feature 1..1288: note = chr3:134515035-134516323
  misc_feature 1..1288: note = Hyper
  source 1..1288: mol_type = genomic DNA

SEQ ID NO: 122397 - DNA, 157 bp, Homo sapiens; identical to SEQ ID NO: 90259
  misc_feature 1..157: note = chr3:134565144-134565301
  misc_feature 1..157: note = Hypo
  source 1..157: mol_type = genomic DNA

SEQ ID NO: 122398 - DNA, 30 bp, Homo sapiens; identical to SEQ ID NO: 40009
  misc_feature 1..30: note = chr3:134624264-134624294
  misc_feature 1..30: note = Hypo
  source 1..30: mol_type = genomic DNA

SEQ ID NO: 122399 - DNA, 30 bp, Homo sapiens; identical to SEQ ID NO: 90261
  misc_feature 1..30: note = chr3:134967156-134967186
  misc_feature 1..30: note = Hypo
  source 1..30: mol_type = genomic DNA

SEQ ID NO: 122400 - DNA, 177 bp, Homo sapiens; identical to SEQ ID NO: 90262
  misc_feature 1..177: note = chr3:135172075-135172252
  misc_feature 1..177: note = Hypo
  source 1..177: mol_type = genomic DNA

SEQ ID NO: 122401 - DNA, 26 bp, Homo sapiens
  misc_feature 1..26: note = chr3:135298460-135298486
  misc_feature 1..26: note = Hypo
  source 1..26: mol_type = genomic DNA
aaggggaaattaggccgggcgcagtg

SEQ ID NO: 122402 - DNA, 30 bp, Homo sapiens; identical to SEQ ID NO: 90264
  misc_feature 1..30: note = chr3:135309812-135309842
  misc_feature 1..30: note = Hypo
  source 1..30: mol_type = genomic DNA

SEQ ID NO: 122403 - DNA, 30 bp, Homo sapiens; identical to SEQ ID NO: 90266
  misc_feature 1..30: note = chr3:135627324-135627354
  misc_feature 1..30: note = Hypo
  source 1..30: mol_type = genomic DNA

SEQ ID NO: 122404 - DNA, 538 bp, Homo sapiens; identical to SEQ ID NO: 90267
  misc_feature 1..538: note = chr3:135684904-135685442
  misc_feature 1..538: note = Hyper
  source 1..538: mol_type = genomic DNA

SEQ ID NO: 122405 - DNA, 56 bp, Homo sapiens; identical to SEQ ID NO: 90270
  misc_feature 1..56: note = chr3:135996415-135996471
  misc_feature 1..56: note = Hypo
  source 1..56: mol_type = genomic DNA

SEQ ID NO: 122406 - DNA, 135 bp, Homo sapiens; identical to SEQ ID NO: 90272
  misc_feature 1..135: note = chr3:136254713-136254848
  misc_feature 1..135: note = Hypo
  source 1..135: mol_type = genomic DNA

SEQ ID NO: 122407 - DNA, 38 bp, Homo sapiens; identical to SEQ ID NO: 90273
  misc_feature 1..38: note = chr3:136366118-136366156
  misc_feature 1..38: note = Hypo
  source 1..38: mol_type = genomic DNA

SEQ ID NO: 122408 - DNA, 588 bp, Homo sapiens; identical to SEQ ID NO: 90274
  misc_feature 1..588: note = chr3:136537591-136538179
  misc_feature 1..588: note = Hyper
  source 1..588: mol_type = genomic DNA

SEQ ID NO: 122409 - DNA, 215 bp, Homo sapiens; identical to SEQ ID NO: 90275
  misc_feature 1..215: note = chr3:136538621-136538836
  misc_feature 1..215: note = Hyper
  source 1..215: mol_type = genomic DNA

SEQ ID NO: 122410 - DNA, 120 bp, Homo sapiens; identical to SEQ ID NO: 40010
  misc_feature 1..120: note = chr3:136582940-136583060
  misc_feature 1..120: note = Hypo
  source 1..120: mol_type = genomic DNA

SEQ ID NO: 122411 - DNA, 373 bp, Homo sapiens; identical to SEQ ID NO: 90277
  misc_feature 1..373: note = chr3:136751376-136751749
  misc_feature 1..373: note = Hyper
  source 1..373: mol_type = genomic DNA

SEQ ID NO: 122412 - DNA, 16 bp, Homo sapiens
  misc_feature 1..16: note = chr3:136916207-136916223
  misc_feature 1..16: note = Hypo
  source 1..16: mol_type = genomic DNA
tgggcagaggccgggc

SEQ ID NO: 122413 - DNA, 1634 bp, Homo sapiens; identical to SEQ ID NO: 90282
  misc_feature 1..1634: note = chr3:137479130-137480764
  misc_feature 1..1634: note = Hyper
  source 1..1634: mol_type = genomic DNA

SEQ ID NO: 122414 - DNA, 227 bp, Homo sapiens; identical to SEQ ID NO: 90283
  misc_feature 1..227: note = chr3:137481120-137481347
  misc_feature 1..227: note = Hyper
  source 1..227: mol_type = genomic DNA

SEQ ID NO: 122415 - DNA, 393 bp, Homo sapiens
  misc_feature 1..393: note = chr3:137481774-137482167
  misc_feature 1..393: note = Hyper
  source 1..393: mol_type = genomic DNA
gggtgagaagttccacgcgtctttctaattttaggaaggggaagcaaagtcttctcctcaaacttgatacactacatgctagagaaagatcctcccttccggcctcctcattccctgtcaccctcccccactcctagcccctcggagccaacggagccttgcgcgtttctggccggtcctcccaagagagaatggtgcaaaagccaataagcctggaacacacgcaggtcccgccgggcctgggacaatggtttccatttaataaatatttcccccaagggcatttcacatcgggcaggcaattattcaaaggaaacaggcgcgcaggttggctctgcgggttatttcgtcctctttacccgaagaatgctcatttgacgcaagaaacgagtc

SEQ ID NO: 122416 - DNA, 30 bp, Homo sapiens; identical to SEQ ID NO: 28397
  misc_feature 1..30: note = chr3:137483214-137483244
  misc_feature 1..30: note = Hyper
  source 1..30: mol_type = genomic DNA

SEQ ID NO: 122417 - DNA, 1039 bp, Homo sapiens
  misc_feature 1..1039: note = chr3:137483649-137484688
  misc_feature 1..1039: note = Hyper
  source 1..1039: mol_type = genomic DNA
caagcggcccatgaacgccttcatggtatggtcccggggccagcggcgcaagatggcccaggaaaaccccaagatgcacaactcggagatcagcaaacgcctaggtgccgaatggaagcttctgtccgaggcagagaagcggccatacatcgatgaagccaagcggctacgcgcccagcacatgaaggagcaccctgactacaagtaccgacctcggcgcaagcccaagaacctgctcaagaaggacaggtatgtcttccccttgccctacctgggcgacacggacccgctcaaggcggctggcctgcccgtgggggcctccgacggcctcctgagcgcgcccgagaaagcccgggccttcttgccgccggcctcggcgccctactccctgctggaccccgcgcagtttagctcgagcgccatccagaagatgggcgaagtgccccacaccttggctaccggcgctctgccctacgcgtccaccctgggctaccagaacggcgccttcggcagcctcagctgccccagccagcacacgcacacgcacccgtcccccaccaaccctggctacgtggtgccctgtaactgtaccgcctggtctgcctccaccctgcagccccccgtcgcctacatcctcttcccaggcatgaccaagactggcatagacccttattcgtcagcccacgctacggccatgtaacccccagcccggcccggacctgaggcgtggtctgaaagccgggtctgcaccctgtcctctgagcctagccccggcctgcagacgcctccggggtcagccctgccgctgtcccttacaccacccagacttttcctctctcttccagggggaagggtggggcgtcctcccggacccaaggcgcagacaggtaccggaaacttgcaaacgttatgtcagctacacagctgcccctatcccgactctcccaaaacaaatctccgactgtaccccctttggacaaaaaagtaggcagttttgctttatttatatccccttcactctcctcggataggctttgga

SEQ ID NO: 122418 - DNA, 548 bp, Homo sapiens; identical to SEQ ID NO: 28401
  misc_feature 1..548: note = chr3:137485061-137485609
  misc_feature 1..548: note = Hyper
  source 1..548: mol_type = genomic DNA

SEQ ID NO: 122419 - DNA, 441 bp, Homo sapiens; identical to SEQ ID NO: 90290
  misc_feature 1..441: note = chr3:137485869-137486310
  misc_feature 1..441: note = Hyper
  source 1..441: mol_type = genomic DNA

SEQ ID NO: 122420 - DNA, 304 bp, Homo sapiens; identical to SEQ ID NO: 28403
  misc_feature 1..304: note = chr3:137486516-137486820
  misc_feature 1..304: note = Hyper
  source 1..304: mol_type = genomic DNA

SEQ ID NO: 122421 - DNA, 74 bp, Homo sapiens
  misc_feature 1..74: note = chr3:137487025-137487099
  misc_feature 1..74: note = Hyper
  source 1..74: mol_type = genomic DNA
ggctggaaaggggcacgtggcgagtgcgagggcaaagtgcgaggggcaaaggcctcggacggtggctgaagctg

SEQ ID NO: 122422 - DNA, 731 bp, Homo sapiens
  misc_feature 1..731: note = chr3:137487303-137488034
  misc_feature 1..731: note = Hyper
  source 1..731: mol_type = genomic DNA
ttggccatcacacttcgtttccttccttctcagactggccttccccagccatctgccctccttagacctggtcccaacctctgcccccacccccatccccgcaagagcctgcctcagctttgcctccgtcgccccgagggctgcggagcgtccgccgaggtgcgcggccgcgactcgccctaacaaacagccaaaatcctgctcgtcacgccgctgacaggggccgattactgactttgaagtcaggcgcagacaaaaagaaatcccctggggggtgtgggggggcagcagtccctgtcaaacctgtttgctcacaactgtctctttctttcaagaaaatcattaaagcaaacctgtagggagaggagcgccccgcccgcccggagtggagaagagccgcttctcccgagcgcgcgtcgcgcagcaaagagcagccaagagttgccctggacagactcctggcatccggagaacctgaactccggcgctgcaaggggcgcccgtggccctgcaggaggaggttctgcagatccctctgcgttaggcacgcgtccggtagccagggagccccagacttctctcgcttagcaacctgggcctccttcgagcggggttggcagggagggcccggacctctcgcctgaggctcccattgcttccccgggacccttctccccgccaaaagtgacccaaatacatgccgcgttcagcgccgtcgctcctctgctggg

SEQ ID NO: 122423 - DNA, 245 bp, Homo sapiens; identical to SEQ ID NO: 28408
  misc_feature 1..245: note = chr3:137488337-137488582
  misc_feature 1..245: note = Hyper
  source 1..245: mol_type = genomic DNA

SEQ ID NO: 122424 - DNA, 2371 bp, Homo sapiens
  misc_feature 1..2371: note = chr3:137488807-137491178
  misc_feature 1..2371: note = Hyper
  source 1..2371: mol_type = genomic DNA
gggacagaaggggtccgttagatttggaggcaggagagcttcccgcctccaccgaggtgcgtgctctcctggcctctgtcctgccctgccctgccctgcctcctaggctctagtggacctagcagtgggagagctacttgggctggtttctttcctgacgctgcagggatgggcatcggcctggaaccagaagcgcaggagctgggccacggcagagtaattaagaaaataatgaaattgatggcggatgggggcgctagaaatcctggggcgtctacttaaaaccagagattcgcggtcggccccacggaatcccggctctgtgtgcgcccaggttccggggcttgggcgttgccggttctcacactaggaaggagcctgaagtcagaaaagatggggcctcgttactcactttctagcccagcccctggccctgggtcccgcagagccgtcatcgcaggctcctgcccagcctctggggtcgggtgagcaaggtgttctcttcggaagcgggaagggctgcgggtcggggacgtcccttggctgccacccctgattctgcatccttttcgctcgaatccctgcgctaggcatcctccccgatcccccaaaagcccaagcactgggtctgggttgaggaagggaacgggtgcccaggccggacagaggctgaaaggaggcctcaaggttcctctttgctacaaagtggagaagttgctctactctggagggcagtggccttttccaaacttttccacttaggtccgtaagaaaagcaattcatacacgatcagcgctttcggtgcgaggatggaaagaaacttcagaaaaactctcgccagacaacccggcagcacttggccccggaacagagaggagagaaagacctgaccgccgcactcagggccacccgccgcactaagtttgagggttccctctgcctccaggcctctgtcgcccgagctcaggctctcctaggtgcttcagggccgggctgcactcgagccccgaggaggccctgctagcgctagcgcggcggtgataaccgagggaggtgggtgagaggtgcggctgtcgaggcaaacgcagagcacccgcccagtcctccaagggccgagagccgggagtcccgaacgccgcttaagcagctccttgcttcccgcagcccgtccacatccctgcgggatttctggacgccccgcccggggacctagggaggagggagagaggagggagggagtgggcagcctgggcgcacgccaccggtccccgtacgcccggcaccccccgtggcgcggcgagtcaatgggatttgcacactcgaggtgtaacagcattactgcattaattaccatttccatttcacgtccagattgtttacttatctgcgggaaacatatgtcgggagaagttcacattccggattctgctccgctgcccaaggtgcaattccggggaggcggcgaggggggaggggagggcttcagattttttattacaccctctagccttatctgccgctgtaaattatgaggatcctccattgagcggcatatggagattatatacttttttgaatatcgtttcccaaagcctgcagattttcactttgaaatgaaacaatcctccgctggttcccccggggacaggcgtctcctgcgttcccccgcgcggcctgggggacccttctcgcagagcaggcgcgcaccccaatgccgtggccggcgcccagtggagacttctttcacagggtctagaataatcttccgcggaacacccatccatatgcagtgtttgagaactaaggcagctcccttgctctgttttcctgcgcctagcccccggacttttgtgccgtttgcagctctttttcatttcgaatacccgcatagacgcgagcccacttctgccctcttcctacgctgggcggctccaaacccgccgcgagggctgaggtgttcacacctgcccacggcagcctgcctcgccctcaagcgcctcaaagcttcctaagcgcttacattggtcttgggacagccgactttggcttctttgtttgtttgagggaccgcggaagtggcggggaatgtgcccccgcttgagaccgcttattgtgagccctcaacggaaatcctgcacggaaggcaaccgcctccccgctcgcggtaagcaggatccacccgagtagcggggaccgaatcccatctttcttatctctcgaagactcctttcaggctgagatcagagagggagggaaaaagaagagagaatcattgttcttctttttttaatttaatataccaagccaccagctcaggtcatttatatgcttaatttagtgataaaagtcaataagcggaatcacagggtt

SEQ ID NO: 122425 - DNA, 17 bp, Homo sapiens
  misc_feature 1..17: note = chr3:137561189-137561206
  misc_feature 1..17: note = Hypo
  source 1..17: mol_type = genomic DNA
agtctagctattggccg

SEQ ID NO: 122426 - DNA, 374 bp, Homo sapiens
  misc_feature 1..374: note = chr3:137717678-137718052
  misc_feature 1..374: note = Hypo
  source 1..374: mol_type = genomic DNA
cgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttcaccctgctggggctgccaggtaagggccaggtgtctggctggctggagggagagattggaggtggagaggaaactgcaggctctgtctgggcaccacgacagggactgctggggagggaggaactgcgattcgtgtttgac

SEQ ID NO: 122427 - DNA, 21 bp, Homo sapiens
  misc_feature 1..21: note = chr3:137945120-137945141
  misc_feature 1..21: note = Hypo
  source 1..21: mol_type = genomic DNA
ccactgcgcccagcctaacat

SEQ ID NO: 122428 - DNA, 120 bp, Homo sapiens; identical to SEQ ID NO: 90302
  misc_feature 1..120: note = chr3:138058967-138059087
  misc_feature 1..120: note = Hypo
  source 1..120: mol_type = genomic DNA

SEQ ID NO: 122429 - DNA, 234 bp, Homo sapiens; identical to SEQ ID NO: 90303
  misc_feature 1..234: note = chr3:138066780-138067014
  misc_feature 1..234: note = Hyper
  source 1..234: mol_type = genomic DNA

SEQ ID NO: 122430 - DNA, 636 bp, Homo sapiens
  misc_feature 1..636: note = chr3:138153816-138154452
  misc_feature 1..636: note = Hyper
  source 1..636: mol_type = genomic DNA
aacctggttgctgctcggcgccctgctgtggatgtggtggcgcaggaaccgccgcgggaagcttgggcgcctggccgccgccttcgaattccttgacaatgaacgcgagttcatcagccgcgagctgcggggccagcacctgccagcctgggtgagccaagccgggtgggagtgggaggtggggagatgcctttcgaggttcggaggaacttgcggtcagcggggagctggtgcgcgcaaacccgaggcagggcgggagcccggcgacctgcacaccccgttccccaccgctcccggggcgcagaccctggggacggtgaccgcccctcccgcggcgcgcagcaccctcacgtccacctctggtccgactgcggtgggagtggggaacttgggtttcatttaaggccccagagctcgagagaagagtcacgggcagaccacacccgggagaaaaacaagggcgtctgggacttcgcagacttactcgggttggaatcagaaggcatttcttccacccgcctgttgattcagagaacgaacgccggacgcaaaacgtagatgggcaaataccgcagtgacagaaacggcgggcccagttgctttcggccgaggcctggactgcggtagggggagggc

SEQ ID NO: 122431 - DNA, 182 bp, Homo sapiens; identical to SEQ ID NO: 90305
  misc_feature 1..182: note = chr3:138157733-138157915
  misc_feature 1..182: note = Hypo
  source 1..182: mol_type = genomic DNA

SEQ ID NO: 122432 - DNA, 342 bp, Homo sapiens; identical to SEQ ID NO: 90307
  misc_feature 1..342: note = chr3:138655796-138656138
  misc_feature 1..342: note = Hyper
  source 1..342: mol_type = genomic DNA

SEQ ID NO: 122433 - DNA, 278 bp, Homo sapiens; identical to SEQ ID NO: 90308
  misc_feature 1..278: note = chr3:138656668-138656946
  misc_feature 1..278: note = Hyper
  source 1..278: mol_type = genomic DNA

SEQ ID NO: 122434 - DNA, 30 bp, Homo sapiens; identical to SEQ ID NO: 90309
  misc_feature 1..30: note = chr3:138657192-138657222
  misc_feature 1..30: note = Hyper
  source 1..30: mol_type = genomic DNA

SEQ ID NO: 122435 - DNA, 1688 bp, Homo sapiens
  misc_feature 1..1688: note = chr3:138657432-138659120
  misc_feature 1..1688: note = Hyper
  source 1..1688: mol_type = genomic DNA
cggctgacaggagagcgttgcgcagaaaattcgaggccgggcgctggaggagtctccgcggcccggagaaggcacagaggcgcccctgagaggcgcagctggaacaggcgatgcacgggttcggatctggccggccaaccgagcccagcggtcgcgaaaaccagagtcgccacagaggttgagcacgattccatttctggggatcgggtccggtggggagccactgtccctaacgcctccagagactttaagtaggacaatataatgctggtaggagcaaggtgcaaggaatttagcggcagaagcctttcgggggggtggggaaaggcagatccgtgcctcgtctgagcctgggggtggggacagcccctggccttgtagcccctgttccggggatcagctgggcccacctaacccccctacatggggttgaaaggggccaatgggacggccccgccgcccctccctcgggattccacagggccctgacccggcctttatctctgcacggtcagcagtcgcgggggcttcaggaaggaggacaaaggcccggtgtcaccgcgggcgggggctcggtttcctggctctctgctcacactcacagcctttagcggttgttgggggaagatttttaaaaatatgtgtcgaatttcctttttttctcttctagaaacaaacaaacaaaaaaggcaaaaggcgaattccccttcactcctcgtccatagagattaaagtttcctgggatcctgccctttttttttctttgactgcctagaaatacttgttctcccttgtacatagaggaaaatgcggggaaaggttttttaaaactcggtttcatactattattattactaaggacaaccgggcaggctgaggtcccaacgtggatgatccgagttggcctcgcgccggggctctgcagccactgccctgtgcgctcagcacctctgggggcgatcagggcccctgcgcttccgcccgccgcccggcagtcgagagcaccctgtgcccagactggccgactcattctcccccgaattttgtttagagctggcaagggggacttagctcgcgccccaagacctgggcttgcagcgccgccaacaggcccggggacacgaggcgctccaggccggggtcttcccggctgctggcccctctcgctccccacccgctggcggcgcctcggtcgcccgcaattgacccaacccgcttcctgcgtttgcccctcaggtttcccgtttctccacaaaggcctaggggagcctcgcccacaggctgaccctgcaacctctggcccggtggctaccttctgcttttctgaaaaagaaaaggaaaaaaaaaaaaaaaaagaaaaaatcaaccagtcgagggaggcgcgtgaggactggaggcgccagccggacagcctatgagtaggtccctgggtcggtgccgcttcgcgggtcagcacggcctttctcagagaaaacctcctaaacgtgtgaagaccgctttgggggaagcgagagggaggttggaggagccccgggcggggtctcagcgcccaccagctgtgccttcagggcttgggtgttcgctgcaacggcaaccgcgtgagcctcactcccacggccaaggggctagggcagggtggatgcaatcgcgtgcgcctggccccggaaggtgctcgcagggggtgcctg

SEQ ID NO: 122436 - DNA, 361 bp, Homo sapiens
  misc_feature 1..361: note = chr3:138662087-138662448
  misc_feature 1..361: note = Hyper
  source 1..361: mol_type = genomic DNA
ccctgaggttcctaccgcctgaccactggagggctgaagtgagaggcctgcaggctcattcccgtggcgcaaaaccgctcctggcccaccagccggcctggacctgccgccacattgctggccaggccccgagatagacggggggggggcagtgagggctgggtgcggggtctagtctcagctgagcagcagcccgcaagaaccggcggatctatcctatcagaagtcggaagtcatctatcccatcagaagagtgaaagccgaccaccccctaatccgcctgggagaaccagactgcaaccaggtcaaacgcctgtgtgcctgcgcggaagcatggatcttaattcgttatttggggatc

SEQ ID NO: 122437 - DNA, 50 bp, Homo sapiens; identical to SEQ ID NO: 90316
  misc_feature 1..50: note = chr3:138662799-138662849
  misc_feature 1..50: note = Hyper
  source 1..50: mol_type = genomic DNA

SEQ ID NO: 122438 - DNA, 37 bp, Homo sapiens; identical to SEQ ID NO: 90317
  misc_feature 1..37: note = chr3:138663076-138663113
  misc_feature 1..37: note = Hyper
  source 1..37: mol_type = genomic DNA

SEQ ID NO: 122439 - DNA, 2814 bp, Homo sapiens
  misc_feature 1..2814: note = chr3:138663703-138666517
  misc_feature 1..2814: note = Hyper
  source 1..2814: mol_type = genomic DNA
aaaacattagccagccgccggggcccggaggtgcccgaagcgacgggactgatagcggaggaaacgcagcctccctccgcgcccgcccgcggtgtaaaccgagtacaggccgtggagccaggctgccccggctcccgctgggtcccaacccccgccccgcctagtgggccccgcggcaagcggcttctgaacagcttcaagagggttcgcggagcaaacacacgtattggtccgtccctttctcgggcagcgcggtcccgccatcagtcctgtccggcgcgtctagccatggactgcacggcagtcgggcggggaacgcggagagcgagcgcaccgacctgtgagagaaggccaagaggtctgcgctgccgacgcccggtcgcacctccgccccgggccctttccgcggtgaatttgggcaggagacgctggggctccggaaagagacgagcccagtagaaagcgcgcagagaggcagcttcaggccaggggagtgcaaggtcacagaggtcagggaggtgagcacaggaggacataaactgaggggacaaagaggagcgacaggagcttaggaaagcgaaaaagcacagagggaccctgggcgctggctccagaggcgggcccagagggtgtgaggtcaggctggcggcggcgtcgtcggctgcgaccggggccggcgtcgcgcgtccctgcatcctcgcatccgtctgcaccggcatgcggtgggctctcagagatcgaggcgcgaatgcagcgcgccggtcttgctgtcgtggtcccagtaagagcaatgcatcatggcgagctcgggctgccgggcacaagcgaactgcaggcccggcgcactggtgggcgcgggcgccgggggcgcggcggtggctgggctggcagggctgagctggcccggcggcggcgcggcggccccgtggtgcggtggggcaggcggcggtgcggcggccgcgtgcagatggtgtgcgtgcggatgcgggtgggggtgcggcggaggcgggggtgcggccggcgggcctcccaggccattgtacgagttcactacgccggggggcagcgccatgctctgcacgcgtgtgtacggcccgtacgaggcggccgggcccgccagccccttgaccacagcggccgcgccagggctaccggggcccgcggctgcagccgcagctgctgcagccgctgcggctgccgccatctggcaggaggcatagggcatgggtgagggaggctgcggtagcggccacgagttgttgaggaagccagactgcaggtacttggggggcgccaggtagccgtagccgtcggccccggcgcccgccacgccgcacccgcctgcggcgcctccggccccgaagagccccttgccgggctggaagtgcgcgggcggcggccggaagggcctcttcatgcggcggcggcgccggtagttgcccttctcgaacatgtcttcgcaggccgggtccagcgtccagtagttgcccttgcgctcgccgccgccctcgcgcggcaccttgatgaagcactcgttgaggctgaggttgtggcggatgctattttgccagcccttcttattcttctcgtagaacgggaacttcgcgatgatgtactggtagatgccggacagcgtgagcctcttctccgcgctctcgcggatcgccatggcgatgagcgccacgtacgagtacgggggcttctgcgccgggtccggcttctccggggctgtcccgccgccacccccaccgcccttgcctgggctcggcggcggcccttctggctccttgactgtgcgaccggtctctggggccagcagggcccccgccgcgtcctcgggctcggggtagctggccatcatgacaaagccggcgcgccgcggccgggccgcctctgctctccgctccaggcgctggcgcggcaaagagttggggcgcacgagtccgcttacggccaagtctcaaacttctggagactgcggatgccgcccgcgcttgcttgctggaggcctgtcgctgctctcccctctccttccccttcccctagggagcggccggcgggagtggagctcagcctctggccatggggagtccgcccaacagagaggggctccggcctcgccgcccctccccgctcaggccagtccccgccttggtgggttttcttttctgcgctcttcccctccccccgccccccggtttcccgaagcacgacccgcgtctctggcggagctgcctcctggagtccctagtgcgccaggagcctcgctctgttctgattcgtatgggctccaccgagttccgcttgcgtcaggcgccttcgcccctatagcggggcggccagccgcgcacgggcgagttcatctccaagtcactttttgtaaacgccccgcacagcctggaccggcctgcccccgcccagcgagcctcaggggcccagccgacagccaggctcacgcgcccttgaaatctgccggtactcgctctgcgggctgggctgggagatgacgaggaccccggtggggtctgcccgcacccggccaaagcccaggaagctcgggccccagcgaggaaaggcgctccaagcctcctcgcggctttcaggtgaaagaaaacgactcctttgctctgccgtttgctgccgtcttgaggctgaacttctagctcggggctggggaggggcgagacggcgagggggctggacggggtagggtggggagagctgctctgaggctttgggaaagtcagcccagaaacgggtgtgactgtacgaagaagcctcggcctggcctgtccctcgcgctctcagagtgac

SEQ ID NO: 122440 - DNA, 947 bp, Homo sapiens
  misc_feature 1..947: note = chr3:138668596-138669543
  misc_feature 1..947: note = Hyper
  source 1..947: mol_type = genomic DNA
gaatcctctccttgccggcccagccagaggtgggtgaaccgggcgctccaggaaacggtgcggggcgccctgatttacttctcaaccttcggaggtaggctggttgctggcgaggtcgggatcctctctgaacagggcatactgtgcctaggttttgtggacgccagggccggttccttttctccccgcggcattggggcgacgcagggcccccggcttagtgaccttggggcggcgctcacctccaaaggccagggtggtgggctgggcagaactcactgcctctttgccccagttttccagggtcccgcagctgcaattcagcagccaccggcgcctcctgaccgtggtcccaccgtagcgccgcctgcggatacggttccagtgaaccgccgattgagcgcagtctcagctcccgcgcctcctcgcagcctggccccgcgcctcggaggtcccgacagccggcgcgagcaatctacacggctctgatacagacgcttttctccccagggccgggaatcctgcaacagcggcagaagccgcccgcgcctcgggcttccggcggcccagctctactagggaagcgtcgcggctgctctgaggcaggcagcgcttcgctagaaccactcagctcgtcccgcgccgccgccggctgcctgaaccaggttccgctgtcccctttcctagcgggaccccgaaacacccggcggcttcccgctcctgagcgggagagaatagagcttgctgcaaccctctgcttggagggatggcctctgcggtgcttggctagcaaagggaagcttcactgtgtctattagtacatccccatacactccacgcctcaacaactgtcagcactcactccctcccggcccctcacagggccctttgcacccacacctcagggactcggtgtccctccactcaggtcacgttactccatccac

SEQ ID NO: 122441 - DNA, 417 bp, Homo sapiens
  misc_feature 1..417: note = chr3:138679148-138679565
  misc_feature 1..417: note = Hyper
  source 1..417: mol_type = genomic DNA
aatgttaggggtcctcgtatgtgttcatggatagtgaggcagtagcatgaagaggcgggaaattcaggatgggagagggctgcaggacaaagactgcgggcagtccggccgggttcctgggtggaggaaggaaggcacgtttcccggtgttgttccaggcctgacgggtgttcagggtgtaggactcagggtgtaggacgagcgtggcgcgtccctccggaccggaagcggggctcaccccagcgacggggggcttcctcactttcgtaccgcgctccttccccgcagaggcccgccggaagcggcagccggcgatggggaccagggcccgggacaggcgggtgatgtctttcctggaggcagcgatgcaggaagcccgcggggagccccggcttcgccgctcggggttcaggtgca

SEQ ID NO: 122442 - DNA, 222 bp, Homo sapiens; identical to SEQ ID NO: 90328
  misc_feature 1..222: note = chr3:139059248-139059470
  misc_feature 1..222: note = Hypo
  source 1..222: mol_type = genomic DNA

SEQ ID NO: 122443 - DNA, 492 bp, Homo sapiens; identical to SEQ ID NO: 90331
  misc_feature 1..492: note = chr3:139258180-139258672
  misc_feature 1..492: note = Hyper
  source 1..492: mol_type = genomic DNA

SEQ ID NO: 122444 - DNA, 448 bp, Homo sapiens; identical to SEQ ID NO: 90333
  misc_feature 1..448: note = chr3:139396418-139396866
  misc_feature 1..448: note = Hyper
  source 1..448: mol_type = genomic DNA

SEQ ID NO: 122445 - DNA, 1656 bp, Homo sapiens
  misc_feature 1..1656: note = chr3:139653445-139655101
  misc_feature 1..1656: note = Hyper
  source 1..1656: mol_type = genomic DNA
ttctcggagatgacgcggagccctgccattgccatccaggtccaaggctatctactctgcccgacaacccctagcaccactaggcgctgctctagtgtgcgcctggcgccctccccagaccagtcgacgcagaacgcccagagacccagccaagggcaagacccttagcgacgcccgtcagtcctctccgcccagatatcagttcaaagggcatggcaggtcagggtccctcgcgccaccccagatgaccctcaggcctcgggtggccactttctgggggagccctccatcccttgcggcagcttttccgagagtcggagtggaggcgcggggctggagggctctccggagccgcccaccagggtcctctgggggcccggtcccgactgggcagggggacctggacagggccccggagcgtggagacggctgaggaaagttgggggtcggggccttggggcggggagcgcggaacccggcgccgatgcccgcgttcatgaatatgcacgagccacctccctccctccgtgacgtcacgggccgtcccggggtgagcgcctgagccgctccgggtccgcgccagtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaaggtgggtgctggggaagtttgctcttctcccaggagggaggcagggcaggcttgagggtgaaagcggcaaggacctaggctcaagctggatttgcccaccctcccttgccgcagcttctttggcctctgtgcgccctggattcccgaagtcagttccctgcgcagcggaccagagaggtccacccgcggacgtcaactcaacccctgggcggggtccgggggctgagcagaaggcgaggtctggggagtacggacaactttgagggctgtctgtgccggggtgggagcgcagtgggtgagtttcgagctctggcccagggacggctagagcagggcgctggcgcgccgtggggacaagcaggtgtctgctcctgcctgggggaaggatcagcggcggtgctttcaaggagggagccgagctgtgacttgtctcccagctcggggatggagtggaaacttgtaggctccagggaaggccccgctgacactcctcaagctcccccagggcgtctctgactccccggggaacgtgtaccctccgggtaggcggcggggtccggaagaagcgcgggatgtgaggctccccgctgcctttcctactccgctctgactaccgaggaccgaggagcctaacctggcaccactcccctgcccaccctgttcctttgaagagcttgacctccccgcgcctcccgcccggaaggaagctagatccaagcgaacgcctggctctgtcaggcgagcctggaagccggcgaaccccggactttgacagct

SEQ ID NO: 122446 - DNA, 30 bp, Homo sapiens; identical to SEQ ID NO: 90338
  misc_feature 1..30: note = chr3:139884168-139884198
  misc_feature 1..30: note = Hypo
  source 1..30: mol_type = genomic DNA

SEQ ID NO: 122447 - DNA, 120 bp, Homo sapiens; identical to SEQ ID NO: 90339
  misc_feature 1..120: note = chr3:140434129-140434249
  misc_feature 1..120: note = Hypo
  source 1..120: mol_type = genomic DNA

SEQ ID NO: 122448 - DNA, 22 bp, Homo sapiens
  misc_feature 1..22: note = chr3:140732060-140732082
  misc_feature 1..22: note = Hypo
  source 1..22: mol_type = genomic DNA
aaagcccttagtggccgggcgc

SEQ ID NO: 122449 - DNA, 2540 bp, Homo sapiens
  misc_feature 1..2540: note = chr3:140769436-140771976
  misc_feature 1..2540: note = Hyper
  source 1..2540: mol_type = genomic DNA
gttagcaaatgactgcgtaatggacctaaagtcaattctgggagcacagacgagggccaccaaaccaagaactttcaatttccccaaggaagcgcagataccagaagcaccctcgaggcttctgttttggccacgccctttaccccatcgctcagttcaggctcccaatgaggcggcccaccatcagcgctggtagagcaaagagaccgacttcctgcgcctcgggtgggcggggaacgctccttgagcaggtgcggtatgaaattggactttaagagatgagttggagcctgatctcaaaaataaagtgtggacgtgtgtgtctgaggaagggggataataaaccacccttttttcctcctggctgctatttcccacgtgcgttgagtaaaggcaccaaagctgcctagtgactgggtgtctcctccccgtcaggggcacccaccctggcgctccaggagcgcttgaatgaatccgggaggacccgcgcgcaggaatgaatgcgagagctagggagtgagcgggcgagtgggcgggtgagtgaatggcgaccgcgccgccgccttggcacaggggcgcgggcgcgggctccacttccctctcccgccagctggtggcctcgagaaggtggcggcgccggcagcggcccgagctgggacggccggggcgcgggatggtgggggaaggggcgttcccggcgaccgcgccttccgcggctattggattagtggccttcagggatgagctcagccagatcggctttcagctgcagcctccgggccggccgggaaggcggggagcgggcggcggcggcggaggagggggaggcggcggcggctgcagcatccagagctggccgtggcggccggcgcgccccgcgcacaaaagcacccagccccaggggagggcgatgaacacaccacatcccgggcccgggccccagctgctgctaccgctgcgtgcgctcagggcgctggggaagacgcccggcgcgccgggggccagcggccgaggcgcggcccgtgcgccctgagcgcgggactcgtcgccctccgggtcaggcgccaagcttccaagcggctagagcgcgggccttggagcgcccccaggatcgcttcagtaaggcgcttccccactccaggcccgacccccggcgcctgagcgccaacttcgccaagaacgctcctaactccaggccatcctgcagcgcagagggggcgctgctgccgggcatcagccgtgaggacgcgcccctggccgtgcggagagagccggcatttgcgggtcactcgggcgcccctgagtgggcggcggcggcagcagacccctctccagggagtccaggacctgccagcgctggggattcttcccgaacaggcgcttgccctctcttttatggtaagtactctccagctcctggtgaggggcgcgcgggggccgggagccgagatccggctgcacggactttgtgcgggccagcactcgacacagctggcgctcctgacgtcccagtccctgagaattcctctctgcaggttgtggcagttcgagatggttgatttgcgcgcagccctggggcgtttggggcccggcctttggtatcatgggttctaagccctttgcttctctgcgtagcggacaacgcacaaaaaactgccatccgattcacccgctttggtttggatccaggatccgtcactcactggctgagtgaccttggacagggcgccaaacctgtttcctcatccgtaggatgggaatgataattgtgcacattttataggggtattggaaagatctatgggatggtgttcgtaggtagacatgtgctgggcacacaggaaacactcaatcatatgttagctagtattattattagctttgcgagcccaagcttgttatccaactttccgaagctgcagcagttccgtcgtccgtgtaatggggacaataattcctgggggtctgttcgtccggggtattcggagaggtggaagtaaagcacgggtcacgcaataggcaccggtggctgttgttaccgtttattcctgactctggggcagtgaggctggtcgcctggcccgagagcgactcagggaccagtcctggccttgcttgaatacaaacttgtctatgctcgggaagggagggggttgggagctcaggaaaccctaggcgcagggctctgggaaggagggagggggtcagagacttgagcgcggcaaatgtgtccgccctggtcgctctgtacgcgccaggggctccaagccagaaggggacgccgagcccccgacctctgactggcgggagaaccgggggagtggctgctcccgccggcccatggccaagcgcagacggctgccggcaggaaggagaggagggcacttttctgtaccgctgtcgcgagaaggtggagagttctcagttctggagtcaggcttgggttcgaatctgtctccaccaccagctcgcggtgtgaccttgggcaagttctctaacctccccccgcttggtttcctcttctgcgccccactctcctc

SEQ ID NO: 122450 - DNA, 43 bp, Homo sapiens; identical to SEQ ID NO: 90345
  misc_feature 1..43: note = chr3:140785562-140785605
  misc_feature 1..43: note = Hypo
  source 1..43: mol_type = genomic DNA

SEQ ID NO: 122451 - DNA, 375 bp, Homo sapiens; identical to SEQ ID NO: 90346
  misc_feature 1..375: note = chr3:141174296-141174671
  misc_feature 1..375: note = Hypo
  source 1..375: mol_type = genomic DNA

SEQ ID NO: 122452 - DNA, 482 bp, Homo sapiens; identical to SEQ ID NO: 90347
  misc_feature 1..482: note = chr3:141378730-141379212
  misc_feature 1..482: note = Hyper
  source 1..482: mol_type = genomic DNA

SEQ ID NO: 122453 - DNA, 138 bp, Homo sapiens; identical to SEQ ID NO: 40015
  misc_feature 1..138: note = chr3:141481968-141482106
  misc_feature 1..138: note = Hypo
  source 1..138: mol_type = genomic DNA

SEQ ID NO: 122454 - DNA, 30 bp, Homo sapiens; identical to SEQ ID NO: 90349
  misc_feature 1..30: note = chr3:141508206-141508236
  misc_feature 1..30: note = Hypo
  source 1..30: mol_type = genomic DNA

SEQ ID NO: 122455 - DNA, 665 bp, Homo sapiens; identical to SEQ ID NO: 28443
  misc_feature 1..665: note = chr3:141516079-141516744
  misc_feature 1..665: note = Hyper
  source 1..665: mol_type = genomic DNA

SEQ ID NO: 122456 - DNA, 86 bp, Homo sapiens; identical to SEQ ID NO: 90351
  misc_feature 1..86: note = chr3:141549437-141549523
  misc_feature 1..86: note = Hypo
  source 1..86: mol_type = genomic DNA

SEQ ID NO: 122457 - DNA, 77 bp, Homo sapiens; identical to SEQ ID NO: 90352
  misc_feature 1..77: note = chr3:141637559-141637636
  misc_feature 1..77: note = Hypo
  source 1..77: mol_type = genomic DNA

SEQ ID NO: 122458 - DNA, 30 bp, Homo sapiens; identical to SEQ ID NO: 40016
  misc_feature 1..30: note = chr3:142337360-142337390
  misc_feature 1..30: note = Hypo
  source 1..30: mol_type = genomic DNA

SEQ ID NO: 122459 - DNA, 305 bp, Homo sapiens; identical to SEQ ID NO: 90355
  misc_feature 1..305: note = chr3:142443546-142443851
  misc_feature 1..305: note = Hyper
  source 1..305: mol_type = genomic DNA

SEQ ID NO: 122460 - DNA, 30 bp, Homo sapiens; identical to SEQ ID NO: 90356
  misc_feature 1..30: note = chr3:142499588-142499618
  misc_feature 1..30: note = Hypo
  source 1..30: mol_type = genomic DNA

SEQ ID NO: 122461 - DNA, 30 bp, Homo sapiens; identical to SEQ ID NO: 90357
  misc_feature 1..30: note = chr3:142499820-142499850
  misc_feature 1..30: note = Hypo
  source 1..30: mol_type = genomic DNA

SEQ ID NO: 122462 - DNA, 466 bp, Homo sapiens; identical to SEQ ID NO: 90358
  misc_feature 1..466: note = chr3:142607418-142607884
  misc_feature 1..466: note = Hyper
  source 1..466: mol_type = genomic DNA

SEQ ID NO: 122463 - DNA, 1409 bp, Homo sapiens
  misc_feature 1..1409: note = chr3:142681832-142683241
  misc_feature 1..1409: note = Hyper
  source 1..1409: mol_type = genomic DNA
ggtggaagggcacgtcgccgccgctcaggaagaacagacggcagaacttgctcaggaacagcagcagcgggatgaagtgcgtccagaagttgagcgtctcgttggtaggcttcagcaccgaggctaggcactcctgggccgtgcacggcagacgccggtagcccgacaggatgaagcactccacgaagtcgtcgggcacctcgtcccagcgcagcagcggcttggcagacgctggggggtcccgggaggcggcagagtgggagttccgggcggcccccgaagctgccggggccggggccggagggccttttgtgcccgcgccccggggctgcaggcgccgcggcatggtgcccggggctcggctagggcgcgcgcaggcgacctctggcgccggctcccgggcgctgggcagcccccgccggccgccgtcggagcctttgtgcccacgccgggggcgtcgctgcaggtttaggagaagacccgtgcctccgagcagccgctcctaaaaattaaataaatcaataagagaatcaattaataggcagcgctgcgaccgccaggagcgcggagcgcgcgaggctcagcggcttcctcgccaagcccctgctaccggcgcgcggccgcccgcgctgcggcagcggcggcggcgcggctgactgcggcggcagcgcggcagcggtgactgggcatcgcgcggtgcgggtgcctccgccgccgccgcccccggagcgggaggtggggatgtgcgagccgaggcgcggagggagggacgggcgcaccgaggaagggcgggggcctcccaggctagggtttcgcggccgcttcgggggatagagttgtcccctgtctcgagttccgtaccatccccctcctcgggccgccgcagcccgggccgccccgttaatgattgatgcgggggccgcaggctggtcggcgacgcggcggcgcgcgcgccgagtactagagtcggccctggggttcgaaacccgacagccacgcgggcgttctggaggacactggggagccgcgttcgcggggggcggggagctgcggctgcggggggaggggagggcgccggagccgggcagggcggagagatgcgccagcggtaatctccggaggtcgccggggaggggggcactccggaagtcggggggctttaagcccgcgtccggatcggggccgtgtcattgtcagctacctggggatgcgcctctcgctccctcactgtctttgcgtgtgtgttagtgtgtgtgtgtgtgtgtgtgtgtgtgtgtcggcctgtctacgcactacacgaaggcttagttggtcttctttcgtctagtgggcgcactcaggtgcgtcaccattctgccgtttccctcgcccttgtcctgtccgaaagaaccgtccgcaagctgccctgt

SEQ ID NO: 122464 - DNA, 22 bp, Homo sapiens
  misc_feature 1..22: note = chr3:142718194-142718216
  misc_feature 1..22: note = Hypo
  source 1..22: mol_type = genomic DNA
gggcgcggtggctcacgcctgt

SEQ ID NO: 122465 - DNA, 21 bp, Homo sapiens
  misc_feature 1..21: note = chr3:142718456-142718477
  misc_feature 1..21: note = Hypo
  source 1..21: mol_type = genomic DNA
gcgagacgtctcaaaacaaac

SEQ ID NO: 122466 - DNA, 44 bp, Homo sapiens; identical to SEQ ID NO: 90363
  misc_feature 1..44: note = chr3:142791151-142791195
  misc_feature 1..44: note = Hypo
  source 1..44: mol_type = genomic DNA

SEQ ID NO: 122467 - DNA, 17 bp, Homo sapiens
  misc_feature 1..17: note = chr3:142802592-142802609
  misc_feature 1..17: note = Hypo
  source 1..17: mol_type = genomic DNA
agcgtgagccaccgtgc

SEQ ID NO: 122468 - DNA, 2458 bp, Homo sapiens
  misc_feature 1..2458: note = chr3:142837831-142840289
  misc_feature 1..2458: note = Hyper
  source 1..2458: mol_type = genomic DNA
ttctgcaaattagaacggggcgttcccctcccccatcaccccaattccagaggacgtcaatcacagtggacgcagcaccgcgagcggaaatgcggagagcatcggggctccgcatgtggggcacaatgaaacaagagcagccccggccagaggtccagtaaagcggaaagacggtcccgcccgcacacccctccggaaaactgaagcgtctcctctgacccccaaggtcagaaagatttattacttccttcgagagggcgcagccacagacccactagagagggcgggcagggtgtcggaagccagagaacggcgctccgcgtcctcccaccgctccagggcgcagaggtgtcctcagtgcccggagaggttggcagtgtcggccccgagggaagcgtggagcggacggccgacaggggatttctgcccaaacttcatcaccaactctttctgagagcaaaaacatggggccgagtccggcagctgcacgcagaatccaactctctggcagctctcggcaccgacgagctccagatcccgcgttcgcatcccggcgctttgcgcgcagagctaagccttcggacccgtggactgcagcccccgcgcgtcgcggtaaagcgggtcgcgtctccagcccccgaggcgcagcgacggtgggagccggctcggcgttgggggcgggggcggggccggcgaagggggagggctgcgcggcggaggggaggagccgcggcgacagacggcggcgcgcaccaaccgggcgccggctggcaggagccgcgcagaggctggtccgagcgcgttgcgggcgcccggcgtaaggggagtcgggtagcagcatcctcctgggcgccgctttcgcgcggcggcggcggctgcggcggggtctttctttgcttaaatacctcgttggccagaagcgctggtaccgggggcgggttgggtcgggtcgggcagtgctgcacacctgggtttccttgcctagagctgtgtgttcggggtcctttggtccagtcggaggctgcggagcggcgggggttgcctgcgctgtccgcccgggcatcctcccggtgatggaagcagccgccgccgccgctgcggggtcgcgctgtgccccatccaccgctgccagagaggtgggaaaattcgccgcacggaggccgaaagcgagaggggctgcgccgctatgccgggagctgagtcccatataagccgcccccagccatcgcccccagccggcttcgttcccctgagcgagacaggaagctgcggtcccgagaaagcggaggagacgtcgctggagccgggaggcgccgggttcggcggagcgcggagcggggctctgggccgcgtgaaagtttttcttcccgagccgcagggcgcccgctgcccggaaactgcccagggataagtcggccgactccccagacccctcgaaggtgcggggacccccagcggaagcgagagggagcgaaatcgaggaacgagtgacagccggacagtccgccgggcggtgatccggggccgctcccgggcgcgccctcggctccaggtgagcggaggaaccgggcagaaccgagggtgggcgttacttaggaggaggaggctgggagggagattggggcgcatccgctcactccgcttcccctcgcaggtcctacccggagccgctgccatgggagagccagccttgggcgctggggaccagccgccgcgcccgcctcggagtcgcggcccgagtcccggcgccagcagccagcccgctgcgtccccttcccgggctgcagggctgcctccgccgcgccgccggcccggattgtgcctgtgatgagccgcagcccgcagcgagctctgcccccgggcgcgctccctcggctgctccaggctgcgcctgcagccgcgccgcgtgccctgctcccgcagtggccccggcgcccaggacgccgctggcccgcgtcccctctcggaatgaaggtgttccgtaggaaggcgctggtgttgtgcgcgggctatgcactgctgctggtgctcactatgctcaacctcctggactacaagtggcacaaggagccgctgcagcagtgcaaccccgatgggccgctgggtgccgcagcgggggcagccggaggcagctgggggcgcccagggccgcctccggccgggccgccccgtgctcatgcccgtttggacctccgcactccttaccgccctcccgctgccgccgtcggggcggctcctgcagccgcggcagggatggcgggggttgcggcccctccaggcaatggcactcggggcaccgggggcgtcggggacaagcggcagctggtgtacgtgttcaccacgtggcgctctggctcgtcgttcttcggcgagctattcaaccagaatcccgaggtgttctttctctacgagccagtgtggcatgtatggcaaaaactgtatccgggggacgccgttt

SEQ ID NO: 122469 - DNA, 24 bp, Homo sapiens
  misc_feature 1..24: note = chr3:142853160-142853184
  misc_feature 1..24: note = Hypo
  source 1..24: mol_type = genomic DNA
gggctcaagcgatcctcccatcta

SEQ ID NO: 122470 - DNA, 30 bp, Homo sapiens; identical to SEQ ID NO: 90376
  misc_feature 1..30: note = chr3:142859875-142859905
  misc_feature 1..30: note = Hypo
  source 1..30: mol_type = genomic DNA

SEQ ID NO: 122471 - DNA, 451 bp, Homo sapiens; identical to SEQ ID NO: 90377
  misc_feature 1..451: note = chr3:142895864-142896315
  misc_feature 1..451: note = Hypo
  source 1..451: mol_type = genomic DNA

SEQ ID NO: 122472 - DNA, 22 bp, Homo sapiens
  misc_feature 1..22: note = chr3:142913215-142913237
  misc_feature 1..22: note = Hypo
  source 1..22: mol_type = genomic DNA
aaagtctcactttgtcgagcag

SEQ ID NO: 122473 - DNA, 22 bp, Homo sapiens
  misc_feature 1..22: note = chr3:142913477-142913499
  misc_feature 1..22: note = Hypo
  source 1..22: mol_type = genomic DNA
caaagtacggggattgcaggcg

SEQ ID NO: 122474 - DNA, 30 bp, Homo sapiens; identical to SEQ ID NO: 90380
  misc_feature 1..30: note = chr3:142957298-142957328
  misc_feature 1..30: note = Hypo
  source 1..30: mol_type = genomic DNA

SEQ ID NO: 122475 - DNA, 21 bp, Homo sapiens
  misc_feature 1..21: note = chr3:142957630-142957651
  misc_feature 1..21: note = Hypo
  source 1..21: mol_type = genomic DNA
ccaccgcgcctggcctgtaat

SEQ ID NO: 122476 - DNA, 260 bp, Homo sapiens; identical to SEQ ID NO: 90382
  misc_feature 1..260: note = chr3:142973621-142973881
  misc_feature 1..260: note = Hypo
  source 1..260: mol_type = genomic DNA

SEQ ID NO: 122477 - DNA, 200 bp, Homo sapiens; identical to SEQ ID NO: 90383
  misc_feature 1..200: note = chr3:143024050-143024250
  misc_feature 1..200: note = Hypo
  source 1..200: mol_type = genomic DNA

SEQ ID NO: 122478 - DNA, 37 bp, Homo sapiens; identical to SEQ ID NO: 90384
  misc_feature 1..37: note = chr3:143036841-143036878
  misc_feature 1..37: note = Hypo
  source 1..37: mol_type = genomic DNA

SEQ ID NO: 122479 - DNA, 45 bp, Homo sapiens; identical to SEQ ID NO: 14579
  misc_feature 1..45: note = chr3:143092973-143093018
  misc_feature 1..45: note = Hypo
  source 1..45: mol_type = genomic DNA

SEQ ID NO: 122480 - DNA, 34 bp, Homo sapiens; identical to SEQ ID NO: 40026
  misc_feature 1..34: note = chr3:143151477-143151511
  misc_feature 1..34: note = Hypo
  source 1..34: mol_type = genomic DNA

SEQ ID NO: 122481 - DNA, 101 bp, Homo sapiens; identical to SEQ ID NO: 90387
  misc_feature 1..101: note = chr3:143166561-143166662
  misc_feature 1..101: note = Hypo
  source 1..101: mol_type = genomic DNA

SEQ ID NO: 122482 - DNA, 30 bp, Homo sapiens; identical to SEQ ID NO: 90388
  misc_feature 1..30: note = chr3:143189998-143190028
  misc_feature 1..30: note = Hypo
  source 1..30: mol_type = genomic DNA

SEQ ID NO: 122483 - DNA, 38 bp, Homo sapiens; identical to SEQ ID NO: 40027
  misc_feature 1..38: note = chr3:143210840-143210878
  misc_feature 1..38: note = Hypo
  source 1..38: mol_type = genomic DNA

SEQ ID NO: 122484 - DNA, 30 bp, Homo sapiens; identical to SEQ ID NO: 90390
  misc_feature 1..30: note = chr3:143346055-143346085
  misc_feature 1..30: note = Hypo
  source 1..30: mol_type = genomic DNA

SEQ ID NO: 122485 - DNA, 29 bp, Homo sapiens
  misc_feature 1..29: note = chr3:143367116-143367145
  misc_feature 1..29: note = Hypo
  source 1..29: mol_type = genomic DNA
accagggaactgtttcgtggaaggcgatt

SEQ ID NO: 122486 - DNA, 231 bp, Homo sapiens
  misc_feature 1..231: note = chr3:143566691-143566922
  misc_feature 1..231: note = Hyper
  source 1..231: mol_type = genomic DNA
caaaaacaaacagctcgccctcgactccccacatgacaatggacccgcatctgtcaacagacttgcattatgtgccgtgtgagaacatgactgtgacatttgctctcgtgacatggcaaatttcggcggcttgtctgtaaagagattagcattcgttacgctgcagcacctttcatcaaactaatgacatttcaatcagcacattttctccagtttcggtactttgctatc

SEQ ID NO: 122487 - DNA, 30 bp, Homo sapiens; identical to SEQ ID NO: 90394
  misc_feature 1..30: note = chr3:144206683-144206713
  misc_feature 1..30: note = Hypo
  source 1..30: mol_type = genomic DNA

SEQ ID NO: 122488 - DNA, 184 bp, Homo sapiens; identical to SEQ ID NO: 90395
  misc_feature 1..184: note = chr3:144314841-144315025
  misc_feature 1..184: note = Hypo
  source 1..184: mol_type = genomic DNA

SEQ ID NO: 122489 - DNA, 167 bp, Homo sapiens; identical to SEQ ID NO: 90398
  misc_feature 1..167: note = chr3:145878028-145878195
  misc_feature 1..167: note = Hyper
  source 1..167: mol_type = genomic DNA

SEQ ID NO: 122490 - DNA, 64 bp, Homo sapiens; identical to SEQ ID NO: 90399
  misc_feature 1..64: note = chr3:145878489-145878553
  misc_feature 1..64: note = Hyper
  source 1..64: mol_type = genomic DNA

SEQ ID NO: 122491 - DNA, 69 bp, Homo sapiens; identical to SEQ ID NO: 90400
  misc_feature 1..69: note = chr3:145878868-145878937
  misc_feature 1..69: note = Hyper
  source 1..69: mol_type = genomic DNA

SEQ ID NO: 122492 - DNA, 28 bp, Homo sapiens
  misc_feature 1..28: note = chr3:145908278-145908306
  misc_feature 1..28: note = Hypo
  source 1..28: mol_type = genomic DNA
aagtctatcctggcccggtgcggtggct

SEQ ID NO: 122493 - DNA, 84 bp, Homo sapiens; identical to SEQ ID NO: 90402
  misc_feature 1..84: note = chr3:145968319-145968403
  misc_feature 1..84: note = Hyper
  source 1..84: mol_type = genomic DNA

SEQ ID NO: 122494 - DNA, 19 bp, Homo sapiens
  misc_feature 1..19: note = chr3:145970676-145970695
  misc_feature 1..19: note = Hypo
  source 1..19: mol_type = genomic DNA
tccccgactgagctggtct

SEQ ID NO: 122495 - DNA, 58 bp, Homo sapiens; identical to SEQ ID NO: 40028
  misc_feature 1..58: note = chr3:146187920-146187978
  misc_feature 1..58: note = Hypo
  source 1..58: mol_type = genomic DNA

SEQ ID NO: 122496 - DNA, 37 bp, Homo sapiens; identical to SEQ ID NO: 40029
  misc_feature 1..37: note = chr3:146188305-146188342
  misc_feature 1..37: note = Hypo
  source 1..37: mol_type = genomic DNA

SEQ ID NO: 122497 - DNA, 116 bp, Homo sapiens; identical to SEQ ID NO: 90409
  misc_feature 1..116: note = chr3:147072554-147072670
  misc_feature 1..116: note = Hyper
  source 1..116: mol_type = genomic DNA

SEQ ID NO: 122498 - DNA, 30 bp, Homo sapiens; identical to SEQ ID NO: 28462
  misc_feature 1..30: note = chr3:147073006-147073036
  misc_feature 1..30: note = Hyper
  source 1..30: mol_type = genomic DNA

SEQ ID NO: 122499 - DNA, 30 bp, Homo sapiens; identical to SEQ ID NO: 90411
  misc_feature 1..30: note = chr3:147073354-147073384
  misc_feature 1..30: note = Hyper
  source 1..30: mol_type = genomic DNA

SEQ ID NO: 122500 - DNA, 144 bp, Homo sapiens; identical to SEQ ID NO: 90412
  misc_feature 1..144: note = chr3:147073957-147074101
  misc_feature 1..144: note = Hyper
  source 1..144: mol_type = genomic DNA

SEQ ID NO: 122501 - DNA, 176 bp, Homo sapiens; identical to SEQ ID NO: 90413
  misc_feature 1..176: note = chr3:147074915-147075091
  misc_feature 1..176: note = Hyper
  source 1..176: mol_type = genomic DNA

SEQ ID NO: 122502 - DNA, 563 bp, Homo sapiens
  misc_feature 1..563: note = chr3:147076998-147077561
  misc_feature 1..563: note = Hyper
  source 1..563: mol_type = genomic DNA
cctttctcctcctcccgccaggtgctggagtttttacaccggtgctttgttacttaaggagaaaaactgcctgcatggtgcaggatgctgaaggggagacagaaagagaaggtctggcggcctgggggcggccatgcgtgtagccctccccggtatgtttttgtgcacagagttggcgccagggcagcgccccagaccccagtcctggctggacaataaatgaccggacagctgcggccgctacaaaggagcccctcgaccgcgtcgctgtttacttagtgtcgggtctgaccccagggctgcttgcggccagtacagatgctgattccaccctgggaacaggctttctgtcctccgttcgccgcgctagccagcacgtgtttgcaaacaacttaactgacttctcgaatattcatctgctgacgctggctttagggaaatttgaggggagactcgctgggcaaagacccgaggcctctggaggtttggctccccacacgcaggtcccgtccgcctcgctgattatcttttcttctttccagaggaagcggataggcttcagc

SEQ ID NO: 122503 - DNA, 287 bp, Homo sapiens; identical to SEQ ID NO: 28466
  misc_feature 1..287: note = chr3:147078959-147079246
  misc_feature 1..287: note = Hyper
  source 1..287: mol_type = genomic DNA

SEQ ID NO: 122504 - DNA, 793 bp, Homo sapiens; identical to SEQ ID NO: 90416
  misc_feature 1..793: note = chr3:147087044-147087837
  misc_feature 1..793: note = Hyper
  source 1..793: mol_type = genomic DNA

SEQ ID NO: 122505 - DNA, 326 bp, Homo sapiens; identical to SEQ ID NO: 90417
  misc_feature 1..326: note = chr3:147088241-147088567
  misc_feature 1..326: note = Hyper
  source 1..326: mol_type = genomic DNA

SEQ ID NO: 122506 - DNA, 26 bp, Homo sapiens
  misc_feature 1..26: note = chr3:147088627-147088653
  misc_feature 1..26: note = Hyper
  source 1..26: mol_type = genomic DNA
caaagctgcaacggaagagattttca

SEQ ID NO: 122507 - DNA, 94 bp, Homo sapiens; identical to SEQ ID NO: 28470
  misc_feature 1..94: note = chr3:147088939-147089033
  misc_feature 1..94: note = Hyper
  source 1..94: mol_type = genomic DNA

SEQ ID NO: 122508 - DNA, 407 bp, Homo sapiens; identical to SEQ ID NO: 90420
  misc_feature 1..407: note = chr3:147090416-147090823
  misc_feature 1..407: note = Hyper
  source 1..407: mol_type = genomic DNA

SEQ ID NO: 122509 - DNA, 114 bp, Homo sapiens; identical to SEQ ID NO: 90421
  misc_feature 1..114: note = chr3:147096028-147096142
  misc_feature 1..114: note = Hyper
  source 1..114: mol_type = genomic DNA

SEQ ID NO: 122510 - DNA, 30 bp, Homo sapiens; identical to SEQ ID NO: 90422
  misc_feature 1..30: note = chr3:147096695-147096725
  misc_feature 1..30: note = Hyper
  source 1..30: mol_type = genomic DNA

SEQ ID NO: 122511 - DNA, 30 bp, Homo sapiens; identical to SEQ ID NO: 90423
  misc_feature 1..30: note = chr3:147098132-147098162
  misc_feature 1..30: note = Hyper
  source 1..30: mol_type = genomic DNA

SEQ ID NO: 122512 - DNA, 308 bp, Homo sapiens; identical to SEQ ID NO: 28473
  misc_feature 1..308: note = chr3:147098379-147098687
  misc_feature 1..308: note = Hyper
  source 1..308: mol_type = genomic DNA

SEQ ID NO: 122513 - DNA, 35 bp, Homo sapiens; identical to SEQ ID NO: 28474
  misc_feature 1..35: note = chr3:147102662-147102697
  misc_feature 1..35: note = Hyper
  source 1..35: mol_type = genomic DNA

SEQ ID NO: 122514 - DNA, 284 bp, Homo sapiens; identical to SEQ ID NO: 90426
  misc_feature 1..284: note = chr3:147102945-147103229
  misc_feature 1..284: note = Hyper
  source 1..284: mol_type = genomic DNA

SEQ ID NO: 122515 - DNA, 396 bp, Homo sapiens
  misc_feature 1..396: note = chr3:147105872-147106268
  misc_feature 1..396: note = Hyper
  source 1..396: mol_type = genomic DNA
gagtgaacccctaaacgtgggcaagtcgggttctagaaaggaagtatatactggagagcgcagtgacagtattaaatggcgtgaaagcaaaggtcagcgcaaatgtatcttaatagagtgtctgtagtgaagtgtgccgcctttgaagcggccgctccccgcgcgtatttccatggcgagcctaacgcggcatgctgatgcaccgtcaaactcacactttcaaccccaaaacccgactctttgaacaacccgagcttgattagacctttctccttttctttcccctcttacaaaccatttcctcgcctttagaaactcgccatcaaacccaaacgcgccctctgatcaccgcagaaagcagaaacaaagggggctgagcggcgattcaagcggctc

SEQ ID NO: 122516 - DNA, 169 bp, Homo sapiens
  misc_feature 1..169: note = chr3:147106520-147106689
  misc_feature 1..169: note = Hyper
  source 1..169: mol_type = genomic DNA
accatgaagatgcaccgtggcgaagaaacactgctttgtgcgcgggccctttgatgtagcaggcgcgagatgcggggcgctcagctgcgcggagcgagattaccttgcgagcaacgcggtggacatctgtaacaagcaaatgaaaaattaaaggcgattagtggccgac

SEQ ID NO: 122517 - DNA, 1959 bp, Homo sapiens
  misc_feature 1..1959: note = chr3:147108766-147110725
  misc_feature 1..1959: note = Hyper
  source 1..1959: mol_type = genomic DNA
cctgggacttgtggccgcagtccgacgagggcgacacgagggcagacggtgtagccgaatcgtagccagagctgggcggcggcgagcgcccgtgcaccttcatgtgcttacgcagcgagctggggtgcgtgtagcacttgtcgcagccccgcaccttgcacgtgtatggcttgtcgctagtgtgcacgtgcgaatgcttcttacggtcgctgctgttggcgaagcgccgctcgcagccctcgaactcgcatctgaagggcttctcgcctggcggaggcaacgcagagacattagtgcttgtgggtcgtgttcccgtcaggtgcttgccaccctcccccattcgtctctcattttctggaaaagaactacaaaatattttcagaaatccctttccacggcgcctcaggtcgagcacccctttccctcgtgcagagagcgcccccggtgccctctcttgaacgcctccatccctcccgccttcctcctctgggctcatggggagggtatggaggaggagcgacagtgactccatcttagtcgagtttccatcctcgaaaatcctgatccactcgggttgtttcctccaaattttctccacttggaaccagaagcacctctgctcggaaatacattaacggaggagctcacaatatagttaacggggaagctcacatctgctcgatttaaagttgctgtttcagactaacttctctgccgctaccccgcccagccgttcatcccccccacccacccccatcctggcccaaattgtttcctaaagtaggttttgcgcaaacgccaaagcgatgaaataatttaaggatgcgcagccgatgcacattgtgtgtgcataaagtggattcgtgctgcagggagaggtattctgagcaatgattcacttcagaagagatttttacaggaatggagccccctccctctttccttctaccccctgagggcaaacatttagcagcattcttcaaatcttgcctaaaccttccgggatccctccagatacgctcgccagtaataatatttcattacgctgctccagaggcttcctggagaccgtgctgtgggcagctggccctcccagtccgcactgacttgcgatgtcgaccggtctgcccagaccacccccacctggctgtcgggcctctcggtcctaagacgaggggttggcgcggtagggtccgcacaggccaaatgggatccgaggtgtctaccgcaaccacgcccttgagcgctgcggcttcgggaagaaaacagctgctgctgtcaggccaggcctggctccgcagcccggagggccaccaggcggctggcataggccggggaggggctgggatcggtggctgcgatgccctgtagagccgagggaaggcgcgagtgcacgttagagtgacaatattggccggaccgagccccaatcggggagctcacggccagctgaattcgctgacgtgtaggagaggaaaggaccccgagaacccggaagcctagattcctgccggagctgcaagtgctgcggaaatgggggaagaaggtttctgggcgctttaaacaaatggctgcctcccagcgctctgagttaagggaccggctacctagcgtctagctgaggaggaagacgcgcagctggagaactgttgcctttgtagttgcttctcccgccgcatccaggaaaaacaggcgctttggggctggttagaacaaacaaagccccaattcccgagccctgttgaggctcggacagagaggtttgcgcacaacctgcgcttctgcgcaatcagcggctcctgagcccgggtctccggcaccacctggtcgctggattcccaccctacaggagcacagctagtacactgaacagtctggaaggtgttggcacctgccatttcgcgggacactggcaccattttataaaacagtgatagaaagatgcggaataaatcagtg

SEQ ID NO: 122518 - DNA, 713 bp, Homo sapiens
  misc_feature 1..713: note = chr3:147110927-147111640
  misc_feature 1..713: note = Hyper
  source 1..713: mol_type = genomic DNA
ccccaacaaaaatcccgccaaacgcttatccgatctcgtgagcgcctcactggacattcacgtaaaacaaaaacaattatttcgctccagacgaggagcagaggagaaaacagcagtgcactgagtgataccggcagccgggaagttcgcaggcccctaggaggccaggtgaggccgcgccccagcttgctccggagctgcaggaggcgccctggtctctgcgcttgacatcacccccgccccccgccaacacccggcctccagtccttccccctccctccagctccctgcactgcgccctgggtgggtgggtgaatgtgaagaggcggcgttgggctaggcccctgcagcccgctcggagcgtcctaggcccggggctgcgctgtgaaagacccagattctcatcccagaggcccagcagtcctgaaaggcctcctctccgaccctgagccgggtccgccgaacaaagttcggaagctcgggctagctgggccagcgccattttctcgcacttgtggctggatctggttgtcccggcgactgcgccccggcgcggtctcttttcctctacctcggatccccagcactgactcgccctcagacgccggggaaggtgtggtgagctcccggccccggccgaggggtccctggagaggagctgggtggcggtggccaggccgagcgcggttgctggcccgcgcctccctccccga

SEQ ID NO: 122519 - DNA, 378 bp, Homo sapiens; identical to SEQ ID NO: 90433
  misc_feature 1..378: note = chr3:147111965-147112343
  misc_feature 1..378: note = Hyper
  source 1..378: mol_type = genomic DNA

SEQ ID NO: 122520 - DNA, 30 bp, Homo sapiens; identical to SEQ ID NO: 90434
  misc_feature 1..30: note = chr3:147112635-147112665
  misc_feature 1..30: note = Hyper
  source 1..30: mol_type = genomic DNA

SEQ ID NO: 122521 - DNA, 49 bp, Homo sapiens; identical to SEQ ID NO: 90435
  misc_feature 1..49: note = chr3:147114169-147114218
  misc_feature 1..49: note = Hyper
  source 1..49: mol_type = genomic DNA

SEQ ID NO: 122522 - DNA, 269 bp, Homo sapiens; identical to SEQ ID NO: 90436
  misc_feature 1..269: note = chr3:147126945-147127214
  misc_feature 1..269: note = Hyper
  source 1..269: mol_type = genomic DNA

SEQ ID NO: 122523 - DNA, 713 bp, Homo sapiens
  misc_feature 1..713: note = chr3:147127613-147128326
  misc_feature 1..713: note = Hyper
  source 1..713: mol_type = genomic DNA
aagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctct

SEQ ID NO: 122524 - DNA, 30 bp, Homo sapiens
  misc_feature 1..30: note = chr3:147128605-147128635
  misc_feature 1..30: note = Hyper
  source 1..30: mol_type = genomic DNA
ccaaccccaaaaagtcgtgcaacaaaactt

SEQ ID NO: 122525 - DNA, 661 bp, Homo sapiens
  misc_feature 1..661: note = chr3:147136863-147137524
  misc_feature 1..661: note = Hyper
  source 1..661: mol_type = genomic DNA
tagggggtgcaacagcgagacttccccacaacacctccaccgaaggctgggtcgtcagcgtttgagggaccctcccgccaccccgcagcctggcggggcgctttccaaatcgtcgcggcaggctctggccgggcagggcgagatgtgcgcatgcgcggcctgtggcccgaggttccacgtgctgatgaatatgcatgagactcccccgccctcgcgggctagagagagaaccaagcagaggctccggcctgtgaaagtcgctggctaggctcccaaaatagtgcggcggggtagctgcacgtgtttgttttcaaaccgcgctggtttaagtgagttcacactgcggagccgacagcagagggtagagcaacctggggctgctgccattggaacggcgagttgagcgggcctgtcagggcctctccgccgagggccgggggctgcatggtgctcgagccccagccggccacaccccagtgcatcgggtggctgggcttccagtttacaccgggcctaccagggaggccttcttctcttatcctttcccaagcccgagctgccgccccggctgttctcatatccctagcccctcggagaagacttagcctacccctagtcagagctcaggccccaggtgaccgggcagcggcttgggggaggt

SEQ ID NO: 122526 - DNA, 809 bp, Homo sapiens
  misc_feature 1..809: note = chr3:147138768-147139577
  misc_feature 1..809: note = Hyper
  source 1..809: mol_type = genomic DNA
aggactccaagctaacgatgacctgtgtgggccttgctctgaacagaaaactcaaactcagcgtgggttcccgcgtcttccccaaaaggccaaggcccaaagaacccttttcatttggcgaggggcttgaggaagggaggggctggggcgggagagggtcggggtctgcaagccagcggcccggcgcagcggacttgtccggctgctcagcttggcagctagcgtccgtgccggcaacgctgttaccctctcctgggctggagagtggggacatcccttccccgcccctaggcgtccctggggtcggcgccagagcccgggagcgccggaggctctggctggatggcggcgaggagggctctgagtcctctcccggccaggccgagcttagtatgtggaggcggcggcgggagtgcgggcatggaccaagggaagggggacacccaaaccgcattggtgccttcctttccctccactcgcgccgtagacctccccaaattgcccgtctccggtatgactgaatctgtctgctggcctctcagctaccaactctgcccgaaatctagatcccagacctggtaagtcgcgttcctcccctaccccgccccgccaccttactagcggactctgcccgcgacagcgtgcgcgcgcgtggcctgaggcgcgcgctgagaagttgggctgatttggaactgctgcgctagttcggcctctgccgctggggtgtatacgtttatacgccgtacgctccagggtagtcaggaatgtcgcggggctccccagtgaggcgggagcgaaaagagtgcagg

SEQ ID NO: 122527 - DNA, 454 bp, Homo sapiens
  misc_feature 1..454: note = chr3:147140804-147141258
  misc_feature 1..454: note = Hyper
  source 1..454: mol_type = genomic DNA
aagtccctggtctggcgctcagcggctgaaactgcagcgtttcggcctcacagatggggctggagttggagacgtcgctgcggccaggactgggaggccacttgcttggcgggtgaggcggctcacgcggtatttattgactggctcgggaaacgtgttcttttacttacttgtcattaaagttctaagttttaaaagcgcattcccagaaaatgcttttattctctttcccccagtaacagagcccgctaactgctttcaactggagaaggggagaaattcactcctgcacgagttcccagctactctctggtgaaagcgggagggcgaagcgaaattgtgttctagctctgagctccgcagccctccaatggctgacttccttcagctgctgtcctggggtgccgatcgctgcggcagacgcaattttccgcacctgcgtgttgttttttgc

SEQ ID NO: 122528 - DNA, 145 bp, Homo sapiens
  misc_feature 1..145: note = chr3:147142166-147142311
  misc_feature 1..145: note = Hyper
  source 1..145: mol_type = genomic DNA
ctggcattctaactgcgacaggactttcgagcgagtgcgaggaaagcccctttcgacagttctgaggttttatccgaccctgcccgggactccctccctgcatgcccccggagctccagtccgggccacccgggggctgctgggg

SEQ ID NO: 122529 - DNA, 30 bp, Homo sapiens; identical to SEQ ID NO: 90444
  misc_feature 1..30: note = chr3:147636685-147636715
  misc_feature 1..30: note = Hypo
  source 1..30: mol_type = genomic DNA

SEQ ID NO: 122530 - DNA, 42 bp, Homo sapiens; identical to SEQ ID NO: 90445
  misc_feature 1..42: note = chr3:148337549-148337591
  misc_feature 1..42: note = Hypo
  source 1..42: mol_type = genomic DNA

SEQ ID NO: 122531 - DNA, 768 bp, Homo sapiens
  misc_feature 1..768: note = chr3:148415302-148416070
  misc_feature 1..768: note = Hyper
  source 1..768: mol_type = genomic DNA
tgtattaccaaagttcgagttactcataggaaagagaaagaagttctctaattcgtccttaaaagttttccaagttcagaaaaaaaaaatgttgaagaacacgaatctccgcaggaaatgatactcctgtacccccagctcgctctccctcacgacccctcgctaggcggggttcgggaccaggtgaacgctgatctgatagttgacacgggacgactgtggcatcatccttgctgccgtcaatatcccgagagggaggaggttgggccgggagggtctcccggggcggggcggaggaggagggaatgcaaaacagagcctcgtccccggaacccaagaagcagcaacgcccctcactataaattcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtgagtccgcgcggaccgccaggcatgcttgggggacttcaagggcggggtgctaagtttcatgtcacggtgtcctaactgctggctctatactgggaagctctcggggaccaaggaaagagcgaccgtagttctggtcagcgcctgcccctggag

SEQ ID NO: 122532 - DNA, 47 bp, Homo sapiens; identical to SEQ ID NO: 90448
  misc_feature 1..47: note = chr3:148459165-148459212
  misc_feature 1..47: note = Hypo
  source 1..47: mol_type = genomic DNA

SEQ ID NO: 122533 - DNA, 24 bp, Homo sapiens
  misc_feature 1..24: note = chr3:148463858-148463882
  misc_feature 1..24: note = Hypo
  source 1..24: mol_type = genomic DNA
cgcgcccagcgtgaaggcttctat

SEQ ID NO: 122534 - DNA, 151 bp, Homo sapiens; identical to SEQ ID NO: 90450
  misc_feature 1..151: note = chr3:148472011-148472162
  misc_feature 1..151: note = Hypo
  source 1..151: mol_type = genomic DNA

SEQ ID NO: 122535 - DNA, 27 bp, Homo sapiens
  misc_feature 1..27: note = chr3:148556008-148556035
  misc_feature 1..27: note = Hypo
  source 1..27: mol_type = genomic DNA
tgggcgacagagcgagactctgtctca

SEQ ID NO: 122536 - DNA, 51 bp, Homo sapiens; identical to SEQ ID NO: 90455
  misc_feature 1..51: note = chr3:148705411-148705462
  misc_feature 1..51: note = Hypo
  source 1..51: mol_type = genomic DNA

SEQ ID NO: 122537 - DNA, 27 bp, Homo sapiens
  misc_feature 1..27: note = chr3:148802983-148803010
  misc_feature 1..27: note = Hypo
  source 1..27: mol_type = genomic DNA
actacaattatgggccggatgcggtgg

SEQ ID NO: 122538 - DNA, 26 bp, Homo sapiens
  misc_feature 1..26: note = chr3:148803250-148803276
  misc_feature 1..26: note = Hypo
  source 1..26: mol_type = genomic DNA
ggacgacagagcgagactccatgtca

SEQ ID NO: 122539 - DNA, 35 bp, Homo sapiens; identical to SEQ ID NO: 90458
  misc_feature 1..35: note = chr3:148804164-148804199
  misc_feature 1..35: note = Hyper
  source 1..35: mol_type = genomic DNA

SEQ ID NO: 122540 - DNA, 30 bp, Homo sapiens; identical to SEQ ID NO: 28493
  misc_feature 1..30: note = chr3:148943086-148943116
  misc_feature 1..30: note = Hyper
  source 1..30: mol_type = genomic DNA

SEQ ID NO: 122541 - DNA, 33 bp, Homo sapiens; identical to SEQ ID NO: 90460
  misc_feature 1..33: note = chr3:149286506-149286539
  misc_feature 1..33: note = Hypo
  source 1..33: mol_type = genomic DNA

SEQ ID NO: 122542 - DNA, 459 bp, Homo sapiens; identical to SEQ ID NO: 90461
  misc_feature 1..459: note = chr3:149374947-149375406
  misc_feature 1..459: note = Hyper
  source 1..459: mol_type = genomic DNA

SEQ ID NO: 122543 - DNA, 415 bp, Homo sapiens; identical to SEQ ID NO: 90462
  misc_feature 1..415: note = chr3:149375996-149376411
  misc_feature 1..415: note = Hyper
  source 1..415: mol_type = genomic DNA

SEQ ID NO: 122544 - DNA, 165 bp, Homo sapiens; identical to SEQ ID NO: 90464
  misc_feature 1..165: note = chr3:149687803-149687968
  misc_feature 1..165: note = Hyper
  source 1..165: mol_type = genomic DNA

SEQ ID NO: 122545 - DNA, 217 bp, Homo sapiens; identical to SEQ ID NO: 90465
  misc_feature 1..217: note = chr3:149956581-149956798
  misc_feature 1..217: note = Hypo
  source 1..217: mol_type = genomic DNA

SEQ ID NO: 122546 - DNA, 35 bp, Homo sapiens; identical to SEQ ID NO: 90466
  misc_feature 1..35: note = chr3:150062858-150062893
  misc_feature 1..35: note = Hypo
  source 1..35: mol_type = genomic DNA

SEQ ID NO: 122547 - DNA, 161 bp, Homo sapiens; identical to SEQ ID NO: 14584
  misc_feature 1..161: note = chr3:150135175-150135336
  misc_feature 1..161: note = Hypo
  source 1..161: mol_type = genomic DNA

SEQ ID NO: 122548 - DNA, 88 bp, Homo sapiens; identical to SEQ ID NO: 40037
  misc_feature 1..88: note = chr3:150237908-150237996
  misc_feature 1..88: note = Hypo
  source 1..88: mol_type = genomic DNA

SEQ ID NO: 122549 - DNA, 258 bp, Homo sapiens; identical to SEQ ID NO: 90469
  misc_feature 1..258: note = chr3:150443222-150443480
  misc_feature 1..258: note = Hypo
  source 1..258: mol_type = genomic DNA

SEQ ID NO: 122550 - DNA, 56 bp, Homo sapiens; identical to SEQ ID NO: 90470
  misc_feature 1..56: note = chr3:150505714-150505770
  misc_feature 1..56: note = Hyper
  source 1..56: mol_type = genomic DNA

SEQ ID NO: 122551 - DNA, 88 bp, Homo sapiens; identical to SEQ ID NO: 90471
  misc_feature 1..88: note = chr3:150583707-150583795
  misc_feature 1..88: note = Hypo
  source 1..88: mol_type = genomic DNA

SEQ ID NO: 122552 - DNA, 2210 bp, Homo sapiens
  misc_feature 1..2210: note = chr3:150802887-150805097
  misc_feature 1..2210: note = Hyper
  source 1..2210: mol_type = genomic DNA
agggtacagtaagaccgtggaaggttgtaaggaccagagattctgactatcaagatcctggcacgtagcgaaggctccataaatggcagccatcattcttggccaagtgcgggcgcattctcccgggcacgcctcccgcggggtccctcaggacaggccgagcccgcctccgcggctccggtctcgcagagctcgcgccaggtggcccagcatcttggtgcccgcgccccgaagcgaggagcgagggcgggttggatgaccaaggtctgccctggaggatcaccccccccgccccttccacgctcccggcgcaggtgaggttttcggcccaggccacggggaccgcgacctctggggaggtcgaggcggagggtgcagcggggggcttggagcagggctccagagggcgctccctccctcgcccaggttcaccccagggccagcctcggcgccggggcccgcgggctgcgcgctctgcggctgcgaaaacccggagaggcggattggagcgcgctcaccgcgctctcagccaactcctccgcggtccggccgccgagctgggcatgctcagtgcggacgccgcgccgccgtccgccaactcggaagctcgcgctcccgggccgtgggggcgagaacgccggcggcgagccggcgtcgctcgccgcccccagacagtggcaaacttcgcggcgttcccggagctcgtccgggcgaggcagataccgcacaaataaaatcaaatccaagtcccccatcccaacccgaatgatggaggctgcggcggccggagtgaccccgccgccgccagccccagcccgctagccgcggaccaacaggtaaagtgttgggggttgggggcggaagggaagaggagctggggccgtggggaggcggcgggctggaggagcccgagacgcctgcgggctggctgcccccgtcggcgctcacagccatcgctcctcacccccttccccagcccctggagggactgtaaagggttaagtcggccccacgccaccgtgagcacggccccctccagccgccgcgaccgccagcagcgcgcctcggcgcctgcccggagccgccgaggggaccgtagctgcggatgcgccactggaacctggcgggcgtctaggaggcaccggccgcttcccaccggccgcatccctgcgtctcgcgccccctccagacctgcctctgcctgcactggcccggtccgtgtccaggtggcggggtctgcggggcgcgtggcggcgggggaagggtccctgccggggaagagaggcgggggcggtccgctccacagcttcttcccgggaggggagggccaccctcgccttgggcgagcacttcagccaccagcctaggcgccaagaaaagtttttttttttttttttccagtgccccacccccacccccatcctgcgcccagctggggtgggtttgggtccattggtgaaaaaagtcacacgttcccatcagctgctcctccccctggagacaaggtaggggggagcagaggaggcaggcgccgcggaggaccctggccgacctctagtccctccgccgccgccaccggagcggtgcgtcccggggctcgagcgcagccgagtacccgccgaaggctgtccccatcagtgcgtgtctgctgccgggcagcggcagcatccaacctgctttattcctcctgcctgcagcgccacagcgagcgagcgagcgaggagggggagagagggagtctgtctgcaaagtgctgctccctggtgctcagaggcggctgctccagctccaactctcattcatttcgccggttaacatgagagatcatggccgccttcgggcttctcagctatgagcagagaccgctgaagcgcccccggctcgggccgcccgacgtctacccacaggaccccaagcagaaggaggtaagggcgccggcggcctccccggcaaccggggccgcgctctgcagcactgacccggggccaagttggcccagcgggcatcgccggcgctgcggtggaagaggtcggggagggggattagaggcgggggccaggctgggggtgctgggcgaccccccggcggcggagaccgagcggctgtcagtccccgcgctccactggggcgctcgctttccatgtgccggtcgctttcccgttgccgggccttgcacggcgccgccgggcgcttctcgggcttcttccctg

SEQ ID NO: 122553 - DNA, 30 bp, Homo sapiens; identical to SEQ ID NO: 90475
  misc_feature 1..30: note = chr3:150848389-150848419
  misc_feature 1..30: note = Hypo
  source 1..30: mol_type = genomic DNA

SEQ ID NO: 122554 - DNA, 96 bp, Homo sapiens; identical to SEQ ID NO: 90477
  misc_feature 1..96: note = chr3:152107121-152107217
  misc_feature 1..96: note = Hypo
  source 1..96: mol_type = genomic DNA

SEQ ID NO: 122555 - DNA, 240 bp, Homo sapiens; identical to SEQ ID NO: 90478
  misc_feature 1..240: note = chr3:152320903-152321143
  misc_feature 1..240: note = Hypo
  source 1..240: mol_type = genomic DNA

SEQ ID NO: 122556 - DNA, 41 bp, Homo sapiens; identical to SEQ ID NO: 90479
  misc_feature 1..41: note = chr3:152321383-152321424
  misc_feature 1..41: note = Hypo
  source 1..41: mol_type = genomic DNA

SEQ ID NO: 122557 - DNA, 30 bp, Homo sapiens; identical to SEQ ID NO: 40039
  misc_feature 1..30: note = chr3:152332728-152332758
  misc_feature 1..30: note = Hypo
  source 1..30: mol_type = genomic DNA

SEQ ID NO: 122558 - DNA, 27 bp, Homo sapiens
  misc_feature 1..27: note = chr3:152540434-152540461
  misc_feature 1..27: note = Hypo
  source 1..27: mol_type = genomic DNA
ttttttcttttttttcgagacggagtc

SEQ ID NO: 122559 - DNA, 1337 bp, Homo sapiens; identical to SEQ ID NO: 90482
  misc_feature 1..1337: note = chr3:152552388-152553725
  misc_feature 1..1337: note = Hyper
  source 1..1337: mol_type = genomic DNA

SEQ ID NO: 122560 - DNA, 22 bp, Homo sapiens
  misc_feature 1..22: note = chr3:152671180-152671202
  misc_feature 1..22: note = Hypo
  source 1..22: mol_type = genomic DNA
acataaatgataggccggactt

SEQ ID NO: 122561 - DNA, 82 bp, Homo sapiens; identical to SEQ ID NO: 90484
  misc_feature 1..82: note = chr3:152707532-152707614
  misc_feature 1..82: note = Hypo
  source 1..82: mol_type = genomic DNA

SEQ ID NO: 122562 - DNA, 26 bp, Homo sapiens
  misc_feature 1..26: note = chr3:152709701-152709727
  misc_feature 1..26: note = Hypo
  source 1..26: mol_type = genomic DNA
aagacacccaggtgccgaggcaagag

SEQ ID NO: 122563 - DNA, 27 bp, Homo sapiens
  misc_feature 1..27: note = chr3:152829598-152829625
  misc_feature 1..27: note = Hypo
  source 1..27: mol_type = genomic DNA
ggcgtgagcgaccgcacccagctgata

SEQ ID NO: 122564 - DNA, 45 bp, Homo sapiens; identical to SEQ ID NO: 90487
  misc_feature 1..45: note = chr3:152874399-152874444
  misc_feature 1..45: note = Hypo
  source 1..45: mol_type = genomic DNA

SEQ ID NO: 122565 - DNA, 30 bp, Homo sapiens; identical to SEQ ID NO: 40041
  misc_feature 1..30: note = chr3:152877598-152877628
  misc_feature 1..30: note = Hypo
  source 1..30: mol_type = genomic DNA

SEQ ID NO: 122566 - DNA, 72 bp, Homo sapiens; identical to SEQ ID NO: 90489
  misc_feature 1..72: note = chr3:152894314-152894386
  misc_feature 1..72: note = Hypo
  source 1..72: mol_type = genomic DNA

SEQ ID NO: 122567 - DNA, 30 bp, Homo sapiens; identical to SEQ ID NO: 90490
  misc_feature 1..30: note = chr3:152894853-152894883
  misc_feature 1..30: note = Hypo
  source 1..30: mol_type = genomic DNA

SEQ ID NO: 122568 - DNA, 34 bp, Homo sapiens; identical to SEQ ID NO: 90491
  misc_feature 1..34: note = chr3:152919057-152919091
  misc_feature 1..34: note = Hypo
  source 1..34: mol_type = genomic DNA

SEQ ID NO: 122569 - DNA, 30 bp, Homo sapiens; identical to SEQ ID NO: 90492
  misc_feature 1..30: note = chr3:152961303-152961333
  misc_feature 1..30: note = Hypo
  source 1..30: mol_type = genomic DNA

SEQ ID NO: 122570 - DNA, 25 bp, Homo sapiens
  misc_feature 1..25: note = chr3:152979662-152979687
  misc_feature 1..25: note = Hypo
  source 1..25: mol_type = genomic DNA
ccaccacgtccggccaactcatatt

SEQ ID NO: 122571 - DNA, 30 bp, Homo sapiens; identical to SEQ ID NO: 40043
  misc_feature 1..30: note = chr3:152999015-152999045
  misc_feature 1..30: note = Hypo
  source 1..30: mol_type = genomic DNA

SEQ ID NO: 122572 - DNA, 18 bp, Homo sapiens
  misc_feature 1..18: note = chr3:153018756-153018774
  misc_feature 1..18: note = Hypo
  source 1..18: mol_type = genomic DNA
aaaaatatgattggccgg

SEQ ID NO: 122573 - DNA, 30 bp, Homo sapiens; identical to SEQ ID NO: 90496
  misc_feature 1..30: note = chr3:153102203-153102233
  misc_feature 1..30: note = Hypo
  source 1..30: mol_type = genomic DNA

SEQ ID NO: 122574 - DNA, 19 bp, Homo sapiens
  misc_feature 1..19: note = chr3:153204811-153204830
  misc_feature 1..19: note = Hypo
  source 1..19: mol_type = genomic DNA
ccatgtcaggttgggcgcg

SEQ ID NO: 122575 - DNA, 26 bp, Homo sapiens
  misc_feature 1..26: note = chr3:153224197-153224223
  misc_feature 1..26: note = Hypo
  source 1..26: mol_type = genomic DNA
aggagccaagatggccgaataggaac

SEQ ID NO: 122576 - DNA, 22 bp, Homo sapiens
  misc_feature 1..22: note = chr3:153381610-153381632
  misc_feature 1..22: note = Hypo
  source 1..22: mol_type = genomic DNA
ctattggctaggtgccgtggct

SEQ ID NO: 122577 - DNA, 642 bp, Homo sapiens; identical to SEQ ID NO: 90500
  misc_feature 1..642: note = chr3:153838818-153839460
  misc_feature 1..642: note = Hyper
  source 1..642: mol_type = genomic DNA

SEQ ID NO: 122578 - DNA, 666 bp, Homo sapiens
  misc_feature 1..666: note = chr3:153839727-153840393
  misc_feature 1..666: note = Hyper
  source 1..666: mol_type = genomic DNA
taggcaagactaactcggtgttgctcctcccggcgctgacttcgaggcccggctatggacggcgagagcgaggtggatttttctagcaacagcataacccctttgtggcggaggcggtcgattcctcagccccaccaggttctgggccggagcaagccgaggccccagtcctaccagagccccaacgggttactaattacggatttcccggtggaggacggagggacgctcctcgcagcgcagattcccgcccaggtgcccaccgcctcggacagcaggacggtacataggagccccctgcttctgggcgcccagcggagagcggtggccaatggtgggacggcatccccggagtacagggctgcctctcctcgacttcgacggcccaagtcacccaagctccccaaagcggtgcctggcggctccccgaaatccccagcaaatggcgcggtgaccttgcctgcgccgccgccgccgccggttctgcgccccccgcggactcctaacgcgcccgccccctgcacccccgaggaggaccttactgggttgactgccagcccggtgccttcgcccactgcaaatggccttgccgctaataacgactctcctgggtcaggttcgcagtccggccggaaggcaaaggaccccgaacgggggctctttcct

SEQ ID NO: 122579 - DNA, 1470 bp, Homo sapiens
  misc_feature 1..1470: note = chr3:154145550-154147020
  misc_feature 1..1470: note = Hyper
  source 1..1470: mol_type = genomic DNA
caagccttttctccacgcacgctgcctcagttccctttccagttccttctcctgatggacagcggggacctctgctacggagctggctccctgtccttggtgatgggctcctgggaacggcggggcacacccccagggttgggaggggtttcagcttttgagtgccggatctgcgcccgctgcctattcaagactccaccagaaaggcacagtctacaacgtgggggacgctagctaggaaacaggcgtccgtgaaacccgcatctgattctccgaatggcctttgtcgcctccctggaccctcacctccgcccatgcgcgctcgtcacagtggggcgccactctgccacctcttaatcggcttcctcctggaaggaggaacaaaagcctgttttgttccctgtcttctccctccacaactgatctctcctcccctctatcccgccctgctggagatgggcgtcgtcctctctaggcgggaatggaacggcgagaaagggatgacagaaggttgtggggaaaaaaccttttaattccctctttccttttctgaatactctctgattttgctgtgtgagacaatatccttggccaccaccgatatggaaaactaagtcgctcgcgacggaaagcgatccccatgcccctgacttttgaaaggagaagcatttagtagtaaaggtttcgcagccaactagccctgtcccgaactgccttcttctaagtgcatgtctaaaacccagcgagatacacttggaagcggacttcactgtgtgtctcttggtgactccccaaaccggcgacgccggtcccaacactcatttacactgtctggcacacacactcgcgctttgtgagcaactgcacttttaccatcatgggcagccaaaggacgacttttgtaagcgctaggatcaaagcgaagcgcttctgcgctacgctcacggtgaagctcctggtgccatagagagtcccccggttctcacgcctgcaggcttcagccccagcggcagcgggcgcacccggtccgaacacggtgtcggagctcggagagcatcccccagagcgccgcagactcgggcctggagcatcctctggggacagggaaaccactctccccgcagtaggaggggtcccaggaattgaagctccacgggaaatttcctggtagttggagtggagtctcggcggctcctccgaacacagcaatcggtgagtgagtgggactgagaggcccacgaggagtccgaaggccaaagcgtacacgatagagaggaatagtacgtaggagctggagcagtccaccaggcagccccagggcgtgcgcacgaaggcgccccagccgcacagcgggagcgccgagagcagcagactggctgcccacacggtcagcaccacgccgagcacctggcccgatcttctggaggctgtctggctccccacacctctgtgcatcgtataaaagttgta

SEQ ID NO: 122580 - DNA, 18 bp, Homo sapiens
  misc_feature 1..18: note = chr3:154179223-154179241
  misc_feature 1..18: note = Hypo
  source 1..18: mol_type = genomic DNA
tctgagatggagtttcgc

SEQ ID NO: 122581 - DNA, 30 bp, Homo sapiens; identical to SEQ ID NO: 90508
  misc_feature 1..30: note = chr3:154373134-154373164
  misc_feature 1..30: note = Hypo
  source 1..30: mol_type = genomic DNA

SEQ ID NO: 122582 - DNA, 30 bp, Homo sapiens; identical to SEQ ID NO: 90509
  misc_feature 1..30: note = chr3:154797184-154797214
  misc_feature 1..30: note = Hyper
  source 1..30: mol_type = genomic DNA

SEQ ID NO: 122583 - DNA, 730 bp, Homo sapiens
  misc_feature 1..730: note = chr3:154797461-154798191
  misc_feature 1..730: note = Hyper
  source 1..730: mol_type = genomic DNA
gagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttggg

SEQ ID NO: 122584 - DNA, 30 bp, Homo sapiens; identical to SEQ ID NO: 90512
  misc_feature 1..30: note = chr3:155668471-155668501
  misc_feature 1..30: note = Hypo
  source 1..30: mol_type = genomic DNA

SEQ ID NO: 122585 - DNA, 76 bp, Homo sapiens; identical to SEQ ID NO: 90513
  misc_feature 1..76: note = chr3:156002795-156002871
  misc_feature 1..76: note = Hypo
  source 1..76: mol_type = genomic DNA

SEQ ID NO: 122586 - DNA, 915 bp, Homo sapiens
  misc_feature 1..915: note = chr3:156009024-156009939
  misc_feature 1..915: note = Hyper
  source 1..915: mol_type = genomic DNA
agcaacccaggctttcgctcgagaatgagtggggaggggtcttgaggagcccccacgtcctcccggagcggaggcgggagggagctgacagccggagtggatggagaccaccagtccgaggggacccgcttgcgattagctgcttcttgggatgctccgcgcgccagttgagcatcctgcctgtggtccaggggatgctggcggcgcatcttgcggtaagcctgcgctgatttgagccatcgcccagaagcgagcccgcattcagacaccgcggaccggctccgcgaagggctgcgtgcagtcaccatgaatgctcagctctaggcttctgtaaaaacctcccccactgcatggatttggctgtttaatcagccgagattacagcccgggaagatttgcaaacctgattctccctccagctgctgtgacaacttcggggccgtctgtttacttctctgggtccccggggactctttcctgcatcgcagccccttgtgccactttgtgggcttggctcgaaagtcagccgccaggactcctctgacggcatccccaggaagggggagcaaggagggcttaaaagaaaagcagaaatccccgcaactgctcaacctctcgtgactgcctgtgttctggggttctgagagggaccgtgcgctgcctggggaagcaatgcaagtctccatagcctgcacagagcacaatttgaagagtcggaatggtgaggaccgacttctgagcaagcagagctccaccgcccccaatgtggtgaacgcagcccgggccaaattccgcacggtcgctatcatcgcgcgcagcctggggacgttcacgcctcagcatcacatttctctcaaagagtccaccgcaaagcagactggcatgaaatataggtatgcacgtaagattccctct

SEQ ID NO: 122587 - DNA, 328 bp, Homo sapiens
  misc_feature 1..328: note = chr3:156534211-156534539
  misc_feature 1..328: note = Hyper
  source 1..328: mol_type = genomic DNA
tcctttcagcctcagcgagcgctgcccttcattaccccccagcgcacttctggacactgcgccgggtcgccggggtcagccgcccggccacgaaagtcgcccccagcgtgccccaggcgtcagtgcacgccgggctcccggctccaggcaggcggggtgaggcagctccgcgaaggccactcgctggcgaccccttcccgggtctcctagccctggccgggctgcccccgcgcccgcccccgccctcgaaatccaggcagtgcgggaggccgccttgctgctctctccgcccgcacagggccgcccgacggagcgggcagggagcagg

SEQ ID NO: 122588 - DNA, 30 bp, Homo sapiens; identical to SEQ ID NO: 90517
  misc_feature 1..30: note = chr3:156543165-156543195
  misc_feature 1..30: note = Hypo
  source 1..30: mol_type = genomic DNA

SEQ ID NO: 122589 - DNA, 23 bp, Homo sapiens
  misc_feature 1..23: note = chr3:156999611-156999634
  misc_feature 1..23: note = Hypo
  source 1..23: mol_type = genomic DNA
actacgcccggccaaaattgagt

SEQ ID NO: 122590 - DNA, 182 bp, Homo sapiens; identical to SEQ ID NO: 28512
  misc_feature 1..182: note = chr3:157155252-157155434
  misc_feature 1..182: note = Hyper
  source 1..182: mol_type = genomic DNA

SEQ ID NO: 122591 - DNA, 77 bp, Homo sapiens; identical to SEQ ID NO: 90520
  misc_feature 1..77: note = chr3:157155701-157155778
  misc_feature 1..77: note = Hyper
  source 1..77: mol_type = genomic DNA

SEQ ID NO: 122592 - DNA, 351 bp, Homo sapiens; identical to SEQ ID NO: 90521
  misc_feature 1..351: note = chr3:157156015-157156366
  misc_feature 1..351: note = Hyper
  source 1..351: mol_type = genomic DNA

SEQ ID NO: 122593 - DNA, 52 bp, Homo sapiens; identical to SEQ ID NO: 90522
  misc_feature 1..52: note = chr3:157217149-157217201
  misc_feature 1..52: note = Hyper
  source 1..52: mol_type = genomic DNA

SEQ ID NO: 122594 - DNA, 121 bp, Homo sapiens; identical to SEQ ID NO: 90523
  misc_feature 1..121: note = chr3:157261112-157261233
  misc_feature 1..121: note = Hyper
  source 1..121: mol_type = genomic DNA

SEQ ID NO: 122595 - DNA, 101 bp, Homo sapiens; identical to SEQ ID NO: 40046
  misc_feature 1..101: note = chr3:157303466-157303567
  misc_feature 1..101: note = Hypo
  source 1..101: mol_type = genomic DNA

SEQ ID NO: 122596 - DNA, 1691 bp, Homo sapiens
  misc_feature 1..1691: note = chr3:157812154-157813845
  misc_feature 1..1691: note = Hyper
  source 1..1691: mol_type = genomic DNA
aagaggaggcaagggcgccgcgagctccccggatgcactggtcccacaggccgtgcccgagtggagcactgcgaatggggccaagaaattttggcctttctcgccggacctggctgcctccgcgggcctctccgcctaccgcgctcccgccgcggcccgactcccgcgggtctccgcgccgaacccacctggctcctatcgcacgggacattcccgacccacccacgccgcgtcactgagcctctgtaccgatacccggcgcctccgccagcagggcctggacgcaccgcctcctttgacctcgggcttcccccgcgctccgctgcttggggcagactggccccgagagggagccaccatctcccctgctccagggtctccagggtccgaacccgtgttgggatctgggttaggattagggtttggagcttggagcctgcctgttaggacccccggccccggcgccgactggagctcgctggaggccacaggaccacggcggatggcctggctgcttcagggcgtaccatgcccgcaggcagatgtttattattaaaaactaccgacgttcatcaaccaggagacccgcaaggcctgcgcactgaatacggcccaaatcctgttcagtggtctttgaaagttaaaagaaagaaacctatcgcccacgtctatgctgaggaacagctttgaatacgagctaagacctgggagagggccaagtgggggtggtggggaacactgctggaggatgtggggctttggcaggggttttacgcaccctccagcacgagggtggggggtcccaggggacgctcaggactctttcagtctttgcggaaggtcccgtcatcacaagagcccgcgcgggaaggaaagttcctgccttggacatggtcagggccgagtcttcaaagtctccaactatccccacacaggcagcacctttgggctttactagtgggatttcttccagaagggggccacgacatggggagagagagctcctcattattttcaaggccaggcttttcctaaacccgattctggcttccaccttctaaatttaaccaatgaagaagctgcttcagccaaccctaaacaggagtgtcagatggggaatcctccctccacagtgccctggcctgcccgcctttgcggctcttttcccgctccgaagtcagcacctgccccgctccagagagggtcaacgaactgggactgattgtcgattatgccataccaaacccaggttgatttcgctccgcaggatccctccttccttcctcccaaaagtgtccccagataaagactggaattatagcaaaacgaataacgagagtccatcttggggaaggaagttactctatcctatgttattttacttcttatctgttctttcattaatttggtataaccctgtttctatgctgggtggataaaatggagggggccggcggaaatgcgctcagcgctaacgacagccacagagccacccttcttactgccccttgactgcggcacgtaagagcagaggcaagcgcttttccaagttggtatattcgagagagtgatacgcattaatcaaaagggaaagactatcccggatattttaatagtaacaggaacaaagatgactcgaaccccatcaaatgaaacgatattttcattcaattgatcgcaaagtgtcttca

SEQ ID NO: 122597 - DNA, 34 bp, Homo sapiens; identical to SEQ ID NO: 90528
  misc_feature 1..34: note = chr3:157815889-157815923
  misc_feature 1..34: note = Hyper
  source 1..34: mol_type = genomic DNA

SEQ ID NO: 122598 - DNA, 1253 bp, Homo sapiens
  misc_feature 1..1253: note = chr3:157820458-157821711
  misc_feature 1..1253: note = Hyper
  source 1..1253: mol_type = genomic DNA
ctgggtacctgcactcgggcctccgacaggcccagtcgctggctcagttcctctcgcatgaaggcgtcgggatagtgggtctcgtcaaaaagcctctccagctcattgagttgttccagggtgaaattggtccgacttcgcctctgcttgattttggtctggccttcgtcctccatccctttcgcatcctctttgcgatctttcagctccggggacactggagggggcaccccagcggggccacacgtgcatccacacgaacacacacacacacgcacacacacacggacgaaaacagcacagcaaatcctgttaccagatttgtcgcaaaaaagaatagagaatccttccccctcgtggaatcctggtccggcttctcaacccacccggaggaagaatatcccggagaagcgcaaaggtcaagtctgagcggccgcctggggcaaggtgggcagtcatccaccacctccttcacaaacgtacctcgactcaccgcctcactattcaccccccagtcaccggccttccccagcaaacaccaaatggtttccactcactttcgcactcacttgctccgcagcactcacagaaatcaaaggcgcagcgccaggcctctcacagagcaaagtctggacataagggcgcggcaaggccacccactggcctctcacaccggccattcccagaaggctggctcgttctcaggccagctctcaccaccgctggctctctgcctaccgcaaacttgctggtctaatttaggaacaattgggccgaaaggtatcagcgagagcaacagaccccggtgttgtgccgcacagggagccgcatccgcagacgcccctcgctgcccctgggctcgggccaaaccctgcataaggtcccctggacagccaggtaatctccgtcccgcctgcccgaccggggtcgcacgagcacaggcgcccacgccatgttggctgcccaaagggctcgccgcccaagccgggccagaaggcaggaggcggaaaaccagcctccggtggcgggcgaaagcaaccgctctttctgttctctcttcgccctccctcgtggaaacgcagactcgaccctaaacgcttaacccacagagatcaacaggttcaagcggaatattcgcgatcctcggtttctattggttgctcaaagccttttcatgcaaccagcagctcggatgtttaataaaatatgaatttttctgctctgggtttgcacacatccgttgccactttcct

SEQ ID NO: 122599 - DNA, 56 bp, Homo sapiens; identical to SEQ ID NO: 90531
  misc_feature 1..56: note = chr3:157822030-157822086
  misc_feature 1..56: note = Hyper
  source 1..56: mol_type = genomic DNA

SEQ ID NO: 122600 - DNA, 1035 bp, Homo sapiens
  misc_feature 1..1035: note = chr3:157822839-157823874
  misc_feature 1..1035: note = Hyper
  source 1..1035: mol_type = genomic DNA
aacacaccaagaaaccgaaacgcctcgcccgggagaagcagcgtagcctggacctcagctttcgttggcttccttctaccttgaaagagaatgggaagttttggcccctaagatccaaagattcaggggctctgcggagttcgaggggtcttggcggccccaaacacctaggcgaccggagggttaagctttccacctctgccccttctccctcccggcaaactctgcgctagaggctagctttagtcccgccgtctggttcagcaccccctcctgcagcccggccccgcgaacttccacgtccgcctgcgggccatccgggctgcgggcccatcctcccgctggtgaaaaatgcatttcggtggaatgggaacatctgggaagggcgcgcacaaaccccacacgcttccccccacgccacccccacaacacactaggaccccacccatgaccgagcataccaccggacccccacccttccactatcactctagctgacaaagctggggtccagggccctctccgtgtccctctcccctccccgctgggcctcggagtcctctcccgcccgagaggagtccggaaggcgggaaggggaaccgctgccgggggtcagtcaggtcgttaccctccgtcagtcgcgggctgcccggctccctgcttctctcggcggcgcccatgtccagctcccggacgggagagcgccctcctccagctcctccgcctgctcctcctcctcctacacctcctccgcctcctccgccgccgcctccgcctcctccgccgccgcctccgccggccgcccggactgccgggctgctgcggtcgtcgcggcccgcctcggtgcagccggtcggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttcct

SEQ ID NO: 122601 - DNA, 218 bp, Homo sapiens
  misc_feature 1..218: note = chr3:157824133-157824351
  misc_feature 1..218: note = Hyper
  source 1..218: mol_type = genomic DNA
cttccctgccggagcgcgcttgttcaatgttaagatctttgacaattcttcctgcggagagttcagatctgatagcgacgctgcgcttgaagtcccactatttatacttcctaacggcggcctcttgttttgagtaaattacctcccctcgcaactcggagtgagcccccttcccgggtagcagtcgcgcctctaccgggggttggggaggggaaaag

SEQ ID NO: 122602 - DNA, 997 bp, Homo sapiens
  misc_feature 1..997: note = chr3:157824411-157825408
  misc_feature 1..997: note = Hyper
  source 1..997: mol_type = genomic DNA
aggagagagagagattggagttcgggcgggctggggctggagtggtagggcagcacagggggaccggagggggcggggagagaaggccggtccccggccgctcaggttttcagatagcccctgccgcctgtgctcttggccattaatccaggattgacaagaatccctaattaatttaattaggcgtggattttgcgttggtgtcacgacttagttaaacactggggagctggatagaccccgcggggtggggccaagaggaaactgacaagtgcgcagctcttagagtcagtcaggtatcccgacactgcatccttccctacagccttgcttcgagtcagggtgcctcgcaatgctcagcttcgcattgcttttcctcgtccctgccctgcatcaaccgcccagcagtttacaggccccgcatcccattcccgcatcctgaccccgcatcccaattctgcatccccgcctctccctcacaatcccacccctgccggccgtagctccaccgcccagcatcatcctgcccagagacagggttgcctgcaccttctccgacccgcgcagcttctcttaggagcttcccggctcgcaggcaggctgagtccgggtcttctccaagctcctcgcccctcggtccgtgttattcgctctattattcgtgtcctggagcccagctgactcctctatggacagaccccgctaaaagggaccagtcgatttaacaagtttccccagcagctgttagctgacagatctcattttaaagtgtttccttagcgcccggtcaaggacagctcgacttcgttcgtttcctctctgaggtctcagaactcccacccttctcccttactctctgcactcggacccctctatggtgaattacaggacttcttctttagcatcttgggaaacatccgagtttatttactaatttgaaaaacaagagattatccctcttcgagtctgaaaaaaaaatcgacgttaagtttgtacc

SEQ ID NO: 122603 - DNA, 151 bp, Homo sapiens; identical to SEQ ID NO: 90538
  misc_feature 1..151: note = chr3:158176209-158176360
  misc_feature 1..151: note = Hypo
  source 1..151: mol_type = genomic DNA

SEQ ID NO: 122604 - DNA, 125 bp, Homo sapiens; identical to SEQ ID NO: 90539
  misc_feature 1..125: note = chr3:158288887-158289012
  misc_feature 1..125: note = Hyper
  source 1..125: mol_type = genomic DNA

SEQ ID NO: 122605 - DNA, 252 bp, Homo sapiens
  misc_feature 1..252: note = chr3:158449947-158450199
  misc_feature 1..252: note = Hyper
  source 1..252: mol_type = genomic DNA
acctcggccagcactcgtagcgcgctgggcgagccggaccggaagttgaagaagtgaagcgccgcgcgcgccgcctgctgcaggagcctgcgcgggaccccagcatcctgaggctgcccagggtcgtcggggtccccggaccccgcgggcgccgccaccggggcgagcaacagcagcagcgcgagcagcggggcggtggggcgcgggcccctgggcccggaccagggagcaggcagccgttgccggcggggc

SEQ ID NO: 122606 - DNA, 55 bp, Homo sapiens; identical to SEQ ID NO: 90541
  misc_feature 1..55: note = chr3:158450408-158450463
  misc_feature 1..55: note = Hyper
  source 1..55: mol_type = genomic DNA

SEQ ID NO: 122607 - DNA, 30 bp, Homo sapiens; identical to SEQ ID NO: 90542
  misc_feature 1..30: note = chr3:159444029-159444059
  misc_feature 1..30: note = Hypo
  source 1..30: mol_type = genomic DNA

SEQ ID NO: 122608 - DNA, 44 bp, Homo sapiens; identical to SEQ ID NO: 90543
  misc_feature 1..44: note = chr3:159480931-159480975
  misc_feature 1..44: note = Hyper
  source 1..44: mol_type = genomic DNA

SEQ ID NO: 122609 - DNA, 58 bp, Homo sapiens; identical to SEQ ID NO: 90544
  misc_feature 1..58: note = chr3:159482848-159482906
  misc_feature 1..58: note = Hyper
  source 1..58: mol_type = genomic DNA

SEQ ID NO: 122610 - DNA, 71 bp, Homo sapiens; identical to SEQ ID NO: 90545
  misc_feature 1..71: note = chr3:159483270-159483341
  misc_feature 1..71: note = Hyper
  source 1..71: mol_type = genomic DNA

SEQ ID NO: 122611 - DNA, 30 bp, Homo sapiens; identical to SEQ ID NO: 90546
  misc_feature 1..30: note = chr3:159751507-159751537
  misc_feature 1..30: note = Hypo
  source 1..30: mol_type = genomic DNA

SEQ ID NO: 122612 - DNA, 300 bp, Homo sapiens; identical to SEQ ID NO: 90547
  misc_feature 1..300: note = chr3:159756632-159756932
  misc_feature 1..300: note = Hyper
  source 1..300: mol_type = genomic DNA

SEQ ID NO: 122613 - DNA, 1147 bp, Homo sapiens; identical to SEQ ID NO: 90548
  misc_feature 1..1147: note = chr3:159943489-159944636
  misc_feature 1..1147: note = Hyper
  source 1..1147: mol_type = genomic DNA

SEQ ID NO: 122614 - DNA, 565 bp, Homo sapiens
  misc_feature 1..565: note = chr3:160167468-160168033
  misc_feature 1..565: note = Hyper
  source 1..565: mol_type = genomic DNA
caccttctccgcatccgtaaaggtccttagactcaccgcggggaggaagcggaccaggcaactccacagcacggaaacacagcgccacgagctccaggcggatgctgagagccgccccgagtccccgccctcctctgccccgaagggcttcaggtgcccagaccgggcggggcctcgcggagcctcgcagcgcaggcgcagtctgcaggcaacattcaactgcaaggcatcggccaatgggaactattgctgggctcgttcgaaagtaaacggtggacggcgcggcccgaggcaggtggcgggagtcagtttaaggctggcgcccagctttccgcgcctgcgtgctaggcgcaggccgcctctcggaagcttggcctcgcaggagcggctctctatcctgtggggagcttcggccagtgggcctcgtgagctggggtcccgcctggggaatccgcatggcaccggtggtctgggggagaggctgggcctggcgcgggacgaggcgaagcgccggtggccgacggcttctgaggaattatcttttacttggcgccacacggggcgg

SEQ ID NO: 122615 - DNA, 48 bp, Homo sapiens; identical to SEQ ID NO: 90550
  misc_feature 1..48: note = chr3:160170146-160170194
  misc_feature 1..48: note = Hypo
  source 1..48: mol_type = genomic DNA

SEQ ID NO: 122616 - DNA, 36 bp, Homo sapiens; identical to SEQ ID NO: 90551
  misc_feature 1..36: note = chr3:160474464-160474500
  misc_feature 1..36: note = Hyper
  source 1..36: mol_type = genomic DNA

SEQ ID NO: 122617 - DNA, 196 bp, Homo sapiens; identical to SEQ ID NO: 90552
  misc_feature 1..196: note = chr3:160822766-160822962
  misc_feature 1..196: note = Hyper
  source 1..196: mol_type = genomic DNA

SEQ ID NO: 122618 - DNA, 540 bp, Homo sapiens; identical to SEQ ID NO: 90553
  misc_feature 1..540: note = chr3:161090003-161090543
  misc_feature 1..540: note = Hyper
  source 1..540: mol_type = genomic DNA

SEQ ID NO: 122619 - DNA, 30 bp, Homo sapiens; identical to SEQ ID NO: 90555
  misc_feature 1..30: note = chr3:163720280-163720310
  misc_feature 1..30: note = Hypo
  source 1..30: mol_type = genomic DNA

SEQ ID NO: 122620 - DNA, 137 bp, Homo sapiens; identical to SEQ ID NO: 28538
  misc_feature 1..137: note = chr3:164911621-164911758
  misc_feature 1..137: note = Hyper
  source 1..137: mol_type = genomic DNA

SEQ ID NO: 122621 - DNA, 87 bp, Homo sapiens; identical to SEQ ID NO: 90557
  misc_feature 1..87: note = chr3:164912404-164912491
  misc_feature 1..87: note = Hyper
  source 1..87: mol_type = genomic DNA

SEQ ID NO: 122622 - DNA, 1578 bp, Homo sapiens
  misc_feature 1..1578: note = chr3:164912907-164914485
  misc_feature 1..1578: note = Hyper
  source 1..1578: mol_type = genomic DNA
aacaaataattaaaacgctgcatcattcattttctgaagagctttgagccgtctatagagccttttctaatctgctgtcgtcaggcgaaacgcacaatggtctgtttagaaacggaaaattattaaaagctcaagcctttttccttctacctcttacaacaccagcgagcattccactgggggaggggtccttcgctccgccacctggcctatttgttggagttacttacgatgtcttcacccagaaaagaggtccgagggtatgttagtctccggtacccctccttccaccaacgtccttacacctaactgatccaattcaaaactgcaacaaacccctagcacctgtgagcgtacagaatacaccgcggccaaactcgatgtgctctacaatgcacatcctacatacgagaaatactggtttcaattaggcgaagtaggaaaggatggcggcgagtacctatggtgcagagcgctcaggatctccgaggtttgctgcgaggggctacccagcaggaggggcaaactctctgcgaagctgaattgtatccatcatactgtagccttgtagcttctcctcttctggccaccaactttccgaaaggctaccgaatcacgcttgtaatccgtttaaatgtttccacctttgagacttgcagggaaatggtcgctgcataccaatgggagagcggggcgcgcacctagcgcggcgatgccagcgacagggagctcacgaccacagctccctatgccctcgatggttggtaggcaggcaggcagagtgagtgtcccaggactaggttcctttgatttaaaatctcggtgctctggatcagtggagagcttcgttgttcccgagagcctgagctcagtctctggatttctctctttctctcttcctcaaaggttgtcactcacagcgcaatccctgcccgaggcctccttccatccgagaagatggaattagcccttgcttttccagggtgtctttgctctttgccctttaggtgggtgggagtgggggttggtggcgtgtagatgagagaagaaaagggtggggagaggcggaaaggaggcaggaagggggcgactagatctcagatcccagcattggtcagacggcgaaggtggggggaaagaaggagagggggagagaagatacaaatacacagtatggctgtgcacaccaaattccacttggatttgggagatctcaggcaaagcacgaaggtgaagcgataccgttggcagagagtgagtcctctgaccgctcaccattcaagcaccctcacttctcgagcgggagaaggtgcgggggaggggggtgggagggggaggggactgctgaacgtttcaggccaaggagacgctcgcggcggcggcggcggcggcatcttttaagactgacctgctttaaaagtgccactttaatggcctaggaaataactaaaatcggattacacgttacttaccaacgtctcctcctaaactggagcgccaggtcgtgtataaggagtcaatataggaaacgcagggctggaacctgaatgcaaatccatcagccgcccccaaatcgcg

SEQ ID NO: 122623 - DNA, 461 bp, Homo sapiens; identical to SEQ ID NO: 90560
  misc_feature 1..461: note = chr3:164914796-164915257
  misc_feature 1..461: note = Hyper
  source 1..461: mol_type = genomic DNA

SEQ ID NO: 122624 - DNA, 91 bp, Homo sapiens; identical to SEQ ID NO: 90566
  misc_feature 1..91: note = chr3:166984418-166984509
  misc_feature 1..91: note = Hypo
  source 1..91: mol_type = genomic DNA

SEQ ID NO: 122625 - DNA, 91 bp, Homo sapiens; identical to SEQ ID NO: 90567
  misc_feature 1..91: note = chr3:166984569-166984660
  misc_feature 1..91: note = Hypo
  source 1..91: mol_type = genomic DNA

SEQ ID NO: 122626 - DNA, 275 bp, Homo sapiens; identical to SEQ ID NO: 90568
  misc_feature 1..275: note = chr3:167097912-167098187
  misc_feature 1..275: note = Hyper
  source 1..275: mol_type = genomic DNA

SEQ ID NO: 122627 - DNA, 33 bp, Homo sapiens; identical to SEQ ID NO: 90570
  misc_feature 1..33: note = chr3:167916958-167916991
  misc_feature 1..33: note = Hypo
  source 1..33: mol_type = genomic DNA

SEQ ID NO: 122628 - DNA, 315 bp, Homo sapiens; identical to SEQ ID NO: 90571
  misc_feature 1..315: note = chr3:167966606-167966921
  misc_feature 1..315: note = Hyper
  source 1..315: mol_type = genomic DNA

SEQ ID NO: 122629 - DNA, 114 bp, Homo sapiens; identical to SEQ ID NO: 90572
  misc_feature 1..114: note = chr3:167967446-167967560
  misc_feature 1..114: note = Hyper
  source 1..114: mol_type = genomic DNA

SEQ ID NO: 122630 - DNA, 445 bp, Homo sapiens; identical to SEQ ID NO: 90573
  misc_feature 1..445: note = chr3:167967937-167968382
  misc_feature 1..445: note = Hyper
  source 1..445: mol_type = genomic DNA

SEQ ID NO: 122631 - DNA, 30 bp, Homo sapiens; identical to SEQ ID NO: 90574
  misc_feature 1..30: note = chr3:168118785-168118815
  misc_feature 1..30: note = Hypo
  source 1..30: mol_type = genomic DNA

SEQ ID NO: 122632 - DNA, 30 bp, Homo sapiens; identical to SEQ ID NO: 90575
  misc_feature 1..30: note = chr3:168156757-168156787
  misc_feature 1..30: note = Hypo
  source 1..30: mol_type = genomic DNA

SEQ ID NO: 122633 - DNA, 56 bp, Homo sapiens; identical to SEQ ID NO: 90576
  misc_feature 1..56: note = chr3:168427120-168427176
  misc_feature 1..56: note = Hypo
  source 1..56: mol_type = genomic DNA

SEQ ID NO: 122634 - DNA, 30 bp, Homo sapiens; identical to SEQ ID NO: 40048
  misc_feature 1..30: note = chr3:168490451-168490481
  misc_feature 1..30: note = Hypo
  source 1..30: mol_type = genomic DNA

SEQ ID NO: 122635 - DNA, 47 bp, Homo sapiens; identical to SEQ ID NO: 28546
  misc_feature 1..47: note = chr3:168864015-168864062
  misc_feature 1..47: note = Hyper
  source 1..47: mol_type = genomic DNA

SEQ ID NO: 122636 - DNA, 40 bp, Homo sapiens; identical to SEQ ID NO: 90579
  misc_feature 1..40: note = chr3:168864583-168864623
  misc_feature 1..40: note = Hyper
  source 1..40: mol_type = genomic DNA

SEQ ID NO: 122637 - DNA, 35 bp, Homo sapiens; identical to SEQ ID NO: 90580
  misc_feature 1..35: note = chr3:168865068-168865103
  misc_feature 1..35: note = Hyper
  source 1..35: mol_type = genomic DNA

SEQ ID NO: 122638 - DNA, 254 bp, Homo sapiens; identical to SEQ ID NO: 90584
  misc_feature 1..254: note = chr3:168960226-168960480
  misc_feature 1..254: note = Hyper
  source 1..254: mol_type = genomic DNA

SEQ ID NO: 122639 - DNA, 885 bp, Homo sapiens; identical to SEQ ID NO: 90587
  misc_feature 1..885: note = chr3:169375895-169376780
  misc_feature 1..885: note = Hyper
  source 1..885: mol_type = genomic DNA

SEQ ID NO: 122640 - DNA, 959 bp, Homo sapiens
  misc_feature 1..959: note = chr3:169378686-169379645
  misc_feature 1..959: note = Hyper
  source 1..959: mol_type = genomic DNA
ctggagtagtgcaagcgggaatctgaggctcagtaaaagtttgtaagagttgagatctagctatcagaaagcggcagcggcatccttagagaccctggggacaaaataaatgggtctcccaccagttgaatgacaagtatcatcagatcggaaacgaggctcagtttctggatgctgagtggactgtgcgtgcgggaatattttaagacggcatcgtatgtcttgcttggcaattaaaatagttgaaaaagttgctcaagaaaattcgaagggttttgtgttctgctttcacttcagaagttatcgggcagtgagttgcggcgcgaagccttaagctttcacttcacaacttaggcatggttgaaaagggctacccacccccacccaccatcccactcccgccaactcccccccccacacacacactctctctctctcccaacctttagtccaaatcgaagcccgcaaacctcaagtatatgtacatttatttcccttcagatgaaaataaagacatcggcctcatttaaaagcaaacagggaaaacagttccaccggcgccctttgacactgtagcagcgagtgtaaagaacaacacccaaaagagaaacagatggactgatgacccaaagagccctatatttaggttgatttctcagacccaggggaaaggaaatgtatcggggagtgtacgagtgcttgggtgaggactgcacaaagcactggaaaggcgcctgggatgacagcatctcgcggggctacaccgccgactccaatgcccgcgaagccgagcctgctgaggtgccgccgacttcccgggctgctgcagggacgcagtgagcaaggaggcgtggatacgatacctaccgtatttggttctaatgtgcgagggtcgcgcggggggagactgggatttcactggggagaagcatcccacccatctccgatctctcatttct

SEQ ID NO: 122641 - DNA, 89 bp, Homo sapiens; identical to SEQ ID NO: 90589
  misc_feature 1..89: note = chr3:169386544-169386633
  misc_feature 1..89: note = Hyper
  source 1..89: mol_type = genomic DNA

SEQ ID NO: 122642 - DNA, 114 bp, Homo sapiens; identical to SEQ ID NO: 90590
  misc_feature 1..114: note = chr3:169427251-169427365
  misc_feature 1..114: note = Hypo
  source 1..114: mol_type = genomic DNA

SEQ ID NO: 122643 - DNA, 36 bp, Homo sapiens; identical to SEQ ID NO: 90591
  misc_feature 1..36: note = chr3:169480922-169480958
  misc_feature 1..36: note = Hyper
  source 1..36: mol_type = genomic DNA

SEQ ID NO: 122644 - DNA, 30 bp, Homo sapiens; identical to SEQ ID NO: 90592
  misc_feature 1..30: note = chr3:169482409-169482439
  misc_feature 1..30: note = Hyper
  source 1..30: mol_type = genomic DNA

SEQ ID NO: 122645 - DNA, 466 bp, Homo sapiens
  misc_feature 1..466: note = chr3:169482680-169483146
  misc_feature 1..466: note = Hyper
  source 1..466: mol_type = genomic DNA
ttgctctagaatgaacggtggaaggcggcaggccgaggcttttccgcccgctgaaagtcagcgagaaaaacagcgcgcggggagcaaaagcacggcgcctacgcccttctcagttagggttagacaaaaaatggccaccacccctcccaggcccaccctccgcaacccggtgcgctgccgggcgagtcggcttataaagggagcggccgccgaccgcacggattggccaagctgactctcgcggctctcgtgagagtcactctctcgggcgggctggttggggggaacgggaaattaaagttccatttccggccatgaggaaggacgttgcccttccgcacgtccgggaaaggctttgcgtctttacttccgaccttctttaaaggtgaaactaacttgaggtatcagagggccttttttctatcctctgcagaccagacgcggttcacctcgactaccttaaaaa

SEQ ID NO: 122646 - DNA, 105 bp, Homo sapiens; identical to SEQ ID NO: 90595
  misc_feature 1..105: note = chr3:169485356-169485461
  misc_feature 1..105: note = Hypo
  source 1..105: mol_type = genomic DNA

SEQ ID NO: 122647 - DNA, 250 bp, Homo sapiens; identical to SEQ ID NO: 90596
  misc_feature 1..250: note = chr3:169487251-169487501
  misc_feature 1..250: note = Hyper
  source 1..250: mol_type = genomic DNA

SEQ ID NO: 122648 - DNA, 463 bp, Homo sapiens; identical to SEQ ID NO: 90598
  misc_feature 1..463: note = chr3:169529938-169530401
  misc_feature 1..463: note = Hyper
  source 1..463: mol_type = genomic DNA

SEQ ID NO: 122649 - DNA, 711 bp, Homo sapiens; identical to SEQ ID NO: 90599
  misc_feature 1..711: note = chr3:169539898-169540609
  misc_feature 1..711: note = Hypo
  source 1..711: mol_type = genomic DNA

SEQ ID NO: 122650 - DNA, 154 bp, Homo sapiens; identical to SEQ ID NO: 90600
  misc_feature 1..154: note = chr3:169540980-169541134
  misc_feature 1..154: note = Hypo
  source 1..154: mol_type = genomic DNA

SEQ ID NO: 122651 - DNA, 19 bp, Homo sapiens
  misc_feature 1..19: note = chr3:169579288-169579307
  misc_feature 1..19: note = Hypo
  source 1..19: mol_type = genomic DNA
agagcgagactccgtctca

SEQ ID NO: 122652 - DNA, 30 bp, Homo sapiens; identical to SEQ ID NO: 90602
  misc_feature 1..30: note = chr3:169900402-169900432
  misc_feature 1..30: note = Hypo
  source 1..30: mol_type = genomic DNA

SEQ ID NO: 122653 - DNA, 22 bp, Homo sapiens
  misc_feature 1..22: note = chr3:169980664-169980686
  misc_feature 1..22: note = Hypo
  source 1..22: mol_type = genomic DNA
accttcttttgtggccgggcgc

SEQ ID NO: 122654 - DNA, 30 bp, Homo sapiens; identical to SEQ ID NO: 90605
  misc_feature 1..30: note = chr3:170025781-170025811
  misc_feature 1..30: note = Hypo
  source 1..30: mol_type = genomic DNA

SEQ ID NO: 122655 - DNA, 420 bp, Homo sapiens; identical to SEQ ID NO: 90606
  misc_feature 1..420: note = chr3:170136627-170137047
  misc_feature 1..420: note = Hyper
  source 1..420: mol_type = genomic DNA

SEQ ID NO: 122656 - DNA, 58 bp, Homo sapiens
  misc_feature 1..58: note = chr3:170137436-170137494
  misc_feature 1..58: note = Hyper
  source 1..58: mol_type = genomic DNA
ccgcccggcctcccccggggcgccgagccttcgcgttaggttccgcccgcagaggtga

SEQ ID NO: 122657 - DNA, 30 bp, Homo sapiens
  misc_feature 1..30: note = chr3:170137698-170137728
  misc_feature 1..30: note = Hyper
  source 1..30: mol_type = genomic DNA
catctccgctgcccccgctacccccgcccc

SEQ ID NO: 122658 - DNA, 32 bp, Homo sapiens; identical to SEQ ID NO: 90607
  misc_feature 1..32: note = chr3:170266977-170267009
  misc_feature 1..32: note = Hypo
  source 1..32: mol_type = genomic DNA

SEQ ID NO: 122659 - DNA, 1444 bp, Homo sapiens
  misc_feature 1..1444: note = chr3:170302487-170303931
  misc_feature 1..1444: note = Hyper
  source 1..1444: mol_type = genomic DNA
gagaactttcagcaccgcggacagcgccattccctgcactcagtcggaggaggagagctaccttgcccccagcgctctcctagaccctatacctagggggaggcagggtgacatcctgcggcccttgggcaattcgggccagtgacgttcaccgacactcaggcggggatcccttcgccagagccagttcctttgagtgtctccgctcaaaatctcaaggaaacgagcttcacacaggtggggggatgaggagtgccagaacaggagcgagccccgctgctctagccttcctgcatctcttctcgcctttgctttgctcactcttcaatcgcaatataaaatactcatttggggagggggcagggtgacacaggagagagaaggagggtgggggctgcatcccgcgtggccacgcagccctaacctggccctcttggattagaggggagctgatgtgctttggaatgggagaagagaggagactgagggttgaagcagtgcaggagagctccccttgctggggctgccggctctgggcagggagcttccctggacaccgctcccgtcacgtcctcttcgccgctcccgggagagtcaccactctccggggacagacgcccctcggggcgccaccatcctggtcggggtgctgggctcggcgggagtccctttgaggagtttgctcccaggtaaaagggcagacgttgctcccgacctccccggagtctgcggccggaaaagcgtctccgtttcatggtctcggtccgaggcggagaacggagctgcccgtgcggggtgcgcgccaaggcgggggacaggacgggcccggcgtctgccgagacctaggctgcccgcattccgctcgcggctccccttctgcctcccgctctagcggcgccggagccgcgctggcccccgccccgcccggcagctcccgcgagtcagagcccggtgcccccagaccgcgggcagtcggggcctcattccgggccagagcaggaaagagcccgacccacctcctcggttcttccagggaaccccttctcggagggcgccctgggcctccgcgccatattcctggtcccccgctcccggtgactccggctccctgggtcattccgggagaggcggccatcccagttgcaggggtcccgctggggcgcggggggcgcggagggggacaaacggcagcgaagggggccgttcacttaccggggtcggggctggaggcgacgagctggctgccaaggctggtggctggcagtccgcacttactgcgcggagctgtctctctagctgggatgggaagtggtggtggcggcaaaggaaggcaggaggcagccgctgctgctgaacagctcctcaattattcagattgggcccccaccccccgaacccctccccgtgcctgctcgtcctccctccagctcgcctgtctccgcct

SEQ ID NO: 122660 - DNA, 109 bp, Homo sapiens; identical to SEQ ID NO: 90612
  misc_feature 1..109: note = chr3:170583189-170583298
  misc_feature 1..109: note = Hypo
  source 1..109: mol_type = genomic DNA

SEQ ID NO: 122661 - DNA, 346 bp, Homo sapiens; identical to SEQ ID NO: 28560
  misc_feature 1..346: note = chr3:170625828-170626174
  misc_feature 1..346: note = Hyper
  source 1..346: mol_type = genomic DNA

SEQ ID NO: 122662 - DNA, 254 bp, Homo sapiens; identical to SEQ ID NO: 90614
  misc_feature 1..254: note = chr3:170626456-170626710
  misc_feature 1..254: note = Hyper
  source 1..254: mol_type = genomic DNA

SEQ ID NO: 122663 - DNA, 18 bp, Homo sapiens
  misc_feature 1..18: note = chr3:170627856-170627874
  misc_feature 1..18: note = Hypo
  source 1..18: mol_type = genomic DNA
atccggccactgtactcc

SEQ ID NO: 122664 - DNA, 20 bp, Homo sapiens
  misc_feature 1..20: note = chr3:170831096-170831116
  misc_feature 1..20: note = Hypo
  source 1..20: mol_type = genomic DNA
tataaaatgctaattcggcc

SEQ ID NO: 122665 - DNA, 30 bp, Homo sapiens; identical to SEQ ID NO: 90617
  misc_feature 1..30: note = chr3:170957950-170957980
  misc_feature 1..30: note = Hypo
  source 1..30: mol_type = genomic DNA

SEQ ID NO: 122666 - DNA, 30 bp, Homo sapiens; identical to SEQ ID NO: 90618
  misc_feature 1..30: note = chr3:171036849-171036879
  misc_feature 1..30: note = Hypo
  source 1..30: mol_type = genomic DNA

SEQ ID NO: 122667 - DNA, 30 bp, Homo sapiens; identical to SEQ ID NO: 90619
  misc_feature 1..30: note = chr3:171095156-171095186
  misc_feature 1..30: note = Hypo
  source 1..30: mol_type = genomic DNA

SEQ ID NO: 122668 - DNA, 30 bp, Homo sapiens; identical to SEQ ID NO: 90620
  misc_feature 1..30: note = chr3:171139798-171139828
  misc_feature 1..30: note = Hypo
  source 1..30: mol_type = genomic DNA

SEQ ID NO: 122669 - DNA, 30 bp, Homo sapiens; identical to SEQ ID NO: 90621
  misc_feature 1..30: note = chr3:171147897-171147927
  misc_feature 1..30: note = Hypo
  source 1..30: mol_type = genomic DNA

SEQ ID NO: 122670 - DNA, 283 bp, Homo sapiens; identical to SEQ ID NO: 90622
  misc_feature 1..283: note = chr3:171528050-171528333
  misc_feature 1..283: note = Hyper
  source 1..283: mol_type = genomic DNA

SEQ ID NO: 122671 - DNA, 27 bp, Homo sapiens
  misc_feature 1..27: note = chr3:171661628-171661655
  misc_feature 1..27: note = Hypo
  source 1..27: mol_type = genomic DNA
cgtgagcctccgcgcccagcctgagaa

SEQ ID NO: 122672 - DNA, 145 bp, Homo sapiens; identical to SEQ ID NO: 40054
  misc_feature 1..145: note = chr3:172033174-172033319
  misc_feature 1..145: note = Hypo
  source 1..145: mol_type = genomic DNA

SEQ ID NO: 122673 - DNA, 2485 bp, Homo sapiens
  misc_feature 1..2485: note = chr3:172165432-172167917
  misc_feature 1..2485: note = Hyper
  source 1..2485: mol_type = genomic DNA
gttctggtccctgagcgaggcacccacgacagcatcgccgcgcctcctccgccacagcttcctgccgatgagactgtagaggaccgtgagacagaagacaggaaggaagaagaagatgctggacacccacaccatgaccgtgagcagtccagagcgcaccgcaaactcggtggggcggcactcgttggtgtcccaagggtcggtgccgttctcgtgctccaccccgactagcacgaagatgggcccggcgctgcagaaggccacggcccagatgacgaagatgaccagcttcacccgccccttggtgaccaccaccttggcccggagtgggaagcagatggcgaagtagcgctcgacgctcagcgctgtgatggtgagcaccgtggcgtaggtgcagctctcactgacgaattggaagagtttgcagaggaggtcgccgaagttccagggccggtactgccagaggcgaacgaggtccaggggcatgcagaggaagatgagcagatcggagaaggccatgctggacaggtagaggttggtggtggtgcgcagctcgcggaagcgcgacaccaccagcatggtgagcaggttgccagcgatgcccaccacgaagagtgccacgcaggtggctgtgacgcccgccagcagcggcgcggggaagagctgcagcagctcgtcgcccagcgagtcgttgccgggggaagcatcccagtccaggtcggccagtgtgaggttgaaccccggctcttcgctgggcgtcgcgttccacatgctgccggctcagctgaacaggctctgggacgtgactgcgctgggaggctggaccgagctggctcccgaggaggtccgcttaggcgcgggagggtgcgagggaggagcgggtgcagacgcgtagggaggatgcttggagaagaaagagagggaggtgagaggcagaagccgaggaagaaggtgagatggggacaaggaagagggagagagactggtggtcagtgggtgagagagtgacccactgctttctctgacacctcccctttcccccaccaactcccccaaagtttctcccaacacatcctccggccggcgcccacacgcatacctgtcaccagccctgcctcgcatttgcgttctcgatccagttccatctcgcacttcccaaagcgtcgcagcgagtggggaccgcagggaccaggcgccgcgaagcgggagcgtgaggcgctctctccgaagccctgggcgacgctggactagtgtgccccggaaggacaggtcacacccgggggtgggggtgaagacgacggtggcggtggggaggacacctttagcagctgggacctgatttcttcctccacaaggctgcagctggctatggccctggtggaaagaaaaagcgagcttgaccaactcgacttgggaagggggatagagagagaaaagaaggaccttgtgtttgtattcataccggtgagcaccaaagaatagtctcacgcagttataggacccaggttcagcgatgtgactacttgtccaaggtcacacagcgagctggggactcggggaccagtgtcggatctcccacccggttgggacttctgagcgcacaggggcaagatatgtgagtaaaccctgtccagaatcccagtcctttgtatcactcggtagtggtagagagtctgctgtagggtatattacttttgcttgatgcaaacctggtggcggggtgccgaggttggtcagggagggaacaggagaaaggaaaaaggcagggttggaggtgtgtggaggcggcaagtgaagaagaggctgtgaggctggcgcgtcgagagtgtgcaggaaacattttttgaggcataactgagagagatcagccatttagtagccgtattcccttgggcaaggtcttcaacctcctgagcattacgtctttttctttgaattgcaatgatttgtgcggaccactgggggtgatatcaagtgtcagggaccaccggaggcactcaataaatagaagacgcgttgctgttgagaagtagaagctgtgccggtgggaacaggtcaaaggccacccctacactagcaaggtgaccctctggacgcggtctgtgcgtctcctgctcagagccagaaatcagcacccgaaggcatgagactgccagttgccagcgaattcacaaatccgaccggcccctcccggcccaccgacctcgggaccgccccaggaacatattcagcactgtggccagcgccacatccatcctaccgcaaagcgccgctggaggaatggcttccctgtcactcccaccgtttttaacttgcgcttctaacgcctcagtcctaccccacggaggagcagggcagactcccacgaagcacaggccggcgttagtcactgccttgaccatacacatcggcgctcacccgatgagataccacgtactgtgtatgagagagtatccccctcagttgaatgcgtttgtacttgcct

SEQ ID NO: 122674 - DNA, 30 bp, Homo sapiens; identical to SEQ ID NO: 90631
  misc_feature 1..30: note = chr3:172263919-172263949
  misc_feature 1..30: note = Hypo
  source 1..30: mol_type = genomic DNA

SEQ ID NO: 122675 - DNA, 37 bp, Homo sapiens; identical to SEQ ID NO: 90632
  misc_feature 1..37: note = chr3:172355768-172355805
  misc_feature 1..37: note = Hypo
  source 1..37: mol_type = genomic DNA

SEQ ID NO: 122676 - DNA, 16 bp, Homo sapiens
  misc_feature 1..16: note = chr3:172356006-172356022
  misc_feature 1..16: note = Hypo
  source 1..16: mol_type = genomic DNA
gcagtgagctgagatc

SEQ ID NO: 122677 - DNA, 58 bp, Homo sapiens; identical to SEQ ID NO: 14590
  misc_feature 1..58: note = chr3:172384961-172385019
  misc_feature 1..58: note = Hypo
  source 1..58: mol_type = genomic DNA

SEQ ID NO: 122678 - DNA, 22 bp, Homo sapiens
  misc_feature 1..22: note = chr3:172395425-172395447
  misc_feature 1..22: note = Hypo
  source 1..22: mol_type = genomic DNA
ttggtgggggaggggcgggggg

SEQ ID NO: 122679 - DNA, 30 bp, Homo sapiens; identical to SEQ ID NO: 90636
  misc_feature 1..30: note = chr3:172424700-172424730
  misc_feature 1..30: note = Hypo
  source 1..30: mol_type = genomic DNA

SEQ ID NO: 122680 - DNA, 35 bp, Homo sapiens; identical to SEQ ID NO: 90637
  misc_feature 1..35: note = chr3:172425347-172425382
  misc_feature 1..35: note = Hypo
  source 1..35: mol_type = genomic DNA

SEQ ID NO: 122681 - DNA, 35 bp, Homo sapiens; identical to SEQ ID NO: 90638
  misc_feature 1..35: note = chr3:172425682-172425717
  misc_feature 1..35: note = Hypo
  source 1..35: mol_type = genomic DNA

SEQ ID NO: 122682 - DNA, 225 bp, Homo sapiens; identical to SEQ ID NO: 90639
  misc_feature 1..225: note = chr3:172466199-172466424
  misc_feature 1..225: note = Hypo
  source 1..225: mol_type = genomic DNA

SEQ ID NO: 122683 - DNA, 31 bp, Homo sapiens; identical to SEQ ID NO: 40058
  misc_feature 1..31: note = chr3:172469925-172469956
  misc_feature 1..31: note = Hypo
  source 1..31: mol_type = genomic DNA

SEQ ID NO: 122684 - DNA, 31 bp, Homo sapiens; identical to SEQ ID NO: 40059
  misc_feature 1..31: note = chr3:172470196-172470227
  misc_feature 1..31: note = Hypo
  source 1..31: mol_type = genomic DNA

SEQ ID NO: 122685 - DNA, 30 bp, Homo sapiens; identical to SEQ ID NO: 90642
  misc_feature 1..30: note = chr3:172550135-172550165
  misc_feature 1..30: note = Hypo
  source 1..30: mol_type = genomic DNA

SEQ ID NO: 122686 - DNA, 284 bp, Homo sapiens; identical to SEQ ID NO: 90643
  misc_feature 1..284: note = chr3:172727266-172727550
  misc_feature 1..284: note = Hypo
  source 1..284: mol_type = genomic DNA

SEQ ID NO: 122687 - DNA, 44 bp, Homo sapiens; identical to SEQ ID NO: 90644
  misc_feature 1..44: note = chr3:172727610-172727654
  misc_feature 1..44: note = Hypo
  source 1..44: mol_type = genomic DNA

SEQ ID NO: 122688 - DNA, 116 bp, Homo sapiens; identical to SEQ ID NO: 90645
  misc_feature 1..116: note = chr3:172858974-172859090
  misc_feature 1..116: note = Hypo
  source 1..116: mol_type = genomic DNA

SEQ ID NO: 122689 - DNA, 604 bp, Homo sapiens; identical to SEQ ID NO: 90646
  misc_feature 1..604: note = chr3:173113090-173113694
  misc_feature 1..604: note = Hyper
  source 1..604: mol_type = genomic DNA

SEQ ID NO: 122690 - DNA, 451 bp, Homo sapiens; identical to SEQ ID NO: 90647
  misc_feature 1..451: note = chr3:173114136-173114587
  misc_feature 1..451: note = Hyper
  source 1..451: mol_type = genomic DNA

SEQ ID NO: 122691 - DNA, 709 bp, Homo sapiens; identical to SEQ ID NO: 28571
  misc_feature 1..709: note = chr3:173114985-173115694
  misc_feature 1..709: note = Hyper
  source 1..709: mol_type = genomic DNA

SEQ ID NO: 122692 - DNA, 218 bp, Homo sapiens; identical to SEQ ID NO: 90649
  misc_feature 1..218: note = chr3:173115957-173116175
  misc_feature 1..218: note = Hyper
  source 1..218: mol_type = genomic DNA

SEQ ID NO: 122693 - DNA, 814 bp, Homo sapiens
  misc_feature 1..814: note = chr3:173302411-173303225
  misc_feature 1..814: note = Hyper
  source 1..814: mol_type = genomic DNA
agccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggtaagtttgtggctcttttattgggagggggctgccagggttttgtgccactgcgcggaaggtgatgcggacgcggtgcctgtgaaatggagagagaaaggggaatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggcttctagggg

SEQ ID NO: 122694 - DNA, 36 bp, Homo sapiens; identical to SEQ ID NO: 90653
  misc_feature 1..36: note = chr3:174159270-174159306
  misc_feature 1..36: note = Hyper
  source 1..36: mol_type = genomic DNA

SEQ ID NO: 122695 - DNA, 37 bp, Homo sapiens; identical to SEQ ID NO: 90655
  misc_feature 1..37: note = chr3:175338134-175338171
  misc_feature 1..37: note = Hypo
  source 1..37: mol_type = genomic DNA

SEQ ID NO: 122696 - DNA, 31 bp, Homo sapiens; identical to SEQ ID NO: 90656
  misc_feature 1..31: note = chr3:176545097-176545128
  misc_feature 1..31: note = Hypo
  source 1..31: mol_type = genomic DNA

SEQ ID NO: 122697 - DNA, 30 bp, Homo sapiens; identical to SEQ ID NO: 90657
  misc_feature 1..30: note = chr3:176837181-176837211
  misc_feature 1..30: note = Hypo
  source 1..30: mol_type = genomic DNA

SEQ ID NO: 122698 - DNA, 206 bp, Homo sapiens; identical to SEQ ID NO: 90658
  misc_feature 1..206: note = chr3:176853680-176853886
  misc_feature 1..206: note = Hypo
  source 1..206: mol_type = genomic DNA

SEQ ID NO: 122699 - DNA, 24 bp, Homo sapiens
  misc_feature 1..24: note = chr3:176869535-176869559
  misc_feature 1..24: note = Hypo
  source 1..24: mol_type = genomic DNA
tttcccagacgggcacggtggctc

SEQ ID NO: 122700 - DNA, 17 bp, Homo sapiens
  misc_feature 1..17: note = chr3:176871397-176871414
  misc_feature 1..17: note = Hypo
  source 1..17: mol_type = genomic DNA
aggcgcggtggctcacg

SEQ ID NO: 122701 - DNA, 41 bp, Homo sapiens; identical to SEQ ID NO: 40063
  misc_feature 1..41: note = chr3:176872455-176872496
  misc_feature 1..41: note = Hypo
  source 1..41: mol_type = genomic DNA

SEQ ID NO: 122702 - DNA, 197 bp, Homo sapiens; identical to SEQ ID NO: 90662
  misc_feature 1..197: note = chr3:176897068-176897265
  misc_feature 1..197: note = Hypo
  source 1..197: mol_type = genomic DNA

SEQ ID NO: 122703 - DNA, 30 bp, Homo sapiens; identical to SEQ ID NO: 90663
  misc_feature 1..30: note = chr3:177158305-177158335
  misc_feature 1..30: note = Hypo
  source 1..30: mol_type = genomic DNA

SEQ ID NO: 122704 - DNA, 28 bp, Homo sapiens
  misc_feature 1..28: note = chr3:178577720-178577748
  misc_feature 1..28: note = Hypo
  source 1..28: mol_type = genomic DNA
aaacaaaataaagttcggaaggggagcc

SEQ ID NO: 122705 - DNA, 30 bp, Homo sapiens; identical to SEQ ID NO: 90665
  misc_feature 1..30: note = chr3:178833103-178833133
  misc_feature 1..30: note = Hypo
  source 1..30: mol_type = genomic DNA

SEQ ID NO: 122706 - DNA, 34 bp, Homo sapiens; identical to SEQ ID NO: 40066
  misc_feature 1..34: note = chr3:178861413-178861447
  misc_feature 1..34: note = Hypo
  source 1..34: mol_type = genomic DNA

SEQ ID NO: 122707 - DNA, 30 bp, Homo sapiens; identical to SEQ ID NO: 90667
  misc_feature 1..30: note = chr3:179031625-179031655
  misc_feature 1..30: note = Hypo
  source 1..30: mol_type = genomic DNA

SEQ ID NO: 122708 - DNA, 30 bp, Homo sapiens; identical to SEQ ID NO: 40067
  misc_feature 1..30: note = chr3:179136841-179136871
  misc_feature 1..30: note = Hypo
  source 1..30: mol_type = genomic DNA

SEQ ID NO: 122709 - DNA, 979 bp, Homo sapiens; identical to SEQ ID NO: 90669
  misc_feature 1..979: note = chr3:179168661-179169640
  misc_feature 1..979: note = Hyper
  source 1..979: mol_type = genomic DNA

SEQ ID NO: 122710 - DNA, 23 bp, Homo sapiens
  misc_feature 1..23: note = chr3:179171196-179171219
  misc_feature 1..23: note = Hypo
  source 1..23: mol_type = genomic DNA
accgatcccggccccatattctt

SEQ ID NO: 122711 - DNA, 30 bp, Homo sapiens; identical to SEQ ID NO: 90671
  misc_feature 1..30: note = chr3:179183022-179183052
  misc_feature 1..30: note = Hypo
  source 1..30: mol_type = genomic DNA

SEQ ID NO: 122712 - DNA, 184 bp, Homo sapiens; identical to SEQ ID NO: 90672
  misc_feature 1..184: note = chr3:179740682-179740866
  misc_feature 1..184: note = Hypo
  source 1..184: mol_type = genomic DNA

SEQ ID NO: 122713 - DNA, 1194 bp, Homo sapiens
  misc_feature 1..1194: note = chr3:179754178-179755372
  misc_feature 1..1194: note = Hyper
  source 1..1194: mol_type = genomic DNA
cccttctcccaccttcggaaaccggtctagttttcccggcagcaccggacagaaatgtcacggtcatgttgcatcacttcacttgttgagctgtgcgaaggcagcacttgaccacagaaacttggtgaaccgccttgctcttaaattagcccccaagaattctctccagccctatagaaatgtcttacctgcatgtgtccctggtacattctgcttcggtttcttcagggctccctgaggccaccggatgcttttcccccgtgcttacttgcccaccaaaagaggggaaaaggtgggtgcacagcgggttctcagagggtgctcctgagccccctggagctccgggtactcggccggccggcggccactcggcagcgctgcgggctgccgggaactgttctccgctcggggtgctgaaagcggacgcgggagagcgcgcagagaaggcgaggagccgggtcggccaggctctcctgcaggcgcgggtcctgctcgcggggcgtctctagaactcactccttcttcgccgaactctttctcgcttcctgccaggttgcctcatgtctctctctctctgagctgcgaaccccctcctcccagccctgacgtgagcgcctacaccagccgccgccgcagctgccgagcggggcgcgcgccgttctcccagccgcgtgcctgccgagaggccgcgggaccgggcacgcgcgcgcgttcccaggggcctgggagcggcccgagggcggccccgggcggtgcgcgctccccgagcgcgtcctcggggctgcgcgcgcgcggcggcaaggcgaggtgccggcaggcggtggtcgcgctggtgtacaacgcccgcagcagcgcggcgttcaggtgcggcgtcggcgggcagggcgattctagcggagaggatggccggccggaagaaaggcgggaagacatgcatcgtctctccgggggccatccaccgcggctgagcctgttatcctacagacattataggctgagtgcaggggttgccgaagagtttacttcggttctgattcagctctcgaaagttacgtccgtatcacccgttaaataaagactccccgctcccctcatccccagttcatcgccgagcattctatttaaaacggcaaaccctagtccctgaggatctggcatgttttatttttttccctagcacgtaacatcacctaa

SEQ ID NO: 122714 - DNA, 30 bp, Homo sapiens; identical to SEQ ID NO: 40070
  misc_feature 1..30: note = chr3:180042862-180042892
  misc_feature 1..30: note = Hypo
  source 1..30: mol_type = genomic DNA

SEQ ID NO: 122715 - DNA, 87 bp, Homo sapiens; identical to SEQ ID NO: 90679
  misc_feature 1..87: note = chr3:180319834-180319921
  misc_feature 1..87: note = Hyper
  source 1..87: mol_type = genomic DNA

SEQ ID NO: 122716 - DNA, 732 bp, Homo sapiens; identical to SEQ ID NO: 28581
  misc_feature 1..732: note = chr3:180397310-180398042
  misc_feature 1..732: note = Hyper
  source 1..732: mol_type = genomic DNA

SEQ ID NO: 122717 - DNA, 121 bp, Homo sapiens; identical to SEQ ID NO: 90681
  misc_feature 1..121: note = chr3:180547113-180547234
  misc_feature 1..121: note = Hypo
  source 1..121: mol_type = genomic DNA

SEQ ID NO: 122718 - DNA, 1286 bp, Homo sapiens
  misc_feature 1..1286: note = chr3:181413144-181414430
  misc_feature 1..1286: note = Hyper
  source 1..1286: mol_type = genomic DNA
cctcggagcagcccacgagcccgtgaaggcgcgtggggaaggggggcctggaaagcccgggcttcgactcactcggccagtaccgctccgaggaggggcctcagcctccttcggagccagggccgcgcccgagccgcgctaggccagggggccggacgcgcacggaagggggctggcggacacggccgggtggtggcgcagttcctgggggcacagggcagcccagcccgccggcccgcgcctccgcttccccactccagcgaaactggacaaggccgacccacccagccgggcccgatccctcaagacactttcagcctcagcccccgtttctcctcgggtttccacagacccaggaaaggacagaggcggcgagcaggctgacaagtttattctagaggctttgaaaaatgaggtttccaggtctcttcgcacgcgcgcgcgcgcgttctcgggctaaaggttcgaagctagagtttgaatttaagccacgtcctgggacaggtcgcgttcagcgtgggcgtcggccccgccgcggccccaggcctcttcgaagtgcgcgtcaagtggggtgtcgggtcgttttgttttttctctaagtgaataattcaatcgtgttaggccagattacatgctcataatacccaggtgtatttaaaagcacccgcgtttctaaacctcccgcagaaagtgggaagcaatcgccccctcggacctggcgccgctgcgcctgctggagcctcgcttccccacagtcgggcggccagtggagggcgaggagcgcgcgcgtcacgagaggcggccccggcctcccagagcccgcaccgggaggccgagggctcgggactcgagccttctgagtccgatttctttccacgtgcagagggtagaaagtggccagtcagggcgtgattgattgcttaaggaaagagaagctacagctttcacggtagttgataactaaagcatgacatgatgccatctgtgtgaaactcgtgatgtgtgtggtcattggctccctggaacatccagaccctgatcgtgcgtatcgtgtttccttataagcagcactcgcgatttaaaaacaggtcccggtgcccctcttgctgatcctctctgccattagcccgcttaattccctttttgtaaattcccctctttacctttctttcgtccctccctccctctctttcttctttcctcctctccttttcccctttctctttttcttcctcaatctaggtcgtttctgctgaatgatatttattcaccgaagtcccaatctg

SEQ ID NO: 122719 - DNA, 99 bp, Homo sapiens; identical to SEQ ID NO: 90683
  misc_feature 1..99: note = chr3:181419696-181419795
  misc_feature 1..99: note = Hyper
  source 1..99: mol_type = genomic DNA

SEQ ID NO: 122720 - DNA, 638 bp, Homo sapiens; identical to SEQ ID NO: 90684
  misc_feature 1..638: note = chr3:181419915-181420553
  misc_feature 1..638: note = Hyper
  source 1..638: mol_type = genomic DNA

SEQ ID NO: 122721 - DNA, 1926 bp, Homo sapiens; identical to SEQ ID NO: 90685
  misc_feature 1..1926: note = chr3:181421249-181423175
  misc_feature 1..1926: note = Hyper
  source 1..1926: mol_type = genomic DNA

SEQ ID NO: 122722 - DNA, 568 bp, Homo sapiens; identical to SEQ ID NO: 90686
  misc_feature 1..568: note = chr3:181428260-181428828
  misc_feature 1..568: note = Hyper
  source 1..568: mol_type = genomic DNA

SEQ ID NO: 122723 - DNA, 111 bp, Homo sapiens; identical to SEQ ID NO: 90687
  misc_feature 1..111: note = chr3:181429607-181429718
  misc_feature 1..111: note = Hyper
  source 1..111: mol_type = genomic DNA

SEQ ID NO: 122724 - DNA, 277 bp, Homo sapiens; identical to SEQ ID NO: 90688
  misc_feature 1..277: note = chr3:181430054-181430331
  misc_feature 1..277: note = Hyper
  source 1..277: mol_type = genomic DNA

SEQ ID NO: 122725 - DNA, 721 bp, Homo sapiens; identical to SEQ ID NO: 90689
  misc_feature 1..721: note = chr3:181430695-181431416
  misc_feature 1..721: note = Hyper
  source 1..721: mol_type = genomic DNA

SEQ ID NO: 122726 - DNA, 503 bp, Homo sapiens
  misc_feature 1..503: note = chr3:181437066-181437569
  misc_feature 1..503: note = Hyper
  source 1..503: mol_type = genomic DNA
gctggaggtgtccttcgttttattaccctagtctgcctgcgtgtacagaatgaagggtgcactgttttatatagagttcggcgctttgaactatcatttgcctagctctcccagcttccgcgcgggccacggctccgggctgtgagcgcgccggcctcccgccggctgccctggggagcgcgcagtgcccagtgctgagagccgacgcgcgggcaaattgaggccgagctgacgagctccggcgggtggacctgacgtcaccgcggcccgggtcacctcacccatggggctccccaagaaggtgctgtgtggggctcgagttctctctgcccgggctctgctcaaacggtcgcattccctctccctcaggcaccgacccgcgtcagacaagtctagaaagtctcccgaggcgttggggccctcaccactccagagtcctctgcctcctgcgccccagcccaagccctctccatgttgacctcgtgacacgggagacggtgtct

SEQ ID NO: 122727 - DNA, 270 bp, Homo sapiens; identical to SEQ ID NO: 90692
  misc_feature 1..270: note = chr3:181438167-181438437
  misc_feature 1..270: note = Hyper
  source 1..270: mol_type = genomic DNA

SEQ ID NO: 122728 - DNA, 3982 bp, Homo sapiens
  misc_feature 1..3982: note = chr3:181440785-181444767
  misc_feature 1..3982: note = Hyper
  source 1..3982: mol_type = genomic DNA
gaccttccaagagttcgttttacatttgttgaagcccaggccttggtgcctcaagttttaaatggaattactcaaggggggcacactactagacaaactattctagccaattccttcatccccgacccagtccctactcctctctgcccccgcccacttcgccacttcttagtcccggatctgaacattttagctgaaagagggaggggtgaggaaagggccaggacagttccctcagtgccaccactgcgggcaaggacagttccctcagtgccaccactgcgcctggagagatccccgcggccctgccgctggctgattctcccctgtgccttgacttgctgaaacatctctctggggaaaattactccctacttgcttacatgtgtgtattaaaaaacacatgtagccatacacatgtttcatcacggcaacaaaaaatatcaacattctagccccaggagcaaaacgtatcaatcattcgcctaaatattgttcagtagatgggggcgggaataggtagacctcctaggagagcggtcacaagtcccctctcctccgcatggacaccaggaatgcggggtctggcggtgctgggcgcagggcgagaagatttgatgtgcagggtaagtaaaggacaagttatttaaaacctcaacacaggaaaagatggtaagagtgctgtgtagccctttgcttgcttgtgactacgagtcgctaggtggcccgcgtttagagtatgcctacggcgcctactaacgtctagacctaggagaggcgtctcccgcccctcgacccacagccagccgccacttgatagctaacgcgtcttccggccggtacacacccacaattaatctttcttattaaagcctccattctgtacccatggggcgactcaaacctatttagatttccgtggttggctgcacaaatttaagtgggcaacgagttataaacctaataacagaggacgagagagggtgatttgagtagagaagacgcaagattcactagggtcgtgaagatgctgcgggccttgcccaccacggcatctacctcggggtgcacgccaggctctgagaaaggtagtgaacctcacaatcacactcaccacacacaacatgcgtacacacacttgcactcctaccccctttgctcacaggtacacttgtgtggaaattgcctcttccgtagttcttataaactcctcccagacaggcagaattctcagagcatcggaaccagggaacttgcagggaaccagggaaggtttgcactgtttgggattaattgagaataattaacactggagccgttaatcaccactttgctgctctctccctcctttcgggtctgcggcgtctgcctttttcgctcccgctgccggcgcgggtgtactggtgaaagtgaagacgtcgcggtagctgtcacccagttcggctgtacttttttaaacgctcgcatattgtttgattactaattcgagttaatatgatctttatggcaacataacagtggataattggcctttttttctgaacaacaatgtaaatcacaatcgctttattatttaataacgtcaaacgcttcgttggattggccccgaccgagaagaccttttctttctagacagtgttgtggaggaagaacaatgaagatctaattgtggagatttcataagttggctcccgtaaatgaacagcttagatatggaagttccagcagatgtgggtactattcgcctctacaagctctaccccccacccccatatacgcagtccaaacactctattggagggttttttttttttttttttttttgtggtggtggtggtcctcagatcctagcaaccacctaaagtttccagtagtaattagagcttttatcgggcttgctcttcagccctttatattgccgatttagcgttaaggcattaagtccacacaccaaattagcgcgactcccaaatagccacaaccacttattctccccttccctcattttggtggttggacaccaagagcatgggcctgggacttttttttttttttttttttttggttttactttgttttgatttgatttttaaaacctattcgctaccgcactgtcttggaatatacttgtttcaggcagagttttgcaagggacctgagccattattttgcaaacgcctggaagagcacatgaaactcagagaactacaatgcagacgacaacgcctagaaggaatgggtccccgctgctcgaatgaaagattaattacatttgccccaaaagccccaattctaacggtctctatcgcggcttttgccgtcactgaaggaccgctgtctctggggtcttcagacatcggagtcctttgcaaatgaagagcccccaccatttggaattcgggtcaaggagaaagactctgagcctgcagcagtttttgtttttgcgtgtgcccgcctctccattttattcaacttcttctgcctgtcgggaagcagaacaatcgctccccacccacccccctccgccccgtttctaagataaacaggaggtgcaaaatgctttgcctgcacacgcgccctcgtggcccagtcttcctgcaacccccagcgcaccggccatgcatctgtctcccaaccagacgtgggagaagacatccccccttcactcttcccacctgcatttaaaaaccatcacattgactgctctagagtcaggttcacatttttggccctccatgccaccttccagtttcttcccggtccactctctttctcaggacctaaaaagtgacggggagagggtgaagaattggagaaagcagcggattttcaaaacgtatcccccccgcccccccatcttttaaagtagtatgttaccacaaggagtgcatttgggaaactttccctaacaggagctgggcgcagtgttattcttctccatgggtctgctggcctccccgcccccgctggacaatgcgtgctttgagactcggtggcctgcaggcagcgggagacgaggggactgggcagccttcctccaaggggcccgcagctgggggagcgccaggcagggagcagggacaaggaggcgagccacgcaggaaggaaaaccataaaagtgccattttttcccttagccctgcacagaggcaggctttgaggacctaggggcagggcagctggggcggggtggggtgggggtgttgagaggttttgcgtgttctttttaccccctttccccccactgaaacattttatttcggcacataattatgcactgcagattctccagcctcctcgccctcaatcttggtaacctggtctttggttaataatatcgcaactcgggacttcaacgctcagaccccctccaggccccagcctccgtattctcggagccctccactactgatacctctcgcggagtgcggcgccccgggaaaagcctcttggccagggactctgggacattactttctagtttgttttgttttttgtttttctcccagagaccaccaccaccctcatcctcttcaggcagcatttaggagaggacctctgagatcagcagaaggcctcagacggtcaccatattggtggaagcgtttgtctgatgttttaaaacgtataccaaacggggcgtcagggccacgtgctgtgccttcgaaacgccgccgcgggccctgcctttcagagctgcggcagccggggctggcgtggagggggcgctgaaacaccggcgggcgtcaggggccagcgctgagctgcagatctggccgcagcgctgagtgaagcgaattatctggagcgtgtttgatctgggactgcgtagtcagcttctgctttatttgtttgtttgtaatctcatatttagcaagccgggacggtggcagcaagggagaaaggacgggatggaggagggggcttcgcggtaaccacaccccttcctaatgagttaatttccatatttgcgcctcccgca

SEQ ID NO: 122729 - DNA, 1161 bp, Homo sapiens
  misc_feature 1..1161: note = chr3:181444827-181445988
  misc_feature 1..1161: note = Hyper
  source 1..1161: mol_type = genomic DNA
ttgcgtcttgcgcagcgcagacacctccactctggattgaaacgaaaaagctcgcggtaagagcagaaaattggtctattgatacattcgctccgagtgttgatcttggcatcaccgatagccggttaattcccccaccccgcccccgccagtgggtcgcacgcggattgccgagggcttgcaggcactcaggcagacgcagacagaaacccacatcgaccccccccctttccccgcctccagctgtccgaccctcaagtctctttctttttcttttttacccaactccggattattttccccctcaaggtgagggcagtgagagcagcgagggcacagtccgcacaaaaagggggaaaataatcgcaaaccaaggaaccaaaagtgaaagtttcaaactagataccaaccctgatggaggttgggtgctgacccgactgtgggtacttaagagaaggaaggagggaaactgaggtggtgagattatgtccacagtatgggtcggttaaaagttgtagtaaagaagttttgggagggccctcactagaaactcaaggcgggtttcagctgatttaacctggtttcctacacatttttgcggtgattctgctctggaaattggcgaaagagacagacctttgcaattgctcacccctccctgcccccaaccaccctgcttactttcgcgaagcgcattaggatgtgggctctggcttgagctccaaaatagcttgcttgtcaattgcgagctgcagcaatatcaaagtgaactgtcccaagtaactcttgtctagaagctgggaagaagcttaagcagctcgctttaatgatgatttgtagctcggcgaggggcacggacagcaaacaccccgcaggtgtgtgccgtaacaccatcatccggacttgaatgtagattactctggcgatcgtttgatcggccctttgaaaccctttacaattgcctgtgacgaacggccagtctcagtttttctctgaataatccctgagggtaagtcctccgggcttttaaagagctctagtattttttttttaaagaataaaaagaaaaacgttcgattttagtttagacctcgtcaacttttagtcgctaacaggcatcactcaagccagtcaatacttaatgaccgttagttacccttg

SEQ ID NO: 122730 - DNA, 516 bp, Homo sapiens; identical to SEQ ID NO: 90701
  misc_feature 1..516: note = chr3:182314781-182315297
  misc_feature 1..516: note = Hypo
  source 1..516: mol_type = genomic DNA

SEQ ID NO: 122731 - DNA, 20 bp, Homo sapiens
  misc_feature 1..20: note = chr3:182457888-182457908
  misc_feature 1..20: note = Hypo
  source 1..20: mol_type = genomic DNA
agcctccgtggctggcgcgg

SEQ ID NO: 122732 - DNA, 21 bp, Homo sapiens
  misc_feature 1..21: note = chr3:182704506-182704527
  misc_feature 1..21: note = Hypo
  source 1..21: mol_type = genomic DNA
agcaaatgggctgggcgcggt

SEQ ID NO: 122733 - DNA, 30 bp, Homo sapiens; identical to SEQ ID NO: 40073
  misc_feature 1..30: note = chr3:182800477-182800507
  misc_feature 1..30: note = Hypo
  source 1..30: mol_type = genomic DNA

SEQ ID NO: 122734 - DNA, 19 bp, Homo sapiens
  misc_feature 1..19: note = chr3:182812783-182812802
  misc_feature 1..19: note = Hypo
  source 1..19: mol_type = genomic DNA
tgccctggccaggcacggt

SEQ ID NO: 122735 - DNA, 148 bp, Homo sapiens; identical to SEQ ID NO: 90706
  misc_feature 1..148: note = chr3:182815981-182816129
  misc_feature 1..148: note = Hypo
  source 1..148: mol_type = genomic DNA

SEQ ID NO: 122736 - DNA, 64 bp, Homo sapiens; identical to SEQ ID NO: 90707
  misc_feature 1..64: note = chr3:182834167-182834231
  misc_feature 1..64: note = Hyper
  source 1..64: mol_type = genomic DNA

SEQ ID NO: 122737 - DNA, 34 bp, Homo sapiens; identical to SEQ ID NO: 90708
  misc_feature 1..34: note = chr3:182895956-182895990
  misc_feature 1..34: note = Hypo
  source 1..34: mol_type = genomic DNA

SEQ ID NO: 122738 - DNA, 859 bp, Homo sapiens
  misc_feature 1..859: note = chr3:182896611-182897470
  misc_feature 1..859: note = Hyper
  source 1..859: mol_type = genomic DNA
tgctgggaggcggaccgggagctcccagtctgcggcccccgccgggttggagcggctccggctcctccaaggctcgggctaagcggctctcaaccgattcccaccccgccctggagaaatgcgggcgtgtctgcaggcatttttgattgtcacgatttgggggcggggtggaggatggggtggcgcattcctggcacctagtgggtagaggccaggggtgctactaaacatcctaccgtgggagcacagagaagcccacgcagcaaagaattgcccggctccgaatatcgaagtgcgcggtcgagaaggcgtgggctgcgggctctgctcgcctctgcaggcgccttagagcagctccgaggtcccccgtgcggagctaggcgcgcacccaggacacccctcgggctcctcggaggaggccctggttgtcccctttctgccgccgccgaggctccggctgctttctgcgtagctgggcagggcccgggcccccacaccgcctctcccgggaatgcgggcgctctggagccgaggagcgggggcgtccgcagggaggtcagctctcctgggcggaggtcctcgggcgcagcgccctcgcctggaaaccagccgtcgcccccgcaggagccagccggcccgtggacgccccagcgcgctcctcctcggtgctgcgggtcgccctgcaattccgagaagaaagtcagagacgccgtggcccaaagaggcgcttagtctttcctcgctcacactcacgtttcctcctcatcgcgttcttctttttctccctggctgctttctcccctctccaggaaagcagatttggaggaacaggtttcgtgactgtcgtccgactggaaaa

SEQ ID NO: 122739 - DNA, 239 bp, Homo sapiens; identical to SEQ ID NO: 90711
  misc_feature 1..239: note = chr3:182971103-182971342
  misc_feature 1..239: note = Hyper
  source 1..239: mol_type = genomic DNA

SEQ ID NO: 122740 - DNA, 531 bp, Homo sapiens; identical to SEQ ID NO: 90712
  misc_feature 1..531: note = chr3:182971927-182972458
  misc_feature 1..531: note = Hyper
  source 1..531: mol_type = genomic DNA

SEQ ID NO: 122741 - DNA, 30 bp, Homo sapiens; identical to SEQ ID NO: 90713
  misc_feature 1..30: note = chr3:182987335-182987365
  misc_feature 1..30: note = Hypo
  source 1..30: mol_type = genomic DNA

SEQ ID NO: 122742 - DNA, 121 bp, Homo sapiens; identical to SEQ ID NO: 90714
  misc_feature 1..121: note = chr3:182987831-182987952
  misc_feature 1..121: note = Hypo
  source 1..121: mol_type = genomic DNA

SEQ ID NO: 122743 - DNA, 30 bp, Homo sapiens; identical to SEQ ID NO: 40078
  misc_feature 1..30: note = chr3:183035309-183035339
  misc_feature 1..30: note = Hypo
  source 1..30: mol_type = genomic DNA

SEQ ID NO: 122744 - DNA, 36 bp, Homo sapiens; identical to SEQ ID NO: 90717
  misc_feature 1..36: note = chr3:183070301-183070337
  misc_feature 1..36: note = Hypo
  source 1..36: mol_type = genomic DNA

SEQ ID NO: 122745 - DNA, 30 bp, Homo sapiens; identical to SEQ ID NO: 90718
  misc_feature 1..30: note = chr3:183084014-183084044
  misc_feature 1..30: note = Hypo
  source 1..30: mol_type = genomic DNA

SEQ ID NO: 122746 - DNA, 247 bp, Homo sapiens; identical to SEQ ID NO: 90719
  misc_feature 1..247: note = chr3:183145371-183145618
  misc_feature 1..247: note = Hyper
  source 1..247: mol_type = genomic DNA

SEQ ID NO: 122747 - DNA, 94 bp, Homo sapiens
  misc_feature 1..94: note = chr3:183145931-183146025
  misc_feature 1..94: note = Hyper
  source 1..94: mol_type = genomic DNA
ctcgccacgccccgcgggggctcccgtgacagaccaagtctggcgctttcccagcgtcgcagctggaccgagagaggagcggccgttctgcaaa

SEQ ID NO: 122748 - DNA, 38 bp, Homo sapiens
  misc_feature 1..38: note = chr3:183146397-183146435
  misc_feature 1..38: note = Hyper
  source 1..38: mol_type = genomic DNA
gacagtgactgaggcgctccagtcgcaccggggtccgg

SEQ ID NO: 122749 - DNA, 29 bp, Homo sapiens
  misc_feature 1..29: note = chr3:183146648-183146677
  misc_feature 1..29: note = Hyper
  source 1..29: mol_type = genomic DNA
cagttcttgacctccgctggccacacctg

SEQ ID NO: 122750 - DNA, 43 bp, Homo sapiens; identical to SEQ ID NO: 90720
  misc_feature 1..43: note = chr3:183183687-183183730
  misc_feature 1..43: note = Hypo
  source 1..43: mol_type = genomic DNA

SEQ ID NO: 122751 - DNA, 30 bp, Homo sapiens; identical to SEQ ID NO: 90721
  misc_feature 1..30: note = chr3:183196555-183196585
  misc_feature 1..30: note = Hypo
  source 1..30: mol_type = genomic DNA

SEQ ID NO: 122752 - DNA, 84 bp, Homo sapiens; identical to SEQ ID NO: 90722
  misc_feature 1..84: note = chr3:183214546-183214630
  misc_feature 1..84: note = Hypo
  source 1..84: mol_type = genomic DNA

SEQ ID NO: 122753 - DNA, 92 bp, Homo sapiens; identical to SEQ ID NO: 90723
  misc_feature 1..92: note = chr3:183355362-183355454
  misc_feature 1..92: note = Hypo
  source 1..92: mol_type = genomic DNA

SEQ ID NO: 122754 - DNA, 141 bp, Homo sapiens; identical to SEQ ID NO: 90724
  misc_feature 1..141: note = chr3:183531359-183531500
  misc_feature 1..141: note = Hypo
  source 1..141: mol_type = genomic DNA

SEQ ID NO: 122755 - DNA, 138 bp, Homo sapiens; identical to SEQ ID NO: 90725
  misc_feature 1..138: note = chr3:183543365-183543503
  misc_feature 1..138: note = Hyper
  source 1..138: mol_type = genomic DNA

SEQ ID NO: 122756 - DNA, 99 bp, Homo sapiens; identical to SEQ ID NO: 90726
  misc_feature 1..99: note = chr3:183603067-183603166
  misc_feature 1..99: note = Hypo
  source 1..99: mol_type = genomic DNA

SEQ ID NO: 122757 - DNA, 172 bp, Homo sapiens; identical to SEQ ID NO: 40081
  misc_feature 1..172: note = chr3:183622013-183622185
  misc_feature 1..172: note = Hypo
  source 1..172: mol_type = genomic DNA

SEQ ID NO: 122758 - DNA, 274 bp, Homo sapiens; identical to SEQ ID NO: 90728
  misc_feature 1..274: note = chr3:183643321-183643595
  misc_feature 1..274: note = Hypo
  source 1..274: mol_type = genomic DNA

SEQ ID NO: 122759 - DNA, 54 bp, Homo sapiens; identical to SEQ ID NO: 90729
  misc_feature 1..54: note = chr3:183648128-183648182
  misc_feature 1..54: note = Hypo
  source 1..54: mol_type = genomic DNA

SEQ ID NO: 122760 - DNA, 79 bp, Homo sapiens; identical to SEQ ID NO: 90730
  misc_feature 1..79: note = chr3:183676026-183676105
  misc_feature 1..79: note = Hypo
  source 1..79: mol_type = genomic DNA

SEQ ID NO: 122761 - DNA, 222 bp, Homo sapiens; identical to SEQ ID NO: 40083
  misc_feature 1..222: note = chr3:183684023-183684245
  misc_feature 1..222: note = Hypo
  source 1..222: mol_type = genomic DNA

SEQ ID NO: 122762 - DNA, 30 bp, Homo sapiens; identical to SEQ ID NO: 90732
  misc_feature 1..30: note = chr3:183688570-183688600
  misc_feature 1..30: note = Hypo
  source 1..30: mol_type = genomic DNA

SEQ ID NO: 122763 - DNA, 30 bp, Homo sapiens; identical to SEQ ID NO: 90733
  misc_feature 1..30: note = chr3:183696328-183696358
  misc_feature 1..30: note = Hypo
  source 1..30: mol_type = genomic DNA

SEQ ID NO: 122764 - DNA, 34 bp, Homo sapiens; identical to SEQ ID NO: 40084
  misc_feature 1..34: note = chr3:183713864-183713898
  misc_feature 1..34: note = Hypo
  source 1..34: mol_type = genomic DNA

SEQ ID NO: 122765 - DNA, 17 bp, Homo sapiens
  misc_feature 1..17: note = chr3:183728806-183728823
  misc_feature 1..17: note = Hypo
  source 1..17: mol_type = genomic DNA
ggcgtgagccaccgtgc

SEQ ID NO: 122766 - DNA, 202 bp, Homo sapiens; identical to SEQ ID NO: 90736
  misc_feature 1..202: note = chr3:183771813-183772015
  misc_feature 1..202: note = Hypo
  source 1..202: mol_type = genomic DNA

SEQ ID NO: 122767 - DNA, 35 bp, Homo sapiens; identical to SEQ ID NO: 90737
  misc_feature 1..35: note = chr3:183801986-183802021
  misc_feature 1..35: note = Hypo
  source 1..35: mol_type = genomic DNA

SEQ ID NO: 122768 - DNA, 21 bp, Homo sapiens
  misc_feature 1..21: note = chr3:183872331-183872352
  misc_feature 1..21: note = Hypo
  source 1..21: mol_type = genomic DNA
ttttttgggggggggcgaggg

SEQ ID NO: 122769 - DNA, 445 bp, Homo sapiens; identical to SEQ ID NO: 90739
  misc_feature 1..445: note = chr3:183948369-183948814
  misc_feature 1..445: note = Hyper
  source 1..445: mol_type = genomic DNA

SEQ ID NO: 122770 - DNA, 26 bp, Homo sapiens
  misc_feature 1..26: note = chr3:183965599-183965625
  misc_feature 1..26: note = Hypo
  source 1..26: mol_type = genomic DNA
cttactgtccaggcccgagttagaaa

SEQ ID NO: 122771 - DNA, 26 bp, Homo sapiens
  misc_feature 1..26: note = chr3:183965925-183965951
  misc_feature 1..26: note = Hypo
  source 1..26: mol_type = genomic DNA
gccaccgcgcccggcagaaatgcatc

SEQ ID NO: 122772 - DNA, 105 bp, Homo sapiens; identical to SEQ ID NO: 90742
  misc_feature 1..105: note = chr3:183977991-183978096
  misc_feature 1..105: note = Hyper
  source 1..105: mol_type = genomic DNA

SEQ ID NO: 122773 - DNA, 567 bp, Homo sapiens; identical to SEQ ID NO: 90743
  misc_feature 1..567: note = chr3:183980079-183980646
  misc_feature 1..567: note = Hyper
  source 1..567: mol_type = genomic DNA

SEQ ID NO: 122774 - DNA, 209 bp, Homo sapiens; identical to SEQ ID NO: 90744
  misc_feature 1..209: note = chr3:183993757-183993966
  misc_feature 1..209: note = Hyper
  source 1..209: mol_type = genomic DNA

SEQ ID NO: 122775 - DNA, 16 bp, Homo sapiens
  misc_feature 1..16: note = chr3:184005808-184005824
  misc_feature 1..16: note = Hypo
  source 1..16: mol_type = genomic DNA
acaacgggagccaggc

SEQ ID NO: 122776 - DNA, 136 bp, Homo sapiens; identical to SEQ ID NO: 90746
  misc_feature 1..136: note = chr3:184015341-184015477
  misc_feature 1..136: note = Hypo
  source 1..136: mol_type = genomic DNA

SEQ ID NO: 122777 - DNA, 16 bp, Homo sapiens
  misc_feature 1..16: note = chr3:184015597-184015613
  misc_feature 1..16: note = Hypo
  source 1..16: mol_type = genomic DNA
gcgtggtggcacaaaa

SEQ ID NO: 122778 - DNA, 144 bp, Homo sapiens; identical to SEQ ID NO: 90748
  misc_feature 1..144: note = chr3:184016089-184016233
  misc_feature 1..144: note = Hypo
  source 1..144: mol_type = genomic DNA

SEQ ID NO: 122779 - DNA, 149 bp, Homo sapiens; identical to SEQ ID NO: 40088
  misc_feature 1..149: note = chr3:184018038-184018187
  misc_feature 1..149: note = Hypo
  source 1..149: mol_type = genomic DNA

SEQ ID NO: 122780 - DNA, 36 bp, Homo sapiens; identical to SEQ ID NO: 90750
  misc_feature 1..36: note = chr3:184031698-184031734
  misc_feature 1..36: note = Hypo
  source 1..36: mol_type = genomic DNA

SEQ ID NO: 122781 - DNA, 41 bp, Homo sapiens; identical to SEQ ID NO: 90751
  misc_feature 1..41: note = chr3:184057516-184057557
  misc_feature 1..41: note = Hypo
  source 1..41: mol_type = genomic DNA

SEQ ID NO: 122782 - DNA, 30 bp, Homo sapiens; identical to SEQ ID NO: 90752
  misc_feature 1..30: note = chr3:184059863-184059893
  misc_feature 1..30: note = Hypo
  source 1..30: mol_type = genomic DNA

SEQ ID NO: 122783 - DNA, 23 bp, Homo sapiens
  misc_feature 1..23: note = chr3:184152655-184152678
  misc_feature 1..23: note = Hypo
  source 1..23: mol_type = genomic DNA
actgtgcccggccagaatgtcct

SEQ ID NO: 122784 - DNA, 35 bp, Homo sapiens; identical to SEQ ID NO: 90754
  misc_feature 1..35: note = chr3:184164708-184164743
  misc_feature 1..35: note = Hypo
  source 1..35: mol_type = genomic DNA

SEQ ID NO: 122785 - DNA, 130 bp, Homo sapiens; identical to SEQ ID NO: 90755
  misc_feature 1..130: note = chr3:184200600-184200730
  misc_feature 1..130: note = Hypo
  source 1..130: mol_type = genomic DNA

SEQ ID NO: 122786 - DNA, 30 bp, Homo sapiens; identical to SEQ ID NO: 40091
  misc_feature 1..30: note = chr3:184226786-184226816
  misc_feature 1..30: note = Hypo
  source 1..30: mol_type = genomic DNA

SEQ ID NO: 122787 - DNA, 86 bp, Homo sapiens; identical to SEQ ID NO: 90757
  misc_feature 1..86: note = chr3:184237219-184237305
  misc_feature 1..86: note = Hypo
  source 1..86: mol_type = genomic DNA

SEQ ID NO: 122788 - DNA, 401 bp, Homo sapiens; identical to SEQ ID NO: 90758
  misc_feature 1..401: note = chr3:184243074-184243475
  misc_feature 1..401: note = Hyper
  source 1..401: mol_type = genomic DNA

SEQ ID NO: 122789 - DNA, 35 bp, Homo sapiens; identical to SEQ ID NO: 90759
  misc_feature 1..35: note = chr3:184279894-184279929
  misc_feature 1..35: note = Hyper
  source 1..35: mol_type = genomic DNA

SEQ ID NO: 122790 - DNA, 51 bp, Homo sapiens; identical to SEQ ID NO: 90760
  misc_feature 1..51: note = chr3:184280171-184280222
  misc_feature 1..51: note = Hyper
  source 1..51: mol_type = genomic DNA

SEQ ID NO: 122791 - DNA, 352 bp, Homo sapiens
  misc_feature 1..352: note = chr3:184301488-184301840
  misc_feature 1..352: note = Hyper
  source 1..352: mol_type = genomic DNA
cccacggagcccagccgcgccgccgcagccggcccgggggaggggcgccccgcacggctaagctctctgcgtccccggggcggacgcggggaggggaggggaagggacgcagcctctccgccgaggcctccttcctcccctagtgggggggaggggctgtgcgggggcaggggcgggcgatgcgggggcccaaggtggcccttggactaggcgccggagctgtcaacggggcgaggtgtggcgggcggccgggggaggggacgcggtgccgagtggcctcctgcacagccgctcagcattccccggctgcaggcgcaaataaagcggagggggcgcgcggagctcctgctca

SEQ ID NO: 122792 - DNA, 306 bp, Homo sapiens
  misc_feature 1..306: note = chr3:184319790-184320096
  misc_feature 1..306: note = Hyper
  source 1..306: mol_type = genomic DNA
tacaggggcagcagccgcggctggcggcttcggggagccccggggctggggcccgcgggcggggcgggaggggaggctgggggcggcgggcccctcctggccattttggccggggaatctgtgtaaagtgtttaaaaagaaaaactctccggaggaggacgtaaccttttcttaacatctggggctcaattagctaatgacagcaaagccttctccggtgtcgctgacccctgggcggcagcccagctcccccacccccggtatttatacagctgcggcccctcgctgggacggggggcagggggc

SEQ ID NO: 122793 - DNA, 563 bp, Homo sapiens
  misc_feature 1..563: note = chr3:184321768-184322331
  misc_feature 1..563: note = Hyper
  source 1..563: mol_type = genomic DNA
taggtggcttggaaacgttcagtagtcggacctgggccacggagggcacagcggccactctttctgagaggcagaggtcggtgggctccaccctcccactccgagccggcctgaccctcggtgcaggcggaaggggggccgcggggagcggaggacggtgccgaggcctcgctgctgctgcagcgcccccgccccgcgtcgcctcccagccctggctcccagtgctccgggcttgctgacggtacagggtggacagccccgagacattttcatcagatctcgtctcccgcagcccagcgctgctgccgggggtcggacagggccgatcccagcacccctcccccgagccctggctgggcgagaaaccgagatggtggctgcagaaaccggagcccccgcgccggggcgaccgcgaggggccgaggcctttgagagcgctgccgccccttgccaaggtcaatcaaaccctcccacgctccggaggcgcgcgctgcgtgctctaggcagcggggattggggccggaggggcgcgtcccggcggggccgggcgagggtgggtgggg

SEQ ID NO: 122794 - DNA, 150 bp, Homo sapiens; identical to SEQ ID NO: 90766
  misc_feature 1..150: note = chr3:184459092-184459242
  misc_feature 1..150: note = Hypo
  source 1..150: mol_type = genomic DNA

SEQ ID NO: 122795 - DNA, 109 bp, Homo sapiens; identical to SEQ ID NO: 40092
  misc_feature 1..109: note = chr3:184785147-184785256
  misc_feature 1..109: note = Hypo
  source 1..109: mol_type = genomic DNA

SEQ ID NO: 122796 - DNA, 112 bp, Homo sapiens; identical to SEQ ID NO: 90770
  misc_feature 1..112: note = chr3:184870195-184870307
  misc_feature 1..112: note = Hyper
  source 1..112: mol_type = genomic DNA

SEQ ID NO: 122797 - DNA, 776 bp, Homo sapiens; identical to SEQ ID NO: 90771
  misc_feature 1..776: note = chr3:184870608-184871384
  misc_feature 1..776: note = Hyper
  source 1..776: mol_type = genomic DNA

SEQ ID NO: 122798 - DNA, 88 bp, Homo sapiens; identical to SEQ ID NO: 90772
  misc_feature 1..88: note = chr3:185001579-185001667
  misc_feature 1..88: note = Hypo
  source 1..88: mol_type = genomic DNA

SEQ ID NO: 122799 - DNA, 28 bp, Homo sapiens
  misc_feature 1..28: note = chr3:185001907-185001935
  misc_feature 1..28: note = Hypo
  source 1..28: mol_type = genomic DNA
gaaccactacgcgcggccactttccttt

SEQ ID NO: 122800 - DNA, 23 bp, Homo sapiens
  misc_feature 1..23: note = chr3:185270882-185270905
  misc_feature 1..23: note = Hypo
  source 1..23: mol_type = genomic DNA
aaaagaaaaacaggccggcacgg

SEQ ID NO: 122801 - DNA, 84 bp, Homo sapiens; identical to SEQ ID NO: 90775
  misc_feature 1..84: note = chr3:185271296-185271380
  misc_feature 1..84: note = Hypo
  source 1..84: mol_type = genomic DNA

SEQ ID NO: 122802 - DNA, 80 bp, Homo sapiens; identical to SEQ ID NO: 90776
  misc_feature 1..80: note = chr3:185277764-185277844
  misc_feature 1..80: note = Hypo
  source 1..80: mol_type = genomic DNA

SEQ ID NO: 122803 - DNA, 30 bp, Homo sapiens; identical to SEQ ID NO: 14609
  misc_feature 1..30: note = chr3:185278325-185278355
  misc_feature 1..30: note = Hypo
  source 1..30: mol_type = genomic DNA

SEQ ID NO: 122804 - DNA, 40 bp, Homo sapiens; identical to SEQ ID NO: 90778
  misc_feature 1..40: note = chr3:185302868-185302908
  misc_feature 1..40: note = Hypo
  source 1..40: mol_type = genomic DNA

SEQ ID NO: 122805 - DNA, 30 bp, Homo sapiens; identical to SEQ ID NO: 90779
  misc_feature 1..30: note = chr3:185303247-185303277
  misc_feature 1..30: note = Hypo
  source 1..30: mol_type = genomic DNA

SEQ ID NO: 122806 - DNA, 30 bp, Homo sapiens; identical to SEQ ID NO: 90780
  misc_feature 1..30: note = chr3:185362704-185362734
  misc_feature 1..30: note = Hypo
  source 1..30: mol_type = genomic DNA

SEQ ID NO: 122807 - DNA, 338 bp, Homo sapiens; identical to SEQ ID NO: 90781
  misc_feature 1..338: note = chr3:185362967-185363305
  misc_feature 1..338: note = Hypo
  source 1..338: mol_type = genomic DNA

SEQ ID NO: 122808 - DNA, 34 bp, Homo sapiens; identical to SEQ ID NO: 90782
  misc_feature 1..34: note = chr3:185363531-185363565
  misc_feature 1..34: note = Hypo
  source 1..34: mol_type = genomic DNA

SEQ ID NO: 122809 - DNA, 136 bp, Homo sapiens; identical to SEQ ID NO: 40098
  misc_feature 1..136: note = chr3:185385541-185385677
  misc_feature 1..136: note = Hypo
  source 1..136: mol_type = genomic DNA

SEQ ID NO: 122810 - DNA, 37 bp, Homo sapiens; identical to SEQ ID NO: 90784
  misc_feature 1..37: note = chr3:185446057-185446094
  misc_feature 1..37: note = Hypo
  source 1..37: mol_type = genomic DNA

SEQ ID NO: 122811 - DNA, 30 bp, Homo sapiens; identical to SEQ ID NO: 90785
  misc_feature 1..30: note = chr3:185457365-185457395
  misc_feature 1..30: note = Hypo
  source 1..30: mol_type = genomic DNA

SEQ ID NO: 122812 - DNA, 17 bp, Homo sapiens
  misc_feature 1..17: note = chr3:185504539-185504556
  misc_feature 1..17: note = Hypo
  source 1..17: mol_type = genomic DNA
tacgtggaaacctacat

SEQ ID NO: 122813 - DNA, 127 bp, Homo sapiens; identical to SEQ ID NO: 90787
  misc_feature 1..127: note = chr3:185543557-185543684
  misc_feature 1..127: note = Hyper
  source 1..127: mol_type = genomic DNA

SEQ ID NO: 122814 - DNA, 172 bp, Homo sapiens; identical to SEQ ID NO: 90788
  misc_feature 1..172: note = chr3:185543923-185544095
  misc_feature 1..172: note = Hyper
  source 1..172: mol_type = genomic DNA

SEQ ID NO: 122815 - DNA, 29 bp, Homo sapiens
  misc_feature 1..29: note = chr3:185547274-185547303
  misc_feature 1..29: note = Hypo
  source 1..29: mol_type = genomic DNA
tcctgctgtgtagccgggttcctaacagg

SEQ ID NO: 122816 - DNA, 35 bp, Homo sapiens; identical to SEQ ID NO: 90790
  misc_feature 1..35: note = chr3:185551925-185551960
  misc_feature 1..35: note = Hypo
  source 1..35: mol_type = genomic DNA

SEQ ID NO: 122817 - DNA, 30 bp, Homo sapiens; identical to SEQ ID NO: 90791
  misc_feature 1..30: note = chr3:185552326-185552356
  misc_feature 1..30: note = Hypo
  source 1..30: mol_type = genomic DNA

SEQ ID NO: 122818 - DNA, 30 bp, Homo sapiens; identical to SEQ ID NO: 90792
  misc_feature 1..30: note = chr3:185598167-185598197
  misc_feature 1..30: note = Hypo
  source 1..30: mol_type = genomic DNA

SEQ ID NO: 122819 - DNA, 81 bp, Homo sapiens; identical to SEQ ID NO: 90793
  misc_feature 1..81: note = chr3:185643324-185643405
  misc_feature 1..81: note = Hypo
  source 1..81: mol_type = genomic DNA

SEQ ID NO: 122820 - DNA, 91 bp, Homo sapiens; identical to SEQ ID NO: 40102
  misc_feature 1..91: note = chr3:185667518-185667609
  misc_feature 1..91: note = Hypo
  source 1..91: mol_type = genomic DNA

SEQ ID NO: 122821 - DNA, 30 bp, Homo sapiens; identical to SEQ ID NO: 90795
  misc_feature 1..30: note = chr3:186019122-186019152
  misc_feature 1..30: note = Hypo
  source 1..30: mol_type = genomic DNA

SEQ ID NO: 122822 - DNA, 619 bp, Homo sapiens; identical to SEQ ID NO: 90796
  misc_feature 1..619: note = chr3:186078712-186079331
  misc_feature 1..619: note = Hyper
  source 1..619: mol_type = genomic DNA

SEQ ID NO: 122823 - DNA, 674 bp, Homo sapiens
  misc_feature 1..674: note = chr3:186079621-186080295
  misc_feature 1..674: note = Hyper
  source 1..674: mol_type = genomic DNA
agccccttccctggccgcgggaccggctcccgctttgccctcctttaccaagttgctgcaccgggtgctccctgagccggggaccccctccgccgcgccggccgccgtcttacctcaccaggcaacacttggttgcgcggtggcccggggcgctccttcttcgcggtttattcccttacttgggaggaaagaggaaccgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcacacacgaatgtggatccgctcgatgggaacctgaccccctttggtgcaactagggcgcgggcatcattaggacgctttttactgacagggcttcggtttgggaggagg

SEQ ID NO: 122824 - DNA, 22 bp, Homo sapiens
  misc_feature 1..22: note = chr3:186329022-186329044
  misc_feature 1..22: note = Hypo
  source 1..22: mol_type = genomic DNA
ttcttttttttgagtcggagtc

SEQ ID NO: 122825 - DNA, 136 bp, Homo sapiens; identical to SEQ ID NO: 90801
  misc_feature 1..136: note = chr3:186495172-186495308
  misc_feature 1..136: note = Hypo
  source 1..136: mol_type = genomic DNA

SEQ ID NO: 122826 - DNA, 78 bp, Homo sapiens; identical to SEQ ID NO: 40105
  misc_feature 1..78: note = chr3:186527185-186527263
  misc_feature 1..78: note = Hypo
  source 1..78: mol_type = genomic DNA

SEQ ID NO: 122827 - DNA, 41 bp, Homo sapiens; identical to SEQ ID NO: 90803
  misc_feature 1..41: note = chr3:186648285-186648326
  misc_feature 1..41: note = Hyper
  source 1..41: mol_type = genomic DNA

SEQ ID NO: 122828 - DNA, 30 bp, Homo sapiens; identical to SEQ ID NO: 90804
  misc_feature 1..30: note = chr3:186649839-186649869
  misc_feature 1..30: note = Hyper
  source 1..30: mol_type = genomic DNA

SEQ ID NO: 122829 - DNA, 664 bp, Homo sapiens; identical to SEQ ID NO: 28626
  misc_feature 1..664: note = chr3:186857050-186857714
  misc_feature 1..664: note = Hyper
  source 1..664: mol_type = genomic DNA

SEQ ID NO: 122830 - DNA, 43 bp, Homo sapiens
  misc_feature 1..43: note = chr3:187086277-187086320
  misc_feature 1..43: note = Hyper
  source 1..43: mol_type = genomic DNA
caagaggcaaaaccccgggccacatggacgctgaagttggatg

SEQ ID NO: 122831 - DNA, 38 bp, Homo sapiens; identical to SEQ ID NO: 90807
  misc_feature 1..38: note = chr3:187238765-187238803
  misc_feature 1..38: note = Hypo
  source 1..38: mol_type = genomic DNA

SEQ ID NO: 122832 - DNA, 35 bp, Homo sapiens; identical to SEQ ID NO: 90808
  misc_feature 1..35: note = chr3:187253705-187253740
  misc_feature 1..35: note = Hypo
  source 1..35: mol_type = genomic DNA

SEQ ID NO: 122833 - DNA, 448 bp, Homo sapiens
  misc_feature 1..448: note = chr3:187387791-187388239
  misc_feature 1..448: note = Hyper
  source 1..448: mol_type = genomic DNA
ttttctcaagagcttcgggagctgagggacccagaaaagcaccaaaactctttagaaggactgagcatcccttacgtccaaaccaatggggcaggagcaaggcttagggagggctggagaatccgggagacgtcgagggagtctccttacctgcttccccgcggcagcagccagggacttctgcagaaactgacggagtctggggtccgagggagcgccggtgacacagcccagggccaggacgatggacagcgcagccagcgcgcactggaggcggcaggacagcatctcggcgccgcgaaagccgagctggagagtggctggtcaaactctaggcgcggatcagcaggcagcagcgatggctccgaacctcgctcctaaagcggcttgtgtgctctcaaccgtctccctctgttttaaactctctctctgacgtcaggctaggagg

SEQ ID NO: 122834 - DNA, 178 bp, Homo sapiens; identical to SEQ ID NO: 90812
  misc_feature 1..178: note = chr3:187416640-187416818
  misc_feature 1..178: note = Hypo
  source 1..178: mol_type = genomic DNA

SEQ ID NO: 122835 - DNA, 1324 bp, Homo sapiens; identical to SEQ ID NO: 90813
  misc_feature 1..1324: note = chr3:187455342-187456666
  misc_feature 1..1324: note = Hyper
  source 1..1324: mol_type = genomic DNA

SEQ ID NO: 122836 - DNA, 542 bp, Homo sapiens; identical to SEQ ID NO: 28630
  misc_feature 1..542: note = chr3:187457112-187457654
  misc_feature 1..542: note = Hyper
  source 1..542: mol_type = genomic DNA

SEQ ID NO: 122837 - DNA, 190 bp, Homo sapiens; identical to SEQ ID NO: 40107
  misc_feature 1..190: note = chr3:187870406-187870596
  misc_feature 1..190: note = Hypo
  source 1..190: mol_type = genomic DNA

SEQ ID NO: 122838 - DNA, 36 bp, Homo sapiens; identical to SEQ ID NO: 90816
  misc_feature 1..36: note = chr3:188096606-188096642
  misc_feature 1..36: note = Hypo
  source 1..36: mol_type = genomic DNA

SEQ ID NO: 122839 - DNA, 31 bp, Homo sapiens; identical to SEQ ID NO: 90817
  misc_feature 1..31: note = chr3:189114996-189115027
  misc_feature 1..31: note = Hypo
  source 1..31: mol_type = genomic DNA

SEQ ID NO: 122840 - DNA, 17 bp, Homo sapiens
  misc_feature 1..17: note = chr3:189838424-189838441
  misc_feature 1..17: note = Hyper
  source 1..17: mol_type = genomic DNA
ccggcgtgggctgtccg

SEQ ID NO: 122841 - DNA, 377 bp, Homo sapiens; identical to SEQ ID NO: 90819
  misc_feature 1..377: note = chr3:189838501-189838878
  misc_feature 1..377: note = Hyper
  source 1..377: mol_type = genomic DNA

SEQ ID NO: 122842 - DNA, 99 bp, Homo sapiens; identical to SEQ ID NO: 90820
  misc_feature 1..99: note = chr3:190039853-190039952
  misc_feature 1..99: note = Hyper
  source 1..99: mol_type = genomic DNA

SEQ ID NO: 122843 - DNA, 195 bp, Homo sapiens; identical to SEQ ID NO: 90821
  misc_feature 1..195: note = chr3:190040207-190040402
  misc_feature 1..195: note = Hyper
  source 1..195: mol_type = genomic DNA

SEQ ID NO: 122844 - DNA, 29 bp, Homo sapiens
  misc_feature 1..29: note = chr3:190065742-190065771
  misc_feature 1..29: note = Hypo
  source 1..29: mol_type = genomic DNA
agaccatgggctgggcgcggtggctcaca

SEQ ID NO: 122845 - DNA, 159 bp, Homo sapiens; identical to SEQ ID NO: 90823
  misc_feature 1..159: note = chr3:190529604-190529763
  misc_feature 1..159: note = Hyper
  source 1..159: mol_type = genomic DNA

SEQ ID NO: 122846 - DNA, 554 bp, Homo sapiens; identical to SEQ ID NO: 90824
  misc_feature 1..554: note = chr3:190580406-190580960
  misc_feature 1..554: note = Hyper
  source 1..554: mol_type = genomic DNA

SEQ ID NO: 122847 - DNA, 82 bp, Homo sapiens; identical to SEQ ID NO: 90825
  misc_feature 1..82: note = chr3:190595746-190595828
  misc_feature 1..82: note = Hypo
  source 1..82: mol_type = genomic DNA

SEQ ID NO: 122848 - DNA, 74 bp, Homo sapiens; identical to SEQ ID NO: 90826
  misc_feature 1..74: note = chr3:191670699-191670773
  misc_feature 1..74: note = Hypo
  source 1..74: mol_type = genomic DNA

SEQ ID NO: 122849 - DNA, 17 bp, Homo sapiens
  misc_feature 1..17: note = chr3:191929220-191929237
  misc_feature 1..17: note = Hypo
  source 1..17: mol_type = genomic DNA
tttatttttttgagacg

SEQ ID NO: 122850 - DNA, 2326 bp, Homo sapiens
  misc_feature 1..2326: note = chr3:192125814-192128140
  misc_feature 1..2326: note = Hyper
  source 1..2326: mol_type = genomic DNA
tggtctccgcctcaccggcctcttgcggccgctgcagaagcgcactttgctgaacaccccgaggacgtgcctctcgcacagggagcgcccgtctttgctggggctggagcggcgcttggaggccgacactcggtcgctgttggactccctcgcctgccgcttctgccggatcaaggagctggctatcgccgcagccatagctgctcagcgagggcctcaggccccagcctctactgcgccctccggcttgcgctccgccggggcgagggcaggacctgggcggccagggaaagggcagtcgcggggaggcagtgctaaaatttgaggaggctgcagtatcgaaaacccggcgctcacaaggttagtcaaagtctgggcagtggcgacaaaatgtgtgaaaatccagatgtaaacttccccaacctctggcggccggggggcggggcggggcggtcccaggccctcttgcgaagtagacgtttgcaccccaaacttgcaccccaaggcgatcggcgtccaaggggcagtggggagtttagtcacactgcgttcggggtaccaagtggaaggggaagaacgatgcccaaaataacaagacgtgcctctgttggagaggcgcaagcgttgtaaggtgtccaaagtatacctacacatacatacatagaaaacccgtttacaaagcagagtctggacccaggcgggtagcgcgcccccggtagaaaatactaaaaagtgaataaaacgttcctttagaaaacaagccaccaaccgcacgagagaaggagaggaaggcagcaatttaactccctgcggcccgcggttctgaagattaggaggtccgtcccagcagggtgaggtctacagaatgcatcgcgccggctgcggctttccaggggccggccacccgagttctggaattccgagaggcgcgaagtgggagcggttacccggagtctgggtaggggcgcggggcgggggcagctgtttccagctgcggtgagagcaactcccggccagcagcactgcaaagagagcgggaggcgagggaggggggagggcgcgagggagggagggagatcctcgagggccaagcacccctcggggagaaaccagcgagaggcgatctgcggggtcccaagagtgggcgctctttctctttccgcttgctttccggcacgagacgggcacagttggtgattatttagggaatcctaaatctggaatgactcagtagtttaaataagccccctcaaaaggcagcgatgccgaaggtgtcctctccagctcggcgcccacacgcctttaactggagctccccgccatggtccacccggggccgccgcaccgagctggtctccgcacaggctcagagggagcgagggaagggagggaaggaaggggcgccctggcgggctcgggatcaggtcatcgccgcgctgctgcccgtgccccctaggctcgcgcgccccggcagtcagcagctcacaggcagcagatcagatggggattacccgccggacgcaaggccgatcactcagtcccgcgccgcccatcccggccgaggaaggaagtgacccgcgcgctgcgaatacccgcgcgtccgctcgggtggggcgggggctggctgcaggcgatgttggctcgcggcggctgaggctcctggccggagctgcccaccatggtctggcgccaggggcgcaggcggggcccctaggcctcctggggctacctcgcgaggcagccgagggcgcaacccgggcgcttggggccggaggcggaatcaggggccggggccaggaggcaggtgcaggcggctgccaactcgcccaacttgctgcgcgggtggccgctcagagccgcgggcttgcggggcgccccccgccgccgcgccgccgcctccccaggcccgggagggggcgctcagggtggagtcccattcatgggctgaggctctgggcgcgcggagccgccgccgcccctccggctggctcagctggagtgctagctccgcaggaaactcggggcccgggcgagagccaccgagatggcaggtgggacgcagagcccgcggcagccagagttcctcccgcacggcccgccgacccacggaagagcgaaagagcgcccaggtggggccgagctgggggccgggcccctggagcgctgggaagcacagcgcgctctagtcaggttccctttcctggagccctccgcttccagactcccttctttcctccctccctcccgccacccctctccctcctctctgtgtcttctgtctctccccttttctcctctctacgcaatcctacgtgattgaggtttg

SEQ ID NO: 122851 - DNA, 507 bp, Homo sapiens
  misc_feature 1..507: note = chr3:192231853-192232360
  misc_feature 1..507: note = Hyper
  source 1..507: mol_type = genomic DNA
ttctttcttttcctccgtgtagtctttcccagggcacccggttgaagcccaaggctaactgggaccctcctacttcagcaccaaggacagaaatcgctaaatctccaggggaaacgtacccctaaccaccgccagatgtctacttttcagacaaagcaagaaaaagaaaatatacctgccttgccagccatctgtttaaaagtcccctctcctgtggaacgcacgagcaacttttcggagacactgaacaactccaagtcgcgcgccgccctcgcaaatcgcagagagggccgcgagaaggtgcgaacgcaggtcacggccagcgccgcttggagagagacccgcaggtttcagcccaggcgcgcccggcgaaagccaacgcgctctccctacaaagcgtcgatgacttcagggatttaaaagaaaaaatacccacagacagaaccagcggaggggccctgacctcgccccagtcgggaaacgccttccctccgccacaggcagcgc

SEQ ID NO: 122852 - DNA, 965 bp, Homo sapiens
  misc_feature 1..965: note = chr3:192232564-192233529
  misc_feature 1..965: note = Hyper
  source 1..965: mol_type = genomic DNA
ggttggtcaactccccgcccacctgcgctagtagtccaaccaacaggcggcctgtcttcggaagccgggtcccgagtccatcgcgcgcgcccaggtggaggggagtttgcacatggagccggagggagcccgggcgccggcagggggcgggccgggacgcggaagtgccggtccgccgggggcagccctccgagagcccgaggcgctgccacccctcggtgggctcgagcacggccccttgagaccttccggaggcggtggctggtctgaggacgacgcggaggacgtcactgcgggtcggtgcttccttacaggtgccttctggaccggggtccttggcacctcccctgctcctgccctcggtgccggaccctgtgccctgggagcccgactacctcggtgtcccagccgtcccgggcttgaggcgctgagagggctgcgcggcttccagcccggaaggcagcggtcccgcgggctgcgcgcggccaagggcgactccggtgtgggaatccggcggaagggaagcacccgcagggagggctggaccccggaggctgcagagcgtcagaagcgactctagggaactagggggtggggtagggaggcggggacgtggaataaagaaagctcctgggtgccggctatgagaagtcaggtgtgcgtaggcgtggacagagtgccgatgtgggagtctggacacctggattttctggtcggggctctgtgtccttgggtaagtcacttaccaccctgggcgtctccccgtcaatctgggtggggaagagggtgtgagatagaggattggcagcggcgtgcttgtttgtccccgtgcctttcaggctcctagaaaagcttagcataggtgcagtgggaagtggagctagaagggacagagggagaggaggcaggtgaggcgagaaatctgaagacaaaagagcgcttcgctttggcgccagtattctggc

SEQ ID NO: 122853 - DNA, 249 bp, Homo sapiens
  misc_feature 1..249: note = chr3:192445228-192445477
  misc_feature 1..249: note = Hyper
  source 1..249: mol_type = genomic DNA
tgcatgcacagtgcccgctcagatttttttttttttttttttacctgggtctggaagctgcaggcaggagctgtcctccgagcgtggtgctgcaggtgtagtgacagatcatcccactttgctctctggatgcacagcagatttgcatgggcgctggcacgcatgcgcagggcgtcccccctccccttttcaccgcctcccgctcccccgcccccttcgcctccctccccaatacggtcctcagttatc

SEQ ID NO: 122854 - DNA, 802 bp, Homo sapiens; identical to SEQ ID NO: 90844
  misc_feature 1..802: note = chr3:192634345-192635147
  misc_feature 1..802: note = Hyper
  source 1..802: mol_type = genomic DNA

SEQ ID NO: 122855 - DNA, 30 bp, Homo sapiens; identical to SEQ ID NO: 90845
  misc_feature 1..30: note = chr3:192754793-192754823
  misc_feature 1..30: note = Hypo
  source 1..30: mol_type = genomic DNA

SEQ ID NO: 122856 - DNA, 198 bp, Homo sapiens; identical to SEQ ID NO: 90846
  misc_feature 1..198: note = chr3:192958910-192959108
  misc_feature 1..198: note = Hyper
  source 1..198: mol_type = genomic DNA

SEQ ID NO: 122857 - DNA, 53 bp, Homo sapiens; identical to SEQ ID NO: 90847
  misc_feature 1..53: note = chr3:193093790-193093843
  misc_feature 1..53: note = Hypo
  source 1..53: mol_type = genomic DNA

SEQ ID NO: 122858 - DNA, 36 bp, Homo sapiens; identical to SEQ ID NO: 90848
  misc_feature 1..36: note = chr3:193103643-193103679
  misc_feature 1..36: note = Hypo
  source 1..36: mol_type = genomic DNA

SEQ ID NO: 122859 - DNA, 37 bp, Homo sapiens; identical to SEQ ID NO: 90849
  misc_feature 1..37: note = chr3:193312128-193312165
  misc_feature 1..37: note = Hypo
  source 1..37: mol_type = genomic DNA

SEQ ID NO: 122860 - DNA, 32 bp, Homo sapiens; identical to SEQ ID NO: 90850
  misc_feature 1..32: note = chr3:193419609-193419641
  misc_feature 1..32: note = Hypo
  source 1..32: mol_type = genomic DNA

SEQ ID NO: 122861 - DNA, 174 bp, Homo sapiens; identical to SEQ ID NO: 5009
  misc_feature 1..174: note = chr3:193548530-193548704
  misc_feature 1..174: note = Hypo
  source 1..174: mol_type = genomic DNA

SEQ ID NO: 122862 - DNA, 30 bp, Homo sapiens; identical to SEQ ID NO: 90852
  misc_feature 1..30: note = chr3:193548916-193548946
  misc_feature 1..30: note = Hypo
  source 1..30: mol_type = genomic DNA

SEQ ID NO: 122863 - DNA, 252 bp, Homo sapiens; identical to SEQ ID NO: 90853
  misc_feature 1..252: note = chr3:193588098-193588350
  misc_feature 1..252: note = Hypo
  source 1..252: mol_type = genomic DNA

SEQ ID NO: 122864 - DNA, 114 bp, Homo sapiens; identical to SEQ ID NO: 90854
  misc_feature 1..114: note = chr3:193656666-193656780
  misc_feature 1..114: note = Hypo
  source 1..114: mol_type = genomic DNA

SEQ ID NO: 122865 - DNA, 30 bp, Homo sapiens; identical to SEQ ID NO: 40114
  misc_feature 1..30: note = chr3:193774655-193774685
  misc_feature 1..30: note = Hypo
  source 1..30: mol_type = genomic DNA

SEQ ID NO: 122866 - DNA, 385 bp, Homo sapiens
  misc_feature 1..385: note = chr3:193776076-193776461
  misc_feature 1..385: note = Hyper
  source 1..385: mol_type = genomic DNA
cggttcctctgcagacgttcagccccttcggaaatgtaaaacccgggaagcgaaagctgcggcgacctcccagagcctctcaggcacgcggcatctctccccaccggcagcgccttgaaataccaaaggcctagccaaagatggaaccgttttgttgggagctcgggtttcccccgccgcgaggctgagccggtggcgcagctgctcaaaggtcacgcccgagacacgtccgcacaagcccgggtggcggggcgggcagcggggagagaagaggggagtggggagggggacgggggcaggggggaggggcgccaccttctccagggccctgcggggtgggctcccatcttcatctcgcaagcatccaacccggggaggtggcttt

SEQ ID NO: 122867 - DNA, 33 bp, Homo sapiens; identical to SEQ ID NO: 90858
  misc_feature 1..33: note = chr3:193858603-193858636
  misc_feature 1..33: note = Hyper
  source 1..33: mol_type = genomic DNA

SEQ ID NO: 122868 - DNA, 36 bp, Homo sapiens; identical to SEQ ID NO: 14616
  misc_feature 1..36: note = chr3:193922775-193922811
  misc_feature 1..36: note = Hypo
  source 1..36: mol_type = genomic DNA

SEQ ID NO: 122869 - DNA, 30 bp, Homo sapiens; identical to SEQ ID NO: 90860
  misc_feature 1..30: note = chr3:193943217-193943247
  misc_feature 1..30: note = Hypo
  source 1..30: mol_type = genomic DNA

SEQ ID NO: 122870 - DNA, 30 bp, Homo sapiens; identical to SEQ ID NO: 90861
  misc_feature 1..30: note = chr3:193969848-193969878
  misc_feature 1..30: note = Hypo
  source 1..30: mol_type = genomic DNA

SEQ ID NO: 122871 - DNA, 18 bp, Homo sapiens
  misc_feature 1..18: note = chr3:194041075-194041093
  misc_feature 1..18: note = Hypo
  source 1..18: mol_type = genomic DNA
agcactttgggaggccga

SEQ ID NO: 122872 - DNA, 197 bp, Homo sapiens; identical to SEQ ID NO: 40117
  misc_feature 1..197: note = chr3:194048751-194048948
  misc_feature 1..197: note = Hypo
  source 1..197: mol_type = genomic DNA

SEQ ID NO: 122873 - DNA, 30 bp, Homo sapiens; identical to SEQ ID NO: 40118
  misc_feature 1..30: note = chr3:194128418-194128448
  misc_feature 1..30: note = Hypo
  source 1..30: mol_type = genomic DNA

SEQ ID NO: 122874 - DNA, 514 bp, Homo sapiens
  misc_feature 1..514: note = chr3:194208071-194208585
  misc_feature 1..514: note = Hyper
  source 1..514: mol_type = genomic DNA
cagtgactagacagacgttgcccagagtcatggtcatggaggaagcttgtgctagaatggtggagaggaaaccagagcccagctcctaatgcaaggctctttcattcctttagccaccctcgcccccgccaaaacaaacagacaaaaaactgtcattctcatatgaccacggactctgcgccccggccgcaggcggaggacagggaggagcgcacacgagaaagctcccacgcgcccgcgcctcgcctccgacgggaaggcgcctcttccgaccgtcctggatgcaaattaaatacttccctccgcagaagacttatctcggggtagggccgcagccggatttccaaatcgcgggtttgattttcgctgcgtcctctccgcgacgcgcgcagggagcgcgcccggccacctgcagcctctggctgcggccatctttccgcctggggccacctggcctgcgccctttgtgcccggcccgctccgtgactgttcttcttgccgctacttacagaac

SEQ ID NO: 122875 - DNA, 30 bp, Homo sapiens; identical to SEQ ID NO: 90867
  misc_feature 1..30: note = chr3:194319447-194319477
  misc_feature 1..30: note = Hypo
  source 1..30: mol_type = genomic DNA

SEQ ID NO: 122876 - DNA, 52 bp, Homo sapiens; identical to SEQ ID NO: 90868
  misc_feature 1..52: note = chr3:194374304-194374356
  misc_feature 1..52: note = Hypo
  source 1..52: mol_type = genomic DNA

SEQ ID NO: 122877 - DNA, 401 bp, Homo sapiens; identical to SEQ ID NO: 90869
  misc_feature 1..401: note = chr3:194407435-194407836
  misc_feature 1..401: note = Hyper
  source 1..401: mol_type = genomic DNA

SEQ ID NO: 122878 - DNA, 990 bp, Homo sapiens
  misc_feature 1..990: note = chr3:194408129-194409119
  misc_feature 1..990: note = Hyper
  source 1..990: mol_type = genomic DNA
cggccaacgcgctggcggaatttaaacgcctcaagcggcgggacgacgcgcgtcaccagcagcaggagctggtgggcgcacacaccatcccgctagtgccgctgcgcaagctgctcctacacggaccctgctgctataaaccgccggtggagcgcagccgcagcgcgcccaagcttggctccatcaccgaggacctgctcggcgaacagctggagcaggagctgcaggaggaagaggaagaggagcaacccgagggctgcccggaggaggaggagaaccgtgcggcagagggagatccagcagaggaggaggccgaggcgcagcgtgcgctagtggtcgccatgcactttgagtgcggggacttgttggatactctggagaatggccgtggggaggcgctaggaggcggcgggggctccctgggcccgggggccgggccgccgcctctgctgctgggcagcgcctccgacatgaaggctgagctgtcgcaacttattagcgacctgggcgagctcagcttcggcaacgacgtgcgcaccctgcaggccgacttgcgggtgacgcgcctgctgtcaggcgacagcacgggcagcgagagctccatcgagggcgggggccctgacgccacctccgccaccgccggggactcgtcccgccaggccgacggcgccagtgcagacgagccccactcgggctgagctcctccgcgcgtcgccggcgctccaccgtggctacccatccgtggtcccgacaacctccctgtcccttgcccgcccccaggaagggggaaatggggcatttggggcccagacctacacttggagcccaggtccagcgttcccccgaccgctttcccctacctcccggcccccgctcccgccccagcacttttggctctgttgcgcgtggggatgcggggagatttgagaggggaaaaccccgccaggagggagagagaggcacccctctgggatgcgggtgagggaaggt

SEQ ID NO: 122879 - DNA, 36 bp, Homo sapiens; identical to SEQ ID NO: 90872
  misc_feature 1..36: note = chr3:194827205-194827241
  misc_feature 1..36: note = Hyper
  source 1..36: mol_type = genomic DNA

SEQ ID NO: 122880 - DNA, 40 bp, Homo sapiens; identical to SEQ ID NO: 90873
  misc_feature 1..40: note = chr3:194834954-194834994
  misc_feature 1..40: note = Hypo
  source 1..40: mol_type = genomic DNA

SEQ ID NO: 122881 - DNA, 43 bp, Homo sapiens; identical to SEQ ID NO: 90874
  misc_feature 1..43: note = chr3:195183871-195183914
  misc_feature 1..43: note = Hypo
  source 1..43: mol_type = genomic DNA

SEQ ID NO: 122882 - DNA, 37 bp, Homo sapiens; identical to SEQ ID NO: 90875
  misc_feature 1..37: note = chr3:195274920-195274957
  misc_feature 1..37: note = Hypo
  source 1..37: mol_type = genomic DNA

SEQ ID NO: 122883 - DNA, 172 bp, Homo sapiens; identical to SEQ ID NO: 90876
  misc_feature 1..172: note = chr3:195474886-195475058
  misc_feature 1..172: note = Hyper
  source 1..172: mol_type = genomic DNA

SEQ ID NO: 122884 - DNA, 30 bp, Homo sapiens; identical to SEQ ID NO: 90877
  misc_feature 1..30: note = chr3:195495704-195495734
  misc_feature 1..30: note = Hypo
  source 1..30: mol_type = genomic DNA

SEQ ID NO: 122885 - DNA, 75 bp, Homo sapiens; identical to SEQ ID NO: 90878
  misc_feature 1..75: note = chr3:195536670-195536745
  misc_feature 1..75: note = Hypo
  source 1..75: mol_type = genomic DNA

SEQ ID NO: 122886 - DNA, 24 bp, Homo sapiens
  misc_feature 1..24: note = chr3:195538329-195538353
  misc_feature 1..24: note = Hypo
  source 1..24: mol_type = genomic DNA
caccgcgcacggcctccactcttc

SEQ ID NO: 122887 - DNA, 293 bp, Homo sapiens; identical to SEQ ID NO: 90880
  misc_feature 1..293: note = chr3:195586977-195587270
  misc_feature 1..293: note = Hypo
  source 1..293: mol_type = genomic DNA

SEQ ID NO: 122888 - DNA, 72 bp, Homo sapiens; identical to SEQ ID NO: 40123
  misc_feature 1..72: note = chr3:195597490-195597562
  misc_feature 1..72: note = Hypo
  source 1..72: mol_type = genomic DNA

SEQ ID NO: 122889 - DNA, 154 bp, Homo sapiens; identical to SEQ ID NO: 90882
  misc_feature 1..154: note = chr3:195599686-195599840
  misc_feature 1..154: note = Hypo
  source 1..154: mol_type = genomic DNA

SEQ ID NO: 122890 - DNA, 1277 bp, Homo sapiens; identical to SEQ ID NO: 90883
  misc_feature 1..1277: note = chr3:195600086-195601363
  misc_feature 1..1277: note = Hypo
  source 1..1277: mol_type = genomic DNA

SEQ ID NO: 122891 - DNA, 22 bp, Homo sapiens
  misc_feature 1..22: note = chr3:195602315-195602337
  misc_feature 1..22: note = Hypo
  source 1..22: mol_type = genomic DNA
gcacgctcggaggcacaggaag

SEQ ID NO: 122892 - DNA, 76 bp, Homo sapiens; identical to SEQ ID NO: 90885
  misc_feature 1..76: note = chr3:195603847-195603923
  misc_feature 1..76: note = Hypo
  source 1..76: mol_type = genomic DNA

SEQ ID NO: 122893 - DNA, 126 bp, Homo sapiens; identical to SEQ ID NO: 90886
  misc_feature 1..126: note = chr3:195604262-195604388
  misc_feature 1..126: note = Hypo
  source 1..126: mol_type = genomic DNA

SEQ ID NO: 122894 - DNA, 30 bp, Homo sapiens; identical to SEQ ID NO: 40130
  misc_feature 1..30: note = chr3:195604945-195604975
  misc_feature 1..30: note = Hypo
  source 1..30: mol_type = genomic DNA

SEQ ID NO: 122895 - DNA, 194 bp, Homo sapiens; identical to SEQ ID NO: 90888
  misc_feature 1..194: note = chr3:195637231-195637425
  misc_feature 1..194: note = Hypo
  source 1..194: mol_type = genomic DNA

SEQ ID NO: 122896 - DNA, 30 bp, Homo sapiens; identical to SEQ ID NO: 90889
  misc_feature 1..30: note = chr3:195644193-195644223
  misc_feature 1..30: note = Hypo
  source 1..30: mol_type = genomic DNA

SEQ ID NO: 122897 - DNA, 219 bp, Homo sapiens; identical to SEQ ID NO: 40132
  misc_feature 1..219: note = chr3:195648722-195648941
  misc_feature 1..219: note = Hypo
  source 1..219: mol_type = genomic DNA

SEQ ID NO: 122898 - DNA, 30 bp, Homo sapiens; identical to SEQ ID NO: 90891
  misc_feature 1..30: note = chr3:195730384-195730414
  misc_feature 1..30: note = Hypo
  source 1..30: mol_type = genomic DNA

SEQ ID NO: 122899 - DNA, 136 bp, Homo sapiens; identical to SEQ ID NO: 90892
  misc_feature 1..136: note = chr3:195834926-195835062
  misc_feature 1..136: note = Hypo
  source 1..136: mol_type = genomic DNA

SEQ ID NO: 122900 - DNA, 76 bp, Homo sapiens; identical to SEQ ID NO: 90893
  misc_feature 1..76: note = chr3:195837125-195837201
  misc_feature 1..76: note = Hypo
  source 1..76: mol_type = genomic DNA

SEQ ID NO: 122901 - DNA, 82 bp, Homo sapiens; identical to SEQ ID NO: 90894
  misc_feature 1..82: note = chr3:195874745-195874827
  misc_feature 1..82: note = Hypo
  source 1..82: mol_type = genomic DNA

SEQ ID NO: 122902 - DNA, 167 bp, Homo sapiens; identical to SEQ ID NO: 90895
  misc_feature 1..167: note = chr3:195924532-195924699
  misc_feature 1..167: note = Hypo
  source 1..167: mol_type = genomic DNA

SEQ ID NO: 122903 - DNA, 21 bp, Homo sapiens
  misc_feature 1..21: note = chr3:195926795-195926816
  misc_feature 1..21: note = Hypo
  source 1..21: mol_type = genomic DNA
acagagcgacactctggctca

SEQ ID NO: 122904 - DNA, 41 bp, Homo sapiens; identical to SEQ ID NO: 90897
  misc_feature 1..41: note = chr3:195928204-195928245
  misc_feature 1..41: note = Hypo
  source 1..41: mol_type = genomic DNA

SEQ ID NO: 122905 - DNA, 30 bp, Homo sapiens; identical to SEQ ID NO: 90898
  misc_feature 1..30: note = chr3:195945299-195945329
  misc_feature 1..30: note = Hypo
  source 1..30: mol_type = genomic DNA

SEQ ID NO: 122906 - DNA, 36 bp, Homo sapiens; identical to SEQ ID NO: 40136
  misc_feature 1..36: note = chr3:195993024-195993060
  misc_feature 1..36: note = Hypo
  source 1..36: mol_type = genomic DNA

SEQ ID NO: 122907 - DNA, 81 bp, Homo sapiens; identical to SEQ ID NO: 90900
  misc_feature 1..81: note = chr3:196056108-196056189
  misc_feature 1..81: note = Hypo
  source 1..81: mol_type = genomic DNA

SEQ ID NO: 122908 - DNA, 36 bp, Homo sapiens; identical to SEQ ID NO: 90901
  misc_feature 1..36: note = chr3:196063642-196063678
  misc_feature 1..36: note = Hypo
  source 1..36: mol_type = genomic DNA

SEQ ID NO: 122909 - DNA, 360 bp, Homo sapiens; identical to SEQ ID NO: 90902
  misc_feature 1..360: note = chr3:196069875-196070235
  misc_feature 1..360: note = Hypo
  source 1..360: mol_type = genomic DNA

SEQ ID NO: 122910 - DNA, 30 bp, Homo sapiens; identical to SEQ ID NO: 90903
  misc_feature 1..30: note = chr3:196099492-196099522
  misc_feature 1..30: note = Hypo
  source 1..30: mol_type = genomic DNA

SEQ ID NO: 122911 - DNA, 140 bp, Homo sapiens; identical to SEQ ID NO: 90904
  misc_feature 1..140: note = chr3:196226294-196226434
  misc_feature 1..140: note = Hypo
  source 1..140: mol_type = genomic DNA

SEQ ID NO: 122912 - DNA, 30 bp, Homo sapiens; identical to SEQ ID NO: 90905
  misc_feature 1..30: note = chr3:196251394-196251424
  misc_feature 1..30: note = Hypo
  source 1..30: mol_type = genomic DNA

SEQ ID NO: 122913 - DNA, 278 bp, Homo sapiens
  misc_feature 1..278: note = chr3:196255622-196255900
  misc_feature 1..278: note = Hyper
  source 1..278: mol_type = genomic DNA
gcggtgtcgcgcctccgggccccatccggctcccagcatcttctcccgctgcggaggccgcatttccactcagggcagcgccgccgcggtggttccgccctgtcgggctcagaccggcctgggcgcctccgcggggagctgggcggtggcgggggccgcgggagtggagccggcccgagcctccagggggcgctggcggccgcttcctccatccgcaggcggctcccggccacgcccgtcgctgagcgtgaggcgatggcggccgagctcagaacact

SEQ ID NO: 122914 - DNA, 91 bp, Homo sapiens; identical to SEQ ID NO: 90907
  misc_feature 1..91: note = chr3:196256207-196256298
  misc_feature 1..91: note = Hypo
  source 1..91: mol_type = genomic DNA

SEQ ID NO: 122915 - DNA, 30 bp, Homo sapiens; identical to SEQ ID NO: 14628
  misc_feature 1..30: note = chr3:196294577-196294607
  misc_feature 1..30: note = Hypo
  source 1..30: mol_type = genomic DNA

SEQ ID NO: 122916 - DNA, 39 bp, Homo sapiens; identical to SEQ ID NO: 90909
  misc_feature 1..39: note = chr3:196318724-196318763
  misc_feature 1..39: note = Hypo
  source 1..39: mol_type = genomic DNA

SEQ ID NO: 122917 - DNA, 482 bp, Homo sapiens; identical to SEQ ID NO: 90910
  misc_feature 1..482: note = chr3:196366435-196366917
  misc_feature 1..482: note = Hyper
  source 1..482: mol_type = genomic DNA

SEQ ID NO: 122918 - DNA, 875 bp, Homo sapiens; identical to SEQ ID NO: 90911
  misc_feature 1..875: note = chr3:196386790-196387665
  misc_feature 1..875: note = Hypo
  source 1..875: mol_type = genomic DNA

SEQ ID NO: 122919 - DNA, 440 bp, Homo sapiens; identical to SEQ ID NO: 90912
  misc_feature 1..440: note = chr3:196388333-196388773
  misc_feature 1..440: note = Hypo
  source 1..440: mol_type = genomic DNA

SEQ ID NO: 122920 - DNA, 140 bp, Homo sapiens; identical to SEQ ID NO: 90913
  misc_feature 1..140: note = chr3:196389082-196389222
  misc_feature 1..140: note = Hypo
  source 1..140: mol_type = genomic DNA

SEQ ID NO: 122921 - DNA, 30 bp, Homo sapiens; identical to SEQ ID NO: 90914
  misc_feature 1..30: note = chr3:196401622-196401652
  misc_feature 1..30: note = Hypo
  source 1..30: mol_type = genomic DNA

SEQ ID NO: 122922 - DNA, 41 bp, Homo sapiens; identical to SEQ ID NO: 40146
  misc_feature 1..41: note = chr3:196402166-196402207
  misc_feature 1..41: note = Hypo
  source 1..41: mol_type = genomic DNA

SEQ ID NO: 122923 - DNA, 40 bp, Homo sapiens; identical to SEQ ID NO: 90916
  misc_feature 1..40: note = chr3:196403527-196403567
  misc_feature 1..40: note = Hypo
  source 1..40: mol_type = genomic DNA

SEQ ID NO: 122924 - DNA, 30 bp, Homo sapiens; identical to SEQ ID NO: 90917
  misc_feature 1..30: note = chr3:196406244-196406274
  misc_feature 1..30: note = Hypo
  source 1..30: mol_type = genomic DNA

SEQ ID NO: 122925 - DNA, 26 bp, Homo sapiens
  misc_feature 1..26: note = chr3:196697284-196697310
  misc_feature 1..26: note = Hypo
  source 1..26: mol_type = genomic DNA
accacaggccccgccaccatgcccgg

SEQ ID NO: 122926 - DNA, 75 bp, Homo sapiens; identical to SEQ ID NO: 90919
  misc_feature 1..75: note = chr3:196730975-196731050
  misc_feature 1..75: note = Hypo
  source 1..75: mol_type = genomic DNA

SEQ ID NO: 122927 - DNA, 246 bp, Homo sapiens; identical to SEQ ID NO: 40148
  misc_feature 1..246: note = chr3:196731283-196731529
  misc_feature 1..246: note = Hypo
  source 1..246: mol_type = genomic DNA

SEQ ID NO: 122928 - DNA, 242 bp, Homo sapiens; identical to SEQ ID NO: 90921
  misc_feature 1..242: note = chr3:196754516-196754758
  misc_feature 1..242: note = Hypo
  source 1..242: mol_type = genomic DNA

SEQ ID NO: 122929 - DNA, 65 bp, Homo sapiens; identical to SEQ ID NO: 90922
  misc_feature 1..65: note = chr3:196755979-196756044
  misc_feature 1..65: note = Hyper
  source 1..65: mol_type = genomic DNA

SEQ ID NO: 122930 - DNA, 76 bp, Homo sapiens; identical to SEQ ID NO: 90923
  misc_feature 1..76: note = chr3:196766119-196766195
  misc_feature 1..76: note = Hypo
  source 1..76: mol_type = genomic DNA

SEQ ID NO: 122931 - DNA, 30 bp, Homo sapiens; identical to SEQ ID NO: 40150
  misc_feature 1..30: note = chr3:196784239-196784269
  misc_feature 1..30: note = Hypo
  source 1..30: mol_type = genomic DNA

SEQ ID NO: 122932 - DNA, 17 bp, Homo sapiens
  misc_feature 1..17: note = chr3:196948094-196948111
  misc_feature 1..17: note = Hypo
  source 1..17: mol_type = genomic DNA
aaacataacagggaccg

SEQ ID NO: 122933 - DNA, 173 bp, Homo sapiens; identical to SEQ ID NO: 90926
  misc_feature 1..173: note = chr3:197183173-197183346
  misc_feature 1..173: note = Hyper
  source 1..173: mol_type = genomic DNA

SEQ ID NO: 122934 - DNA, 30 bp, Homo sapiens; identical to SEQ ID NO: 90927
  misc_feature 1..30: note = chr3:197183698-197183728
  misc_feature 1..30: note = Hyper
  source 1..30: mol_type = genomic DNA

SEQ ID NO: 122935 - DNA, 161 bp, Homo sapiens; identical to SEQ ID NO: 90928
  misc_feature 1..161: note = chr3:197186095-197186256
  misc_feature 1..161: note = Hypo
  source 1..161: mol_type = genomic DNA

SEQ ID NO: 122936 - DNA, 34 bp, Homo sapiens; identical to SEQ ID NO: 90929
  misc_feature 1..34: note = chr3:197226091-197226125
  misc_feature 1..34: note = Hypo
  source 1..34: mol_type = genomic DNA

SEQ ID NO: 122937 - DNA, 30 bp, Homo sapiens; identical to SEQ ID NO: 90930
  misc_feature 1..30: note = chr3:197229517-197229547
  misc_feature 1..30: note = Hypo
  source 1..30: mol_type = genomic DNA

SEQ ID NO: 122938 - DNA, 117 bp, Homo sapiens; identical to SEQ ID NO: 90931
  misc_feature 1..117: note = chr3:197246683-197246800
  misc_feature 1..117: note = Hypo
  source 1..117: mol_type = genomic DNA

SEQ ID NO: 122939 - DNA, 25 bp, Homo sapiens
  misc_feature 1..25: note = chr3:197313900-197313925
  misc_feature 1..25: note = Hypo
  source 1..25: mol_type = genomic DNA
tataagaacccaacacggcgaaacc

SEQ ID NO: 122940 - DNA, 300 bp, Homo sapiens; identical to SEQ ID NO: 40152
  misc_feature 1..300: note = chr3:197327024-197327324
  misc_feature 1..300: note = Hypo
  source 1..300: mol_type = genomic DNA

SEQ ID NO: 122941 - DNA, 83 bp, Homo sapiens; identical to SEQ ID NO: 90934
  misc_feature 1..83: note = chr3:197327773-197327856
  misc_feature 1..83: note = Hypo
  source 1..83: mol_type = genomic DNA

SEQ ID NO: 122942 - DNA, 162 bp, Homo sapiens; identical to SEQ ID NO: 90935
  misc_feature 1..162: note = chr3:197402041-197402203
  misc_feature 1..162: note = Hypo
  source 1..162: mol_type = genomic DNA

SEQ ID NO: 122943 - DNA, 30 bp, Homo sapiens; identical to SEQ ID NO: 90936
  misc_feature 1..30: note = chr3:197479155-197479185
  misc_feature 1..30: note = Hypo
  source 1..30: mol_type = genomic DNA

SEQ ID NO: 122944 - DNA, 21 bp, Homo sapiens
  misc_feature 1..21: note = chr3:197601763-197601784
  misc_feature 1..21: note = Hypo
  source 1..21: mol_type = genomic DNA
agctcctggcagactcgagtg

SEQ ID NO: 122945 - DNA, 231 bp, Homo sapiens; identical to SEQ ID NO: 90938
  misc_feature 1..231: note = chr3:197608050-197608281
  misc_feature 1..231: note = Hypo
  source 1..231: mol_type = genomic DNA

SEQ ID NO: 122946 - DNA, 30 bp, Homo sapiens; identical to SEQ ID NO: 90939
  misc_feature 1..30: note = chr3:197616707-197616737
  misc_feature 1..30: note = Hypo
  source 1..30: mol_type = genomic DNA

SEQ ID NO: 122947 - DNA, 29 bp, Homo sapiens
  misc_feature 1..29: note = chr3:197677029-197677058
  misc_feature 1..29: note = Hyper
  source 1..29: mol_type = genomic DNA
atcccacaaggccacgcggcggggcctcg

SEQ ID NO: 122948 - DNA, 87 bp, Homo sapiens; identical to SEQ ID NO: 90940
  misc_feature 1..87: note = chr3:197685732-197685819
  misc_feature 1..87: note = Hypo
  source 1..87: mol_type = genomic DNA

SEQ ID NO: 122949 - DNA, 26 bp, Homo sapiens
  misc_feature 1..26: note = chr3:197686059-197686085
  misc_feature 1..26: note = Hypo
  source 1..26: mol_type = genomic DNA
gagtgaaactccgtctcaaaaaaaaa

SEQ ID NO: 122950 - DNA, 246 bp, Homo sapiens
  misc_feature 1..246: note = chr3:197686977-197687223
  misc_feature 1..246: note = Hyper
  source 1..246: mol_type = genomic DNA
cttctagcgggtgacgctgtccaatcggaaagcgcctttccgccggctgggccctccgtctacccccagcggcgaggggcggggccggcgcgggcgcagaggcgtcacgcactccatggtaacgacgctcggcccgaagatggcggccgaatggggcggaggagtgggttactcgggctcaggcccgggccggagccggtggcgctggagcgggtctgtgtgggtccgaagcgttttactcctgtt

SEQ ID NO: 122951 - DNA, 317 bp, Homo sapiens; identical to SEQ ID NO: 90942
  misc_feature 1..317: note = chr3:197807228-197807545
  misc_feature 1..317: note = Hyper
  source 1..317: mol_type = genomic DNA

SEQ ID NO: 122952 - DNA, 268 bp, Homo sapiens
  misc_feature 1..268: note = chr3:197840370-197840638
  misc_feature 1..268: note = Hyper
  source 1..268: mol_type = genomic DNA
agaggaaaagacagacggcggcggggacattggagaggagaaaagagagggaggaagagaggcgggaaagacagaagaaaggcaggggaggcgcgacggggcgagggacggggaggaaagcggtctcccgcctccagggcgggccgagggctgggcccgcggggcgctcacgtccctccggatcgcccgcctgggtccgctcgccgcggagagagtctcagcagttccgactcccgaggaacgggcgacttcccgaaacacccaaggg

SEQ ID NO: 122953 - DNA, 511 bp, Homo sapiens
  misc_feature 1..511: note = chr4:107304-107815
  misc_feature 1..511: note = Hyper
  source 1..511: mol_type = genomic DNA
gcgttcccagggccccggcgccccggccgggaagagccgcccaggaatcaggcagccgccgggcctcgacctgcgacgaggagccgacccgccgtgtcccgtgagtcgccccgggccctccgcccgcccctccgcgctgggcagggccccagcagttgtcctcctcccgctcccgggctcggcccgggctccatggggctccaggcgggcggcagcggccagcggtcccctgaagggccgagtcctcccttccctcctcctgctcctcccccgcgcggtcgccgagggcgagaccgacttttgccgcaaggtgcaggcggcccgggcggcggcggctcgggaaacgcatggccctggggacgcggcgaggacaggagagcccggctgcgaggtcgggaccctgaggcccaggggcgggtccgcggcgtgcggggccctggcggctcctctgtgctgcgctgggctccgggcgcgcgggatgcgggcagcggcgggacggtccacacgggcg

SEQ ID NO: 122954 - DNA, 1030 bp, Homo sapiens
  misc_feature 1..1030: note = chr4:330301-331331
  misc_feature 1..1030: note = Hyper
  source 1..1030: mol_type = genomic DNA
tgcccgcgcccggagcggatgggcctggcccggctccaccccgcggggctccgcggctcaacgggtcgcccaggggcgcgggcccggcttcgtcctcgacggtgtccgccccggccctggctaggccgacggcagccgggtccgggtggggctcgggctcggggcgcgcccctcccatctctccagggtccgcgtcctcgctgccgccaggtcccgccgagatccccggtggccccggctccagcggctgcagcgtcgccatcgccgggcagaccccggccgacctcaaagcgaccgcgcggtggggccggcggggactggggctgcgcagcgcggcctggggtgggggcggcggggcccccaggagctcctgggaaccgagggtcctggggcggtcccgccccgcacagctccgggtgagcttggggagggagacacactctcagcccacctcgccccgcccgacagcgctccgagtcctgagtcccctcacccccattctacagacacgaaggtgaagccaaagacgggacgctcacttcctgagaatttgctgcctgctgcgtggacaccaccgacctattgtttacagcggtcagggacccgccccccagacccccaggaccgcgcttccgggggaggagggtgtcctcagcaacggtgacccgcaccaaagccctcctcaccggggtcaccgccacagccggtgcgaggcccgcagggcgctggggatgcgcgaccgactcccgtgaacctgctcctcgcgcgtcagggagagctgtgcacccaactaggctctgtgaggacggactgaggtcggcctgcaggctgcggccccgaaggcaggatttgtggagagatgattcgcgagccttggaggaaggatgggctgtgcgtgcgtgggtgcgtgcgtgtgtgtgtgtgtgtgtctgtgacttttgtatgtttatgtgagactgcgtacgtgcgcgcgtctgtgtgtgcgcgcgcgcgtatatgtctgtgtgtgtgcgtgcgtgtataatttcta

SEQ ID NO: 122955 - DNA, 736 bp, Homo sapiens; identical to SEQ ID NO: 92100
  misc_feature 1..736: note = chr4:331562-332298
  misc_feature 1..736: note = Hyper
  source 1..736: mol_type = genomic DNA

SEQ ID NO: 122956 - DNA, 53 bp, Homo sapiens; identical to SEQ ID NO: 92142
  misc_feature 1..53: note = chr4:379992-380045
  misc_feature 1..53: note = Hyper
  source 1..53: mol_type = genomic DNA

SEQ ID NO: 122957 - DNA, 207 bp, Homo sapiens; identical to SEQ ID NO: 92143
  misc_feature 1..207: note = chr4:380356-380563
  misc_feature 1..207: note = Hyper
  source 1..207: mol_type = genomic DNA

SEQ ID NO: 122958 - DNA, 30 bp, Homo sapiens; identical to SEQ ID NO: 92298
  misc_feature 1..30: note = chr4:552737-552767
  misc_feature 1..30: note = Hypo
  source 1..30: mol_type = genomic DNA

SEQ ID NO: 122959 - DNA, 2206 bp, Homo sapiens
  misc_feature 1..2206: note = chr4:568295-570501
  misc_feature 1..2206: note = Hyper
  source 1..2206: mol_type = genomic DNA
gtcgccgtcctggggcgctcgctctgtccccctcgcctcggaccaccaggcagagcagccccagggtttggacttgccaagaaaagtgcagtcgggctagccaagcccaaacatttattgtaaacttgaaaatggaatccagatatgaacgacacaaataagaagagaaacctcccagatacagaaatggtcacatcaggggccccctcctgtggtcacggagcccgcagagggggccaggccggaggctgcaaagccacgtggaagaggcggcgcccctgaggcctggccctggaccccgccccgctgcccgtcctcccttgccgcgggggtcctgagcggggcggggtgggtggaacgcaagcgcggtccgcgggatgggggtccggcccgcgggatcagcaggcccgatgggtctcccagggccgcggcgtctcgcagggcggccggcagcagtaggggtaggaggcgttgaggtcggggtccgagggcgcgtaccccggcagctccaccgacgggtgccccccgcagcgcacctccgcgcccgcctcgtccagcgcgtggaggacgcctacgttgatgtaggagaccgcgtggtgcgccgcgaagcccgcgcagtccccgggggcggccaggtccgactcctccggggacaggatggaggcctcgctcggccgctgctgcagccgccgcccccgccggccccgccggccccggcgcgcccgagaggcgggcggctgcgcgcggagcccggagccgccgcggggccgcgccagggcccggcctcccctccgcctgccgcgccgaccgcgccgggcctgcgacgacttgtagttcttgacgagcaggaggctgagcaggcccagcaggcactcaagcgagttgaagacggtggagagcaccaggccgcgctggtagtccttcagctggcggcacttggcggacgtggcgctgtccagggtgctgcgagcgcgcggggcgccgggggccgagcccggcgccgagccgggggccgagcccggggccgagccgggggttgagcccggggccgagccggggctcgaacctggcgcccgcgggggcaggcagtagtgcgagtacttgcgctccaccagggacacggtgtcgccgtcgatcacggcgcccgcgaatgcgctgaggaccccgagcatgaagaccaggacgccgagcagaagcaggttctggctgctcaccggccccggggccccggccgcggcccccgactcgcccggcgtggcctcgggagcgcctgccggcgccgcggggacccccaaacccgggcccggttccgaccccgcgaggggcgcgtcccggggtccgcagcagagcagggcggcgccgagcagtgagaggccggcggccagcagcagcccggagtagaaggcgccggcggcggcccccaggcggaacggctccccgcgcagctccgagcccaacgagaagcacttgaggccgacggcggcggcgctgagcgcgcaggcgagcaggaggcaggaggagagcgcggcgcaggccccgcggacgctccacttcatcctccgcgcccgagccggcccgcaccccgcgcgcccgccgccgcccgccgccgcccccgccgcctgcgcctcctcccggcgccgcgcggccggaccgccggcctcctcctcatcctcccgcgtcctcccgggcccgcgccgccgccgccggagcccgcatcctccgcctcccgccgccgccgccgccgccgccgccgccgcgaccccgcgccgggaaccgatgcggcgcagagaccgcagggcgcgcgccccctccccagcccgcggggcccctcccaggaggctcgttcccccccaaccccccaccccgcccgcggccccgcgcgcctcgccctggcgccgcccttccccgcccccggcagcccccgccacccccgggacgcccctccgcttcctcctcccggagcgggggcccctggccgcgtctctccgccttccctccctatccgcgcccctatccggcgcgggccgctgcggaaacgcagctctccacccccagctggctctcccggaccccctgggccccaccctcagcgctccccaccgctcggcgcccctgcgtctgcgctcccctctctcccctctctatccactgggtctgggccgcacttcccgcccacccgcctgccagcggccgggaagcctgtgga

SEQ ID NO: 122960 - DNA, 1356 bp, Homo sapiens; identical to SEQ ID NO: 92325
  misc_feature 1..1356: note = chr4:570836-572192
  misc_feature 1..1356: note = Hyper
  source 1..1356: mol_type = genomic DNA

SEQ ID NO: 122961 - DNA, 36 bp, Homo sapiens; identical to SEQ ID NO: 92362
  misc_feature 1..36: note = chr4:617245-617281
  misc_feature 1..36: note = Hypo
  source 1..36: mol_type = genomic DNA

SEQ ID NO: 122962 - DNA, 372 bp, Homo sapiens; identical to SEQ ID NO: 92364
  misc_feature 1..372: note = chr4:619507-619879
  misc_feature 1..372: note = Hypo
  source 1..372: mol_type = genomic DNA

SEQ ID NO: 122963 - DNA, 638 bp, Homo sapiens; identical to SEQ ID NO: 92377
  misc_feature 1..638: note = chr4:628132-628770
  misc_feature 1..638: note = Hypo
  source 1..638: mol_type = genomic DNA

SEQ ID NO: 122964 - DNA, 120 bp, Homo sapiens; identical to SEQ ID NO: 92378
  misc_feature 1..120: note = chr4:628830-628950
  misc_feature 1..120: note = Hypo
  source 1..120: mol_type = genomic DNA

SEQ ID NO: 122965 - DNA, 37 bp, Homo sapiens; identical to SEQ ID NO: 92379
  misc_feature 1..37: note = chr4:629370-629407
  misc_feature 1..37: note = Hypo
  source 1..37: mol_type = genomic DNA

SEQ ID NO: 122966 - DNA, 33 bp, Homo sapiens; identical to SEQ ID NO: 92384
  misc_feature 1..33: note = chr4:650380-650413
  misc_feature 1..33: note = Hypo
  source 1..33: mol_type = genomic DNA

SEQ ID NO: 122967 - DNA, 510 bp, Homo sapiens; identical to SEQ ID NO: 92385
  misc_feature 1..510: note = chr4:650838-651348
  misc_feature 1..510: note = Hypo
  source 1..510: mol_type = genomic DNA

SEQ ID NO: 122968 - DNA, 30 bp, Homo sapiens; identical to SEQ ID NO: 92387
  misc_feature 1..30: note = chr4:652650-652680
  misc_feature 1..30: note = Hypo
  source 1..30: mol_type = genomic DNA

SEQ ID NO: 122969 - DNA, 46 bp, Homo sapiens; identical to SEQ ID NO: 92391
  misc_feature 1..46: note = chr4:657666-657712
  misc_feature 1..46: note = Hyper
  source 1..46: mol_type = genomic DNA

SEQ ID NO: 122970 - DNA, 46 bp, Homo sapiens; identical to SEQ ID NO: 92392
  misc_feature 1..46: note = chr4:658106-658152
  misc_feature 1..46: note = Hyper
  source 1..46: mol_type = genomic DNA

SEQ ID NO: 122971 - DNA, 359 bp, Homo sapiens; identical to SEQ ID NO: 92393
  misc_feature 1..359: note = chr4:660870-661229
  misc_feature 1..359: note = Hypo
  source 1..359: mol_type = genomic DNA

SEQ ID NO: 122972 - DNA, 294 bp, Homo sapiens; identical to SEQ ID NO: 92401
  misc_feature 1..294: note = chr4:671984-672278
  misc_feature 1..294: note = Hypo
  source 1..294: mol_type = genomic DNA

SEQ ID NO: 122973 - DNA, 33 bp, Homo sapiens; identical to SEQ ID NO: 92404
  misc_feature 1..33: note = chr4:676071-676104
  misc_feature 1..33: note = Hypo
  source 1..33: mol_type = genomic DNA

SEQ ID NO: 122974 - DNA, 78 bp, Homo sapiens; identical to SEQ ID NO: 40163
  misc_feature 1..78: note = chr4:676743-676821
  misc_feature 1..78: note = Hypo
  source 1..78: mol_type = genomic DNA

SEQ ID NO: 122975 - DNA, 185 bp, Homo sapiens; identical to SEQ ID NO: 92407
  misc_feature 1..185: note = chr4:678471-678656
  misc_feature 1..185: note = Hypo
  source 1..185: mol_type = genomic DNA

SEQ ID NO: 122976 - DNA, 49 bp, Homo sapiens; identical to SEQ ID NO: 92408
  misc_feature 1..49: note = chr4:679019-679068
  misc_feature 1..49: note = Hypo
  source 1..49: mol_type = genomic DNA

SEQ ID NO: 122977 - DNA, 175 bp, Homo sapiens
  misc_feature 1..175: note = chr4:682771-682946
  misc_feature 1..175: note = Hyper
  source 1..175: mol_type = genomic DNA
ctgcccctaccgtggcgttggagcagttgagcaggctgatcgcgagcaggaacacccagcggcgcgcgtaggtgcggtggccccgctgcgcgcacagggcccggggctcggccaaccccgtctcggcctccgtcggccccgccatcgtcggcggcctccacgggtctccgccggt

SEQ ID NO: 122978 - DNA, 34 bp, Homo sapiens; identical to SEQ ID NO: 92410
  misc_feature 1..34: note = chr4:692476-692510
  misc_feature 1..34: note = Hypo
  source 1..34: mol_type = genomic DNA

SEQ ID NO: 122979 - DNA, 79 bp, Homo sapiens; identical to SEQ ID NO: 92419
  misc_feature 1..79: note = chr4:718161-718240
  misc_feature 1..79: note = Hypo
  source 1..79: mol_type = genomic DNA

SEQ ID NO: 122980 - DNA, 196 bp, Homo sapiens; identical to SEQ ID NO: 92433
  misc_feature 1..196: note = chr4:738289-738485
  misc_feature 1..196: note = Hypo
  source 1..196: mol_type = genomic DNA

SEQ ID NO: 122981 - DNA, 57 bp, Homo sapiens; identical to SEQ ID NO: 92434
  misc_feature 1..57: note = chr4:741730-741787
  misc_feature 1..57: note = Hypo
  source 1..57: mol_type = genomic DNA

SEQ ID NO: 122982 - DNA, 30 bp, Homo sapiens; identical to SEQ ID NO: 92448
  misc_feature 1..30: note = chr4:757296-757326
  misc_feature 1..30: note = Hypo
  source 1..30: mol_type = genomic DNA

SEQ ID NO: 122983 - DNA, 104 bp, Homo sapiens; identical to SEQ ID NO: 92452
  misc_feature 1..104: note = chr4:759737-759841
  misc_feature 1..104: note = Hypo
  source 1..104: mol_type = genomic DNA

SEQ ID NO: 122984 - DNA, 16 bp, Homo sapiens
  misc_feature 1..16: note = chr4:774267-774283
  misc_feature 1..16: note = Hypo
  source 1..16: mol_type = genomic DNA
gcgcccagcctgtgtt

SEQ ID NO: 122985 - DNA, 126 bp, Homo sapiens; identical to SEQ ID NO: 92476
  misc_feature 1..126: note = chr4:779768-779894
  misc_feature 1..126: note = Hyper
  source 1..126: mol_type = genomic DNA

SEQ ID NO: 122986 - DNA, 146 bp, Homo sapiens; identical to SEQ ID NO: 92477
  misc_feature 1..146: note = chr4:780132-780278
  misc_feature 1..146: note = Hyper
  source 1..146: mol_type = genomic DNA

SEQ ID NO: 122987 - DNA, 156 bp, Homo sapiens; identical to SEQ ID NO: 92479
  misc_feature 1..156: note = chr4:786342-786498
  misc_feature 1..156: note = Hyper
  source 1..156: mol_type = genomic DNA

SEQ ID NO: 122988 - DNA, 818 bp, Homo sapiens; identical to SEQ ID NO: 92480
  misc_feature 1..818: note = chr4:788774-789592
  misc_feature 1..818: note = Hyper
  source 1..818: mol_type = genomic DNA

SEQ ID NO: 122989 - DNA, 118 bp, Homo sapiens; identical to SEQ ID NO: 92505
  misc_feature 1..118: note = chr4:819123-819241
  misc_feature 1..118: note = Hyper
  source 1..118: mol_type = genomic DNA

SEQ ID NO: 122990 - DNA, 161 bp, Homo sapiens; identical to SEQ ID NO: 40169
  misc_feature 1..161: note = chr4:828951-829112
  misc_feature 1..161: note = Hypo
  source 1..161: mol_type = genomic DNA

SEQ ID NO: 122991 - DNA, 487 bp, Homo sapiens; identical to SEQ ID NO: 92521
  misc_feature 1..487: note = chr4:829521-830008
  misc_feature 1..487: note = Hypo
  source 1..487: mol_type = genomic DNA

SEQ ID NO: 122992 - DNA, 30 bp, Homo sapiens; identical to SEQ ID NO: 92581
  misc_feature 1..30: note = chr4:870008-870038
  misc_feature 1..30: note = Hypo
  source 1..30: mol_type = genomic DNA

SEQ ID NO: 122993 - DNA, 62 bp, Homo sapiens; identical to SEQ ID NO: 92635
  misc_feature 1..62: note = chr4:905870-905932
  misc_feature 1..62: note = Hypo
  source 1..62: mol_type = genomic DNA

SEQ ID NO: 122994 - DNA, 360 bp, Homo sapiens; identical to SEQ ID NO: 92658
  misc_feature 1..360: note = chr4:955184-955544
  misc_feature 1..360: note = Hypo
  source 1..360: mol_type = genomic DNA

SEQ ID NO: 122995 - DNA, 1199 bp, Homo sapiens; identical to SEQ ID NO: 92659
  misc_feature 1..1199: note = chr4:955851-957050
  misc_feature 1..1199: note = Hypo
  source 1..1199: mol_type = genomic DNA

SEQ ID NO: 122996 - DNA, 30 bp, Homo sapiens; identical to SEQ ID NO: 92663
  misc_feature 1..30: note = chr4:957409-957439
  misc_feature 1..30: note = Hypo
  source 1..30: mol_type = genomic DNA

SEQ ID NO: 122997 - DNA, 186 bp, Homo sapiens
  misc_feature 1..186: note = chr4:967581-967767
  misc_feature 1..186: note = Hyper
  source 1..186: mol_type = genomic DNA
tgggctcggtttgaccgcagccgggccagacttctccggacgccgcacgcgcggcgttgtacctgcggggtcccggcccgcggctgcgcagacaggcgcctcccacgcgagacgcggatgctgtccgaggcccccggccgcgcaggacgcccccggcgaggggcagcgctgcgggcctcccacagt

SEQ ID NO: 122998 - DNA, 30 bp, Homo sapiens; identical to SEQ ID NO: 92679
  misc_feature 1..30: note = chr4:980454-980484
  misc_feature 1..30: note = Hyper
  source 1..30: mol_type = genomic DNA

SEQ ID NO: 122999 - DNA, 117 bp, Homo sapiens; identical to SEQ ID NO: 92681
  misc_feature 1..117: note = chr4:994673-994790
  misc_feature 1..117: note = Hypo
  source 1..117: mol_type = genomic DNA

SEQ ID NO: 123000 - DNA, 1384 bp, Homo sapiens
  misc_feature 1..1384: note = chr4:995855-997239
  misc_feature 1..1384: note = Hyper
  source 1..1384: mol_type = genomic DNA
ccccatttacaacgacgaggcggacccgctggtgggctggtccctgccacagccgtggagggcggacgtgacctacgcggccatggtggtgaaggtgggccggcccaacgccctgcgcgccccccggccaccttcctcccgagacgggacaggcgagcggtggccgcgccacccggtcccagctgccctggacacccgcaggtcatcgcgcagcatcagaacctgctactggccaacaccacctccgccttcccctacgcgctcctgagcaacgacaatgccttcctgagctaccacccgcaccccttcgcgcagcgcacgctcaccgcgcgcttccaggtcaacaacacccgcccgccgcacgtgcagctgttgcgcaagccggtgctcacggccatggggctgctggcgctgctgggtgagccggggccgctggggtgggccggccagggccctccaggctggggagcggctcctgcgaaggccccgctgcggggagcgcacttcctccagccgcgcgcttcccggggtcggcctccgcgtggcggggcctggggactccttcaccaaggggagggggagcgagtggtgggaggcccggccctgggtcggggggcggctgggcaacgaccccacgcggcgacggcccccccccgccccgcagatgaggagcagctctgggccgaagtgtcgcaggccgggaccgtcctggacagcaaccacacggtgggcgtcctggccagcgcccaccgcccccagggcccggccgacgcctggcgcgccgcggtgctgatctacgcgagcgacgacacccgcgcccaccccaaccgcagcgtcgcggtgaccctgcggctgcgcggggtgccccccggcccgggtaagccggggttccagggaggtctctggccccgctggggctctggagggggcggcccggggagccgaggcctgagtgtcaggccccgcaggcctggtctacgtcacgcgctacctggacaacgggctctgcagccccgacggcgagtggcggcgcctgggccggcccgtcttccccacggcagagcagttccggcgcatgcgcgcggctgaggtaggtgggccgcggaggggcgaggggccgggccgggccggggtcccgggggggtggggtccggggcgggggctccgaggcggtgtgggtgggaggtggagcggtgggccgggggcgttcgccctgaggtcgggccgagcgtccccagctcccctggagaaccctgaggaccggccactgcgcccaggacccggtggccgcggcgccccgccccttacccgccggcggccgcctgaccctgcgccccgcgctgcggctgccgtcgcttttgctggtgcacgtgtgtgcgcgccc

SEQ ID NO: 123001 - DNA, 147 bp, Homo sapiens; identical to SEQ ID NO: 91403
  misc_feature 1..147: note = chr4:1008582-1008729
  misc_feature 1..147: note = Hypo
  source 1..147: mol_type = genomic DNA

SEQ ID NO: 123002 - DNA, 359 bp, Homo sapiens
  misc_feature 1..359: note = chr4:1016007-1016366
  misc_feature 1..359: note = Hypo
  source 1..359: mol_type = genomic DNA
gacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggtgtgcaggagggcggacggggacacacctggggcccgagagtcagccagc

SEQ ID NO: 123003 - DNA, 499 bp, Homo sapiens; identical to SEQ ID NO: 91407
  misc_feature 1..499: note = chr4:1016612-1017111
  misc_feature 1..499: note = Hypo
  source 1..499: mol_type = genomic DNA

SEQ ID NO: 123004 - DNA, 30 bp, Homo sapiens; identical to SEQ ID NO: 91409
  misc_feature 1..30: note = chr4:1020713-1020743
  misc_feature 1..30: note = Hypo
  source 1..30: mol_type = genomic DNA

SEQ ID NO: 123005 - DNA, 30 bp, Homo sapiens; identical to SEQ ID NO: 40177
  misc_feature 1..30: note = chr4:1022834-1022864
  misc_feature 1..30: note = Hypo
  source 1..30: mol_type = genomic DNA

SEQ ID NO: 123006 - DNA, 333 bp, Homo sapiens; identical to SEQ ID NO: 91411
  misc_feature 1..333: note = chr4:1024175-1024508
  misc_feature 1..333: note = Hypo
  source 1..333: mol_type = genomic DNA

SEQ ID NO: 123007 - DNA, 471 bp, Homo sapiens; identical to SEQ ID NO: 91412
  misc_feature 1..471: note = chr4:1025819-1026290
  misc_feature 1..471: note = Hypo
  source 1..471: mol_type = genomic DNA

SEQ ID NO: 123008 - DNA, 327 bp, Homo sapiens; identical to SEQ ID NO: 91416
  misc_feature 1..327: note = chr4:1036212-1036539
  misc_feature 1..327: note = Hypo
  source 1..327: mol_type = genomic DNA

SEQ ID NO: 123009 - DNA, 66 bp, Homo sapiens; identical to SEQ ID NO: 91418
  misc_feature 1..66: note = chr4:1036897-1036963
  misc_feature 1..66: note = Hypo
  source 1..66: mol_type = genomic DNA

SEQ ID NO: 123010 - DNA, 30 bp, Homo sapiens; identical to SEQ ID NO: 91434
  misc_feature 1..30: note = chr4:1076633-1076663
  misc_feature 1..30: note = Hypo
  source 1..30: mol_type = genomic DNA

SEQ ID NO: 123011 - DNA, 75 bp, Homo sapiens; identical to SEQ ID NO: 91454
  misc_feature 1..75: note = chr4:1093400-1093475
  misc_feature 1..75: note = Hypo
  source 1..75: mol_type = genomic DNA

SEQ ID NO: 123012 - DNA, 336 bp, Homo sapiens
  misc_feature 1..336: note = chr4:1165347-1165683
  misc_feature 1..336: note = Hyper
  source 1..336: mol_type = genomic DNA
caggaaatccctccccgccgcccgcagggaaccatggcccccagtcacgtcggaccgtgacaccctgtggctgcccctgccgcgacccacctgcgccctccccgtgagcgccccctgcccccaccgcatccccggaaccgcacaccgcaggcgctcggcaaacattctggtgttagagtctcccgacgtcagcacgccccagactgggaagcgccgccgtgcagctgtgcggggggctccggcgccgcagccctcctggtggagcaggaggcgaggagggggctgtacttacccagcagcgaagaccactgcgcaggggggcggaacagggggtac

SEQ ID NO: 123013 - DNA, 369 bp, Homo sapiens; identical to SEQ ID NO: 91528
  misc_feature 1..369: note = chr4:1165990-1166359
  misc_feature 1..369: note = Hyper
  source 1..369: mol_type = genomic DNA

SEQ ID NO: 123014 - DNA, 79 bp, Homo sapiens; identical to SEQ ID NO: 91534
  misc_feature 1..79: note = chr4:1189021-1189100
  misc_feature 1..79: note = Hypo
  source 1..79: mol_type = genomic DNA

SEQ ID NO: 123015 - DNA, 30 bp, Homo sapiens; identical to SEQ ID NO: 91542
  misc_feature 1..30: note = chr4:1200560-1200590
  misc_feature 1..30: note = Hypo
  source 1..30: mol_type = genomic DNA

SEQ ID NO: 123016 - DNA, 30 bp, Homo sapiens; identical to SEQ ID NO: 91543
  misc_feature 1..30: note = chr4:1200921-1200951
  misc_feature 1..30: note = Hypo
  source 1..30: mol_type = genomic DNA

SEQ ID NO: 123017 - DNA, 30 bp, Homo sapiens; identical to SEQ ID NO: 91567
  misc_feature 1..30: note = chr4:1256143-1256173
  misc_feature 1..30: note = Hypo
  source 1..30: mol_type = genomic DNA

SEQ ID NO: 123018 - DNA, 72 bp, Homo sapiens; identical to SEQ ID NO: 91577
  misc_feature 1..72: note = chr4:1282473-1282545
  misc_feature 1..72: note = Hypo
  source 1..72: mol_type = genomic DNA

SEQ ID NO: 123019 - DNA, 30 bp, Homo sapiens; identical to SEQ ID NO: 91584
  misc_feature 1..30: note = chr4:1290639-1290669
  misc_feature 1..30: note = Hypo
  source 1..30: mol_type = genomic DNA

SEQ ID NO: 123020 - DNA, 579 bp, Homo sapiens; identical to SEQ ID NO: 91587
  misc_feature 1..579: note = chr4:1299056-1299635
  misc_feature 1..579: note = Hypo
  source 1..579: mol_type = genomic DNA

SEQ ID NO: 123021 - DNA, 107 bp, Homo sapiens; identical to SEQ ID NO: 91591
  misc_feature 1..107: note = chr4:1331010-1331117
  misc_feature 1..107: note = Hypo
  source 1..107: mol_type = genomic DNA

SEQ ID NO: 123022 - DNA, 163 bp, Homo sapiens; identical to SEQ ID NO: 91592
  misc_feature 1..163: note = chr4:1331733-1331896
  misc_feature 1..163: note = Hypo
  source 1..163: mol_type = genomic DNA

SEQ ID NO: 123023 - DNA, 392 bp, Homo sapiens; identical to SEQ ID NO: 91593
  misc_feature 1..392: note = chr4:1332268-1332660
  misc_feature 1..392: note = Hypo
  source 1..392: mol_type = genomic DNA

SEQ ID NO: 123024 - DNA, 305 bp, Homo sapiens; identical to SEQ ID NO: 91594
  misc_feature 1..305: note = chr4:1332878-1333183
  misc_feature 1..305: note = Hypo
  source 1..305: mol_type = genomic DNA

SEQ ID NO: 123025 - DNA, 322 bp, Homo sapiens; identical to SEQ ID NO: 91595
  misc_feature 1..322: note = chr4:1338490-1338812
  misc_feature 1..322: note = Hypo
  source 1..322: mol_type = genomic DNA

SEQ ID NO: 123026 - DNA, 43 bp, Homo sapiens; identical to SEQ ID NO: 91596
  misc_feature 1..43: note = chr4:1339099-1339142
  misc_feature 1..43: note = Hypo
  source 1..43: mol_type = genomic DNA

SEQ ID NO: 123027 - DNA, 429 bp, Homo sapiens
  misc_feature 1..429: note = chr4:1396406-1396835
  misc_feature 1..429: note = Hyper
  source 1..429: mol_type = genomic DNA
ctcaaggccaacacccgaggagccttggtccccaccggagaggattcacgggtgggcccggccgggcggagggcggcgcgggagcctgggagaagggggcgcggccgcctgcggtttattgattgagtgaagttccgcaaagtgcttcgcagcgggccgagcccgcgggagccacctgcccggccccgacgcgcatggtcatttataaatttaaaactcttccgtagcaaccggttatgtacagagtcaacgactggaatcgtagaaaacagccgggcccggcagcggcctcggaggcggagcggcacggggctcagaggtgcggcgcgtagaaggcgggcgccccgtaggtctgcgagcccagcacgaagggcgagagcaccgccgggctcgacaggaacggcagctgcgcggcgcacaccaggcctc

SEQ ID NO: 123028 - DNA, 626 bp, Homo sapiens
  misc_feature 1..626: note = chr4:1397154-1397780
  misc_feature 1..626: note = Hyper
  source 1..626: mol_type = genomic DNA
ggtgaaggcggtgcgcgctcgccgcggcttcccggacttggagtcggaccccgtgcgcttccgcttgggcttcgccgccgtcgccgtgccctgcggggtggtccccgcgccccccggcgccgctgcacctcccggtgggccctgggcaacgggcgagttctcgcggggtccgggggccgctgcctcgtcgacggtggctccgggggacgcgtcggtctcagccgcgccctggcaacccgacccgcgggccccgaggccgccgccgcctccccgcgcctcctccgcgcctcgcgccgcctccgtctcgggcgcttcgtcctcgtcgtcgtcctcgtcgtcgggaacctcgtccccgctgtccgcgctcgggctgtggccgccgccgccgctgctgtagccgttggtgtcgttggtctcggcctcccctgccttgaaggggtcgccggcgtctgcgggagggagggacaaggacagggcagggcagttaggaccggccggttcccagatcccgccctccgcgcgccccgcttcctcccccagggttccctcccgccccctgctcagcgcctcctgcttcgtcacccgcctcctctctctctccttcgctctgtcgtttccctcccctc

SEQ ID NO: 123029 - DNA, 101 bp, Homo sapiens; identical to SEQ ID NO: 91634
  misc_feature 1..101: note = chr4:1398277-1398378
  misc_feature 1..101: note = Hyper
  source 1..101: mol_type = genomic DNA

SEQ ID NO: 123030 - DNA, 50 bp, Homo sapiens
  misc_feature 1..50: note = chr4:1398676-1398726
  misc_feature 1..50: note = Hyper
  source 1..50: mol_type = genomic DNA
agcaggagtaggatccgcccctagacgaccgcgagcgccgtcccagccct

SEQ ID NO: 123031 - DNA, 189 bp, Homo sapiens; identical to SEQ ID NO: 91636
  misc_feature 1..189: note = chr4:1399065-1399254
  misc_feature 1..189: note = Hyper
  source 1..189: mol_type = genomic DNA

SEQ ID NO: 123032 - DNA, 64 bp, Homo sapiens; identical to SEQ ID NO: 91637
  misc_feature 1..64: note = chr4:1399500-1399564
  misc_feature 1..64: note = Hyper
  source 1..64: mol_type = genomic DNA

SEQ ID NO: 123033 - DNA, 40 bp, Homo sapiens
  misc_feature 1..40: note = chr4:1399990-1400030
  misc_feature 1..40: note = Hyper
  source 1..40: mol_type = genomic DNA
ggtggggcgcaggggcgctgcgggccgggccgctccagcc

SEQ ID NO: 123034 - DNA, 1620 bp, Homo sapiens
  misc_feature 1..1620: note = chr4:1400248-1401868
  misc_feature 1..1620: note = Hyper
  source 1..1620: mol_type = genomic DNA
cggcggctcgggccccgccacctactgggctcccatccctggcggcccccgcacctccacacgaccccgcgcaggcggccgctgctccgctcgctctcggcgccgcgccctgcgcttggccggtgctgccttcgccgccgccttaggcgcccgcggcgcccggtccgcgcatttatggcagccccgccggaggcgcccacgcgcccacacgccgaacacacgtgcgcccgcaggcggccgcggggctccgccgccctcgttagcgcgcgcgcctaattggctgcgaacggtcccgggccgaggaggcggaccccgcacaggacacacggacggagccgccgggcgggacgaacagacacgcagcccggagcccagagcggtccgcaggcggctgtggtggtcagcggcgcgtcgctgcgcctccgctcgtccggaaacggcgcgccagcctccttggctaagggggaggagacagccccggcttttaaataattgcgggatcaatctgcggcggggccgcagcgaccccagggcgcgcgggccagcgagcgccaagagttggctgggacatcccggcgcaggatgcggtgactggcctggcctctcctccgggcccccagcgcgcagggccctgagctccgaaggctcccacagctctggcgcccctcggcagttggggtggggatggggggagaggttctcacgcgcgattctccgagtctccgccgggtctgcagccccctcccgcgcgttccgtgggtctcggtcccgcctctctcacttgctcccgcttggggtctccttttgcgtctccagggtctctcttgctcagggtctgtgcccctccatcccttcccacgcccgcccctttcacgtcgtcaaattagggcccgacctggagtgccagcagaggggcggagccggcggtccccgggccgctcattagaagtggaatcgaaaatgagagactgcttgtccctcttaacccgcccccaaaagggggaccgacaaattgcacacacagcaggcggcctacataaaatcgatcctcttcaagtaaggagaaaatgtgtgtttcttccaaaaagaatacgacaaatgcccccttctccacatctggataaataggaagccccgcggcctgagtctttatttgggtacgttttatctacagcggcggtgtttgcaggacagggccctgcggcccgcggccctcggccctcgaggattgggcctggcgtccggagtcccagtgcgggatcgtggtagctccccggcgggtcgctcctctccctcctcctcctgcccacgcagcgagcagccagacgcaggtggaccctggtgggcgccggcagtgcgagcgcgcgcgcttcttcagggtgtgagcgcgcgggcgcgtgcaccggcgggtgtgcgcgccgccttacactgcggtccccggagcctgttccgcgcgcagggcggtcctttgcaattaccgcgggcaatgatcctttggaagcagaaattaaaagttgggagaaataatggtggaccgatcggctgtaatttgggccaagctcggacacgctgagccccagggagcctggaactggttgggcggggcggggggggggcgca

SEQ ID NO: 123035 - DNA, 216 bp, Homo sapiens; identical to SEQ ID NO: 91646
  misc_feature 1..216: note = chr4:1402196-1402412
  misc_feature 1..216: note = Hyper
  source 1..216: mol_type = genomic DNA

SEQ ID NO: 123036 - DNA, 642 bp, Homo sapiens
  misc_feature 1..642: note = chr4:1403963-1404605
  misc_feature 1..642: note = Hyper
  source 1..642: mol_type = genomic DNA
gtatagtgtttgcctcgtgcgaagtgcactccaccccacacttggccccacagcctcgctgtgcacctccttgcatcggccggacgggggcggggggtgcgggcggaggacggggaaggaggctcctgtgtcccctcttctcgcccctgcacacactcgcgccacggcgacccatgttgatcaccggagtttgggaagtcagaggggagccctctgctttcaggcctgggttccttctctaagatatgcccacttaggggcctgtgactcctccagaatgagtgtaccacactcgggacaccagaagcgagaggggacacaggctctgacctcgagagcacgtcagctctggagacccgcggccccagcctcgtgtgcctccgcacagggcagcttcagcactgcgaacagcgccagcaccgcggacagcgcgctcccacctcgcccccggaggccacgggctcgggccgtgttcagcaccgcggacagcgccagcaactccgagggtctcctggcctccagcccgccgtctctgacctccctgccccgccctcgactccttctcaaactttgggatgccccaggggaggaagagggcggcaggctgtgtgtggagtcttggcacggcgtacattacacagc

SEQ ID NO: 123037 - DNA, 191 bp, Homo sapiens; identical to SEQ ID NO: 91654
  misc_feature 1..191: note = chr4:1407940-1408131
  misc_feature 1..191: note = Hyper
  source 1..191: mol_type = genomic DNA

SEQ ID NO: 123038 - DNA, 38 bp, Homo sapiens; identical to SEQ ID NO: 91655
  misc_feature 1..38: note = chr4:1408475-1408513
  misc_feature 1..38: note = Hyper
  source 1..38: mol_type = genomic DNA

SEQ ID NO: 123039 - DNA, 211 bp, Homo sapiens; identical to SEQ ID NO: 40189
  misc_feature 1..211: note = chr4:1504889-1505100
  misc_feature 1..211: note = Hypo
  source 1..211: mol_type = genomic DNA

SEQ ID NO: 123040 - DNA, 157 bp, Homo sapiens; identical to SEQ ID NO: 91713
  misc_feature 1..157: note = chr4:1512241-1512398
  misc_feature 1..157: note = Hypo
  source 1..157: mol_type = genomic DNA

SEQ ID NO: 123041 - DNA, 224 bp, Homo sapiens; identical to SEQ ID NO: 91714
  misc_feature 1..224: note = chr4:1514843-1515067
  misc_feature 1..224: note = Hyper
  source 1..224: mol_type = genomic DNA

SEQ ID NO: 123042 - DNA, 78 bp, Homo sapiens; identical to SEQ ID NO: 91725
  misc_feature 1..78: note = chr4:1538540-1538618
  misc_feature 1..78: note = Hypo
  source 1..78: mol_type = genomic DNA

SEQ ID NO: 123043 - DNA, 66 bp, Homo sapiens; identical to SEQ ID NO: 91758
  misc_feature 1..66: note = chr4:1555624-1555690
  misc_feature 1..66: note = Hypo
  source 1..66: mol_type = genomic DNA

SEQ ID NO: 123044 - DNA, 110 bp, Homo sapiens; identical to SEQ ID NO: 40191
  misc_feature 1..110: note = chr4:1556398-1556508
  misc_feature 1..110: note = Hypo
  source 1..110: mol_type = genomic DNA

SEQ ID NO: 123045 - DNA, 64 bp, Homo sapiens; identical to SEQ ID NO: 91766
  misc_feature 1..64: note = chr4:1556783-1556847
  misc_feature 1..64: note = Hypo
  source 1..64: mol_type = genomic DNA

SEQ ID NO: 123046 - DNA, 275 bp, Homo sapiens; identical to SEQ ID NO: 91769
  misc_feature 1..275: note = chr4:1561925-1562200
  misc_feature 1..275: note = Hypo
  source 1..275: mol_type = genomic DNA

SEQ ID NO: 123047 - DNA, 30 bp, Homo sapiens; identical to SEQ ID NO: 91772
  misc_feature 1..30: note = chr4:1564339-1564369
  misc_feature 1..30: note = Hypo
  source 1..30: mol_type = genomic DNA

SEQ ID NO: 123048 - DNA, 250 bp, Homo sapiens; identical to SEQ ID NO: 40193
  misc_feature 1..250: note = chr4:1576408-1576658
  misc_feature 1..250: note = Hypo
  source 1..250: mol_type = genomic DNA

SEQ ID NO: 123049 - DNA, 406 bp, Homo sapiens; identical to SEQ ID NO: 91786
  misc_feature 1..406: note = chr4:1577697-1578103
  misc_feature 1..406: note = Hypo
  source 1..406: mol_type = genomic DNA

SEQ ID NO: 123050 - DNA, 104 bp, Homo sapiens; identical to SEQ ID NO: 91788
  misc_feature 1..104: note = chr4:1578710-1578814
  misc_feature 1..104: note = Hypo
  source 1..104: mol_type = genomic DNA

SEQ ID NO: 123051 - DNA, 46 bp, Homo sapiens; identical to SEQ ID NO: 91804
  misc_feature 1..46: note = chr4:1598363-1598409
  misc_feature 1..46: note = Hypo
  source 1..46: mol_type = genomic DNA

SEQ ID NO: 123052 - DNA, 30 bp, Homo sapiens; identical to SEQ ID NO: 91806
  misc_feature 1..30: note = chr4:1603751-1603781
  misc_feature 1..30: note = Hypo
  source 1..30: mol_type = genomic DNA

SEQ ID NO: 123053 - DNA, 179 bp, Homo sapiens; identical to SEQ ID NO: 91807
  misc_feature 1..179: note = chr4:1605588-1605767
  misc_feature 1..179: note = Hypo
  source 1..179: mol_type = genomic DNA

SEQ ID NO: 123054 - DNA, 305 bp, Homo sapiens; identical to SEQ ID NO: 91808
  misc_feature 1..305: note = chr4:1608336-1608641
  misc_feature 1..305: note = Hypo
  source 1..305: mol_type = genomic DNA

SEQ ID NO: 123055 - DNA, 30 bp, Homo sapiens; identical to SEQ ID NO: 91815
  misc_feature 1..30: note = chr4:1614181-1614211
  misc_feature 1..30: note = Hypo
  source 1..30: mol_type = genomic DNA

SEQ ID NO: 123056 - DNA, 560 bp, Homo sapiens; identical to SEQ ID NO: 91816
  misc_feature 1..560: note = chr4:1616533-1617093
  misc_feature 1..560: note = Hypo
  source 1..560: mol_type = genomic DNA

SEQ ID NO: 123057 - DNA, 81 bp, Homo sapiens; identical to SEQ ID NO: 91818
  misc_feature 1..81: note = chr4:1623676-1623757
  misc_feature 1..81: note = Hypo
  source 1..81: mol_type = genomic DNA

SEQ ID NO: 123058 - DNA, 30 bp, Homo sapiens; identical to SEQ ID NO: 91825
  misc_feature 1..30: note = chr4:1649418-1649448
  misc_feature 1..30: note = Hypo
  source 1..30: mol_type = genomic DNA

SEQ ID NO: 123059 - DNA, 136 bp, Homo sapiens; identical to SEQ ID NO: 91830
  misc_feature 1..136: note = chr4:1663439-1663575
  misc_feature 1..136: note = Hypo
  source 1..136: mol_type = genomic DNA

SEQ ID NO: 123060 - DNA, 30 bp, Homo sapiens; identical to SEQ ID NO: 91844
  misc_feature 1..30: note = chr4:1684775-1684805
  misc_feature 1..30: note = Hypo
  source 1..30: mol_type = genomic DNA

SEQ ID NO: 123061 - DNA, 55 bp, Homo sapiens; identical to SEQ ID NO: 91845
  misc_feature 1..55: note = chr4:1686695-1686750
  misc_feature 1..55: note = Hypo
  source 1..55: mol_type = genomic DNA

SEQ ID NO: 123062 - DNA, 399 bp, Homo sapiens; identical to SEQ ID NO: 91846
  misc_feature 1..399: note = chr4:1687080-1687479
  misc_feature 1..399: note = Hypo
  source 1..399: mol_type = genomic DNA

SEQ ID NO: 123063 - DNA, 30 bp, Homo sapiens; identical to SEQ ID NO: 91859
  misc_feature 1..30: note = chr4:1719182-1719212
  misc_feature 1..30: note = Hypo
  source 1..30: mol_type = genomic DNA

SEQ ID NO: 123064 - DNA, 30 bp, Homo sapiens; identical to SEQ ID NO: 91895
  misc_feature 1..30: note = chr4:1752186-1752216
  misc_feature 1..30: note = Hypo
  source 1..30: mol_type = genomic DNA

SEQ ID NO: 123065 - DNA, 30 bp, Homo sapiens; identical to SEQ ID NO: 91896
  misc_feature 1..30: note = chr4:1752494-1752524
  misc_feature 1..30: note = Hypo
  source 1..30: mol_type = genomic DNA

SEQ ID NO: 123066 - DNA, 30 bp, Homo sapiens; identical to SEQ ID NO: 91897
  misc_feature 1..30: note = chr4:1753599-1753629
  misc_feature 1..30: note = Hypo
  source 1..30: mol_type = genomic DNA

SEQ ID NO: 123067 - DNA, 30 bp, Homo sapiens; identical to SEQ ID NO: 91921
  misc_feature 1..30: note = chr4:1788923-1788953
  misc_feature 1..30: note = Hypo
  source 1..30: mol_type = genomic DNA

SEQ ID NO: 123068 - DNA, 75 bp, Homo sapiens; identical to SEQ ID NO: 91922
  misc_feature 1..75: note = chr4:1791269-1791344
  misc_feature 1..75: note = Hypo
  source 1..75: mol_type = genomic DNA

SEQ ID NO: 123069 - DNA, 109 bp, Homo sapiens; identical to SEQ ID NO: 91924
  misc_feature 1..109: note = chr4:1796489-1796598
  misc_feature 1..109: note = Hyper
  source 1..109: mol_type = genomic DNA

SEQ ID NO: 123070 - DNA, 649 bp, Homo sapiens; identical to SEQ ID NO: 91925
  misc_feature 1..649: note = chr4:1803127-1803776
  misc_feature 1..649: note = Hypo
  source 1..649: mol_type = genomic DNA

SEQ ID NO: 123071 - DNA, 155 bp, Homo sapiens; identical to SEQ ID NO: 91926
  misc_feature 1..155: note = chr4:1804729-1804884
  misc_feature 1..155: note = Hypo
  source 1..155: mol_type = genomic DNA

SEQ ID NO: 123072 - DNA, 546 bp, Homo sapiens; identical to SEQ ID NO: 91927
  misc_feature 1..546: note = chr4:1805091-1805637
  misc_feature 1..546: note = Hypo
  source 1..546: mol_type = genomic DNA

SEQ ID NO: 123073 - DNA, 106 bp, Homo sapiens; identical to SEQ ID NO: 91928
  misc_feature 1..106: note = chr4:1805886-1805992
  misc_feature 1..106: note = Hypo
  source 1..106: mol_type = genomic DNA

SEQ ID NO: 123074 - DNA, 436 bp, Homo sapiens; identical to SEQ ID NO: 91929
  misc_feature 1..436: note = chr4:1807256-1807692
  misc_feature 1..436: note = Hypo
  source 1..436: mol_type = genomic DNA

SEQ ID NO: 123075 - DNA, 58 bp, Homo sapiens; identical to SEQ ID NO: 91934
  misc_feature 1..58: note = chr4:1811789-1811847
  misc_feature 1..58: note = Hyper
  source 1..58: mol_type = genomic DNA

SEQ ID NO: 123076 - DNA, 30 bp, Homo sapiens; identical to SEQ ID NO: 91937
  misc_feature 1..30: note = chr4:1827297-1827327
  misc_feature 1..30: note = Hypo
  source 1..30: mol_type = genomic DNA

SEQ ID NO: 123077 - DNA, 365 bp, Homo sapiens
  misc_feature 1..365: note = chr4:1864167-1864532
  misc_feature 1..365: note = Hyper
  source 1..365: mol_type = genomic DNA
gtgggcagcaatggccgcgcgccctgctctgggtggtcccgaccccggggaagtccctgtgcagaacgggggctgcgggggcggcaggaggaagtggggggcgcggcacccaggcctcgctgtcttccctttcccttcgagggacctcgcgctgcaaaatccgaagagcccggctggggcggggtcgcggggtgcgcgggaaccggggcctgggacggggcggggcctagccagggcctccacggaagcgaggccaggactggggagtggggggtgggggggtcgtggctgagtgggtgccctgagggcggtcaaggaccccgcgggcctcttctcctgcctggacactgcgcttgcctggctat

SEQ ID NO: 123078 - DNA, 30 bp, Homo sapiens; identical to SEQ ID NO: 91999
  misc_feature 1..30: note = chr4:1958502-1958532
  misc_feature 1..30: note = Hypo
  source 1..30: mol_type = genomic DNA

SEQ ID NO: 123079 - DNA, 291 bp, Homo sapiens; identical to SEQ ID NO: 92000
  misc_feature 1..291: note = chr4:1960087-1960378
  misc_feature 1..291: note = Hypo
  source 1..291: mol_type = genomic DNA

SEQ ID NO: 123080 - DNA, 30 bp, Homo sapiens; identical to SEQ ID NO: 92001
  misc_feature 1..30: note = chr4:1960796-1960826
  misc_feature 1..30: note = Hypo
  source 1..30: mol_type = genomic DNA

SEQ ID NO: 123081 - DNA, 80 bp, Homo sapiens; identical to SEQ ID NO: 92002
  misc_feature 1..80: note = chr4:1961324-1961404
  misc_feature 1..80: note = Hypo
  source 1..80: mol_type = genomic DNA

SEQ ID NO: 123082 - DNA, 187 bp, Homo sapiens; identical to SEQ ID NO: 92003
  misc_feature 1..187: note = chr4:1976939-1977126
  misc_feature 1..187: note = Hypo
  source 1..187: mol_type = genomic DNA

SEQ ID NO: 123083 - DNA, 100 bp, Homo sapiens; identical to SEQ ID NO: 92004
  misc_feature 1..100: note = chr4:1977425-1977525
  misc_feature 1..100: note = Hypo
  source 1..100: mol_type = genomic DNA

SEQ ID NO: 123084 - DNA, 620 bp, Homo sapiens; identical to SEQ ID NO: 40207
  misc_feature 1..620: note = chr4:1993715-1994335
  misc_feature 1..620: note = Hypo
  source 1..620: mol_type = genomic DNA

SEQ ID NO: 123085 - DNA, 85 bp, Homo sapiens; identical to SEQ ID NO: 92006
  misc_feature 1..85: note = chr4:1994745-1994830
  misc_feature 1..85: note = Hypo
  source 1..85: mol_type = genomic DNA

SEQ ID NO: 123086 - DNA, 98 bp, Homo sapiens; identical to SEQ ID NO: 92007
  misc_feature 1..98: note = chr4:1999785-1999883
  misc_feature 1..98: note = Hypo
  source 1..98: mol_type = genomic DNA

SEQ ID NO: 123087 - DNA, 30 bp, Homo sapiens; identical to SEQ ID NO: 40209
  misc_feature 1..30: note = chr4:2009272-2009302
  misc_feature 1..30: note = Hypo
  source 1..30: mol_type = genomic DNA

SEQ ID NO: 123088 - DNA, 30 bp, Homo sapiens; identical to SEQ ID NO: 92017
  misc_feature 1..30: note = chr4:2038336-2038366
  misc_feature 1..30: note = Hypo
  source 1..30: mol_type = genomic DNA

SEQ ID NO: 123089 - DNA, 615 bp, Homo sapiens
  misc_feature 1..615: note = chr4:2042116-2042731
  misc_feature 1..615: note = Hyper
  source 1..615: mol_type = genomic DNA
gtgggcgcgactgtccgtgggcgctaggggcaggggtgataggagcaggtcgcgagcgggcgcagcgtgggaccgaaggggagaaggacgcctgcggcccggcgcgtccccggaggcacgtcccccccagggctccgcggccccggcaacagcgcggggctacccctctacggctcccgccccactgggggaccgcgacggcctgctcccgggctcttggctccgagtggagaagagcgcggaagtgcgcactagcccgacactcgggagggccgctgcctccccaggcgcctgggacagcggcccgcagcccccacccggcccctcgggccccgcgtgcgtttcagcgcgctgaggatgcagcacacccccgaggtgcgaccgggtccccgaagcccggcgtcggcccaacccggaggaggcagcggcagtcacgggcacgcttccccaacccaccctcccacccactcttagggtcaggacacccgcgtccggccggggcaggggcggctctgaccacgcgagaagcaggtgcgtccgcagtcccagcttgtgccgggaagaccaccggccagaaccccgggggttgggggtagaggtcggctaggctgggga

SEQ ID NO: 123090 - DNA, 105 bp, Homo sapiens; identical to SEQ ID NO: 92021
  misc_feature 1..105: note = chr4:2043082-2043187
  misc_feature 1..105: note = Hyper
  source 1..105: mol_type = genomic DNA

SEQ ID NO: 123091 - DNA, 30 bp, Homo sapiens; identical to SEQ ID NO: 92022
  misc_feature 1..30: note = chr4:2043417-2043447
  misc_feature 1..30: note = Hyper
  source 1..30: mol_type = genomic DNA

SEQ ID NO: 123092 - DNA, 182 bp, Homo sapiens; identical to SEQ ID NO: 92023
  misc_feature 1..182: note = chr4:2048726-2048908
  misc_feature 1..182: note = Hyper
  source 1..182: mol_type = genomic DNA

SEQ ID NO: 123093 - DNA, 558 bp, Homo sapiens
  misc_feature 1..558: note = chr4:2059984-2060542
  misc_feature 1..558: note = Hyper
  source 1..558: mol_type = genomic DNA
gtggaccagttcagccgcccctccccaccccaccagggcgctgcggcctcactcccacgtccacgggcaggcccagcccctcctggccttcaggtgacctcagctgcccggctggccccaactccaccgcacaacgcagactgcgggtccccaggcctggacccctggccccgtcccgcccgcgcatgtcggggaagctctgctccggcagccctcggggtggtgctgggaggtcgcgcagaactgaagggggctaggttcgagaagcgccgaggatggggtctgcgaccgcctccccgcacctgagcttctccgccccagcctgcggcgtctgcaggtcctacaaggcgcagagcccccgctgcacctgcaccgaggccacggggcgcatgcgcggccgcggggggcgggggccgggccgggaggggtcctgcgggccccgcatccccgtgcccactgcggggctcggacaggggggcgccgcgccaggccgcagaccccgcccttccgcgtccccactccggctgcccgtgcggctccggacgaggcttcccgggg

SEQ ID NO: 123094 - DNA, 672 bp, Homo sapiens; identical to SEQ ID NO: 92026
  misc_feature 1..672: note = chr4:2061476-2062148
  misc_feature 1..672: note = Hyper
  source 1..672: mol_type = genomic DNA

SEQ ID NO: 123095 - DNA, 712 bp, Homo sapiens; identical to SEQ ID NO: 92027
  misc_feature 1..712: note = chr4:2065587-2066299
  misc_feature 1..712: note = Hypo
  source 1..712: mol_type = genomic DNA

SEQ ID NO: 123096 - DNA, 91 bp, Homo sapiens; identical to SEQ ID NO: 92028
  misc_feature 1..91: note = chr4:2129361-2129452
  misc_feature 1..91: note = Hypo
  source 1..91: mol_type = genomic DNA

SEQ ID NO: 123097 - DNA, 30 bp, Homo sapiens; identical to SEQ ID NO: 92033
  misc_feature 1..30: note = chr4:2251665-2251695
  misc_feature 1..30: note = Hypo
  source 1..30: mol_type = genomic DNA

SEQ ID NO: 123098 - DNA, 141 bp, Homo sapiens; identical to SEQ ID NO: 40213
  misc_feature 1..141: note = chr4:2278785-2278926
  misc_feature 1..141: note = Hypo
  source 1..141: mol_type = genomic DNA

SEQ ID NO: 123099 - DNA, 332 bp, Homo sapiens; identical to SEQ ID NO: 92037
  misc_feature 1..332: note = chr4:2288990-2289322
  misc_feature 1..332: note = Hypo
  source 1..332: mol_type = genomic DNA

SEQ ID NO: 123100 - DNA, 30 bp, Homo sapiens; identical to SEQ ID NO: 92038
  misc_feature 1..30: note = chr4:2290228-2290258
  misc_feature 1..30: note = Hypo
  source 1..30: mol_type = genomic DNA

SEQ ID NO: 123101 - DNA, 333 bp, Homo sapiens; identical to SEQ ID NO: 40214
  misc_feature 1..333: note = chr4:2305585-2305918
  misc_feature 1..333: note = Hypo
  source 1..333: mol_type = genomic DNA

SEQ ID NO: 123102 - DNA, 107 bp, Homo sapiens; identical to SEQ ID NO: 28710
  misc_feature 1..107: note = chr4:2418673-2418780
  misc_feature 1..107: note = Hyper
  source 1..107: mol_type = genomic DNA

SEQ ID NO: 123103 - DNA, 44 bp, Homo sapiens; identical to SEQ ID NO: 92041
  misc_feature 1..44: note = chr4:2418988-2419032
  misc_feature 1..44: note = Hyper
  source 1..44: mol_type = genomic DNA

SEQ ID NO: 123104 - DNA, 148 bp, Homo sapiens; identical to SEQ ID NO: 92046
  misc_feature 1..148: note = chr4:2459751-2459899
  misc_feature 1..148: note = Hypo
  source 1..148: mol_type = genomic DNA

SEQ ID NO: 123105 - DNA, 30 bp, Homo sapiens; identical to SEQ ID NO: 92047
  misc_feature 1..30: note = chr4:2460473-2460503
  misc_feature 1..30: note = Hypo
  source 1..30: mol_type = genomic DNA

SEQ ID NO: 123106 - DNA, 30 bp, Homo sapiens; identical to SEQ ID NO: 92055
  misc_feature 1..30: note = chr4:2514698-2514728
  misc_feature 1..30: note = Hypo
  source 1..30: mol_type = genomic DNA

SEQ ID NO: 123107 - DNA, 21 bp, Homo sapiens
  misc_feature 1..21: note = chr4:2526051-2526072
  misc_feature 1..21: note = Hypo
  source 1..21: mol_type = genomic DNA
agacttcgtctcaaaaaaaaa

SEQ ID NO: 123108 - DNA, 35 bp, Homo sapiens; identical to SEQ ID NO: 14672
  misc_feature 1..35: note = chr4:2527902-2527937
  misc_feature 1..35: note = Hypo
  source 1..35: mol_type = genomic DNA

SEQ ID NO: 123109 - DNA, 92 bp, Homo sapiens; identical to SEQ ID NO: 92059
  misc_feature 1..92: note = chr4:2540246-2540338
  misc_feature 1..92: note = Hypo
  source 1..92: mol_type = genomic DNA

SEQ ID NO: 123110 - DNA, 30 bp, Homo sapiens; identical to SEQ ID NO: 92066
  misc_feature 1..30: note = chr4:2626134-2626164
  misc_feature 1..30: note = Hypo
  source 1..30: mol_type = genomic DNA

SEQ ID NO: 123111 - DNA, 60 bp, Homo sapiens; identical to SEQ ID NO: 92068
  misc_feature 1..60: note = chr4:2688393-2688453
  misc_feature 1..60: note = Hypo
  source 1..60: mol_type = genomic DNA

SEQ ID NO: 123112 - DNA, 30 bp, Homo sapiens; identical to SEQ ID NO: 92071
  misc_feature 1..30: note = chr4:2746348-2746378
  misc_feature 1..30: note = Hypo
  source 1..30: mol_type = genomic DNA

SEQ ID NO: 123113 - DNA, 30 bp, Homo sapiens; identical to SEQ ID NO: 92072
  misc_feature 1..30: note = chr4:2763047-2763077
  misc_feature 1..30: note = Hypo
  source 1..30: mol_type = genomic DNA

SEQ ID NO: 123114 - DNA, 449 bp, Homo sapiens; identical to SEQ ID NO: 28711
  misc_feature 1..449: note = chr4:2765778-2766227
  misc_feature 1..449: note = Hyper
  source 1..449: mol_type = genomic DNA

SEQ ID NO: 123115 - DNA, 30 bp, Homo sapiens; identical to SEQ ID NO: 92074
  misc_feature 1..30: note = chr4:2915308-2915338
  misc_feature 1..30: note = Hypo
  source 1..30: mol_type = genomic DNA

SEQ ID NO: 123116 - DNA, 114 bp, Homo sapiens; identical to SEQ ID NO: 40217
  misc_feature 1..114: note = chr4:2926282-2926396
  misc_feature 1..114: note = Hypo
  source 1..114: mol_type = genomic DNA

SEQ ID NO: 123117 - DNA, 52 bp, Homo sapiens; identical to SEQ ID NO: 92076
  misc_feature 1..52: note = chr4:2930363-2930415
  misc_feature 1..52: note = Hypo
  source 1..52: mol_type = genomic DNA

SEQ ID NO: 123118 - DNA, 247 bp, Homo sapiens; identical to SEQ ID NO: 92077
  misc_feature 1..247: note = chr4:2932839-2933086
  misc_feature 1..247: note = Hypo
  source 1..247: mol_type = genomic DNA

SEQ ID NO: 123119 - DNA, 48 bp, Homo sapiens; identical to SEQ ID NO: 92078
  misc_feature 1..48: note = chr4:2978950-2978998
  misc_feature 1..48: note = Hypo
  source 1..48: mol_type = genomic DNA

SEQ ID NO: 123120 - DNA, 45 bp, Homo sapiens; identical to SEQ ID NO: 40220
  misc_feature 1..45: note = chr4:2987431-2987476
  misc_feature 1..45: note = Hypo
  source 1..45: mol_type = genomic DNA

SEQ ID NO: 123121 - DNA, 30 bp, Homo sapiens; identical to SEQ ID NO: 92090
  misc_feature 1..30: note = chr4:3177345-3177375
  misc_feature 1..30: note = Hypo
  source 1..30: mol_type = genomic DNA

SEQ ID NO: 123122 - DNA, 54 bp, Homo sapiens; identical to SEQ ID NO: 92091
  misc_feature 1..54: note = chr4:3252743-3252797
  misc_feature 1..54: note = Hypo
  source 1..54: mol_type = genomic DNA

SEQ ID NO: 123123 - DNA, 187 bp, Homo sapiens; identical to SEQ ID NO: 92092
  misc_feature 1..187: note = chr4:3285790-3285977
  misc_feature 1..187: note = Hypo
  source 1..187: mol_type = genomic DNA

SEQ ID NO: 123124 - DNA, 134 bp, Homo sapiens; identical to SEQ ID NO: 92093
  misc_feature 1..134: note = chr4:3286580-3286714
  misc_feature 1..134: note = Hypo
  source 1..134: mol_type = genomic DNA

SEQ ID NO: 123125 - DNA, 167 bp, Homo sapiens; identical to SEQ ID NO: 92094
  misc_feature 1..167: note = chr4:3292632-3292799
  misc_feature 1..167: note = Hypo
  source 1..167: mol_type = genomic DNA

SEQ ID NO: 123126 - DNA, 32 bp, Homo sapiens; identical to SEQ ID NO: 92095
  misc_feature 1..32: note = chr4:3301969-3302001
  misc_feature 1..32: note = Hypo
  source 1..32: mol_type = genomic DNA

SEQ ID NO: 123127 - DNA, 57 bp, Homo sapiens; identical to SEQ ID NO: 92097
  misc_feature 1..57: note = chr4:3310494-3310551
  misc_feature 1..57: note = Hypo
  source 1..57: mol_type = genomic DNA

SEQ ID NO: 123128 - DNA, 144 bp, Homo sapiens; identical to SEQ ID NO: 92098
  misc_feature 1..144: note = chr4:3313229-3313373
  misc_feature 1..144: note = Hypo
  source 1..144: mol_type = genomic DNA

SEQ ID NO: 123129 - DNA, 203 bp, Homo sapiens; identical to SEQ ID NO: 92099
  misc_feature 1..203: note = chr4:3313433-3313636
  misc_feature 1..203: note = Hypo
  source 1..203: mol_type = genomic DNA

SEQ ID NO: 123130 - DNA, 30 bp, Homo sapiens; identical to SEQ ID NO: 92101
  misc_feature 1..30: note = chr4:3417466-3417496
  misc_feature 1..30: note = Hypo
  source 1..30: mol_type = genomic DNA

SEQ ID NO: 123131 - DNA, 44 bp, Homo sapiens; identical to SEQ ID NO: 92102
  misc_feature 1..44: note = chr4:3418235-3418279
  misc_feature 1..44: note = Hypo
  source 1..44: mol_type = genomic DNA

SEQ ID NO: 123132 - DNA, 30 bp, Homo sapiens; identical to SEQ ID NO: 92103
  misc_feature 1..30: note = chr4:3425872-3425902
  misc_feature 1..30: note = Hypo
  source 1..30: mol_type = genomic DNA

SEQ ID NO: 123133 - DNA, 33 bp, Homo sapiens; identical to SEQ ID NO: 92104
  misc_feature 1..33: note = chr4:3441235-3441268
  misc_feature 1..33: note = Hypo
  source 1..33: mol_type = genomic DNA

SEQ ID NO: 123134 - DNA, 336 bp, Homo sapiens; identical to SEQ ID NO: 92105
  misc_feature 1..336: note = chr4:3445886-3446222
  misc_feature 1..336: note = Hypo
  source 1..336: mol_type = genomic DNA

SEQ ID NO: 123135 - DNA, 727 bp, Homo sapiens; identical to SEQ ID NO: 92106
  misc_feature 1..727: note = chr4:3446443-3447170
  misc_feature 1..727: note = Hypo
  source 1..727: mol_type = genomic DNA

SEQ ID NO: 123136 - DNA, 235 bp, Homo sapiens; identical to SEQ ID NO: 92107
  misc_feature 1..235: note = chr4:3447780-3448015
  misc_feature 1..235: note = Hypo
  source 1..235: mol_type = genomic DNA

SEQ ID NO: 123137 - DNA, 30 bp, Homo sapiens; identical to SEQ ID NO: 40229
  misc_feature 1..30: note = chr4:3449723-3449753
  misc_feature 1..30: note = Hypo
  source 1..30: mol_type = genomic DNA

SEQ ID NO: 123138 - DNA, 30 bp, Homo sapiens; identical to SEQ ID NO: 92109
  misc_feature 1..30: note = chr4:3465854-3465884
  misc_feature 1..30: note = Hypo
  source 1..30: mol_type = genomic DNA

SEQ ID NO: 123139 - DNA, 195 bp, Homo sapiens; identical to SEQ ID NO: 92110
  misc_feature 1..195: note = chr4:3467304-3467499
  misc_feature 1..195: note = Hypo
  source 1..195: mol_type = genomic DNA

SEQ ID NO: 123140 - DNA, 326 bp, Homo sapiens; identical to SEQ ID NO: 92111
  misc_feature 1..326: note = chr4:3475077-3475403
  misc_feature 1..326: note = Hypo
  source 1..326: mol_type = genomic DNA

SEQ ID NO: 123141 - DNA, 58 bp, Homo sapiens; identical to SEQ ID NO: 92112
  misc_feature 1..58: note = chr4:3479511-3479569
  misc_feature 1..58: note = Hypo
  source 1..58: mol_type = genomic DNA

SEQ ID NO: 123142 - DNA, 53 bp, Homo sapiens; identical to SEQ ID NO: 92113
  misc_feature 1..53: note = chr4:3534408-3534461
  misc_feature 1..53: note = Hyper
  source 1..53: mol_type = genomic DNA

SEQ ID NO: 123143 - DNA, 17 bp, Homo sapiens
  misc_feature 1..17: note = chr4:3565396-3565413
  misc_feature 1..17: note = Hypo
  source 1..17: mol_type = genomic DNA
caagactgtgacacacg

SEQ ID NO: 123144 - DNA, 133 bp, Homo sapiens; identical to SEQ ID NO: 92116
  misc_feature 1..133: note = chr4:3603530-3603663
  misc_feature 1..133: note = Hypo
  source 1..133: mol_type = genomic DNA

SEQ ID NO: 123145 - DNA, 142 bp, Homo sapiens; identical to SEQ ID NO: 92117
  misc_feature 1..142: note = chr4:3609066-3609208
  misc_feature 1..142: note = Hypo
  source 1..142: mol_type = genomic DNA

SEQ ID NO: 123146 - DNA, 30 bp, Homo sapiens; identical to SEQ ID NO: 92118
  misc_feature 1..30: note = chr4:3616292-3616322
  misc_feature 1..30: note = Hypo
  source 1..30: mol_type = genomic DNA

SEQ ID NO: 123147 - DNA, 30 bp, Homo sapiens; identical to SEQ ID NO: 92123
  misc_feature 1..30: note = chr4:3652102-3652132
  misc_feature 1..30: note = Hypo
  source 1..30: mol_type = genomic DNA

SEQ ID NO: 123148 - DNA, 30 bp, Homo sapiens; identical to SEQ ID NO: 92124
  misc_feature 1..30: note = chr4:3654274-3654304
  misc_feature 1..30: note = Hypo
  source 1..30: mol_type = genomic DNA

SEQ ID NO: 123149 - DNA, 61 bp, Homo sapiens; identical to SEQ ID NO: 92125
  misc_feature 1..61: note = chr4:3664470-3664531
  misc_feature 1..61: note = Hypo
  source 1..61: mol_type = genomic DNA

SEQ ID NO: 123150 - DNA, 77 bp, Homo sapiens; identical to SEQ ID NO: 92126
  misc_feature 1..77: note = chr4:3690825-3690902
  misc_feature 1..77: note = Hypo
  source 1..77: mol_type = genomic DNA

SEQ ID NO: 123151 - DNA, 184 bp, Homo sapiens; identical to SEQ ID NO: 92127
  misc_feature 1..184: note = chr4:3702485-3702669
  misc_feature 1..184: note = Hypo
  source 1..184: mol_type = genomic DNA

SEQ ID NO: 123152 - DNA, 912 bp, Homo sapiens; identical to SEQ ID NO: 92134
  misc_feature 1..912: note = chr4:3767295-3768207
  misc_feature 1..912: note = Hyper
  source 1..912: mol_type = genomic DNA

SEQ ID NO: 123153 - DNA, 804 bp, Homo sapiens
  misc_feature 1..804: note = chr4:3768818-3769622
  misc_feature 1..804: note = Hyper
  source 1..804: mol_type = genomic DNA
gcgcacaccacgccgcgtcaaggccaccatcgtggccgtgtggctcatctcggccgtcatctccttcccgccgctggtctcgctctaccgccagcccgacggcgccgcctacccgcagtgcggcctcaacgacgagacctggtacatcctgtcctcctgcatcggctccttcttcgcgccctgcctcatcatgggcctggtctacgcgcgcatctaccgagtggccaagctgcgcacgcgcacgctcagcgagaagcgcgcccccgtgggccccgacggtgcgtccccgactaccgaaaacgggctgggcgcggcggcaggcgcaggcgagaacgggcactgcgcgcccccgcccgccgacgtggagccggacgagagcagcgcagcggccgagaggcggcggcgccggggcgcgttgcggcggggcgggcggcggcgagcgggcgcggaggggggcgcgggcggtgcggacgggcagggggcggggccgggggcggctgagtcgggggcgctgaccgcctccaggtccccggggcccggtggccgcctgtcgcgcgccagctcgcgctccgtcgagttcttcctgtcgcgccggcgccgggcgcgcagcagcgtgtgccgccgcaaggtggcccaggcgcgcgagaagcgcttcacctttgtgctggctgtggtcatgggcgtgttcgtgctctgctggttccccttcttcttcagctacagcctgtacggcatctgccgcgaggcctgccaggtgcccggcccgctcttcaagttcttcttctggatcggctactgcaacag

SEQ ID NO: 123154 - DNA, 30 bp, Homo sapiens; identical to SEQ ID NO: 40234
  misc_feature 1..30: note = chr4:3782694-3782724
  misc_feature 1..30: note = Hypo
  source 1..30: mol_type = genomic DNA

SEQ ID NO: 123155 - DNA, 270 bp, Homo sapiens; identical to SEQ ID NO: 92139
  misc_feature 1..270: note = chr4:3783050-3783320
  misc_feature 1..270: note = Hypo
  source 1..270: mol_type = genomic DNA

SEQ ID NO: 123156 - DNA, 30 bp, Homo sapiens; identical to SEQ ID NO: 92140
  misc_feature 1..30: note = chr4:3783791-3783821
  misc_feature 1..30: note = Hypo
  source 1..30: mol_type = genomic DNA

SEQ ID NO: 123157 - DNA, 30 bp, Homo sapiens; identical to SEQ ID NO: 92144
  misc_feature 1..30: note = chr4:3864547-3864577
  misc_feature 1..30: note = Hyper
  source 1..30: mol_type = genomic DNA

SEQ ID NO: 123158 - DNA, 771 bp, Homo sapiens; identical to SEQ ID NO: 92146
  misc_feature 1..771: note = chr4:3873077-3873848
  misc_feature 1..771: note = Hyper
  source 1..771: mol_type = genomic DNA

SEQ ID NO: 123159 - DNA, 154 bp, Homo sapiens; identical to SEQ ID NO: 28718
  misc_feature 1..154: note = chr4:3882096-3882250
  misc_feature 1..154: note = Hyper
  source 1..154: mol_type = genomic DNA

SEQ ID NO: 123160 - DNA, 147 bp, Homo sapiens; identical to SEQ ID NO: 92150
  misc_feature 1..147: note = chr4:3925878-3926025
  misc_feature 1..147: note = Hypo
  source 1..147: mol_type = genomic DNA

SEQ ID NO: 123161 - DNA, 551 bp, Homo sapiens
  misc_feature 1..551: note = chr4:4144902-4145453
  misc_feature 1..551: note = Hyper
  source 1..551: mol_type = genomic DNA
gctccggggctggggcgcgtgctaggggcccgcggggtttcagctgtattttcgaacccctgtgcttggccgaggggttcccaaggctccactccgccttggagggggctgcggaagcccggaggtgacacgggctctgggaggggcgtccccaacgtgggggaggggtgacaggggcctttgaagacagcgcgggactaggagggggtgcccccgacctaagtcgtggtaaactgaggccggcgaggagggaggctgagtccggggaccaggcggcccctcgctgctcctcgggccagtcgcccccctgcgcctgttcgtacgggcagggccggcggccgagtccagcgggctcggggccaggccggggtcccgcgggcggcgcctcctcctccgcggcgtccccatactcgccctccgcgtcgctctcgtccgagttgtcctcctccaagtagcggtcaccgcgcaccttgtgctggggccgcgggatgtggggctagcgcggggccatgccccgccgcagcttctgctccatccgcaggtaggagacc

SEQ ID NO: 123162 - DNA, 30 bp, Homo sapiens; identical to SEQ ID NO: 92197
  misc_feature 1..30: note = chr4:4221107-4221137
  misc_feature 1..30: note = Hypo
  source 1..30: mol_type = genomic DNA

SEQ ID NO: 123163 - DNA, 290 bp, Homo sapiens
  misc_feature 1..290: note = chr4:4227985-4228275
  misc_feature 1..290: note = Hyper
  source 1..290: mol_type = genomic DNA
aggaggctcctgcggcgacccaagcttcagagagagagagaggaaaggaagggcagacaggaaagctaggaaagatgcacagagagaccaaggcagaaaaggctgaagggaagacggcagcggtaggaagggcgcagagcagcctcaggatgcagccagcgggcgaggaggcggagacccgctcgcccggcgcctggactcaccgcgcagccagccggcacccgcgtgcgtgtccttgaggcggaagaggcggcggtgcgcggagctgcggcccacgtaccacagcatcc

SEQ ID NO: 123164 - DNA, 56 bp, Homo sapiens; identical to SEQ ID NO: 92200
  misc_feature 1..56: note = chr4:4229330-4229386
  misc_feature 1..56: note = Hyper
  source 1..56: mol_type = genomic DNA

SEQ ID NO: 123165 - DNA, 362 bp, Homo sapiens; identical to SEQ ID NO: 92201
  misc_feature 1..362: note = chr4:4229586-4229948
  misc_feature 1..362: note = Hyper
  source 1..362: mol_type = genomic DNA

SEQ ID NO: 123166 - DNA, 23 bp, Homo sapiens
  misc_feature 1..23: note = chr4:4251225-4251248
  misc_feature 1..23: note = Hypo
  source 1..23: mol_type = genomic DNA
gaaaagagtgccagccgcgcgcg

SEQ ID NO: 123167 - DNA, 30 bp, Homo sapiens; identical to SEQ ID NO: 40236
  misc_feature 1..30: note = chr4:4251746-4251776
  misc_feature 1..30: note = Hypo
  source 1..30: mol_type = genomic DNA

SEQ ID NO: 123168 - DNA, 82 bp, Homo sapiens; identical to SEQ ID NO: 14678
  misc_feature 1..82: note = chr4:4256159-4256241
  misc_feature 1..82: note = Hypo
  source 1..82: mol_type = genomic DNA

SEQ ID NO: 123169 - DNA, 1551 bp, Homo sapiens
  misc_feature 1..1551: note = chr4:4387460-4389011
  misc_feature 1..1551: note = Hyper
  source 1..1551: mol_type = genomic DNA
gtcacctgtcaaagacggctagccctcctggggattttgaaatcagggcacccgcggcaagttcccaggctgtgcctggggctcaaggcggtggctgctcctgtgctctgggcttattcccaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagccggcctcctcccgcgcgggctccactcccatttcggcctcgcccccacaccccatagtctttcatccgtgagtcctgcaggcaggacgggttggaggtctgcaaacaggaccctctctgggaagccgcgacagcggctgagctcggggtttgggggcgcaggtcgggctagaaccaccccccttctctccgcgtccgggcatcgtcccagcggcccctcctctgtgcccaggatgctcgggcggcggctgcagtgggacctccaccttctctgccaaccagagcggaggaacctttccgcctccctccaagcggcgcactgagcgctctttgcctagaacgacttccctcccgctgcctggggcagcctcaccctgggcgcccacaccccagccctgggagagcgctactccgcctcccgcaccaccgaaaacctcctcctcctttacgggccgcgcctcctttacgggccgcgccccctttatacgcggacgcgccctcttttggtcgccccctccccaacccagcactaaggagcaccctgctctggtctccgccaccacccagcgcctcctggacccatccccccaaacccttgaacgtcctcaggacccccaggtgagcgcggcgcgctgcgggcggggaccctctctgcacctccccgcacccctgggggtcgctctgtccctacggtccccgcctcccctttctcctttctaagcgcctcgcgcccaggccgccgcccggggtggcgcagcccgcagccctcccgctccgggcgccctccgccgctccgagaccccctgggggcgcgtcctctcccgctcccctgttccctcccccggctcagggcgggcgcgtggtcccaggggaggctcccgcccagccccgcactcctttgtgcggccgggcgggcgctgcgtcaaggtggaggcgcggccacacgcgcgcacccacccgcgcgcacccagcccccgggagaggcaggaagggaggcggcggcgcgaggaggagggagcggccgtggagcccaatcgttcgctccccttcccgggtccgcgcgcggcgccgcctccgccattgctgcgagcaggagcaggagacgcggagctcggagcgctcagctgacctgccggagccgggcgtgggtgagtgcggccggccgcgcctgggcttgccgaggccagaccttgcccgcccaggagcagtgcccgggggatgcccatctcccggagtacgcgggacggggctgtgaacag

SEQ ID NO: 123170 - DNA, 66 bp, Homo sapiens; identical to SEQ ID NO: 92211
  misc_feature 1..66: note = chr4:4389231-4389297
  misc_feature 1..66: note = Hyper
  source 1..66: mol_type = genomic DNA

SEQ ID NO: 123171 - DNA, 30 bp, Homo sapiens; identical to SEQ ID NO: 92212
  misc_feature 1..30: note = chr4:4389764-4389794
  misc_feature 1..30: note = Hyper
  source 1..30: mol_type = genomic DNA

SEQ ID NO: 123172 - DNA, 448 bp, Homo sapiens; identical to SEQ ID NO: 92213
  misc_feature 1..448: note = chr4:4417485-4417933
  misc_feature 1..448: note = Hypo
  source 1..448: mol_type = genomic DNA

SEQ ID NO: 123173 - DNA, 146 bp, Homo sapiens; identical to SEQ ID NO: 92222
  misc_feature 1..146: note = chr4:4614181-4614327
  misc_feature 1..146: note = Hypo
  source 1..146: mol_type = genomic DNA

SEQ ID NO: 123174 - DNA, 41 bp, Homo sapiens; identical to SEQ ID NO: 92225
  misc_feature 1..41: note = chr4:4675041-4675082
  misc_feature 1..41: note = Hypo
  source 1..41: mol_type = genomic DNA

SEQ ID NO: 123175 - DNA, 37 bp, Homo sapiens; identical to SEQ ID NO: 92233
  misc_feature 1..37: note = chr4:4753216-4753253
  misc_feature 1..37: note = Hypo
  source 1..37: mol_type = genomic DNA

SEQ ID NO: 123176 - DNA, 38 bp, Homo sapiens; identical to SEQ ID NO: 92240
  misc_feature 1..38: note = chr4:4854394-4854432
  misc_feature 1..38: note = Hyper
  source 1..38: mol_type = genomic DNA

SEQ ID NO: 123177 - DNA, 1048 bp, Homo sapiens
  misc_feature 1..1048: note = chr4:4854669-4855717
  misc_feature 1..1048: note = Hyper
  source 1..1048: mol_type = genomic DNA
ctctcctgcctgggccgacccggcgctttactgcttctcacgaaggtgcgccggctgctccagaaatcgcagactgcctccaggaagaacttgctggagtcacagcagcttctcagcgacttgacagcagtgattcagacttcaacttgggcggaggggcgggggaggagaaagagatttccagagaaaacgactgagcggtagggaggggaagagagaccgagccacgcgcctcgagaagcagtgcagagagcggaagagacagaggctgcgagacctacccacagagaccaagagagacgctcggaggggagaccgccttaggcgcagagattcagaggcagacagacaggcagacagaaggatacaggaaaggaatgtcgccgaaaggcagggacaaacctgagtcccagaaaaataagagacaactcccacacaccaggctgtccgcgggccgccttgtcacagaaaggcagctccccagccccgcagagtcccgacagctgcccccgcgaaggtggggcgaggggcggcttttccgggggaaactctctccctggacgcccctcctttccagcctcagctctggcctttctcggcatccccagcttgccttcagtttcactccatatctgggtctctcagaggcctcgggaggtcttccgttctctctgtcgccgtgtccacggaaggagcctccccaaccctctgtggctccgcgcctcttgggccggagcatctctgtcttccggagtctcttgatcattgctcctgcccgtcctcgcccatttcaaagacgaccaacagaggcttagaaaaattggccctccaccctcggctggttacctggctcgtagccctgggtctgttttcttctcagagagacctgagatcctcgacatttcctaaattcatggaaaacctcgacagtgttcaggactcccaaagaaggtggtgggcgggagggggaggagcataagagaaaagtagtgagtacgggcccaaagacccatttcgtggattgggggagggacggggaggctgttcc

SEQ ID NO: 123178 - DNA, 173 bp, Homo sapiens; identical to SEQ ID NO: 92243
  misc_feature 1..173: note = chr4:4858694-4858867
  misc_feature 1..173: note = Hyper
  source 1..173: mol_type = genomic DNA

SEQ ID NO: 123179 - DNA, 179 bp, Homo sapiens
  misc_feature 1..179: note = chr4:4859646-4859825
  misc_feature 1..179: note = Hyper
  source 1..179: mol_type = genomic DNA
gaggccccggtgcaccgcgcgtccagccggcccaactcgagctagaagccccaaccactgcccagtgcctgagttgcagtcttgggtcctttagaaacctggagatgtgcgtaaaattcagatgccggtattcccgaacttccccaggcctcagcatatctcggcggcctgtggacaga

SEQ ID NO: 123180 - DNA, 51 bp, Homo sapiens; identical to SEQ ID NO: 92246
  misc_feature 1..51: note = chr4:4861085-4861136
  misc_feature 1..51: note = Hyper
  source 1..51: mol_type = genomic DNA

SEQ ID NO: 123181 - DNA, 226 bp, Homo sapiens; identical to SEQ ID NO: 28731
  misc_feature 1..226: note = chr4:4861342-4861568
  misc_feature 1..226: note = Hyper
  source 1..226: mol_type = genomic DNA

SEQ ID NO: 123182 - DNA, 1532 bp, Homo sapiens; identical to SEQ ID NO: 92248
  misc_feature 1..1532: note = chr4:4861780-4863312
  misc_feature 1..1532: note = Hyper
  source 1..1532: mol_type = genomic DNA

SEQ ID NO: 123183 - DNA, 185 bp, Homo sapiens; identical to SEQ ID NO: 28735
  misc_feature 1..185: note = chr4:4867591-4867776
  misc_feature 1..185: note = Hyper
  source 1..185: mol_type = genomic DNA

SEQ ID NO: 123184 - DNA, 98 bp, Homo sapiens; identical to SEQ ID NO: 92250
  misc_feature 1..98: note = chr4:4868024-4868122
  misc_feature 1..98: note = Hyper
  source 1..98: mol_type = genomic DNA

SEQ ID NO: 123185 - DNA, 987 bp, Homo sapiens
  misc_feature 1..987: note = chr4:4868537-4869524
  misc_feature 1..987: note = Hyper
  source 1..987: mol_type = genomic DNA
gaggaatgataggggcgtctcaccggccctgcacgctgtgaaagcgttttcgttttgttggggaggagacggaagcctcattttgcaaattcagcttctgaccacgcagtcaagaccaaagcagtccgtggcgtggaagcggggcagaaatgaggttacctggcggcaagggacctggggcgcctcgagctttgagcataggtccgcagggccggggcggttggggaccgggaggctggggtggggctgaagacctcgcgctaagagcgccttactttaaggttagtttctcggatcgctgaacccggggctgaaggaccagattgagcaggaggcccagtgaggacagttactggtgaggcaggggccccgagtgcgaatcctaccgctgcgccctccttagtgacccaaggccgggaggtgagcccagccgggtccaggcctgcgccccgcctagagccctcgggggcgcaataggaagcggcgaggagaggccgcggccgcctttcaactctgcggctggcgccggcctggccgggcccccgaggccgcgcggcctccaaggttccgtcccgccctcccagacgctcagctcgcatcgccccacagtggaacagtcccccggccccgacgccggactccctgggaagcccccgacccccaagtgccaccaccaagtgcccactctccagagcactcccaggcccccactccagacttgcggaatttgttccgctccactcaacagctcccacgcctgccgcgcactccgcccccttcccaggcccagggggaccctgcctccaccccgcctgcctcccccacagcgccctcccgcggccctcagctcacagccagctctcccagcgcctgctcactgtagttccggtgctggacgctggccttggctccctgcgttacaagtagatcctcaagtgcgcacacgcacacgaccaacacacgtcatccacacgacataccaacaca

SEQ ID NO: 123186 - DNA, 189 bp, Homo sapiens; identical to SEQ ID NO: 92255
  misc_feature 1..189: note = chr4:4870045-4870234
  misc_feature 1..189: note = Hyper
  source 1..189: mol_type = genomic DNA

SEQ ID NO: 123187 - DNA, 69 bp, Homo sapiens; identical to SEQ ID NO: 92256
  misc_feature 1..69: note = chr4:4871315-4871384
  misc_feature 1..69: note = Hyper
  source 1..69: mol_type = genomic DNA

SEQ ID NO: 123188 - DNA, 461 bp, Homo sapiens
  misc_feature 1..461: note = chr4:4871754-4872215
  misc_feature 1..461: note = Hyper
  source 1..461: mol_type = genomic DNA
cgcgggttatcccaacgaatcctcactaccaggtgggcacgtgccattgtgacccgtgtcatagactgaagcatagagagttgaatgactcagacaagatcacacagctagtgagagtgaaacagagcttccaactcagacagccggtgccaccatctggcgcccctaaatctcagttccctggtccgcggaatgggaacactttcgggctggtgcagaggaaactatgggtgactccaaaggcagcgcgcggtaagaactccgggtgagaaggggagcgcgcgaggagagcgccaagcgtagcgcggagcatagaggcaggatggtgacctgagcgctctttgctggccggctctgctctccgcagcgccattggaattccttactctccagtcccccgagggtgtgtgtgggtgaggggaggtccctgaggcggaagggatgagcggagtggaagcgga

SEQ ID NO: 123189 - DNA, 34 bp, Homo sapiens; identical to SEQ ID NO: 92259
  misc_feature 1..34: note = chr4:4872457-4872491
  misc_feature 1..34: note = Hyper
  source 1..34: mol_type = genomic DNA

SEQ ID NO: 123190 - DNA, 132 bp, Homo sapiens; identical to SEQ ID NO: 92260
  misc_feature 1..132: note = chr4:4872777-4872909
  misc_feature 1..132: note = Hyper
  source 1..132: mol_type = genomic DNA

SEQ ID NO: 123191 - DNA, 342 bp, Homo sapiens; identical to SEQ ID NO: 92261
  misc_feature 1..342: note = chr4:4873139-4873481
  misc_feature 1..342: note = Hyper
  source 1..342: mol_type = genomic DNA

SEQ ID NO: 123192 - DNA, 121 bp, Homo sapiens; identical to SEQ ID NO: 92265
  misc_feature 1..121: note = chr4:5052435-5052556
  misc_feature 1..121: note = Hyper
  source 1..121: mol_type = genomic DNA

SEQ ID NO: 123193 - DNA, 1260 bp, Homo sapiens; identical to SEQ ID NO: 92266
  misc_feature 1..1260: note = chr4:5052845-5054105
  misc_feature 1..1260: note = Hyper
  source 1..1260: mol_type = genomic DNA

SEQ ID NO: 123194 - DNA, 172 bp, Homo sapiens; identical to SEQ ID NO: 92267
  misc_feature 1..172: note = chr4:5160791-5160963
  misc_feature 1..172: note = Hypo
  source 1..172: mol_type = genomic DNA

SEQ ID NO: 123195 - DNA, 174 bp, Homo sapiens; identical to SEQ ID NO: 92268
  misc_feature 1..174: note = chr4:5171284-5171458
  misc_feature 1..174: note = Hypo
  source 1..174: mol_type = genomic DNA

SEQ ID NO: 123196 - DNA, 30 bp, Homo sapiens; identical to SEQ ID NO: 40240
  misc_feature 1..30: note = chr4:5458789-5458819
  misc_feature 1..30: note = Hypo
  source 1..30: mol_type = genomic DNA

SEQ ID NO: 123197 - DNA, 30 bp, Homo sapiens; identical to SEQ ID NO: 92277
  misc_feature 1..30: note = chr4:5464682-5464712
  misc_feature 1..30: note = Hypo
  source 1..30: mol_type = genomic DNA

SEQ ID NO: 123198 - DNA, 796 bp, Homo sapiens
  misc_feature 1..796: note = chr4:5709732-5710528
  misc_feature 1..796: note = Hyper
  source 1..796: mol_type = genomic DNA
ccctaggtcgaagctcgtaaaatggagagcaggattcgaaccagggtcgctggtgaagtccaagccggcagctgccacaccccgaggaaggtctccagtttccctcgaagctttctggccgtgagcgggatacacctaagggccgcgaagcaccctattcagatcctgccctcccttcctcattctttgcgaaatactaagggtcctccctgccaccgccggtgtagacaaagtcaaaccactacagtcagaccggagcctggggtcgggccctccttacctgcgtgctgctctcgggccccgccccgctccgccccggagggatcctcaggccgggcccagacctaggagccacctggggatcccggggtggctgcgcgccgagggggcgccagcggggacgtgagctggcgccgagacagcctcggccccccagcgccagggccactgccaggagacccccggccagcacccacgtggggcgcccccgggagcccgaggggtccatcgcctgtcgggacccgctacctcaaagcggcgggtgccgccgagtcgctggagcttccggaccccaggcccgccccgccgccgagcatgctcagtgcgagccgccgccgaaagttttctggaacaaacacccgcatctggggcttggcgggccaggaggtgccggacgggcgtgggagggggagagcgagttggcgcggcccaggcgcccggcggccaggcctgggtttgcttgcgcccaaaccgaatcagagcgggtcactcccctgctccccgaggttaccaggac

SEQ ID NO: 123199 - DNA, 443 bp, Homo sapiens
  misc_feature 1..443: note = chr4:5712891-5713334
  misc_feature 1..443: note = Hyper
  source 1..443: mol_type = genomic DNA
gctgaaagttttgagcggtgatccaggctcctccctccggctcggcgaagcagggaaggggagagaagcaggagtcgggagactgcacaggccagaaagtctgcggagcgggccgcgcccctggcccgcccgggctccaagtcccgcgtcgccgccctggcggggacggtgcagcaggcggcgggatgcggcggggcggcagcctgagcgccccggatggcccgcggcggggcggcctgcaagagcgacgcgcggctgctgctggggcgggacgcgctgcggccggcgcccgccctgctggcccccgccgtgctgctgggcgccgcgctcggcctcggcctcggcctttggcttggctgccgcgcgggccgccagcgcacgcgacaccaggtgggtcggccgagcagacagcggcggggcggggagcgcggggcgcgtggctt

SEQ ID NO: 123200 - DNA, 1490 bp, Homo sapiens; identical to SEQ ID NO: 28748
  misc_feature 1..1490: note = chr4:5889116-5890606
  misc_feature 1..1490: note = Hyper
  source 1..1490: mol_type = genomic DNA

SEQ ID NO: 123201 - DNA, 334 bp, Homo sapiens
  misc_feature 1..334: note = chr4:5891895-5892229
  misc_feature 1..334: note = Hyper
  source 1..334: mol_type = genomic DNA
aagtcctaggttccccgtaccagggcgttccctggggtcagtctggagatctgagcagaaagcccctacagcaagggacaagaccacgtgcgtatcagggggaggagcatccgcctgccactggccaaacagatcgctgctcccaagcagatttcgccggtacaaagcgccgcagccgctcagcctccggcagcggcaatccttgcgcctgcgccgcagaaacccctcctgcagcccagggagaagcctggtgggcggggggggaagggccggggcacccgttgcgaagccctggagcggtgaggcccgccccggaacccgagcccactgtaac

SEQ ID NO: 123202 - DNA, 182 bp, Homo sapiens; identical to SEQ ID NO: 92354
  misc_feature 1..182: note = chr4:5892520-5892702
  misc_feature 1..182: note = Hyper
  source 1..182: mol_type = genomic DNA

SEQ ID NO: 123203 - DNA, 317 bp, Homo sapiens; identical to SEQ ID NO: 92355
  misc_feature 1..317: note = chr4:5893437-5893754
  misc_feature 1..317: note = Hyper
  source 1..317: mol_type = genomic DNA

SEQ ID NO: 123204 - DNA, 432 bp, Homo sapiens
  misc_feature 1..432: note = chr4:5893981-5894413
  misc_feature 1..432: note = Hyper
  source 1..432: mol_type = genomic DNA
ccagaggttccttcgcgtttaagcgtccatgcggtagctttagccaacttcccctctcagaacctctctccctttctgtagaagaggagccgggactggacccgggcgatcccttccgagtctcacggaccacgccggccagccccgaccgagtcgccccagctctgggaacctcttgcatgatgaggtgggggaggggccgcgccgtggctctccccagcctggcggccgctgccccaacaccggggcccgggcatggccctcgggcgccccatgccctgggtcctcccggggcccgcccccctcgtctggcccgcgcgcgccccgagggtacctggccattgtcccggccgaggggcaggtcgcggggcgcggggcggcggatgcgcagcgtcggcggccgctcgtcgcgctctccgggagagctgaccg

SEQ ID NO: 123205 - DNA, 494 bp, Homo sapiens
  misc_feature 1..494: note = chr4:5894635-5895129
  misc_feature 1..494: note = Hyper
  source 1..494: mol_type = genomic DNA
gccgcgccaggtacacgggcaggtcgtcctcggtgttccacgcgcgccgccggtccgccatacccgtccaaggccggccacccaccgcgctcccgcctgcccgcccgcggccctgggcaccgccgtgcgccgcgctccgcgcctcggtgcgggcctgcggcggcccgggcgcgactgcggcccagggaggggaggggcggggcgtggcgcgcgccggggcggggccggggcggggcctctgggcggctgcgggctagcggcgcggccagctacaaaggaccaggaggcggggatcgcggctggggcggggagggacggtgacgctcccgagccgcagcgcggagggcgggccgcggcaccgcagtgccctcgccgcaccccccactctccgcccccaggcggagcgcagggcgcgaggagagcgcggggcaggagccgtgtgcgtacactcgcgcgcccacacgctctggaggcacacgcgggttcatacctgc

SEQ ID NO: 123206 - DNA, 30 bp, Homo sapiens; identical to SEQ ID NO: 92358
  misc_feature 1..30: note = chr4:6019884-6019914
  misc_feature 1..30: note = Hypo
  source 1..30: mol_type = genomic DNA

SEQ ID NO: 123207 - DNA, 160 bp, Homo sapiens; identical to SEQ ID NO: 92359
  misc_feature 1..160: note = chr4:6032062-6032222
  misc_feature 1..160: note = Hypo
  source 1..160: mol_type = genomic DNA

SEQ ID NO: 123208 - DNA, 169 bp, Homo sapiens; identical to SEQ ID NO: 92363
  misc_feature 1..169: note = chr4:6176884-6177053
  misc_feature 1..169: note = Hypo
  source 1..169: mol_type = genomic DNA

SEQ ID NO: 123209 - DNA, 30 bp, Homo sapiens; identical to SEQ ID NO: 92365
  misc_feature 1..30: note = chr4:6195587-6195617
  misc_feature 1..30: note = Hypo
  source 1..30: mol_type = genomic DNA

SEQ ID NO: 123210 - DNA, 845 bp, Homo sapiens
  misc_feature 1..845: note = chr4:6200828-6201673
  misc_feature 1..845: note = Hyper
  source 1..845: mol_type = genomic DNA
cagctgaagttagggcgttcgcggagagagcacagcactggcaaaggccaaggacagtgtgcctgcgagtgtgcgcagatggggcgggcggcggaggagggctggcggttagatacagtatcgctggagctcagagagccgggcagaggctggcggagagccgaggctggcccagccttcaggagaccggcgagctggggtgtgtgggagcgggatgcttctaaggcgaaaagaagcgccagcctcgtaagcggcctctatctgggctgcccaggccggatgctcaggagcccacagcaggggggatggagcgaaggaccgaggggctgggaggcgaggccgcagcgcactgacgcaggccagcgaggccgctggccccgacgcagggcgcccggcaaggtgtctggcaccacgagagtcaatccttgcgcgccatctccggaggccagtgcgcccagggcgcgccggcccggcaggagggtgggtgccagcctttcttcccatctctcgagcctcctccccggcgcccacgtgggcggagcagcgcgagggtgtgcgtggcaggggccgcggcggcgtgtgccgtgcgtggggtggggtgcgggctgggcggcctcgccttcgggccccgcgccgccggggcgcggcccccagctccatcttctttgccacctgggcggagatctgggggactgtgacctaccctgcggaagacacggaggggacgggccggccacaccccccgcgccactccggcaggcaccgggtgggtccccctcccgctccttggcttgagggcggaatccggagaagagtggaaataggggtggcgtgaaggagagctg

SEQ ID NO: 123211 - DNA, 779 bp, Homo sapiens; identical to SEQ ID NO: 92368
  misc_feature 1..779: note = chr4:6201879-6202658
  misc_feature 1..779: note = Hyper
  source 1..779: mol_type = genomic DNA

SEQ ID NO: 123212 - DNA, 744 bp, Homo sapiens
  misc_feature 1..744: note = chr4:6223447-6224191
  misc_feature 1..744: note = Hyper
  source 1..744: mol_type = genomic DNA
tctggaaaggactcccggagagcagctgctctgaattttctaatttcgctacactggtgatgtatcatgtattcctgtgtgattcgaaaatgttaaaagtcatataataatgtagaagacgacccttcgcgagcgaggccccccacctctggccactgagggcacttacgtaactgcggggcgggcgcaggcctccactgggtgagcggcaggcgggggcggggctgcccggagcctcggccccgcccacccctctcccccgcccactgtccccgcccagccccgggctgctcggaaaggccggagtccggagcacagcaacgcgcggagcggcccggcccctctggtggtcccgcccacgcgacccgggcgcagcggcgggcgccggacagctgtcccggcgggcgaacgacatgcagcggaactgcgggaggctgcggttcggtggctggacttgcgtcccccacctcctctgtcgcgcgtgccctgctccccagtgagggcgtccctgggatgggatctgggcgcccggcgcagcgcggctgacaacagccgagcggttccggtgcgctggcacgtggctcgggcctgcccccccggcctggccgcctcccggcgcgttccccggtgcaggtgcctggcccgtgccccgccatctccgcccggcgccgcctgtgctgaaggagccacgccccgggctccggagcctgcctctgcaaagtccaggcccgcggcgcgcaggtc

SEQ ID NO: 123213 - DNA, 531 bp, Homo sapiens; identical to SEQ ID NO: 92376
  misc_feature 1..531: note = chr4:6247186-6247717
  misc_feature 1..531: note = Hyper
  source 1..531: mol_type = genomic DNA

SEQ ID NO: 123214 - DNA, 901 bp, Homo sapiens; identical to SEQ ID NO: 92380
  misc_feature 1..901: note = chr4:6472218-6473119
  misc_feature 1..901: note = Hyper
  source 1..901: mol_type = genomic DNA

SEQ ID NO: 123215 - DNA, 30 bp, Homo sapiens; identical to SEQ ID NO: 92381
  misc_feature 1..30: note = chr4:6473457-6473487
  misc_feature 1..30: note = Hyper
  source 1..30: mol_type = genomic DNA

SEQ ID NO: 123216 - DNA, 693 bp, Homo sapiens
  misc_feature 1..693: note = chr4:6473794-6474487
  misc_feature 1..693: note = Hyper
  source 1..693: mol_type = genomic DNA
atcgcgcggtccaaaccttcggagggcattcggtgcgacggcatccccacgccgcggccggccggaggggtctcagacaacacgtacgttaccttcagtcacatagctgtggtcccgcaggaagctgtggttaattttccgcgtgtccgtgtcctcgcccattgaaggccgtgcccggtgctctgggcatgccccgccgccacacaccgatgcaatccgcagaggtcgcgccgggcgcgcgggccatgccgccgcagcctagcaggggcgcgggccgccggggccccgaagggagggcatcgcggcagggggacgggcgggggcggccgggggcgggcgccgcggtcaagcgagcgcgcggtgggcgggcggcggccgcgggttcgggcgggccggggcccaggcgcgcatcccggccggcccgtgcgcgctgcgtccgtgcgcccggcggcggggcctggtgccggtgcgcctggctgcggcgacggcggcgaggggacgcgcgcggcgctgcgctgcgccgaccaagccggggccgagccgggctgcgcgggctggggccgccgccgccgccgctgtcgcaggcccctccctcgcgccgcccgctctccgcccccgcggccctgcaggtggagccggcgcccaagccgaggctgcaccgccgtgctcgggccctcgcggtgggcaccttgg

SEQ ID NO: 123217 - DNA, 83 bp, Homo sapiens; identical to SEQ ID NO: 92386
  misc_feature 1..83: note = chr4:6525252-6525335
  misc_feature 1..83: note = Hypo
  source 1..83: mol_type = genomic DNA

SEQ ID NO: 123218 - DNA, 87 bp, Homo sapiens; identical to SEQ ID NO: 92388
  misc_feature 1..87: note = chr4:6537147-6537234
  misc_feature 1..87: note = Hypo
  source 1..87: mol_type = genomic DNA

SEQ ID NO: 123219 - DNA, 193 bp, Homo sapiens; identical to SEQ ID NO: 92389
  misc_feature 1..193: note = chr4:6540136-6540329
  misc_feature 1..193: note = Hypo
  source 1..193: mol_type = genomic DNA

SEQ ID NO: 123220 - DNA, 614 bp, Homo sapiens; identical to SEQ ID NO: 92390
  misc_feature 1..614: note = chr4:6564642-6565256
  misc_feature 1..614: note = Hyper
  source 1..614: mol_type = genomic DNA

SEQ ID NO: 123221 - DNA, 30 bp, Homo sapiens; identical to SEQ ID NO: 40243
  misc_feature 1..30: note = chr4:6627192-6627222
  misc_feature 1..30: note = Hypo
  source 1..30: mol_type = genomic DNA

SEQ ID NO: 123222 - DNA, 34 bp, Homo sapiens; identical to SEQ ID NO: 92399
  misc_feature 1..34: note = chr4:6660444-6660478
  misc_feature 1..34: note = Hyper
  source 1..34: mol_type = genomic DNA

SEQ ID NO: 123223 - DNA, 93 bp, Homo sapiens; identical to SEQ ID NO: 92400
  misc_feature 1..93: note = chr4:6670121-6670214
  misc_feature 1..93: note = Hypo
  source 1..93: mol_type = genomic DNA

SEQ ID NO: 123224 - DNA, 93 bp, Homo sapiens; identical to SEQ ID NO: 40245
  misc_feature 1..93: note = chr4:6719866-6719959
  misc_feature 1..93: note = Hypo
  source 1..93: mol_type = genomic DNA

SEQ ID NO: 123225 - DNA, 228 bp, Homo sapiens; identical to SEQ ID NO: 92403
  misc_feature 1..228: note = chr4:6748346-6748574
  misc_feature 1..228: note = Hypo
  source 1..228: mol_type = genomic DNA

SEQ ID NO: 123226 - DNA, 30 bp, Homo sapiens; identical to SEQ ID NO: 92406
  misc_feature 1..30: note = chr4:6771794-6771824
  misc_feature 1..30: note = Hypo
  source 1..30: mol_type = genomic DNA

SEQ ID NO: 123227 - DNA, 113 bp, Homo sapiens; identical to SEQ ID NO: 92409
  misc_feature 1..113: note = chr4:6896320-6896433
  misc_feature 1..113: note = Hypo
  source 1..113: mol_type = genomic DNA

SEQ ID NO: 123228 - DNA, 30 bp, Homo sapiens; identical to SEQ ID NO: 92411
  misc_feature 1..30: note = chr4:6946432-6946462
  misc_feature 1..30: note = Hypo
  source 1..30: mol_type = genomic DNA

SEQ ID NO: 123229 - DNA, 74 bp, Homo sapiens; identical to SEQ ID NO: 92412
  misc_feature 1..74: note = chr4:6957571-6957645
  misc_feature 1..74: note = Hypo
  source 1..74: mol_type = genomic DNA

SEQ ID NO: 123230 - DNA, 19 bp, Homo sapiens
  misc_feature 1..19: note = chr4:7035959-7035978
  misc_feature 1..19: note = Hypo
  source 1..19: mol_type = genomic DNA
gagacgcagggaaggatgt

SEQ ID NO: 123231 - DNA, 231 bp, Homo sapiens; identical to SEQ ID NO: 92414
  misc_feature 1..231: note = chr4:7047052-7047283
  misc_feature 1..231: note = Hypo
  source 1..231: mol_type = genomic DNA

SEQ ID NO: 123232 - DNA, 30 bp, Homo sapiens; identical to SEQ ID NO: 92415
  misc_feature 1..30: note = chr4:7084525-7084555
  misc_feature 1..30: note = Hypo
  source 1..30: mol_type = genomic DNA

SEQ ID NO: 123233 - DNA, 34 bp, Homo sapiens; identical to SEQ ID NO: 92416
  misc_feature 1..34: note = chr4:7131141-7131175
  misc_feature 1..34: note = Hypo
  source 1..34: mol_type = genomic DNA

SEQ ID NO: 123234 - DNA, 30 bp, Homo sapiens; identical to SEQ ID NO: 40252
  misc_feature 1..30: note = chr4:7134112-7134142
  misc_feature 1..30: note = Hypo
  source 1..30: mol_type = genomic DNA

SEQ ID NO: 123235 - DNA, 770 bp, Homo sapiens; identical to SEQ ID NO: 92421
  misc_feature 1..770: note = chr4:7194112-7194882
  misc_feature 1..770: note = Hyper
  source 1..770: mol_type = genomic DNA

SEQ ID NO: 123236 - DNA, 362 bp, Homo sapiens
  misc_feature 1..362: note = chr4:7195096-7195458
  misc_feature 1..362: note = Hyper
  source 1..362: mol_type = genomic DNA
atcctgggccacctccgatactcccccactggcctccaggtcttgggttacggaggaggaccccagaaccttcggaagcctgcaggtccttgagggtaccccagctcggcgttacctcccctgcccccagactccaccagctgagcgtcgcgttctgggattttgggctccgggatccttccctccctggtctaccagggactccgcggtggcgcctccgcaggctccgggacttccccggtcagctcgaatcctgttctgggactctgggatttctgggttacccctctccccggggtactctagtgcgacccgcggctgtcttgagctcttgctgccggtcgccccgcctggatgcactg

SEQ ID NO: 123237 - DNA, 30 bp, Homo sapiens; identical to SEQ ID NO: 40253
  misc_feature 1..30: note = chr4:7237615-7237645
  misc_feature 1..30: note = Hypo
  source 1..30: mol_type = genomic DNA

SEQ ID NO: 123238 - DNA, 206 bp, Homo sapiens; identical to SEQ ID NO: 92426
  misc_feature 1..206: note = chr4:7261017-7261223
  misc_feature 1..206: note = Hypo
  source 1..206: mol_type = genomic DNA

SEQ ID NO: 123239 - DNA, 30 bp, Homo sapiens; identical to SEQ ID NO: 92427
  misc_feature 1..30: note = chr4:7282766-7282796
  misc_feature 1..30: note = Hypo
  source 1..30: mol_type = genomic DNA

SEQ ID NO: 123240 - DNA, 35 bp, Homo sapiens; identical to SEQ ID NO: 92428
  misc_feature 1..35: note = chr4:7295601-7295636
  misc_feature 1..35: note = Hypo
  source 1..35: mol_type = genomic DNA

SEQ ID NO: 123241 - DNA, 32 bp, Homo sapiens; identical to SEQ ID NO: 92429
  misc_feature 1..32: note = chr4:7302270-7302302
  misc_feature 1..32: note = Hypo
  source 1..32: mol_type = genomic DNA

SEQ ID NO: 123242 - DNA, 30 bp, Homo sapiens; identical to SEQ ID NO: 92432
  misc_feature 1..30: note = chr4:7376235-7376265
  misc_feature 1..30: note = Hypo
  source 1..30: mol_type = genomic DNA

SEQ ID NO: 123243 - DNA, 146 bp, Homo sapiens; identical to SEQ ID NO: 92438
  misc_feature 1..146: note = chr4:7475389-7475535
  misc_feature 1..146: note = Hypo
  source 1..146: mol_type = genomic DNA

SEQ ID NO: 123244 - DNA, 30 bp, Homo sapiens; identical to SEQ ID NO: 92442
  misc_feature 1..30: note = chr4:7522096-7522126
  misc_feature 1..30: note = Hypo
  source 1..30: mol_type = genomic DNA

SEQ ID NO: 123245 - DNA, 107 bp, Homo sapiens; identical to SEQ ID NO: 92447
  misc_feature 1..107: note = chr4:7542297-7542404
  misc_feature 1..107: note = Hypo
  source 1..107: mol_type = genomic DNA

SEQ ID NO: 123246 - DNA, 30 bp, Homo sapiens; identical to SEQ ID NO: 92453
  misc_feature 1..30: note = chr4:7602064-7602094
  misc_feature 1..30: note = Hypo
  source 1..30: mol_type = genomic DNA

SEQ ID NO: 123247 - DNA, 233 bp, Homo sapiens; identical to SEQ ID NO: 40255
  misc_feature 1..233: note = chr4:7647740-7647973
  misc_feature 1..233: note = Hypo
  source 1..233: mol_type = genomic DNA

SEQ ID NO: 123248 - DNA, 75 bp, Homo sapiens; identical to SEQ ID NO: 92458
  misc_feature 1..75: note = chr4:7679887-7679962
  misc_feature 1..75: note = Hypo
  source 1..75: mol_type = genomic DNA

SEQ ID NO: 123249 - DNA, 413 bp, Homo sapiens; identical to SEQ ID NO: 92466
  misc_feature 1..413: note = chr4:7741281-7741694
  misc_feature 1..413: note = Hypo
  source 1..413: mol_type = genomic DNA

SEQ ID NO: 123250 - DNA, 155 bp, Homo sapiens; identical to SEQ ID NO: 92467
  misc_feature 1..155: note = chr4:7742306-7742461
  misc_feature 1..155: note = Hypo
  source 1..155: mol_type = genomic DNA

SEQ ID NO: 123251 - DNA, 30 bp, Homo sapiens; identical to SEQ ID NO: 92470
  misc_feature 1..30: note = chr4:7758476-7758506
  misc_feature 1..30: note = Hypo
  source 1..30: mol_type = genomic DNA

SEQ ID NO: 123252 - DNA, 30 bp, Homo sapiens; identical to SEQ ID NO: 92481
  misc_feature 1..30: note = chr4:7941161-7941191
  misc_feature 1..30: note = Hyper
  source 1..30: mol_type = genomic DNA

SEQ ID NO: 123253 - DNA, 75 bp, Homo sapiens; identical to SEQ ID NO: 92482
  misc_feature 1..75: note = chr4:7941713-7941788
  misc_feature 1..75: note = Hyper
  source 1..75: mol_type = genomic DNA

SEQ ID NO: 123254 - DNA, 20 bp, Homo sapiens
  misc_feature 1..20: note = chr4:7960311-7960331
  misc_feature 1..20: note = Hypo
  source 1..20: mol_type = genomic DNA
cctacaggccaggcacggtg

SEQ ID NO: 123255 - DNA, 143 bp, Homo sapiens; identical to SEQ ID NO: 92486
  misc_feature 1..143: note = chr4:7968382-7968525
  misc_feature 1..143: note = Hypo
  source 1..143: mol_type = genomic DNA

SEQ ID NO: 123256 - DNA, 110 bp, Homo sapiens; identical to SEQ ID NO: 92490
  misc_feature 1..110: note = chr4:8039486-8039596
  misc_feature 1..110: note = Hypo
  source 1..110: mol_type = genomic DNA

SEQ ID NO: 123257 - DNA, 76 bp, Homo sapiens; identical to SEQ ID NO: 92503
  misc_feature 1..76: note = chr4:8128936-8129012
  misc_feature 1..76: note = Hypo
  source 1..76: mol_type = genomic DNA

SEQ ID NO: 123258 - DNA, 338 bp, Homo sapiens; identical to SEQ ID NO: 92510
  misc_feature 1..338: note = chr4:8201112-8201450
  misc_feature 1..338: note = Hyper
  source 1..338: mol_type = genomic DNA

SEQ ID NO: 123259 - DNA, 183 bp, Homo sapiens; identical to SEQ ID NO: 92516
  misc_feature 1..183: note = chr4:8240141-8240324
  misc_feature 1..183: note = Hypo
  source 1..183: mol_type = genomic DNA

SEQ ID NO: 123260 - DNA, 32 bp, Homo sapiens; identical to SEQ ID NO: 40261
  misc_feature 1..32: note = chr4:8252769-8252801
  misc_feature 1..32: note = Hypo
  source 1..32: mol_type = genomic DNA

SEQ ID NO: 123261 - DNA, 828 bp, Homo sapiens; identical to SEQ ID NO: 92518
  misc_feature 1..828: note = chr4:8271325-8272153
  misc_feature 1..828: note = Hyper
  source 1..828: mol_type = genomic DNA

SEQ ID NO: 123262 - DNA, 66 bp, Homo sapiens; identical to SEQ ID NO: 92520
  misc_feature 1..66: note = chr4:8293769-8293835
  misc_feature 1..66: note = Hypo
  source 1..66: mol_type = genomic DNA

SEQ ID NO: 123263 - DNA, 105 bp, Homo sapiens; identical to SEQ ID NO: 40262
  misc_feature 1..105: note = chr4:8327019-8327124
  misc_feature 1..105: note = Hypo
  source 1..105: mol_type = genomic DNA

SEQ ID NO: 123264 - DNA, 30 bp, Homo sapiens; identical to SEQ ID NO: 40263
  misc_feature 1..30: note = chr4:8378202-8378232
  misc_feature 1..30: note = Hypo
  source 1..30: mol_type = genomic DNA

SEQ ID NO: 123265 - DNA, 171 bp, Homo sapiens; identical to SEQ ID NO: 92532
  misc_feature 1..171: note = chr4:8386144-8386315
  misc_feature 1..171: note = Hypo
  source 1..171: mol_type = genomic DNA

SEQ ID NO: 123266 - DNA, 97 bp, Homo sapiens; identical to SEQ ID NO: 92536
  misc_feature 1..97: note = chr4:8483866-8483963
  misc_feature 1..97: note = Hypo
  source 1..97: mol_type = genomic DNA

SEQ ID NO: 123267 - DNA, 113 bp, Homo sapiens; identical to SEQ ID NO: 92562
  misc_feature 1..113: note = chr4:8582115-8582228
  misc_feature 1..113: note = Hyper
  source 1..113: mol_type = genomic DNA

SEQ ID NO: 123268 - DNA, 30 bp, Homo sapiens; identical to SEQ ID NO: 92563
  misc_feature 1..30: note = chr4:8582549-8582579
  misc_feature 1..30: note = Hyper
  source 1..30: mol_type = genomic DNA

SEQ ID NO: 123269 - DNA, 30 bp, Homo sapiens; identical to SEQ ID NO: 92567
  misc_feature 1..30: note = chr4:8588860-8588890
  misc_feature 1..30: note = Hypo
  source 1..30: mol_type = genomic DNA

SEQ ID NO: 123270 - DNA, 62 bp, Homo sapiens; identical to SEQ ID NO: 92568
  misc_feature 1..62: note = chr4:8594397-8594459
  misc_feature 1..62: note = Hyper
  source 1..62: mol_type = genomic DNA

SEQ ID NO: 123271 - DNA, 30 bp, Homo sapiens; identical to SEQ ID NO: 92569
  misc_feature 1..30: note = chr4:8603223-8603253
  misc_feature 1..30: note = Hypo
  source 1..30: mol_type = genomic DNA

SEQ ID NO: 123272 - DNA, 258 bp, Homo sapiens; identical to SEQ ID NO: 92570
  misc_feature 1..258: note = chr4:8607707-8607965
  misc_feature 1..258: note = Hypo
  source 1..258: mol_type = genomic DNA

SEQ ID NO: 123273 - DNA, 30 bp, Homo sapiens; identical to SEQ ID NO: 92571
  misc_feature 1..30: note = chr4:8608178-8608208
  misc_feature 1..30: note = Hypo
  source 1..30: mol_type = genomic DNA

SEQ ID NO: 123274 - DNA, 143 bp, Homo sapiens; identical to SEQ ID NO: 92572
  misc_feature 1..143: note = chr4:8608508-8608651
  misc_feature 1..143: note = Hypo
  source 1..143: mol_type = genomic DNA

SEQ ID NO: 123275 - DNA, 106 bp, Homo sapiens; identical to SEQ ID NO: 92573
  misc_feature 1..106: note = chr4:8615814-8615920
  misc_feature 1..106: note = Hypo
  source 1..106: mol_type = genomic DNA

SEQ ID NO: 123276 - DNA, 30 bp, Homo sapiens; identical to SEQ ID NO: 92574
  misc_feature 1..30: note = chr4:8620407-8620437
  misc_feature 1..30: note = Hypo
  source 1..30: mol_type = genomic DNA

SEQ ID NO: 123277 - DNA, 30 bp, Homo sapiens; identical to SEQ ID NO: 92575
  misc_feature 1..30: note = chr4:8620650-8620680
  misc_feature 1..30: note = Hypo
  source 1..30: mol_type = genomic DNA

SEQ ID NO: 123278 - DNA, 30 bp, Homo sapiens; identical to SEQ ID NO: 92576
  misc_feature 1..30: note = chr4:8647534-8647564
  misc_feature 1..30: note = Hypo
  source 1..30: mol_type = genomic DNA

SEQ ID NO: 123279 - DNA, 30 bp, Homo sapiens; identical to SEQ ID NO: 92577
  misc_feature 1..30: note = chr4:8648137-8648167
  misc_feature 1..30: note = Hypo
  source 1..30: mol_type = genomic DNA

SEQ ID NO: 123280 - DNA, 46 bp, Homo sapiens; identical to SEQ ID NO: 92578
  misc_feature 1..46: note = chr4:8648553-8648599
  misc_feature 1..46: note = Hypo
  source 1..46: mol_type = genomic DNA

SEQ ID NO: 123281 - DNA, 203 bp, Homo sapiens; identical to SEQ ID NO: 92579
  misc_feature 1..203: note = chr4:8689984-8690187
  misc_feature 1..203: note = Hyper
  source 1..203: mol_type = genomic DNA

SEQ ID NO: 123282 - DNA, 36 bp, Homo sapiens; identical to SEQ ID NO: 92582
  misc_feature 1..36: note = chr4:8700182-8700218
  misc_feature 1..36: note = Hypo
  source 1..36: mol_type = genomic DNA

SEQ ID NO: 123283 - DNA, 36 bp, Homo sapiens; identical to SEQ ID NO: 92585
  misc_feature 1..36: note = chr4:8774988-8775024
  misc_feature 1..36: note = Hypo
  source 1..36: mol_type = genomic DNA

SEQ ID NO: 123284 - DNA, 30 bp, Homo sapiens; identical to SEQ ID NO: 92586
  misc_feature 1..30: note = chr4:8778539-8778569
  misc_feature 1..30: note = Hypo
  source 1..30: mol_type = genomic DNA

SEQ ID NO: 123285 - DNA, 38 bp, Homo sapiens; identical to SEQ ID NO: 92590
  misc_feature 1..38: note = chr4:8793763-8793801
  misc_feature 1..38: note = Hypo
  source 1..38: mol_type = genomic DNA

SEQ ID NO: 123286 - DNA, 41 bp, Homo sapiens; identical to SEQ ID NO: 92593
  misc_feature 1..41: note = chr4:8822099-8822140
  misc_feature 1..41: note = Hypo
  source 1..41: mol_type = genomic DNA

SEQ ID NO: 123287 - DNA, 1817 bp, Homo sapiens
  misc_feature 1..1817: note = chr4:8858790-8860607
  misc_feature 1..1817: note = Hyper
  source 1..1817: mol_type = genomic DNA
cacagcggaccatctcaataacaaaccgaaactctggctatctccaggtagtcgaacttgggatgccttttgttttcagtgcttgtaattttctgaatttttaaaataacgaacagagtctccttgcgacattaaatgcaatgcagccgccgaggaagcgtcggggacagatggggttggacgccgtccccacttcctcccctgcagccgcctccaggccgccaacctcgcccagccggagcctcagtcctggagggtcgggcggcggcggccttcccctggagtggcattcttgttgcccgtggggccccctccccaggtaggaggcaggaggcggggtctggggcagcctccgctttctccttcctccttcccccgcggcttccctgctgcgccgggcctcccaggtctcaccccgagtttccgcacccggtggggcgcgggttccggcccagcttctctcggaagtgacggctgacctagagcccatccctggcctcggcctccgcacccccccgcccccctgcctgtggaacccgcagcccagaagcctggagcctctctgcgagcacgcaggggtctcccagcttccggatcgttccgccgttcgccctgggtctgagtctgggggttcgggaaacaattttggacgtttctggttggattgtgtctaaatcgtgcattttacgcgacaggggactcgaggtccttgaggatcccaaactgccgcagcccctccctcctcctccccttgcccttgcccctgcccagagaagtgcgctcctccagggtcatccacacgcgccgtgccgagccccgggccccagttccaggagccgcgtctctacgggccagtgggtcctgagagagtagggcttcgggcgctcggggagaggaggcggaggaggggtgaagccgaggggtggcttttaacgaaaaagaagttgaagcatcagctaagccattagggctaatgcgatgtactgtaagacggggatcaatgccgggcctcggggaccggcgtgggggagggggcagcaggccgaccgcccccaagccggtcgaggcccccgtccatttgggggaaatggattttcgcgatttaagaaacaaacccaaatcaaatgagcgaggcccggatgtgctgacgctgcggttacgcgcgcggagctggagccccgagagcgctctaggaaaggcgcagcggcgaccgcgggagggggtgagaagccgaggcagagaggtccggagaagcagaaagagatgccgaccggcagagaaagagcgagacagacacaccgaggggtgagggggcaaaagggagcagcctcgcaattttcgcagaagaaaacaggccggcgcggctggggatgcgcttctgggccaggcgcggcaagaccccaggaactagccagagccccaagacccaggcgcctatttgagctcctttgagtccggcaggaggcctaggtccattcgggagagagaggtgccagcccctaccttgtgcagtcccctcgcccggacgtcatggggggagtgccccctgagcgcaggcccccgggcggccggggcctcgcttctggcggccgggagaggtcggcaccgtgacactcaggcacacatacaccaatgccccgggcccgctagggacgctgagctccaggcaacgaaaaacgaaggtcctggagtcggtcctgagtgcattcctccactgggccccgtcgagaatgaaactctcggagcatcgtcactgggaggtcctggggggacactggggtgggcgagcttcttcaaagactcggtttccactgggc

SEQ ID NO: 123288 - DNA, 32 bp, Homo sapiens; identical to SEQ ID NO: 92598
  misc_feature 1..32: note = chr4:8861124-8861156
  misc_feature 1..32: note = Hyper
  source 1..32: mol_type = genomic DNA

SEQ ID NO: 123289 - DNA, 1568 bp, Homo sapiens
  misc_feature 1..1568: note = chr4:8861410-8862978
  misc_feature 1..1568: note = Hyper
  source 1..1568: mol_type = genomic DNA
tgccttctctacacacgtgcgtggtctatgtgacgtggagtcgcactgggacccgaatgaggacatccccccgccccttcgtcatcgtgggaataccgtggaacaaggcgggcaaagggctgatcagctcccgtcccggcccgaagaaagcttccaggggaggcggaagggccattcgccattccagagcaggcgcgggcagtggcccacggctctgggcccggatctgtgtccacctctggatacccaattcccgccaccatgttgttgggagcaaggaggcacaactgcccgtggtgggagtggagggcttaggtccccattagaaccggcagagccccgacggggccaacggcggtgctgacagcgcgaactgcgtcaggggcgaagccgagttcgtggagcgccgttgcgcacaagtgcgcgggtcagcagggccctggtgcctggacacccccgggtgcgcgcggcgtggctgccctggtgccccagtgagagcatgactgcgcgccaaatggaagtgggggcgccccctggcctttcctatacccggggccaaaaccgctgggaccgatatactgcaggagtccgggcacaggctgaggggaccggcccgtgcgttgagcgcctcggaggtgctccgggtcatggtgggtgctgagcgggaacacggaaggctgtgtacacagcagcaagcaatgcacccgcgctcccgtcattacatcgcgccgccttcacccccgctacgatgaccactccgcagatgggcaagacgggctcagagagatgaagtgactttcccaaagccacacagcgggccagtgaaggcaccgcgcacggtccaggaatctaacccttcctggggagtggggagggaagggctcgacccgaaggggccaggcggcagagagccccgcgtcccccgccacgggctaagacgcaaggcggcccgccgtgtctccacctgcgcgcctcgagcttcgctccgctctagccttcgggttaacaccgcttccttccagaagcctaaggaggcccgggcggatcagacgcctcccttctccgcagccccatgccctgcccgcagcttgagctcaccgcccttctcggggtggcggtgcggagaccggacggctccactgtgcagaccccgaggggtaaggggccgggtaggggaggggagcgagaagtggcgaggtgagaactgaggggcgaggctgaaggctgagccagacttccagacgccagagagacgccaggtgagccgggcgggggcgggggcgagggcgggggagggggcggggccggaaccgcggggagggggcggggcgcccgggagggccgcgagctgggaaggtcccgggcggccggagacggtgaagaggcggggccgagtcgcgtccgcggggtcccggacacagcggagctggcgccactgtcggggttccgttccatctaggtcgggcagccccgcgggtccgggcgccgctgccctcctctacctgctgggaagcgcaggccgagcagggatgaacctggctccagggccccagcggggcaggcagggc

SEQ ID NO: 123290 - DNA, 613 bp, Homo sapiens
  misc_feature 1..613: note = chr4:8863322-8863935
  misc_feature 1..613: note = Hyper
  source 1..613: mol_type = genomic DNA
gcgtaggcggagccccgggggcacggccgaggctgcgcttcaggagtgtccgccaggcgccttcccgggcggttggcgaaacccgaggaggcccacagctctggcctggggcgccgtcgttccaggggcctctgcgcctctctctggcgtctgtctggaccctcagagccccgggatcaaggcgcccatcctcttgatggcggggcgcacctttcgcgtgggtcgggcgctgcagaccaagcacgccgagtgcgtcaaggaagtgcccggaaaccaaagacaacgcacccgggaccaagaggaggccgctgcgcgcaacctcccaaacactgcagcgaagtcggaaccacgtccgcgtgggtgactcgggctggggagccgggaggcggcgccaaggacccttcagcccttgtccgtcctccctgatatgtcctcgacgcggtctgaggcctccccagcggaggcgacgccccggcgccaggtgccctgggtgggggaacccggagggggcaccacgaccagtggagaaggggcggaggccgggaaagctgcgtggaaaagaggaagggttaagactgaaatcattctacagagaccacgttaatgggtttaa

SEQ ID NO: 123291 - DNA, 594 bp, Homo sapiens
  misc_feature 1..594: note = chr4:8864526-8865120
  misc_feature 1..594: note = Hyper
  source 1..594: mol_type = genomic DNA
cgtttgctccccaggcggtgaggctggctcttcgaccacttagctgttctcggcgcccgatcctgtgtgtccttccgtgcatgacacgcagagcttagctctgtgaggacagggctgtcccctctccggcccacctatgaaggggtgtccacctctccgtttccctccagggcagtcattcattgggtgatccgccttggggacctggggatcggcgagtccaggaggcccagcgaacgaatttccggtggctgggacccacttcccagcgggaccctggataggcatgcccactctggctaccagaagggcagggtggccgaagggtatgaagcatatgagtgcacaggcggggaggaacagcagcagcaccagcgcaggagtagcccgctggcctccctcaggcgggtggaggagggcgccggggagcctcagtgccaccgtgctccagaattcctgcccctctcagaaccccggtttccctttccaacaagttgcaaggtggggcggaaggccacgaaagactcttgggggagaggcactgacagaaagggaaagagaagcccacccggcctctcccgcctccctggtgct

SEQ ID NO: 123292 - DNA, 30 bp, Homo sapiens; identical to SEQ ID NO: 92606
  misc_feature 1..30: note = chr4:8865644-8865674
  misc_feature 1..30: note = Hyper
  source 1..30: mol_type = genomic DNA

SEQ ID NO: 123293 - DNA, 1456 bp, Homo sapiens
  misc_feature 1..1456: note = chr4:8868700-8870156
  misc_feature 1..1456: note = Hyper
  source 1..1456: mol_type = genomic DNA
tgctcccaggagggacggcacccagcgcagcttgagctgtctctgccctcgtgatcacaaagcagtgaaactgtccagaaaatgtccctttttattccatacgcaaataagtagattcatttaaaaaaacaacaacccggaggctgcgacgtctgcagagagccccagcctgcctgctcctggaacggacgatgggacccacaggtccagggtcctttctccaccagcacccgcgagaggggtagcacagccctccgggccggcctgctgtctgggtcccaggaaagggacgtttagtgttgggggcagtctgtggggacagtcaccgctcagccttggacagccggttcgtagttttcctttgttgcgctgggcttggcctgagggcagctgccccgggtggccatggccgaccgctcctcgctgaggccggggggtggccgtggcgccgggggctgcgcagcccagagtctctgcatggccccctgttcgagtggggatccagcctggcaaatgggtggggcgtcccattacattctagaggcgctccccacagaagctgaggcccgcccggccgcggcctgcgctcccgaggtatctaggaggccgcaggagcgaccatcccttccctaacgccccctgagccctgcgcctgccgctgaatcgcgcgtccacacaggtccacagggtcgtggggagagggcccggcaggcggggctcacaccaggccaggcatctgcgcccgcagaaagggcacggaggcggcggccgggaaggcggccagcgggtaggcgagggccccggagaagccgagcagcggtgggggcggcgcgggcgcggcgggcgccagcgggaagggcagggtggccgggggcccagcggcggctgcggccggggggctttcgtggtagagcaccggcacgcggaccaggcgctgcgctcccggcggggacaggctggccgcctccagctcggctgccagctgccgcttccacttgttgcggcggttctggaaccagatcttaacctgcgtctcggtgagctgcagggaggcggccaggccggcgcgctcggcgctgctcaggtagcgcttcaggtcgaaggtggattccagctggaagacctggctgcgggagaagactgtgcgcgtcttcttctttcggccgccgcccacgccaacgccgccgcgtgtctccccagccgccgcagggacctcggccagctccgacgcctcctccgtgccggccgccgggccacgcgccgccagctccgctgcctcccgctgcaccgctcccggcccggggcctcgcggccaggcgccctccgcacggcccatctcctcgcccgtctccggtgagtcccggtcgctggctgcaggggagagagggcaccaccgttggttctagggcactgattaccagactcaatcactgaggccagccgtccccaccttgag

SEQ ID NO: 123294 - DNA, 1306 bp, Homo sapiens
  misc_feature 1..1306: note = chr4:8872678-8873984
  misc_feature 1..1306: note = Hyper
  source 1..1306: mol_type = genomic DNA
cagcctccctgggaccggaggagcccggcaatgggtgaagctatggcctgcaaaacctcctcgttagcggagctcctgccccagagggtgggcctccaaaccagcccaaccaggggctcctgggggccccacaaggcccagacgccgttccacagaagggagaggatggcccagaacgggcggcgacgagcccgaagtcccccagcaaatgcgcagggaggaagtcgggccccaccgcctgacccaccctccccgcgccctcactcactgtcaggactgaggccgcctccatagccaccgtgcgcccgtgggtaccagcgcgctgcgcctccgcagcccagagcgaagggcggcccgggaccggggggcggccgaggaccgaggcccagcgcgcccggcccgagcagcgcacgggcccgcgcctccccgccgggcccggtgcccgcgagcaactgtcgccgccgctgtagccgtcgccgccgcgcctgctcggcgtcctcgtcttcggggtcgtcgtcgtcctcctcctcgtcctcccggctgccgtcgccctgggtcgcgcgccctgcgcccttggcctcggccgccagcaggttctcgatgaggaaggaggaggcgcgggccggcgtggcgcgcccgggctccgtcagctcgtcaggcatcgcggccgcgggcttctcgggctcggccgggctcctcggtccccgctggggatggtggcgcgcggctcccgggcgcacgcgcgggccggccctggagctgctacccggaccgctggcgtcgggccccgcagggcaggcggcggcctccgcgccgggctgggctgggccgggccgggagcgagtgcgcgccgacagctgatcgggcagccgcctggctcgcctttcaggtcgccgttctggtcgccgccggggcggcctcactgggggcggggagggggaggggccagcaggggcggggggtcgcgggctgggccgggagggcggcccgctgagccccgaggacgctgcgccggccccgagcgcggccgctgccgggagacgctgcccagacctgagcgcgcgggcagcggcgcagccgagggcgggcggccccgggcgcaggcggggggtcgcgccgggtccgatcccgcgtgatcagttcccccgtcccgcgccacccgctccgtgggggcggggcctgggctgagcggccacccattggctgtggggccccgatgaggaacgggctggccaatcaccgtccggccagagccgtaattaccccgctgcgaggagggtgttggaccgaccgtgagtaactgtgt

SEQ ID NO: 123295 - DNA, 252 bp, Homo sapiens
  misc_feature 1..252: note = chr4:8874476-8874728
  misc_feature 1..252: note = Hyper
  source 1..252: mol_type = genomic DNA
ctcccatatctgcagcgggaagttcgggaacataacgcaccctggagctgtctccgttccggcgtcgacttcagacttacctacattaggtcactgcgcggacgcgcgggttaagccggcttcacccgatgcgagttatttcgcagagatacatccatcctcccagggccagccccgggcccctctccacccgagtaccgcccgcgttcccggaggtgaccgcaggcctggggcttccgctttgtttaattc

SEQ ID NO: 123296 - DNA, 233 bp, Homo sapiens; identical to SEQ ID NO: 92613
  misc_feature 1..233: note = chr4:8875695-8875928
  misc_feature 1..233: note = Hyper
  source 1..233: mol_type = genomic DNA

SEQ ID NO: 123297 - DNA, 139 bp, Homo sapiens; identical to SEQ ID NO: 92614
  misc_feature 1..139: note = chr4:8878536-8878675
  misc_feature 1..139: note = Hyper
  source 1..139: mol_type = genomic DNA

SEQ ID NO: 123298 - DNA, 171 bp, Homo sapiens
  misc_feature 1..171: note = chr4:8879491-8879662
  misc_feature 1..171: note = Hyper
  source 1..171: mol_type = genomic DNA
cctggagcctggaaccgccggggccagctgagaagccgcctccgccgctggagtccctgggaagggtcccctccacctgcccacagccagcctgggaggcagacgcgccaacgtctggcccctcagcagggacagcggctccaacaaagccacccccgggaggggacgctg

SEQ ID NO: 123299 - DNA, 680 bp, Homo sapiens
  misc_feature 1..680: note = chr4:8893356-8894036
  misc_feature 1..680: note = Hyper
  source 1..680: mol_type = genomic DNA
tttgcttcactgcttcgcccaaaaccgagaacccgcggctcacagacgctccatcctatccgcggacagaaacgaatccgagccgcagctgcacgtttgaaccccgcaaagccactgtgagccggtactgaaaccccaaggaaaagtcggggtttgggggcgggatccttgccccatgtgggttgggaaaagacggtgggaaccttcgggactctggagtggtgaaatgacgggagaggacactcaacactcccgactcatgcccttcagagcggagctctgacctggcctcctccaggcagtcttcccggctgcgtcctgccctatctcctcctccccagctcggcgtttgcagccccgctgggccgcgcgcaactggagcgccaagttgcgtcacctgagcgctgttaccgtggtgcccggtctgaccgcgtgtgcgaacccaggcgtctgcgaccgcgaagctgcgagttgtctcgggccctcccggagctgcgggcggctcctcgagaaactcagagagcccaggcgcaccacgggccagccaggacatccccaggcggccctgttagccccattttatggaggaagactgaggctttgggttgcatgggacccgcggttaccccgcaaacacagacgcttacgaagacgctatcgcgagccgaacagtctggagg

SEQ ID NO: 123300 - DNA, 1723 bp, Homo sapiens
  misc_feature 1..1723: note = chr4:8894641-8896364
  misc_feature 1..1723: note = Hyper
  source 1..1723: mol_type = genomic DNA
ggaaacgcctgcctccggtcggtctagcgcggcgtgtgcgagtgcagcccccgcggggacgtgggcaccaacagcaggcgagtgactaccgcggcgcagttcccgaggacccagcgcctctcccgaggccaccctcccgggcaggaattactgtctgccggcccgaagccgccaccccacccgccgccctgtttcaaagttggggagagtccatgccgcgacggagcgagcagacttggacatggtcgagtgcctggtgcgcacgattggtcttaagagtttagggaaaaaagcacgcggggaaaccacgcggggcccggcgcgctctcgtttcccaccactgcccccttcccgggcaccgtgggccgccgctgttgcccgtcccgctttcttctcgcctcggagcaccgggtcccccggagtgacctactgcagccgagccccggcggtcgggggcttgcgctgggttttgggacgcggtctcagacgcttggccctgtggccctacccatcggttccggtcccaagaacggtgctctcctgtgcctcgggcctttcccggggcgccgggccgcggcaggagcgacctccgcccgcgctaccttcctgccctgtggcctacctgggtcccccttacacctctgctcggtgcagccctgagcctcggtttcccagacggcgcagctgaggctctcgaggtgacgagaggctgtgggggtgaggtcgcagccctgctccctcctcagttccgccacccaccccttcggtagtaacgccgttctcaaaatgggcccagggccccttccggccaaacacagcctggactcctgggcagagaccgagcgcggcagaggtggcccgaaggccgggttgcgggggatcccggcctctgcccaactgccccggaatctggcaggcagacacgctgcgccactggggacaatgcgaccccaatgagctggcgctcccctctggcgaaggaccaggtggcgaggtcgcccctgtcgtgtggcccaatgcgttaccagcaagaacaaagtcccatcttaactgctcttcgcgcggcttttgaccttgggtcggggctgcgtctcagcgctcaacagccccgcttctccccacggttttaaattaccggaacgaagccactgccagcggcgcctgcacggggagggcagggagcgctcggggcgcattgggacctcgagtaccttcaccctagggagtgctcgtccccagcccggcctctgcggccgcccccggcccagcccgtgctgtcctcatcttatcgcggcccgccccggccctgcgctcccgccgctccgcagccaggtttctccgctgccgtcctcttccagggccaaggggccgtggcagacccggagcctcccggaggcgcttctgccggggcggattatctcccctctcccaccaggccccggcggggggcaccaactcgccccgaaagccgagaagcgctggaactccccctcctggccccctcctccgcttctgtttgtttaaccttccggcagggcggtgaccctgcgccctgccaggcgctgccatggggtcaggcgggggtggggggcgcctcaggggtccggcggcggctgggagtcccccgagcagcagagaccctcctcctgtctcctgttctgcccatcgtgggaagtgtcccaggcctggttgtgccagaggccctgggcgaccttcagcagtg

SEQ ID NO: 123301 - DNA, 54 bp, Homo sapiens; identical to SEQ ID NO: 92625
  misc_feature 1..54: note = chr4:8911942-8911996
  misc_feature 1..54: note = Hypo
  source 1..54: mol_type = genomic DNA

SEQ ID NO: 123302 - DNA, 52 bp, Homo sapiens; identical to SEQ ID NO: 92629
  misc_feature 1..52: note = chr4:8965616-8965668
  misc_feature 1..52: note = Hyper
  source 1..52: mol_type = genomic DNA

SEQ ID NO: 123303 - DNA, 124 bp, Homo sapiens; identical to SEQ ID NO: 40270
  misc_feature 1..124: note = chr4:8967222-8967346
  misc_feature 1..124: note = Hypo
  source 1..124: mol_type = genomic DNA

SEQ ID NO: 123304 - DNA, 30 bp, Homo sapiens; identical to SEQ ID NO: 92640
  misc_feature 1..30: note = chr4:9153953-9153983
  misc_feature 1..30: note = Hyper
  source 1..30: mol_type = genomic DNA

SEQ ID NO: 123305 - DNA, 83 bp, Homo sapiens; identical to SEQ ID NO: 92646
  misc_feature 1..83: note = chr4:9423198-9423281
  misc_feature 1..83: note = Hypo
  source 1..83: mol_type = genomic DNA

SEQ ID NO: 123306 - DNA, 169 bp, Homo sapiens; identical to SEQ ID NO: 92654
  misc_feature 1..169: note = chr4:9499324-9499493
  misc_feature 1..169: note = Hyper
  source 1..169: mol_type = genomic DNA

SEQ ID NO: 123307 - DNA, 172 bp, Homo sapiens; identical to SEQ ID NO: 92655
  misc_feature 1..172: note = chr4:9499862-9500034
  misc_feature 1..172: note = Hyper
  source 1..172: mol_type = genomic DNA

SEQ ID NO: 123308 - DNA, 682 bp, Homo sapiens
  misc_feature 1..682: note = chr4:9783020-9783702
  misc_feature 1..682: note = Hyper
  source 1..682: mol_type = genomic DNA
aaggctccagggatgcgccaagcacccttcggttttcccggggagaattttccccggcccggggactagggtctggcgctggggcgcccctcggacctgcgggatcgcccctacactctggcgcgctgagggcggtgagcgagggcgccaaggcacaggtggggcgggagtcgagcgcggaggctcggggggcgggacgcggggcctgggagcggccagggaccgcggcagcgcctcagtgccagcctggcgcccgcgactgcctgccccagcccctcagtggcggcttgctctcttctctcgctccgaaccagacacagccgctgccgctgccgtccggcgcgctacagactcccgagaacagccctggctgtcagcgagcaccagccgcttcctgtccccatcgcggagactggaggggcgcaccacggccatggagccagaggcgcttcaggaggcaagagaagtccccgcgcgctccgcagcccggcgcagctcatggtgagcgccctctggggctcgagggtcccttggctgagggggcgcatcctcggggtgcccgatggggctgcctgggggtcgcagggctgaagttgggaccgcgcacagaccgcccctgcagtccagcccgaaatgctgccgccaggcagcaacggcaccgcgtacccggggcagttcgctc

SEQ ID NO: 123309 - DNA, 176 bp, Homo sapiens; identical to SEQ ID NO: 92680
  misc_feature 1..176: note = chr4:9847574-9847750
  misc_feature 1..176: note = Hypo
  source 1..176: mol_type = genomic DNA

SEQ ID NO: 123310 - DNA, 30 bp, Homo sapiens; identical to SEQ ID NO: 40271
  misc_feature 1..30: note = chr4:10200240-10200270
  misc_feature 1..30: note = Hypo
  source 1..30: mol_type = genomic DNA

SEQ ID NO: 123311 - DNA, 30 bp, Homo sapiens; identical to SEQ ID NO: 91413
  misc_feature 1..30: note = chr4:10319571-10319601
  misc_feature 1..30: note = Hypo
  source 1..30: mol_type = genomic DNA

SEQ ID NO: 123312 - DNA, 30 bp, Homo sapiens; identical to SEQ ID NO: 91423
  misc_feature 1..30: note = chr4:10412582-10412612
  misc_feature 1..30: note = Hypo
  source 1..30: mol_type = genomic DNA

SEQ ID NO: 123313 - DNA, 955 bp, Homo sapiens; identical to SEQ ID NO: 91424
  misc_feature 1..955: note = chr4:10458372-10459327
  misc_feature 1..955: note = Hyper
  source 1..955: mol_type = genomic DNA

SEQ ID NO: 123314 - DNA, 762 bp, Homo sapiens
  misc_feature 1..762: note = chr4:10462775-10463537
  misc_feature 1..762: note = Hyper
  source 1..762: mol_type = genomic DNA
tgccagtctctgagacgttttctcaactgcaaaacaggagtaactggagcaacctttcgtggagggtgccaggcgctggagcgtggctaaggcagggaccacgtcccagccgccctttcccgccctgcggcgcaggcccactctcttggctctcctggcccgcacactcagctcggccgccgcggctgccgcggaagcgcgcagtgaggctagtggggccacgagcggcgcgctgagcatgcgcgcccgatagagcctcgagatgcgccgggccgcgctgcgctgcagtaccgcccgcggcctgcagtgtcgctgcgagcccggctggcccagctcggcgtgtagagctctaccccgcgcggcgggcggtgcagccccgcgctcacctgggcgtcttcgctcccgctcgccccgcgcttccgaaaatcgggaatgtaatgttttgtttttacattccaatttgctccctccccaggctggcgtggaatccgagggttcctgatgactgcagctcctcgcccctcccgctgtgttcccgccgcctctgggctgaaagcgccatcaggacccgtggcgcgtgggctttgttaagtcattaactgcttgggacatagcaggagcatggtgcgcggcacagaacaggcttggcttccacggcccatccaggcggagccgtcagcgtcccttgcctagaccagagctctggaaagcggagaggcggacaggggccgttccccagatctgttccggaggatgcagatc

SEQ ID NO: 123315 - DNA, 35 bp, Homo sapiens; identical to SEQ ID NO: 91428
  misc_feature 1..35: note = chr4:10501134-10501169
  misc_feature 1..35: note = Hypo
  source 1..35: mol_type = genomic DNA

SEQ ID NO: 123316 - DNA, 30 bp, Homo sapiens; identical to SEQ ID NO: 91519
  misc_feature 1..30: note = chr4:11428999-11429029
  misc_feature 1..30: note = Hyper
  source 1..30: mol_type = genomic DNA

SEQ ID NO: 123317 - DNA, 145 bp, Homo sapiens; identical to SEQ ID NO: 91520
  misc_feature 1..145: note = chr4:11429558-11429703
  misc_feature 1..145: note = Hyper
  source 1..145: mol_type = genomic DNA

SEQ ID NO: 123318 - DNA, 48 bp, Homo sapiens; identical to SEQ ID NO: 91521
  misc_feature 1..48: note = chr4:11430659-11430707
  misc_feature 1..48: note = Hyper
  source 1..48: mol_type = genomic DNA

SEQ ID NO: 123319 - DNA, 30 bp, Homo sapiens; identical to SEQ ID NO: 91530
  misc_feature 1..30: note = chr4:11781107-11781137
  misc_feature 1..30: note = Hypo
  source 1..30: mol_type = genomic DNA

SEQ ID NO: 123320 - DNA, 827 bp, Homo sapiens
  misc_feature 1..827: note = chr4:13523948-13524775
  misc_feature 1..827: note = Hyper
  source 1..827: mol_type = genomic DNA
tccctaccttcctcccgagggagaggcagagcctctagctccatttcagacctgcaaggaaagggctttgagaagggaactggggagaagcacgttccaggtgtgggttcagctcggcactcgccacaggcctccgcaggtggctctccttggcagcgaggcaaggcgcaaacccgctggcttgggaagcctgacgtgacccccgcccgccaagcctggcaggaagcgacgccggggttctccgcaagaagaaggcggcctccgggtgtcggccgcagccaggctactgtgctccggggcaaaccgctgcaaagtcctagtgaggcagaactcgacccccaacactcagcagcctgccgtccacccatccacacccccgtctcgccccctgccccaagctggcagatgccttgtcgcccctctaagaccgcacccggattgggtggctgcaaagacgctcgccaaagcgctcagagccccagggaagccgtggcgcctggcagctccctctcctctgggagatctgggggcgccagggctgccggggcctagcacagcgtgcgccacgaggcttaaggatgcgaaaactactgggaggccgagagaggtcccgggagcaggggcttgaggaggcaccttggggctacggacttcgctgccgtggtggcctcgcaggagaaagtggcttaaatgaagagtcctggctccaggcttgacgcccagctagataaacgatcacctccctgagaggaggccttgggcatgccgtgttcccagagcccatggcacagtggcccccagaacacgctgatcgagcagaggccaga

SEQ ID NO: 123321 - DNA, 333 bp, Homo sapiens
  misc_feature 1..333: note = chr4:13525379-13525712
  misc_feature 1..333: note = Hyper
  source 1..333: mol_type = genomic DNA
acactggcctggctgcgctgtactgccaggtggccttctcaggatccctcgctgcgcctctcagccccatcccatccaaaccacgccccgcctgcggccactagcccattttatcccattgagcccccgtccttccccatcgcggggttccactccactggtgccagggctatgcccctcacccacccactccaccggtgctggctaccgcaatctctacccgggcgtccagattcctggccttgtcctttctgctggaatcatcaatgggatcgcgccgccgccgccgagcagccctacactcctggctcgcgctctcggcctccggcacct

SEQ ID NO: 123322 - DNA, 259 bp, Homo sapiens
  misc_feature 1..259: note = chr4:13526706-13526965
  misc_feature 1..259: note = Hyper
  source 1..259: mol_type = genomic DNA
agtgaggtccgcactcggcgcagactgaagtgctccagaactaaccacctccgcagacgcaacggagccaggaggggcctcaggggcctccaaccgcatggctcttcccagctttcccggacaccagcgctgagcactggggagccggggagcaagcgccaagaggagcttttaaattaaaatttccagagtagcctcagagagggagggaaattccagttgaaaagccccttctgcctcaggacgttattcagtaaaa

SEQ ID NO: 123323 - DNA, 58 bp, Homo sapiens; identical to SEQ ID NO: 91613
  misc_feature 1..58: note = chr4:13529323-13529381
  misc_feature 1..58: note = Hyper
  source 1..58: mol_type = genomic DNA

SEQ ID NO: 123324 - DNA, 37 bp, Homo sapiens; identical to SEQ ID NO: 28814
  misc_feature 1..37: note = chr4:13529606-13529643
  misc_feature 1..37: note = Hyper
  source 1..37: mol_type = genomic DNA

SEQ ID NO: 123325 - DNA, 254 bp, Homo sapiens; identical to SEQ ID NO: 91615
  misc_feature 1..254: note = chr4:13530726-13530980
  misc_feature 1..254: note = Hyper
  source 1..254: mol_type = genomic DNA

SEQ ID NO: 123326 - DNA, 99 bp, Homo sapiens; identical to SEQ ID NO: 91616
  misc_feature 1..99: note = chr4:13532820-13532919
  misc_feature 1..99: note = Hyper
  source 1..99: mol_type = genomic DNA

SEQ ID NO: 123327 - DNA, 41 bp, Homo sapiens; identical to SEQ ID NO: 91617
  misc_feature 1..41: note = chr4:13536477-13536518
  misc_feature 1..41: note = Hyper
  source 1..41: mol_type = genomic DNA

SEQ ID NO: 123328 - DNA, 204 bp, Homo sapiens; identical to SEQ ID NO: 91618
  misc_feature 1..204: note = chr4:13537569-13537773
  misc_feature 1..204: note = Hyper
  source 1..204: mol_type = genomic DNA

SEQ ID NO: 123329 - DNA, 30 bp, Homo sapiens; identical to SEQ ID NO: 91619
  misc_feature 1..30: note = chr4:13537979-13538009
  misc_feature 1..30: note = Hyper
  source 1..30: mol_type = genomic DNA

SEQ ID NO: 123330 - DNA, 30 bp, Homo sapiens; identical to SEQ ID NO: 28817
  misc_feature 1..30: note = chr4:13539344-13539374
  misc_feature 1..30: note = Hyper
  source 1..30: mol_type = genomic DNA

SEQ ID NO: 123331 - DNA, 180 bp, Homo sapiens
  misc_feature 1..180: note = chr4:13540888-13541068
  misc_feature 1..180: note = Hyper
  source 1..180: mol_type = genomic DNA
aagggaaggggcgcccgggtccgcagggtaggtggagtctgcggtggaagatggagccgccaggggtgcgaccgggacctctgtggcttttcctactctaaagaaactcccggattctttcaccgcccaatcggcaaagatggagaacaaactaccctcttaagacgcagcaacaagcaa

SEQ ID NO: 123332 - DNA, 39 bp, Homo sapiens
  misc_feature 1..39: note = chr4:13541408-13541447
  misc_feature 1..39: note = Hyper
  source 1..39: mol_type = genomic DNA
aaacgctggtcaccacgctccgcccgggccagatccgag

SEQ ID NO: 123333 - DNA, 173 bp, Homo sapiens; identical to SEQ ID NO: 91623
  misc_feature 1..173: note = chr4:13541822-13541995
  misc_feature 1..173: note = Hyper
  source 1..173: mol_type = genomic DNA

SEQ ID NO: 123334 - DNA, 823 bp, Homo sapiens
  misc_feature 1..823: note = chr4:13543579-13544402
  misc_feature 1..823: note = Hyper
  source 1..823: mol_type = genomic DNA
agcgcgggaatcactcgctgcctcagcccaagcgggttcactgggtgcctgcggcagctgcgcaggtggagagcgcccagcctgggaggcagtagtacgggtaatagtaggagggctgcagtggcagaagcgagggtggccgcagcacttcgccgggcaggtattgtctctggtcgtcgcgcaccagcacctttacggccaccttcttggcggcgggcgccgaggccagcaggtcggctgccatctgccggcgctttgtcttgtagcgacggttctggaaccagattttcacctgcgtctcggtgagcttcagcgacgcggccaggtctgcgcgctcgggcccggacaggtagcgctggtggttaaagcggcgctccagctcgaagacctgcgcgtgggagaaagcggcccgcgagcgcttcttgcgtggcttgggcgccgccggctcctcctcctcctccgcgacgcctgccggcccgctgccgcccccgccgccggccccgctgcacagcgcggacacgtgtgcacctctggggccaacaccgtcgtcctcggtccttgggctgcggtcgcctgcggaccccggtgggaacagaaacaagagactgtcagcgccacagacgaggtgaggccgggcctcaactgcaggggtcacgggagtggggcggaaatacactttgatcccactcaagcggagcggaggtctgggaggccctgggcccgggagaccagtcttagactcttgccccactgggtatcccatctaggcctcttctggggagggcggcagactcagccgctgtgtcaacgctgtgttgtcgag

SEQ ID NO: 123335 - DNA, 1294 bp, Homo sapiens
  misc_feature 1..1294: note = chr4:13545462-13546756
  misc_feature 1..1294: note = Hyper
  source 1..1294: mol_type = genomic DNA
ctccgagccccagggcgcagggtgctcaagccgaccaccccactcggcgtggttgccctccgcgtccatcccctcagcccggcccccatccccgcgaagccgcagcagacctgagacgctggcggacatctcgctgtcgctccggcccgcggcttcctcctctaggtctttggaagcggccagctcacagaccggctggccgaggctcaaggatccccccgcaaggccggccccgctggccccccgcgcgtccgcgcagcgccgcctgctctcgttctcctcgctgagcgcggagtccgagtcccagccttccgggctctccgcagtccgccccgcagctgttctggtaccggcaggagacgccagcagagagtcctcggcgccccccaacgcgcccgcgtccctctccccaaagagccgccaacagcagacagcgggagccgcggccaccgatgccgctgtgcccccgggcgccgggcgcccctctggcgcggccagcccgccgcgctcctctttcttgttgaggatcgcctggatggagaaggacgtcaaggtgttggcgccgcgcacagccatctgcgccgcgggcaggagcggccggcggggcgggcagctggggcgccgagcagctccgagcgggacagagagcgccggcggccgcagcgcgagtgagctgggtgtgcgaggccgccgccgcccactgctgcgcggcccagcagctcccgccccactccgtcccaggatcagcgccgaccctcgcccccaccttagaggcccaccccgcccggagaccccctccccccgaatccagagccagacgctctcctttcgcagctcagctggattatctcatcgcttctcgcccttaggggcgggctggggtctgccccctcgggggacgtgaaggaggattggcgggggcccctccgtggcagcagtcccctcccgagcgccgccggggcgcacagcccgagtcactttttctttgcgcgtctgtcccttcctcgcctgcaggatttcgctcctggcccgtcctccccttccctgctgggcaggctcttccggagcccacccccggcggcggcggcggtagccgcggccgcggccgctggattccgagaggcgcggggaacttttttaccccctgccctggttttatctgtttcttttctctttccttcccttgcgttccactgtaccacccccctcccgcccgggtgtcattcctcactgctgagtgacagcctgaggccacacccctccactgggctgtcccgggcgctcccggccgtcc

SEQ ID NO: 123336 - DNA, 1362 bp, Homo sapiens
  misc_feature 1..1362: note = chr4:13548502-13549864
  misc_feature 1..1362: note = Hyper
  source 1..1362: mol_type = genomic DNA
aaagatgtggtttggcgactttgagttgtcgggtatttttgtgtcccaggagtgtgagaaaggggctacgttccgcgtcttccggaggcgcacagcaagggagtctcctggtgtcatctcgggccattacggcgcttagtcgatcattaggtctgtgggtgactgtaggcagagccgggagttgggtgcttggcgcggagggtgaactcgcgggtcttgagctgcaactagaagctgctcctagcaaggggtcgggtggagatgaaaagactgtggggaaggggaggtggttgtatgcccagagatatcccggcgtaactacggagtccaggcccagagtggcggtgtgtggcgaaggcgcagcaggcctgcgcctgtcggaggacggcagatctggacgcgaccgcgcgggcgtgcctgggtcccgcttcctgcccatcgagggcgacttccttcgggctcagctgtgagctccaggaactctgcaacctcccgacgggcgccacgctccggcttgggccggcccgggagttggcggagctgcgcggcccggccgggcggccggtgaggctttcgagaggcaccgggctcgctcagcgtccgcgcctctctaccccgccgcgccccctccgcgcccacgggcccattttttcctagtcttctgcctctcttccttcttcctccctcccctcctcctccacacctttgtcttcttcctcctccctcctcctgcttctcctccgcagtttggatcctacgggccccctacgtgccgcgcccttcggtccccggaaccgcccgggctgggggtgctgctgcgcggtgagacttccgcgggcggcgggcggagagcgggatttgactgcgaaagccaagggggcggggaaggggaagccccggccctcgggggcgcgcagtaaactgctgcacacgtgcccgcgctcccgaggggggcgcccagtgggctcgggatttcctggctgcgccaccgcgcgcctcgcccccgacgcccgccacctgtgccctgggccgccttccctgacgccagcggccggaggtcgcgcgcgccgggtgctgcccagcaacgaaaggccatgcggggttcgtccctcagatgccggtgaccttgattgaagtcacctgccttctctagcttccagtcctttaaaacgagggtttggacccggtgccttctgaacccggtgcttcactgagtgagcaagtgaagggtgtgtgtgtgtgtttggggtgggggcgggggcgaggggagggaggggcagcgttgccggctccccagagccaggtccaggcagaggtcgcgcccagcactgaccgtcggtcccaatccgcagactcccgagg

SEQ ID NO: 123337 - DNA, 188 bp, Homo sapiens; identical to SEQ ID NO: 91728
  misc_feature 1..188: note = chr4:15412373-15412561
  misc_feature 1..188: note = Hyper
  source 1..188: mol_type = genomic DNA

SEQ ID NO: 123338 - DNA, 28 bp, Homo sapiens
  misc_feature 1..28: note = chr4:15697095-15697123
  misc_feature 1..28: note = Hypo
  source 1..28: mol_type = genomic DNA
acaaggtgaaattgacgggaaaaggaag

SEQ ID NO: 123339 - DNA, 709 bp, Homo sapiens; identical to SEQ ID NO: 91787
  misc_feature 1..709: note = chr4:15780033-15780742
  misc_feature 1..709: note = Hyper
  source 1..709: mol_type = genomic DNA

SEQ ID NO: 123340 - DNA, 33 bp, Homo sapiens; identical to SEQ ID NO: 40273
  misc_feature 1..33: note = chr4:15789491-15789524
  misc_feature 1..33: note = Hypo
  source 1..33: mol_type = genomic DNA

SEQ ID NO: 123341 - DNA, 199 bp, Homo sapiens; identical to SEQ ID NO: 91802
  misc_feature 1..199: note = chr4:15826894-15827093
  misc_feature 1..199: note = Hypo
  source 1..199: mol_type = genomic DNA

SEQ ID NO: 123342 - DNA, 553 bp, Homo sapiens; identical to SEQ ID NO: 91809
  misc_feature 1..553: note = chr4:16083930-16084483
  misc_feature 1..553: note = Hyper
  source 1..553: mol_type = genomic DNA

SEQ ID NO: 123343 - DNA, 1009 bp, Homo sapiens
  misc_feature 1..1009: note = chr4:16084707-16085716
  misc_feature 1..1009: note = Hyper
  source 1..1009: mol_type = genomic DNA
ccatatccctactcccgctgtggtcggctgcacagtgttggcccatttccgcactcagccagggaagctcagcgcctcacgtccccggggccatccctagagtttcctttaccgcagactcgttcccaagaccctggcgagtctcacctcggtcaccgttctccccgagagcgagtccgaagtctctggggccccggtccagttcgcacactcacctccgactcccgctccggaaccacggccgccggctacccccacccccgcccccatccccagtggatggaaagaagacccaagcggggcgtcgcgggccaccactcagactaaaaagtttgggttggacgggcaccggcaccaccacgctctccccgcagttcctctggcccccagccgctgtccgggcccgcaccacctgctgaggggccagggaggcggcgcagatggctagggtaaggggggcgcagagcgaacccgtccactcctcactgtacacccccagtacagtggaaggagtgcgctcagccccgcgcctggtcagcagatgcctctctcgctccgggatgaggacccagctactcaccgtgcacccggctcccgctcctgctcccgccctagtcaccgctgccgccgcccttcccttagctcgccagaccctggctcgtgaattatttatgacccggcttctgggaccaccgcgacggctttcggagagcccgcctcccactgccggccgcggaggggctcaggcggcgctgcggccggaccctcggacgtggcgggaggcaggagaaaggcccgggtgcccggggggacccgttgcggcttcctctgtcccggacggggacctaggtatggggccgccgtaatggaaaggattccttaaacatactcaccgcggcgggagagctgagagcatggccaggtgccgcgtggggatctgcctcagtcacttaaagatcgcgaaacccgagccctggacgcactctgattggaccggctgagctgcttc

SEQ ID NO: 123344 - DNA, 106 bp, Homo sapiens; identical to SEQ ID NO: 91840
  misc_feature 1..106: note = chr4:16787092-16787198
  misc_feature 1..106: note = Hypo
  source 1..106: mol_type = genomic DNA

SEQ ID NO: 123345 - DNA, 30 bp, Homo sapiens; identical to SEQ ID NO: 28831
  misc_feature 1..30: note = chr4:17326218-17326248
  misc_feature 1..30: note = Hyper
  source 1..30: mol_type = genomic DNA

SEQ ID NO: 123346 - DNA, 30 bp, Homo sapiens; identical to SEQ ID NO: 91902
  misc_feature 1..30: note = chr4:17638206-17638236
  misc_feature 1..30: note = Hypo
  source 1..30: mol_type = genomic DNA

SEQ ID NO: 123347 - DNA, 779 bp, Homo sapiens
  misc_feature 1..779: note = chr4:17782834-17783613
  misc_feature 1..779: note = Hyper
  source 1..779: mol_type = genomic DNA
agtccattctccagccggcgccaccgtcggctttggagccctggcaagtgccgggcgggttaattttgctgttgagagcagaagccatcgctaaaacgcgcccagcactcagactctctcgttttctccctgcccaccgtgtgcacgtgcgtgcgcgcgcgggcgtgcgagcgtgtgggtttctcgggagaggtggcactgcagtcccgtcgcctgcaccgccgcgtggccccagcttcccgaaggtctccgcctcccgggcccacccgcgcgcccaccctttttcctctcctgctggttctctggctggctggctccgcgggcacccgcaccctgcggcgaggcgtcggcgccccgcacgtgccgctggcgatcagtctgcagttccccagccagtgcaggtttcgtgtgcaaggggagagcttccgcggctaggagctgccggccttggggggtttgcggtgggcgggcactgcgctcttggacacgtgggtggcgcgcggccctggacttggtggcgacggaccctgcccgaggtggggatcccaggctaaagaggaagaagagcctccggagagggacagggcacagtgactggcggcctccggagagggacagggcacagtgactggcggctcccgagtctccgagctgatagcggagatggcggtgggggacgagatgctaagagaggggcgggtaggtgagggcgagccatcgggactcaaggaggtgtgggatccggggcgcacggtgtgggccagcgcctgagttgcgcg

SEQ ID NO: 123348 - DNA, 30 bp, Homo sapiens; identical to SEQ ID NO: 91919
  misc_feature 1..30: note = chr4:17818237-17818267
  misc_feature 1..30: note = Hypo
  source 1..30: mol_type = genomic DNA

SEQ ID NO: 123349 - DNA, 466 bp, Homo sapiens; identical to SEQ ID NO: 92009
  misc_feature 1..466: note = chr4:20253509-20253975
  misc_feature 1..466: note = Hyper
  source 1..466: mol_type = genomic DNA

SEQ ID NO: 123350 - DNA, 106 bp, Homo sapiens
  misc_feature 1..106: note = chr4:20254217-20254323
  misc_feature 1..106: note = Hyper
  source 1..106: mol_type = genomic DNA
tggctctgcgccctccggaacccggctcttgtttcttctacctttgccatcaggtgtctgccgcggagctgcggcttatctgggagacgagcggggttgacacgcg

SEQ ID NO: 123351 - DNA, 427 bp, Homo sapiens
  misc_feature 1..427: note = chr4:20254693-20255120
  misc_feature 1..427: note = Hyper
  source 1..427: mol_type = genomic DNA
ccagacatccttcagcgaagtgcatgtgtgtttgtaaaccatcgttggctgtcgggagaccgcgaggaccggtccaggctgcggcggagtcgagggcgagggagaggccgcgtgagtgagcagagtccagagccgtgcgcccccagaactgcgcgtccgccccgtgcacccccgcgcgccatgcccagttgccccgcgcgctctgctacgggcccgctgggcttccgcgccttctagcttccggagcccactttgatcggggccataatacctattgagatcccctcttctgtcttgtaccttcgccactggcatcggatttgcagaagcgtgcgtgggatcagaggaccgccctccccacaacaaccggcccctgcatcttagcagccgttggaagccccagctcttttaccgccaagttcatcct

SEQ ID NO: 123352 - DNA, 1603 bp, Homo sapiens
  misc_feature 1..1603: note = chr4:20255327-20256930
  misc_feature 1..1603: note = Hyper
  source 1..1603: mol_type = genomic DNA
ctgggttgctagccccgccgggcactgggcctcagacactgcgcggttccctcggagcagcaagctaaagaaagcccccagtgccggcgaggaaggaggcggcggggaaagatgcgcggcgttggctggcagatgctgtccctgtcgctggggttagtgctggcgatcctgaacaaggtggcaccgcaggcgtgcccggcgcagtgctcttgctcgggcagcacagtggactgtcacgggctggcgctgcgcagcgtgcccaggaatatcccccgcaacaccgagagactgtgagtatgcgctcttcgtcttcccctctccccatccgggccgcgcacccctgcctccactggaggaacctgtcagctcagggtcctgtgcctggggcagccctcgctagctctcccccatgcacatcctggggttgagctctccgggagggcactggccagggaagggcctctgtccaaggaggggcgggtccgctggcagctgcgctagttctccctcccctgctctcgtcccgccactcgcagctccttgctggctagttctctggggctggggagcgggtagataggggacaagtactggaggatgcccggggcaagtgagacgccactttgttctccagagtccataaacggagtcaccttgcgattgccagcatccaggtcggtttcagagcccagtcctcgctcttgtcgcaggctggcgcggaggggatagcagggagactcaaaagagagaaacttgccttccccgattttttgtcaccctcctgggggcgaaggttaggaagaaggggtcatggagtgcctgggggtgcttctcacaggtcgcggggagaagggtgccccaggacggcgacacctcgcatagtagcctcgcgcagccccccgccccccacttctccggggaggggaagacggcgtcaggcccctagggacttgtctcagcgggcgactgcgagggaggaccgtgtcccatccgttaagcgaagttagcactggttctccagcgcaaaccagcccaaccaggtcttaccactgcggcgacccggcggtgcccggctgccccctccggcccttcctgctgaacccctgcgtccccatccacctttctggcagtttctgcgccccttcacgtggcagcagttcccctgccttcccctcttcgcgctccgttgctcgcagacgtccccgcctccctgtctttgcgagtctctaatgaagaagtaaatgcagacccggtgttgacggcccacgcgctcctgatgaggcgcttccagagttcagcgaagtggagcatggaggccgttctctttgtgaacgccgaggccgccgccccgcgccagtccggccgccctaggcacgttccgctctcgcggttgcgtgtgggccgggagtaagcgaagggcgcggggctaggccggcaggggccagcgcgtctggattcgtcccgcggcctctttgcccccggggtgtaagggtttcgggccgtggagaggaggcgctctgacccgcacgtctccacccgcgcagcccattgcacttcaagtcgcccttcttatccaacccatttctctcgcccttagttttaa

SEQ ID NO: 123353 - DNA, 270 bp, Homo sapiens
  misc_feature 1..270: note = chr4:21305925-21306195
  misc_feature 1..270: note = Hyper
  source 1..270: mol_type = genomic DNA
agccacgcatgaagtcgcggcgcagatcacccgaggacccaggaggtcaccaggaacgtcccgaggaaacatgaggcccggcgcggaggagatggctctgcgccccgggactctgcgcgccgcgccgccgccaccagtggctttgttgggccggccagttgccttggaaacaagagaacccaaggaagggctggactcctgctgcagacagggagcagagcaccgcaccttgaaatacggagaaaaacctgaaaacgctgagaggtggag

SEQ ID NO: 123354 - DNA, 1001 bp, Homo sapiens
  misc_feature 1..1001: note = chr4:21949877-21950878
  misc_feature 1..1001: note = Hyper
  source 1..1001: mol_type = genomic DNA
atgcataaacaacctcggaaattttcagagaaggcaaaagtacgcacaggatcgcaggggaccctgccaccggcgagtttcaaacacacttcaaacatcttttcttccccgacctggatcttgcatgcacccccctctcctttgcaccccattcctgccgctcccacctccccttcccagtcccgccaggtgactgtgtctcatgcagcgaaggcaacaagcgtccccagccgaggaagggaaggggcagccgtcttggctcgcgagggaaggagggcggaagcgggcgcccgctcgcaagcttattgcatcctaccgcctgtagagctggcctcctccagctgagccgaaatgctttccaccctcctcacattcatgtctagggacgcagggtgcagaagcgagactcgagagtccaccggccaggggcgtctgtccacgggtctgcacgggagcgcaccgccgctcggcccgggggcgtccgtggcgctgggagcgagagcttcggcggcggctgcgggcagggcgcgcggagcgggctgcaggtgcgggcggaggccggcggggggcgccgggggcgctgcgcggcccttggcggcgggggcgcgcggggtggcgggggaggccgaggcgccggcagcttcgcgccggcggctggaagcgggcgggctgcacgggcggctcgagtgcggggaccccagcccctcgccctcgtgagcgccgcccctgccacctgctgccaagtcaccggactggggatgcggggggcggggtgcggggagaggaaagcgccgcgggtggcacggtgcctctggcgacagagtagatggacccgaaagagacccgaggtgacttcgggctgggcaggacacccccgggagttgccagcggctctcagcgggcgcctctaggaccccttgtcactgcgagcagcgcctgctctggggaggggctcgaaggcgccgcgccttctcaacgcgccgctgcgtcccccaggggct

SEQ ID NO: 123355 - DNA, 30 bp, Homo sapiens; identical to SEQ ID NO: 92034
  misc_feature 1..30: note = chr4:22516841-22516871
  misc_feature 1..30: note = Hyper
  source 1..30: mol_type = genomic DNA

SEQ ID NO: 123356 - DNA, 30 bp, Homo sapiens; identical to SEQ ID NO: 92035
  misc_feature 1..30: note = chr4:22622408-22622438
  misc_feature 1..30: note = Hypo
  source 1..30: mol_type = genomic DNA

SEQ ID NO: 123357 - DNA, 146 bp, Homo sapiens; identical to SEQ ID NO: 92042
  misc_feature 1..146: note = chr4:24471691-24471837
  misc_feature 1..146: note = Hyper
  source 1..146: mol_type = genomic DNA

SEQ ID NO: 123358 - DNA, 209 bp, Homo sapiens; identical to SEQ ID NO: 92043
  misc_feature 1..209: note = chr4:24472371-24472580
  misc_feature 1..209: note = Hyper
  source 1..209: mol_type = genomic DNA

SEQ ID NO: 123359 - DNA, 407 bp, Homo sapiens; identical to SEQ ID NO: 92044
  misc_feature 1..407: note = chr4:24473331-24473738
  misc_feature 1..407: note = Hyper
  source 1..407: mol_type = genomic DNA

SEQ ID NO: 123360 - DNA, 30 bp, Homo sapiens; identical to SEQ ID NO: 40275
  misc_feature 1..30: note = chr4:24535112-24535142
  misc_feature 1..30: note = Hypo
  source 1..30: mol_type = genomic DNA

SEQ ID NO: 123361 - DNA, 308 bp, Homo sapiens
  misc_feature 1..308: note = chr4:24801697-24802005
  misc_feature 1..308: note = Hyper
  source 1..308: mol_type = genomic DNA
cgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccctccactctgaggtctcaccttcgcctttgctgaagtctccccgcagccctctccac

SEQ ID NO: 123362 - DNA, 398 bp, Homo sapiens; identical to SEQ ID NO: 92049
  misc_feature 1..398: note = chr4:24914406-24914804
  misc_feature 1..398: note = Hyper
  source 1..398: mol_type = genomic DNA

SEQ ID NO: 123363 - DNA, 50 bp, Homo sapiens; identical to SEQ ID NO: 92050
  misc_feature 1..50: note = chr4:24967393-24967443
  misc_feature 1..50: note = Hypo
  source 1..50: mol_type = genomic DNA

SEQ ID NO: 123364 - DNA, 89 bp, Homo sapiens; identical to SEQ ID NO: 92051
  misc_feature 1..89: note = chr4:25013961-25014050
  misc_feature 1..89: note = Hypo
  source 1..89: mol_type = genomic DNA

SEQ ID NO: 123365 - DNA, 59 bp, Homo sapiens; identical to SEQ ID NO: 92052
  misc_feature 1..59: note = chr4:25032044-25032103
  misc_feature 1..59: note = Hyper
  source 1..59: mol_type = genomic DNA

SEQ ID NO: 123366 - DNA, 38 bp, Homo sapiens; identical to SEQ ID NO: 92053
  misc_feature 1..38: note = chr4:25090356-25090394
  misc_feature 1..38: note = Hyper
  source 1..38: mol_type = genomic DNA

SEQ ID NO: 123367 - DNA, 69 bp, Homo sapiens; identical to SEQ ID NO: 92054
  misc_feature 1..69: note = chr4:25098014-25098083
  misc_feature 1..69: note = Hypo
  source 1..69: mol_type = genomic DNA

SEQ ID NO: 123368 - DNA, 35 bp, Homo sapiens; identical to SEQ ID NO: 92058
  misc_feature 1..35: note = chr4:25377692-25377727
  misc_feature 1..35: note = Hypo
  source 1..35: mol_type = genomic DNA

SEQ ID NO: 123369 - DNA, 128 bp, Homo sapiens; identical to SEQ ID NO: 92060
  misc_feature 1..128: note = chr4:25656679-25656807
  misc_feature 1..128: note = Hyper
  source 1..128: mol_type = genomic DNA

SEQ ID NO: 123370 - DNA, 363 bp, Homo sapiens
  misc_feature 1..363: note = chr4:25657130-25657493
  misc_feature 1..363: note = Hyper
  source 1..363: mol_type = genomic DNA
cacttgcgggaatctcgtgcggaccgagtcggggcgggagagggcgcgcaccagccaggctagggcgcgcggggcgccgaggggcgcggggccgtttggggccgttcgggccagttcgcgcggcggggcccgtcggagcttttctctcggcagcctggctggccgcgcgtcttctccgcgcagcgggcgaagtcgcgatgggttcattaaggcggcaggtaggcagtgccccggcggcggctgcggcaggcggtcctggaatgtgcgaggggcgtgatgacagcggccagcctctttgcgcaacaccttcgccatatatacccggggcgctgcgctccacctggccgccgcctccagcccagc

SEQ ID NO: 123371 - DNA, 261 bp, Homo sapiens
  misc_feature 1..261: note = chr4:26030405-26030666
  misc_feature 1..261: note = Hyper
  source 1..261: mol_type = genomic DNA
gcctgggtgattttacgtgcggatgcagaggaggggcagcgtcggggcggcggagtccgacctcgggggattcaccctgagggttacaggcaaggccgctccaggcacgcagcacctgccgggcgccacccaggagggggcagcagcgccattcgcaaagccggcccgctccgctccgctctcaggctcagggctgcggagacaggaatcgcagcttcccctggaaggggcgtcccaggggacctccgccaggccagggga

SEQ ID NO: 123372 - DNA, 30 bp, Homo sapiens; identical to SEQ ID NO: 92067
  misc_feature 1..30: note = chr4:26296591-26296621
  misc_feature 1..30: note = Hypo
  source 1..30: mol_type = genomic DNA

SEQ ID NO: 123373 - DNA, 52 bp, Homo sapiens; identical to SEQ ID NO: 92069
  misc_feature 1..52: note = chr4:27086432-27086484
  misc_feature 1..52: note = Hyper
  source 1..52: mol_type = genomic DNA

SEQ ID NO: 123374 - DNA, 90 bp, Homo sapiens; identical to SEQ ID NO: 92070
  misc_feature 1..90: note = chr4:27086750-27086840
  misc_feature 1..90: note = Hyper
  source 1..90: mol_type = genomic DNA

SEQ ID NO: 123375 - DNA, 30 bp, Homo sapiens; identical to SEQ ID NO: 92080
  misc_feature 1..30: note = chr4:30718156-30718186
  misc_feature 1..30: note = Hyper
  source 1..30: mol_type = genomic DNA

SEQ ID NO: 123376 - DNA, 30 bp, Homo sapiens; identical to SEQ ID NO: 92081
  misc_feature 1..30: note = chr4:30718953-30718983
  misc_feature 1..30: note = Hyper
  source 1..30: mol_type = genomic DNA

SEQ ID NO: 123377 - DNA, 250 bp, Homo sapiens; identical to SEQ ID NO: 28855
  misc_feature 1..250: note = chr4:30719374-30719624
  misc_feature 1..250: note = Hyper
  source 1..250: mol_type = genomic DNA

SEQ ID NO: 123378 - DNA, 571 bp, Homo sapiens
  misc_feature 1..571: note = chr4:30719850-30720421
  misc_feature 1..571: note = Hyper
  source 1..571: mol_type = genomic DNA
tccctgccctggcctcggaggaggagccaccacccctggggtgatgctactttcacagactggaaaatactcgccagctccctgacacacacttagacacacttccatccaacgggcatctacgatcccctgtagggagagcttggaaatctctgccgcctctccctcctcattcctgttcctgcgcccgcccaaacaaccgcgcgctacatctgctcgttgactttattggtgtttgtcttgtttaaatcattctgcctcgtcacccaggtctcgtaaagaatacccacactggacagattttattttttcggctttaaatttttctttgaggggaggcccttaaatgtgtatggatacgtcaggcgagctgaagactaagcaaatcccagcagcggccctttctctctttcgagatggtaaaaattctccccaaatacctacagtccgtctcagtcgtcttaatcctagccgggcctcttcgtttacagccactgaaataaatgagtaaatggctcagttcaaaaacacaaccagacctgagatctgatgaggccggctgcggtggtcg

SEQ ID NO: 123379 - DNA, 303 bp, Homo sapiens; identical to SEQ ID NO: 92085
  misc_feature 1..303: note = chr4:30720644-30720947
  misc_feature 1..303: note = Hyper
  source 1..303: mol_type = genomic DNA

SEQ ID NO: 123380 - DNA, 223 bp, Homo sapiens; identical to SEQ ID NO: 92086
  misc_feature 1..223: note = chr4:30721247-30721470
  misc_feature 1..223: note = Hyper
  source 1..223: mol_type = genomic DNA

SEQ ID NO: 123381 - DNA, 30 bp, Homo sapiens; identical to SEQ ID NO: 92087
  misc_feature 1..30: note = chr4:30721945-30721975
  misc_feature 1..30: note = Hyper
  source 1..30: mol_type = genomic DNA

SEQ ID NO: 123382 - DNA, 172 bp, Homo sapiens; identical to SEQ ID NO: 92088
  misc_feature 1..172: note = chr4:30722839-30723011
  misc_feature 1..172: note = Hyper
  source 1..172: mol_type = genomic DNA

SEQ ID NO: 123383 - DNA, 437 bp, Homo sapiens
  misc_feature 1..437: note = chr4:30724216-30724653
  misc_feature 1..437: note = Hyper
  source 1..437: mol_type = genomic DNA
gcagccccccaagaccgacaaggccaccgtggtccttaacatcaaagacgagaacgacaacgtgccgtccattgaaatccgcaagattgggcgcatccccctcaaggacggggtggccaacgtggccgaggacgttctggtcgacacccccatcgctctggtgcaggtgtccgaccgagaccaaggcgagaacggggtggtcacctgcaccgtggtgggcgacgtgcccttccagctcaagccagccagcgacaccgagggcgaccagaacaagaaaaagtacttcttgcacacctcgacccctctggactatgaggccacccgggagttcaacgtggtcatcgtggcggtggactcaggcagccccagcctctcgagcaacaactccctgattgtcaaggtgggagacaccaacgacaacccgcccatgttcggcc

SEQ ID NO: 123384 - DNA, 155 bp, Homo sapiens; identical to SEQ ID NO: 92115
  misc_feature 1..155: note = chr4:35962570-35962725
  misc_feature 1..155: note = Hypo
  source 1..155: mol_type = genomic DNA

SEQ ID NO: 123385 - DNA, 30 bp, Homo sapiens; identical to SEQ ID NO: 92119
  misc_feature 1..30: note = chr4:36206328-36206358
  misc_feature 1..30: note = Hypo
  source 1..30: mol_type = genomic DNA

SEQ ID NO: 123386 - DNA, 18 bp, Homo sapiens
  misc_feature 1..18: note = chr4:36311031-36311049
  misc_feature 1..18: note = Hypo
  source 1..18: mol_type = genomic DNA
gatcgcaggttgcagtga

SEQ ID NO: 123387 - DNA, 30 bp, Homo sapiens; identical to SEQ ID NO: 92121
  misc_feature 1..30: note = chr4:36345308-36345338
  misc_feature 1..30: note = Hypo
  source 1..30: mol_type = genomic DNA

SEQ ID NO: 123388 - DNA, 207 bp, Homo sapiens; identical to SEQ ID NO: 92122
  misc_feature 1..207: note = chr4:36418721-36418928
  misc_feature 1..207: note = Hypo
  source 1..207: mol_type = genomic DNA

SEQ ID NO: 123389 - DNA, 1904 bp, Homo sapiens
  misc_feature 1..1904: note = chr4:37245537-37247441
  misc_feature 1..1904: note = Hyper
  source 1..1904: mol_type = genomic DNA
gaacccacaccctcccgcccggcccaggtgcgcacccggccgcgcggggctccagcaacctggcggccgacgggcccgggagctgtcaggcgagcagaacagccggtgagtgcgccttgatgggagcagaaaggcccctaggaaccttggaggcctcggaggaactacccgcggagatccgctcccagaaaggttccgggaccacgcggcgaggagcacgtgaacggcgcagcttggctataaaaaccccgctcaagcgcgcgtggggagcaaccggagcggcaggacgctgccacctgcgccaggagagatagggatgaagcgatcgtccctccaggacgccagagacaatctggagacttgatgctttaaactctccgggtctggcttggggttgtgtgcgtcgaactttgaggctggattccctgcacttgggcagagacgcacagacgcccgagcgtgtggattcccgaaaattctcagggcttgtgtgacctttaggagagttggagggggcgtagtagaaatctcaggctaattgatttcttgtcctccaccacggaggcagacaggagccctcggctgtccacagaggagtccaggaggctcctgcgcacccccgaggcccccgcgcccaagccccggccgtcctctaagccgcaagttatttctgcgcccgagagaggcgggctcggataaagtcgggacgccttctggtacataaagtttcatctgctctcctcgctcgcacggtccctgccgcctggcggccccctcctcccacggcgggcgcgggcggggagatggccgccggcgcttcccggcgcaaacgggcgctgcgcgcgtagccgccgccacgctgacctcccgctccagctggctgctgctcggagccctagcagcgggcgaaggcggaggcccagaagggcaggagaccgccgcgacaggagcccgagggtccgtatggcttctcctcgccggcgggtgctgtgcgccacggagctcgccaaaggcgcttcgggctcggagcggctctgagccgcgccgcctgctgagatcgaccgcctgctgagccgttccgtggagctgcgggcaggaacccgaggagcaggaggtggcggcggcggcagtggctgttcctcccagagggcgatgtggccggccggcgcgggcaccaagctgccctgtccccgagactctgcgctccggcgggcggctttctctgggaacctcacggccctgccctctcacctcgtgcccgccggccgcagcgtccgggtcttcatcagcgccaaccctgaaggtacgtccctcgctcgggtttgcccgtccgtccttctgtccgtcagcgctgcgggagctggagagtgtgtgtccgccccacagcccggtgcgccctgcgctcccttcctccagctaaagccgtggccgccctgagcgcgtgggaatttaatttgaatcactttttttctcccctcgctggccggttttgcctgcacacttctattaggacacccattctccaccccgggttattcccctgggtcaatccaagaaacatccaaggcattagccggcccttctggaagctccattctgccgccgccgccaccaccacctcctgtcccccgcccttttttttttttttaaagcggtttcttctccgagatgaccgcaaacacaaacagtagctctcctccccgaggcgggttcctgagtgcggggctacctccttggccactttttccagctgaggcgaggtgagttccttgagactctcctcctgcaggtgcgatggtgccctttgcagaggccaagcagacttttgtgaaccggaggtcgagggggacaccctctgtgggtcccggaacaggcttcgcggtggggcgcgcaggatgggctca

SEQ ID NO: 123390 - DNA, 55 bp, Homo sapiens; identical to SEQ ID NO: 92133
  misc_feature 1..55: note = chr4:37455430-37455485
  misc_feature 1..55: note = Hyper
  source 1..55: mol_type = genomic DNA

SEQ ID NO: 123391 - DNA, 77 bp, Homo sapiens; identical to SEQ ID NO: 92141
  misc_feature 1..77: note = chr4:37892223-37892300
  misc_feature 1..77: note = Hyper
  source 1..77: mol_type = genomic DNA

SEQ ID NO: 123392 - DNA, 30 bp, Homo sapiens; identical to SEQ ID NO: 92145
  misc_feature 1..30: note = chr4:38650068-38650098
  misc_feature 1..30: note = Hypo
  source 1..30: mol_type = genomic DNA

SEQ ID NO: 123393 - DNA, 32 bp, Homo sapiens; identical to SEQ ID NO: 92147
  misc_feature 1..32: note = chr4:38732941-38732973
  misc_feature 1..32: note = Hyper
  source 1..32: mol_type = genomic DNA

SEQ ID NO: 123394 - DNA, 116 bp, Homo sapiens; identical to SEQ ID NO: 28867
  misc_feature 1..116: note = chr4:39047287-39047403
  misc_feature 1..116: note = Hyper
  source 1..116: mol_type = genomic DNA

SEQ ID NO: 123395 - DNA, 234 bp, Homo sapiens; identical to SEQ ID NO: 92151
  misc_feature 1..234: note = chr4:39448261-39448495
  misc_feature 1..234: note = Hypo
  source 1..234: mol_type = genomic DNA

SEQ ID NO: 123396 - DNA, 30 bp, Homo sapiens; identical to SEQ ID NO: 92152
  misc_feature 1..30: note = chr4:39697732-39697762
  misc_feature 1..30: note = Hyper
  source 1..30: mol_type = genomic DNA

SEQ ID NO: 123397 - DNA, 26 bp, Homo sapiens
  misc_feature 1..26: note = chr4:39790045-39790071
  misc_feature 1..26: note = Hypo
  source 1..26: mol_type = genomic DNA
tttgtattcttaggccgggcttggtg

SEQ ID NO: 123398 - DNA, 145 bp, Homo sapiens; identical to SEQ ID NO: 92154
  misc_feature 1..145: note = chr4:39816644-39816789
  misc_feature 1..145: note = Hypo
  source 1..145: mol_type = genomic DNA

SEQ ID NO: 123399 - DNA, 24 bp, Homo sapiens
  misc_feature 1..24: note = chr4:39817089-39817113
  misc_feature 1..24: note = Hypo
  source 1..24: mol_type = genomic DNA
cgcccagcccgaaactggagactt

SEQ ID NO: 123400 - DNA, 30 bp, Homo sapiens; identical to SEQ ID NO: 92156
  misc_feature 1..30: note = chr4:39860480-39860510
  misc_feature 1..30: note = Hypo
  source 1..30: mol_type = genomic DNA

SEQ ID NO: 123401 - DNA, 30 bp, Homo sapiens; identical to SEQ ID NO: 40281
  misc_feature 1..30: note = chr4:40479216-40479246
  misc_feature 1..30: note = Hypo
  source 1..30: mol_type = genomic DNA

SEQ ID NO: 123402 - DNA, 100 bp, Homo sapiens; identical to SEQ ID NO: 40282
  misc_feature 1..100: note = chr4:40533094-40533194
  misc_feature 1..100: note = Hypo
  source 1..100: mol_type = genomic DNA

SEQ ID NO: 123403 - DNA, 30 bp, Homo sapiens; identical to SEQ ID NO: 92159
  misc_feature 1..30: note = chr4:40543284-40543314
  misc_feature 1..30: note = Hypo
  source 1..30: mol_type = genomic DNA

SEQ ID NO: 123404 - DNA, 206 bp, Homo sapiens; identical to SEQ ID NO: 92160
  misc_feature 1..206: note = chr4:40910280-40910486
  misc_feature 1..206: note = Hypo
  source 1..206: mol_type = genomic DNA

SEQ ID NO: 123405 - DNA, 1134 bp, Homo sapiens
  misc_feature 1..1134: note = chr4:41258716-41259850
  misc_feature 1..1134: note = Hyper
  source 1..1134: mol_type = genomic DNA
cccaccaacaaatcccgtctccacaaccaccagattatctcaccggcgagtgagactgcaaggtttgggggcccggccgtaccactccgcgctgcgcacggggggttcgtacccatctggccgcgaccgtccgtttccccctcgcttggttctgcccctgctccccctgcacaggcctcacagtgcgtctggccggcgctttatagctgcagcctgggcggctccgctagctgtttttcgtcttccctaggctatttctgccgggcgctccgcgaagatgcagctcaagccgatggagatcaaccccgaggtgagcgccaggtgcaccgctacccggagagcgcgaggccgagggagggggagccgagtcgctgatcggttcggttttgcctttttctttgcatttgcctttcagatgctgaacaaagtgagtggcgtctcgcgccgtctctggccccctcccccgcgagcgccgaggcgggggcgcccaccggttccggctgctggcagggaccaagccgcccgctgcgagcaccggagacggccgggctggggcgtgggctgggcgcctttcctgggcccctgcatttagcgggtgactctacgaaaccggtcacggggagacggagggggctgcgccccgtggcgagcgagcgccaggcggagctcccgagggcgtggcgcgggcagcacagactcggctgcacgggcttcgcgggcgccacgtgtgggccgcgctttgtgctgtgtcattgcgccggcccgggtgggggtggcagggcgggactggggctcctcccaggctcgggtgcgggcgcggagggcgcgcgcctcctggccccgccccctggcaggtgcccgcgacccgcgtgtccccgtgcgcctggccgccttgtctcctctccgcaggtgctgtcccggctgggggtcgccggccagtggcgcttcgtggacgtgctggggctggaagaggagtctctgggctcggtgccagcgcctgcctgcgcgctgctgctgctgtttcccctcacggcccaggtagggcgtggggcccaggatgcgccggccgccggcagtgcacgccgctccccagcttgagtcctcgggggctccccgccccgccccctcccctgt

SEQ ID NO: 123406 - DNA, 81 bp, Homo sapiens; identical to SEQ ID NO: 40284
  misc_feature 1..81: note = chr4:41314285-41314366
  misc_feature 1..81: note = Hypo
  source 1..81: mol_type = genomic DNA

SEQ ID NO: 123407 - DNA, 863 bp, Homo sapiens
  misc_feature 1..863: note = chr4:41362304-41363167
  misc_feature 1..863: note = Hyper
  source 1..863: mol_type = genomic DNA
ggactgcaggtgctgcgcggccagtgcccgcgcgtcctactgctccggtgccgcagcgcccgctcccccgggcccgggtgcgccccactgggcgcgcgtctcccatatgatgccagacccatccgcccgcccctcagcagccggcggggcgcagggacgtgcggggcggccagcggattccctctatcgggccgggtgtgaacgggagggagacacgcagcgctcgctccgggttatttttagtccgtagctgtgctccccctccccgggggcggagcggccctcgaaggtggggaggagaagaagctcccggcgcctccgcgctcgctcccgcgggtcactcacggcgcgttggagcccgggcggcgccgggaacagctgccgcggcgtcctctagcagcgcgcggctctcccgggacctgcgccggccgggggcggggagaggcggggaggggaggccggcgggcgggaaggggcggggagcgcgctcctgcggcggcgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggtaggtgcgggtggctggcgggcggccttgcactggcgccctgagccacggacccgcgcacgctccgaccgcaggtccagccttgcctccccccaaccgcccccactttcttttgccagctgctccaggtcacccccccgggcctcggcgagccgcgaaaccttagcgctttggcattggaatcccgggcgagggtgggcgtgaaaggggacac

SEQ ID NO: 123408 - DNA, 415 bp, Homo sapiens; identical to SEQ ID NO: 92168
  misc_feature 1..415: note = chr4:41746821-41747236
  misc_feature 1..415: note = Hyper
  source 1..415: mol_type = genomic DNA

SEQ ID NO: 123409 - DNA, 1382 bp, Homo sapiens
  misc_feature 1..1382: note = chr4:41747445-41748827
  misc_feature 1..1382: note = Hyper
  source 1..1382: mol_type = genomic DNA
cagacacacattccccgagacagacacaaactgacacgcagacacagccccctgagagtgccccgcgtccaggccgcgctgctcacaacccccgatcagcaggcggagccctggccccgctgcgaggccccaggcaggtgcgaagccagggaagtttgtttgttttgtttgggggttgaggaagggggtaggagtggggttgaaatgagggcgacgccgttttccctttattcttagcgcgattactttaggccctcaatgaaaaagccatggcagcagcgacgacaatagccttgggcctacccgctcgcccactcgcccgcccgggccctggctcgcccgctgtcgccgccgccgccgccgccgcaggattccagatcagaacatactgctcttcactaaggcggctttggcaccgttgggtctttggagcgaagataggacgctggcgaagggacccccaagcgaatccgggatggaggtgatggggccggggccgggagcccagccttgtccagggcccccagccgcagccaggcctccagctgccgccgctgccgctgccgccgccgccgctgccgcggccgccgccgctgctgctgcgccgcccttgccgggttcgcctcccgggcccccgggccccgccgcccccggagctccagccgggctgggcccgccgccgccgcctccattcgccccgcagctgggggtggggttgggattgggacctgggcccccagtgctgtccgggtcagtgctcttggcctctttgctctcgtcgtccctggaagagtcagactttttgcccgaggagccgttcttggccgcggccgctgcggctgccgctgcgcgctcctgcttgcgaaacttggcgcggcggttctggaaccacacctggcccaagacggaaggagagacggtgaagcagggggagaaagaagaaaatgggaaagaaaagcaccggttagggtggcccaagttctacttcggcttgttttaacaccctcctccccatgcgctgtgatcacccccgcgcgcacatccaccaagtctaccgcttcttattgctgtgcattttcggagaaactttcttagggggagtgagcacgccagggacatgaaggcttgcggcagagtttaaaaagccgcaggtcccagaaagacccgaaaagggaaggccttattttggtgggcctctgttcagtcggcttcttgagcaagccccgagctcgccattcacccctaagcctaagttctaaagttaaactctaattggtagaaggaaaagggatcctctctgggtttgctccgctgcccatccccggcctttgagcctggaagagcgtgcgatggtgcgcaccgcttctcggtcgggggctcac

SEQ ID NO: 123410 - DNA, 691 bp, Homo sapiens; identical to SEQ ID NO: 92172
  misc_feature 1..691: note = chr4:41749079-41749770
  misc_feature 1..691: note = Hyper
  source 1..691: mol_type = genomic DNA

SEQ ID NO: 123411 - DNA, 497 bp, Homo sapiens; identical to SEQ ID NO: 28877
  misc_feature 1..497: note = chr4:41750102-41750599
  misc_feature 1..497: note = Hyper
  source 1..497: mol_type = genomic DNA

SEQ ID NO: 123412 - DNA, 37 bp, Homo sapiens; identical to SEQ ID NO: 92174
  misc_feature 1..37: note = chr4:41751372-41751409
  misc_feature 1..37: note = Hyper
  source 1..37: mol_type = genomic DNA

SEQ ID NO: 123413 - DNA, 181 bp, Homo sapiens; identical to SEQ ID NO: 28879
  misc_feature 1..181: note = chr4:41751719-41751900
  misc_feature 1..181: note = Hyper
  source 1..181: mol_type = genomic DNA

SEQ ID NO: 123414 - DNA, 1861 bp, Homo sapiens
  misc_feature 1..1861: note = chr4:41752312-41754173
  misc_feature 1..1861: note = Hyper
  source 1..1861: mol_type = genomic DNA
gctctcccctgccaccgtgttttattgcgcactaaactgccgcggacgcagtaatggattaaacggggacagcggtcccccagccttgtgcttctttgcagggtgagtttcaggctcgtttcaggtggttgcaaatcctcggggcgtgaggaagcgctaaagtcgggagtgcagggagccggacctaccgaggatcctggtgatagttttatggggagggctgatagttttattgcagttgtatgttgtacaatgcgtatttgataaagaagggcccttggtgaccagtgtgcacttttttgtgcacgggggtgaaatgaaaataaatgtatacaaggttttactgcggcgggaaacaaattgcaacgctctaaatggtttttctttatggtcaccagacaagaggagaaaagggatgcaaacatctgtcttcagtcccctaaacctaaaggccagcaaagacggatgcgaatccaagtgctattacagcggagatttgtctttatttatcccgctctcatgaatatgaatttgcatttgggccgggaggtggctgtatccctttggactccacacatggaatttcccccacgctcatccccctccccaaccacttaagggaggtgggggataggttgtcaagcacaaggctgagatcgtccaagtttcttcgttccctcggatttcgggttgggggatgtgcttgctggttttctgaacgcaactctgccgccgaggcctgcactcaggagatgtggatgtagggagcacaggccggggtgtccaccgccagcccgctcctctgctgtagggtttaagcgcgtttccctgcagaagagagtgaccaggggtggtcaggaggtgatgaatttcggctccaaggcctatttttgacagtaaccaggttcacaccccgcttggcactagagccttactgcacctggggtgtgtctccgcgtggtgcagagcgcgcgctctactccggaagctacggccgggtgccgcgccaccgctgtgcgccctgggcctgatccctacgccctagtcgagtgcagggcagggcaatttcgccgtgggtcctagtttgctgacagttcccaggcccctttagcttttggggaggaggcgagactaggacctaaaaagtgctgggagctcggagtagaggggttcatgttgccagtttctgaggattgctcttaggtgaagatgtggaacttggaaatttaggtggtgcacagaggcacttcctgagcgaaagggagtgttggggtggggagttcagtgggcacctcaggggacctggatgctgacggggcatcagagggtgtcaaaaggagaagctaagggatctgggcgaggtctcagccgaagggcgctggcaagggaagtgcttggccggggagggtgcccggggggcggtcaaggggcaggcccggggctctgtccctcccggtcctggggtcccttcccgtcccgcggttccggaacgcctcgccagccctctctgggcgccccctgctgccgggcgccccctgctgccggccgccccgggtcggggtgccgtgagccttctcgcctttgtaccaggagacctttcagcgccgggcccacacggtcggatgagcaaatgcgcttgacttcattttcccctttgtagaccttgtaggtttattttgttcagtgtcaccatccctcccccaccacccctggcctatcgtccctctgcccgtcttttgtggcccggggtcctgcttctgcttggagatgaaaggcgtgcggggctgggccaggccagagccccagccccagcgccctgttttgttccagttgtgctttctacacgcgagctctcccctaa

SEQ ID NO: 123415 - DNA, 662 bp, Homo sapiens
  misc_feature 1..662: note = chr4:41867511-41868173
  misc_feature 1..662: note = Hyper
  source 1..662: mol_type = genomic DNA
acccccgggcctttgcgccaccgcaccaatttgcatccccaacgaatgcgcgctgccctgatccccgagcacgcgggtattaatgatcataaaaaactgggcgattacaaaaagagaaagtgctaaatcccgggagctggggcaagatttcaaaaggcaacacaccgaatccaagtctgtactttaacttttttaataacgatttttttttttctgggctggaagctcgcactgaatcctggaggaattgctaaatcggattaaggttatattttgcaacagactggatggagcaataaaggagagcgcgcggaaatgggacttcacccatcaattagatctctattagcagccaatgcaggcttcaccacaggaaatgtcacgtcccagccctagcggaccctttcgttccccacccccagctctcacctcccctgtccctggagttaaacaactcttctggcgcacacattggaactaaacaaacccttttgtgtggaatacggtttttgtgttttgttttttgtttttcttattgaacttgttttggaaccctgtaccacctgccttccccaaccccagcgcagcgagctaaccccgggacactcccaccccggccggctgaacaggttgcagcgcgacacctgcgctgtctgctgggt

SEQ ID NO: 123416 - DNA, 110 bp, Homo sapiens
  misc_feature 1..110: note = chr4:41869265-41869375
  misc_feature 1..110: note = Hyper
  source 1..110: mol_type = genomic DNA
ctgcgcgccccccgccggcctgagtggcaccgcgtgcccctgccggggcgcggctcctgcactgcgggcgcgcaggcggcggcgggctctgccggcgccccttattagca

SEQ ID NO: 123417 - DNA, 433 bp, Homo sapiens; identical to SEQ ID NO: 92182
  misc_feature 1..433: note = chr4:41875374-41875807
  misc_feature 1..433: note = Hyper
  source 1..433: mol_type = genomic DNA

SEQ ID NO: 123418 - DNA, 249 bp, Homo sapiens
  misc_feature 1..249: note = chr4:41881182-41881431
  misc_feature 1..249: note = Hyper
  source 1..249: mol_type = genomic DNA
cccgctggccctggccgcgcgacaggaggctgcaggcacgtcctgcggctccggggcgaaggctagggaaggggatagagggaggtcgctgcggggagggggacagaggcaggcacagagtcctaaagagatttgagactcgcgctcctgcactttctatcccacgcgcccccatccgaggggacctcacccctgggaagactccaataaatgcaacccggcgccactcgattccgggataatttttaa

SEQ ID NO: 123419 - DNA, 30 bp, Homo sapiens; identical to SEQ ID NO: 28888
  misc_feature 1..30: note = chr4:41881717-41881747
  misc_feature 1..30: note = Hyper
  source 1..30: mol_type = genomic DNA

SEQ ID NO: 123420 - DNA, 166 bp, Homo sapiens
  misc_feature 1..166: note = chr4:41882098-41882264
  misc_feature 1..166: note = Hyper
  source 1..166: mol_type = genomic DNA
agagtatcacaagcccgccctactgatcacgcggagaggattccttcttcccctctttactccgcgccctgccgcggaaacccttcccgtggcctcgaactggtccccgacgactgcggggtacgcggggcccaaagccagactctactcccgcgcagatgcggga

SEQ ID NO: 123421 - DNA, 64 bp, Homo sapiens
  misc_feature 1..64: note = chr4:41882530-41882594
  misc_feature 1..64: note = Hyper
  source 1..64: mol_type = genomic DNA
gaccggcagggttctcgccttaatctgtaccaccgtcccgtaaatctgtcgctcagcccatagc

SEQ ID NO: 123422 - DNA, 1552 bp, Homo sapiens; identical to SEQ ID NO: 92188
  misc_feature 1..1552: note = chr4:41882880-41884432
  misc_feature 1..1552: note = Hyper
  source 1..1552: mol_type = genomic DNA

SEQ ID NO: 123423 - DNA, 30 bp, Homo sapiens; identical to SEQ ID NO: 92189
  misc_feature 1..30: note = chr4:41993805-41993835
  misc_feature 1..30: note = Hypo
  source 1..30: mol_type = genomic DNA

SEQ ID NO: 123424 - DNA, 87 bp, Homo sapiens; identical to SEQ ID NO: 92190
  misc_feature 1..87: note = chr4:41994052-41994139
  misc_feature 1..87: note = Hypo
  source 1..87: mol_type = genomic DNA

SEQ ID NO: 123425 - DNA, 2395 bp, Homo sapiens
  misc_feature 1..2395: note = chr4:42152702-42155097
  misc_feature 1..2395: note = Hyper
  source 1..2395: mol_type = genomic DNA
ctcaggctgtggcctcgcaaccagcccatctcgctccctgcaggcaggcagtgggctgctttgccgggcagcgcccgcagactcgagataaaggagaggagtcgcggaccccagagtgggtgcctcccacgaggcgtttctgtaaggctcgggccgagatgctcgggaggggcaggaccccgcggcgcggcagcgtgccacggacggggacgaggggatggcggggacgacgacgtgggcggtgggagcagagtgcctgcgactcccggggcaggaaggaggggcgggatggttccccgcgcccgaaatccacggcgtggcggacgcggaggagccccgagtctcacaaccaaggggtgggaaggaaaagggacagagcgagacagagcgcccccgagaaacacaggcgcacaaaaaaagacagaaggaaaaacggaactgagagccagccagcatggactgcgacagcgtgagagtgcatcaaagaggtggcgaagaaagcactagaaggcaaaggagaagtggagagaagaagaaacaaatggaggaagaaggagaaagggaaaaagcagacggaaaaagtgaagtagtacgagggcgtcccagcggggcggcccgagaagctccagcttcttcccgagcggccgccgctatcccccgggggggcgtctggccccactccggaccacgcccgagcgatcctggtcgccgactgccacagccgtgcttcccggcgcgggatccaagccgcggagccacctgttaggcgcgcgccgtcggaagcccaggcgcggcggcgctggagaatcctctcgaagtttccgggtgcgcggggaggccccaggtgcgccccgacatcccgacacggcccagcacgggtaagtgtcggcggccccccgcttctccttcctgggtcccctcccgctgcccccggccgtggcgggaaggaaagttgtgcggagagttggtacctgcgctgagctccaggctggcgctgtcgctacccgtgccgccggtgccggcggccgccgccgcgcctgggccatacctgacgacagcggcgaacgaagacgacgaggaggcggcgggggacgcgggcggcggctgcgccggagtcctcaagtggccctgggatgtggcgggcgtgcaggacggcgacgacgacgaagcggcggcggcggcccggccgggcccgggggggtaggagctctgcgcctggaactgctgcggcggcggctcgctgctgctgatggagacggcggcgtgcggcgcgaagggcggcgggggcggcgggggcgcccgcacgtgcggcagctccaccagggtgggtcgctcgtagcgcttggccagcgccggtctcttgctggggaacgtcttgaggacgctgtaggggctgcgctgcttgtagattttggggacgctgggcccctcctctgccggctgcatctcttcctccatccggcgcctcggggccggtccctcggagcacgtcccctccccgccgggcgccgggctccgagggtgcctccgccgcctgcccgccgggtctgccctggtgcgcgcgtgtgggagggtgtgtgtctgtgccgtggccgccgccgccgccgcctgtcgctgaggctggcatcgccgagcccccgcgcggggggctgccgcccgagctcctgattgacaggctgcctcgccaatgcctggagggagaaaggaggtaaagagcaagtgtttagggtaatatctgctaatgataatgggggcggggcggggcctggcgccgcagccgcccgcggggtctgcctggcggctccgcgcctccgacggggagcgggggaagggggaaagcgaggacctggaggacgcccgggaactggtgaagaaggtggggatccgggatctggctacggcgagactttagagacccagatgtggactcgaggcttctgcggctgcgggcggggtccggcttccgaaacgagctcgtggcgccccctgcatgaccccaaactctcggggttgcacagaggaggggctagtcgttggggcggggtcgtcagagtacgtgtgtattacagcaagttcttctaccaatcgggaattgctctccgatccttctgaaaagaacctcttgaagatcttggcccgggtggtcgcgcggtgtttacggggctttggggtcctgctttccccgagcatcgcggcctctgagctcatgcggaacataaaagctcgcaaggcgtagaactttttcacgttttcatttgtttcccgtaggggccccgagaacgtgcatgacaccatgatttcccccccattataaagatgagaaaaccgaggctctgagaggttgaagggaattgcccaaagtcagacactcgggagtgtgcggctgtgttgcact

SEQ ID NO: 123426 - DNA, 151 bp, Homo sapiens; identical to SEQ ID NO: 40286
  misc_feature 1..151: note = chr4:42200720-42200871
  misc_feature 1..151: note = Hypo
  source 1..151: mol_type = genomic DNA

SEQ ID NO: 123427 - DNA, 65 bp, Homo sapiens; identical to SEQ ID NO: 92202
  misc_feature 1..65: note = chr4:42316016-42316081
  misc_feature 1..65: note = Hypo
  source 1..65: mol_type = genomic DNA

SEQ ID NO: 123428 - DNA, 29 bp, Homo sapiens
  misc_feature 1..29: note = chr4:42317313-42317342
  misc_feature 1..29: note = Hypo
  source 1..29: mol_type = genomic DNA
gcccagagggagctcgtccccagatcaag

SEQ ID NO: 123429 - DNA, 2249 bp, Homo sapiens; identical to SEQ ID NO: 92204
  misc_feature 1..2249: note = chr4:42398808-42401057
  misc_feature 1..2249: note = Hyper
  source 1..2249: mol_type = genomic DNA

SEQ ID NO: 123430 - DNA, 30 bp, Homo sapiens; identical to SEQ ID NO: 92205
  misc_feature 1..30: note = chr4:42442205-42442235
  misc_feature 1..30: note = Hypo
  source 1..30: mol_type = genomic DNA

SEQ ID NO: 123431 - DNA, 53 bp, Homo sapiens; identical to SEQ ID NO: 92214
  misc_feature 1..53: note = chr4:44448607-44448660
  misc_feature 1..53: note = Hyper
  source 1..53: mol_type = genomic DNA

SEQ ID NO: 123432 - DNA, 107 bp, Homo sapiens; identical to SEQ ID NO: 92215
  misc_feature 1..107: note = chr4:44448966-44449073
  misc_feature 1..107: note = Hyper
  source 1..107: mol_type = genomic DNA

SEQ ID NO: 123433 - DNA, 1677 bp, Homo sapiens
  misc_feature 1..1677: note = chr4:44449437-44451114
  misc_feature 1..1677: note = Hyper
  source 1..1677: mol_type = genomic DNA
tcgtgcagggagagccgctctctataaggagttaaccagcgcctgccccggacacccccgcggggcctccagcggggctcaaactggcggcggctcagcagggggcgaggggtgctgggaaacgccggggctgcgaacttacggaagaaaatgtactcggtgtagctgctccagatcttgtcgtcgcggtactggttgacgaaggcggcggtgcccgaggagttacacgccaccatgtggaagccggcctcggacaggcgatcaaaggcctgctccaagtaggtgaacttgaggtagaagcgggacgtgtacttctccggctgccggtcggggtcgcggctctcgttgagcgtgtccccgaagacctccttggccagcgcgatgcgcccgcacaccatgatgcgcgccacacgccggaatttggcgtcggcctggttgtcgcgcacggtggtgtaggagccccggtagcccagcgtgaggaagcccgagcgcttgtcctgcgcgccgccgccgccgccaccaccgtgcgctcccgggcccgagggcacggcggccgccgccccgcgcagcagcagcgcgtcgctgctaccctgcgagacgttgtcctccaggtcgctctggcagccctcgtcgttgagagagttctgcttggtgaccttgggcgacagcagcttgaccaagtcggtgagctggaaatactcggcctcgcgcagcagccgctccttctcggggaagtgctccggcagcgcgagttgcttgtcccgcagataatccagcacgtacctgaaaaggaagccgtcccggtcgatgaagaagcgcgcccggctgtccctgggcagctcgccccggcgccgggcgccgccacggggactagagggcgagaacatgctggccaaagtactgtccgggacgctgagcagcgtcgagtgcttggtcacataaacctggccgcctacgttcagctccactacttcagggaagggcgagggtgcgcagggccccggggcggcggcggccgacgcgccgggcgagctggacgaggaaaccatctcgctaatgggcaggatggtgctgccgccgctgcccgtgtccttcagagccatagtccccccgccgccggcccagtgacccgagagagctgcactttctcgttcccggagcccgcgccccagccctccgcgtgctcctggcgctctgcgccctcggactgggcggcgcgttcctccgaccggggcggccccgctcagggttcggggcagcggcggcgtcggcggcgcccgagctccatcggaggagagacgcgcgagagaggagctccgccggtgcggcggcggcaatggagaggcaagaaggagctgctgctcctttggggcgagggcggggaagtgtgagagagacttgcgagaggctctagggctgctgctcggctctccgtggggagggcgggaggaggggccgaagcaaagaaaactcgccgccccggcagcttgcaagcgtgccgcgaggccggagcgccgacggtggcgctaactactcctggcagcacgggaggaggcactgacgtcaagccccggactgggacccgagcctcagctgtcatttaaagagataggctgcagccgcggctcccgggctccgacgctagggggcggggccgagagccgagcctgcaagagg

SEQ ID NO: 123434 - DNA, 52 bp, Homo sapiens; identical to SEQ ID NO: 92220
  misc_feature 1..52: note = chr4:45473410-45473462
  misc_feature 1..52: note = Hypo
  source 1..52: mol_type = genomic DNA

SEQ ID NO: 123435 - DNA, 20 bp, Homo sapiens
  misc_feature 1..20: note = chr4:46067754-46067774
  misc_feature 1..20: note = Hypo
  source 1..20: mol_type = genomic DNA
tttgagacagagtctcgctc

SEQ ID NO: 123436 - DNA, 32 bp, Homo sapiens; identical to SEQ ID NO: 28904
  misc_feature 1..32: note = chr4:46391678-46391710
  misc_feature 1..32: note = Hyper
  source 1..32: mol_type = genomic DNA

SEQ ID NO: 123437 - DNA, 98 bp, Homo sapiens; identical to SEQ ID NO: 92224
  misc_feature 1..98: note = chr4:46392417-46392515
  misc_feature 1..98: note = Hyper
  source 1..98: mol_type = genomic DNA

SEQ ID NO: 123438 - DNA, 37 bp, Homo sapiens; identical to SEQ ID NO: 92226
  misc_feature 1..37: note = chr4:46783708-46783745
  misc_feature 1..37: note = Hypo
  source 1..37: mol_type = genomic DNA

SEQ ID NO: 123439 - DNA, 37 bp, Homo sapiens; identical to SEQ ID NO: 92227
  misc_feature 1..37: note = chr4:46806970-46807007
  misc_feature 1..37: note = Hypo
  source 1..37: mol_type = genomic DNA

SEQ ID NO: 123440 - DNA, 1569 bp, Homo sapiens
  misc_feature 1..1569: note = chr4:46994820-46996389
  misc_feature 1..1569: note = Hyper
  source 1..1569: mol_type = genomic DNA
ttgcgcgtttgaaatcgttcatacccccaaatccaggacgcagcctgttgtcataaccatcgagcaaactgtccaggatgcgggtgaaattttctgtgcacaatttctcctccttttggttctgtcctggggattcgtttaaactgcaagcgaaaaaaaaaaaaccgggggcggaggagattattttaagaatccatcagagaacaggtgcaaacaggtttgttttctagggaaagagtcgcttgccccaagctaaaggagaggaggttgggggttgggatgcagaagacagaaatggtcaggaaaagcgcgccccgccgcaagacccccagtgcccacacgcctcttggatcctgcgcccttggtgctctccgcatctatgcggtcacagaaaagcctggcttcggcccctgctcttacagctgagataagaagacctagtccacccagggaggagcgagtggccaaaggggtcccggagctagccatttctccactttccgttgcccacctcctcgcaccccagagaactcaccaaaccgccaggcacaggaagcgcaggagggcgaaactgaccccggcggacagagcgatcgcgggtaccttcttggcagaaaccatctttgcaacatgccatacttcaagcctgttcacgtttccaggctcttcagatgccctgagcagggtgcgaggagagggcagagaggctcccgcggcgtgcgcacactcgcgctcacactcgcccgcgctcagccagcccgagccgcggtgggcgtgtgtgtgcacggggccaggggaggcggaacctgccttcctcgccccctcctttctcgctcagcgctcaatgtgtatgtagagctatgtataccgctccacaccctttcgtgcccgcgcgctgaaggttctggggttcgtatccgcgcgcttgcgctgcaagactcggcaagtttgttccgactgtaactccggggatgaggaacggggtctctcgcccctcctccggcttcgcagcccccgaccccaagtgggctccccgcccacagcagtgttcgtcctcctacctcctggccccctcccttccgctgggatttggatctaaccaatgaagctcctctgtcatcaggttgtgcgaggacctgtttgtacccagagtcaaggttggaggtggagaaagggcgggtgacggggactgctgggcgtcgggtggtagcggtggtgaggagaggggatcaagtccgggctcaaaccacctttgagaccctcccattcaggtgttatggggggcggtagggagagcaatgaaagcagaaagattcttcctggtaacaggggttgcagctcacccggcggactctcgccaaactattgggaagtggactcgagccgcactctagtcccagtatttgctaagctattgctttaaagacaccccatttctttacccgcctccaccagacacgcgcacaccctccgctttgctgctccatccttttctggagaggaggggagaggtggagacaagcgacctctggtcaaaatcactttcacttcttgcgacactcttctttt

SEQ ID NO: 123441 - DNA, 57 bp, Homo sapiens; identical to SEQ ID NO: 92230
  misc_feature 1..57: note = chr4:47033544-47033601
  misc_feature 1..57: note = Hyper
  source 1..57: mol_type = genomic DNA

SEQ ID NO: 123442 - DNA, 965 bp, Homo sapiens
  misc_feature 1..965: note = chr4:47034011-47034976
  misc_feature 1..965: note = Hyper
  source 1..965: mol_type = genomic DNA
ggacttcggaggtaacgcttcatcttttttcaacctgtaacccatccttagttctccttttctgtcaaagataaatgtcaaaaaaaaaaaaagaaaaggcatgtcattttcgtaagcgtgcactataccctgggcacacacacacacacacacacacacacacacaccccgggtccccagtctcaggtggatgaatcctcaggcggaggcgaccttctcccgggccgacacaccctctgcatagtcactgcatcacgcgtgtgcccacacctgttttcccaggcagtcccctgaaaggggtggtggggggagcagggagggagcccgttaagaatggagtaagggctgggaagcccccagaccctccccagcctgctgtcactgagagaatctgttcctaatgtggcccacctccccggcagggccccccgtcgacgttgggatgcggatcgatgtcgccagcatagacatggtctccgaagtgaatatggtgagtggcctcccgaggggcccggcggttcggcttacgcagatgggaaatggacaggtccctttgccctctgcgtttcattggcggtcacctcgcccctggcccctgaggtcccactccgcacccgctccccgctccggcacacacacccggtcgcccctggtttgtaatttcgacacacacgggctactgcggtgttccaggggaaacgtgctcggcactattttgggaaggacgagtgactgttgcgccgtggatctgctggggcggagtctgagcgttactttagctgggtttccctgcgtgtttggatgaggagggcaccatctgctggcagccgggcggcctgcactagggtccccggaccggtggtcggcagccatcacctccccaggcgcggtgctggcaatccccatggccctcgcagtccgcgagcccggatgcaccaaggccctgccaccgagagcacagtctg

SEQ ID NO: 123443 - DNA, 263 bp, Homo sapiens; identical to SEQ ID NO: 92234
  misc_feature 1..263: note = chr4:47839267-47839530
  misc_feature 1..263: note = Hyper
  source 1..263: mol_type = genomic DNA

SEQ ID NO: 123444 - DNA, 38 bp, Homo sapiens; identical to SEQ ID NO: 92235
  misc_feature 1..38: note = chr4:47915048-47915086
  misc_feature 1..38: note = Hypo
  source 1..38: mol_type = genomic DNA

SEQ ID NO: 123445 - DNA, 92 bp, Homo sapiens; identical to SEQ ID NO: 92236
  misc_feature 1..92: note = chr4:48378917-48379009
  misc_feature 1..92: note = Hypo
  source 1..92: mol_type = genomic DNA

SEQ ID NO: 123446 - DNA, 1231 bp, Homo sapiens
  misc_feature 1..1231: note = chr4:48485255-48486486
  misc_feature 1..1231: note = Hyper
  source 1..1231: mol_type = genomic DNA
agaaccacttactggcgattcacaggaggggaccgggcggcagggcggggcggggcctgcggggcgcggggccgcggcgcggagccggcgcagcgattgggttcacccggggggccgcgctgcgcggagtgccaggctgcgggcggctgcagacctgggagcggagaccggcccgccgcccccgacgccgccgagcacgtcagcggcgcgcagccggggctcggagaccgacgggcagaacgacgggcggcgactgcggcgaccgcgggacggcgagaggcacgcggcgggaggggaccggaatccgcagctccggccgcgccatggacggcaacgacaacgtgaccctgctcttcgcccctctgctgcgggacaactacaccctggcgcccaatgccagcagcctgggccccggcacggacctcgccctcgcccctgcctccagcgccggccccggccctgggctcagcctcgggccgggtccgagcttcggcttcagccccggccccactccgaccccggagcccacgaccagcggcctcgcgggcggcgcggcgagccacggcccttccccgttccctcggccctgggcgccccacgcgctcccgttctgggacacgccgctgaaccacgggctgaacgtgttcgtgggcgccgccctgtgcatcaccatgctgggcctgggctgcacggtggacgtgaaccacttcggggcgcacgtccgtcggcccgtgggcgcgctgctggcagcgctctgccagttcggcctcctgccgctgctggccttcctgctggccctcgccttcaagctggacgaggtggccgccgtggcggtgctcctgtgtggctgctgtcccggcggcaatctctccaatcttatgtccctgctggttgacggcgacatgaacctcaggtacggatctgtctattccttgggcatctgtctcatcccagacgcgcgtttacggccgtgggctcacgacgaaggacagaggcagtggaggggttggaattaggcgtggaggaaggaggagaaaaggagaggaagttgatgacgccccggctttagaagtcaaggccgacctgcaggttgtgctgctaggggagcaagctagacggcgagggagctgctccaaggctgggattccatgcgcagcgcggcccttcagcagggtccctcgccgtcctccccgagcgtcggggtggcagcgcaggtcgttgtccagtggaa

SEQ ID NO: 123447 - DNA, 1097 bp, Homo sapiens
  misc_feature 1..1097: note = chr4:48492180-48493277
  misc_feature 1..1097: note = Hyper
  source 1..1097: mol_type = genomic DNA
cggtggcaggaagggcgtggagggcggtgcagcgtgcgagcccccgccgagggccatccccgcctccgctcggccgcccgggcaagtcgcctatttagggtgcggcggcgggcgggagcagtgcgcccatggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctgcgacgtggcggtgcaggtgagcccgcgcatcgacgccgcggtacagtgctcgctggggaggcgcacgctgcagcgccgggcccgcgaccccgagtccccggccggccccggggccgagggcaccacgggtggcggctctttctcccagcagccatcccgtcgaggcctggagcagggcagcccccagaacggcgccccgcggcccatgcgcttcccgcgcaccgtcgccgtgtactcgcccctggccttgcgccgtctcaccgccttcctggaggggcccgggcccgcggcgggcgagcagaggtccggggcgtcggacggagagagggggccgccgcccgcgcggcttcaaggcccagaggagggggaggtgtggacgaagaaggcgccccggcggccgcagtccgacgacgacggcgaggcccaggccgcagtccgagcgagctgggagcagccggccgacggtcccgagctgccgccgcgagaggcccaggagggcgaggcggctccgcggtcggcgctaaggagcccggggcaacctccgtcggcggggagggcccgagacggcggcgacggacgggaggcggccgtcgcgggagaggggccgtcgccacggagcccggagctgggcaaggagcggctgcgcttccaggtaaag

SEQ ID NO: 123448 - DNA, 30 bp, Homo sapiens; identical to SEQ ID NO: 92262
  misc_feature 1..30: note = chr4:48946783-48946813
  misc_feature 1..30: note = Hypo
  source 1..30: mol_type = genomic DNA

SEQ ID NO: 123449 - DNA, 213 bp, Homo sapiens; identical to SEQ ID NO: 28916
  misc_feature 1..213: note = chr4:48987912-48988125
  misc_feature 1..213: note = Hyper
  source 1..213: mol_type = genomic DNA

SEQ ID NO: 123450 - DNA, 68 bp, Homo sapiens; identical to SEQ ID NO: 28917
  misc_feature 1..68: note = chr4:48988465-48988533
  misc_feature 1..68: note = Hyper
  source 1..68: mol_type = genomic DNA

SEQ ID NO: 123451 - DNA, 39 bp, Homo sapiens; identical to SEQ ID NO: 92269
  misc_feature 1..39: note = chr4:52708566-52708605
  misc_feature 1..39: note = Hyper
  source 1..39: mol_type = genomic DNA

SEQ ID NO: 123452 - DNA, 23 bp, Homo sapiens
  misc_feature 1..23: note = chr4:52892709-52892732
  misc_feature 1..23: note = Hypo
  source 1..23: mol_type = genomic DNA
atcgcgcccggcctaaattgctt

SEQ ID NO: 123453 - DNA, 140 bp, Homo sapiens; identical to SEQ ID NO: 92271
  misc_feature 1..140: note = chr4:52917545-52917685
  misc_feature 1..140: note = Hyper
  source 1..140: mol_type = genomic DNA

SEQ ID NO: 123454 - DNA, 123 bp, Homo sapiens; identical to SEQ ID NO: 92272
  misc_feature 1..123: note = chr4:52917964-52918087
  misc_feature 1..123: note = Hyper
  source 1..123: mol_type = genomic DNA

SEQ ID NO: 123455 - DNA, 159 bp, Homo sapiens; identical to SEQ ID NO: 92273
  misc_feature 1..159: note = chr4:53617401-53617560
  misc_feature 1..159: note = Hyper
  source 1..159: mol_type = genomic DNA

SEQ ID NO: 123456 - DNA, 106 bp, Homo sapiens; identical to SEQ ID NO: 92274
  misc_feature 1..106: note = chr4:53617801-53617907
  misc_feature 1..106: note = Hyper
  source 1..106: mol_type = genomic DNA

SEQ ID NO: 123457 - DNA, 960 bp, Homo sapiens; identical to SEQ ID NO: 92275
  misc_feature 1..960: note = chr4:53728037-53728997
  misc_feature 1..960: note = Hyper
  source 1..960: mol_type = genomic DNA

SEQ ID NO: 123458 - DNA, 30 bp, Homo sapiens; identical to SEQ ID NO: 92278
  misc_feature 1..30: note = chr4:54858212-54858242
  misc_feature 1..30: note = Hypo
  source 1..30: mol_type = genomic DNA

SEQ ID NO: 123459 - DNA, 40 bp, Homo sapiens; identical to SEQ ID NO: 92279
  misc_feature 1..40: note = chr4:54957438-54957478
  misc_feature 1..40: note = Hyper
  source 1..40: mol_type = genomic DNA

SEQ ID NO: 123460 - DNA, 1712 bp, Homo sapiens; identical to SEQ ID NO: 92280
  misc_feature 1..1712: note = chr4:54965799-54967511
  misc_feature 1..1712: note = Hyper
  source 1..1712: mol_type = genomic DNA

SEQ ID NO: 123461 - DNA, 24 bp, Homo sapiens
  misc_feature 1..24: note = chr4:54969747-54969771
  misc_feature 1..24: note = Hyper
  source 1..24: mol_type = genomic DNA
gagtgttgtctttagcgcgcgcgc

SEQ ID NO: 123462 - DNA, 684 bp, Homo sapiens; identical to SEQ ID NO: 28926
  misc_feature 1..684: note = chr4:54969831-54970515
  misc_feature 1..684: note = Hyper
  source 1..684: mol_type = genomic DNA

SEQ ID NO: 123463 - DNA, 480 bp, Homo sapiens
  misc_feature 1..480: note = chr4:54975768-54976248
  misc_feature 1..480: note = Hyper
  source 1..480: mol_type = genomic DNA
atattaatagtgtggcgaaagttttttgtgtgcgtgtccttttctaggtcgggggtggggaggggcggtgggtggacgcagagggaggaaggctcagccttggatccttgccacctgaacaacgtcgcctctgcccacgtggaaagcctcgcttgtctggcagccggggttctgaatggttgccgcgacccctgcgctcccagcagggccaagaggacctcgcgggcaccagcgtccgggcgggaagggacgtgtgcccaagcctcgcctcctggccctcagtgggctgggacgcccttgatcaccggcgcaggaaagaggctccccagcccgtgagcttcgtccgggcgccagggcagggatggctggtggtgtgcactggagagcacgacggtgacgctgcgtgggaaagagacgtgggaagggcatagccggattatccactcagctccaattttctccaagcgccactcaccccac

SEQ ID NO: 123464 - DNA, 22 bp, Homo sapiens
  misc_feature 1..22: note = chr4:55012635-55012657
  misc_feature 1..22: note = Hypo
  source 1..22: mol_type = genomic DNA
ttttttcagagggagcgtcgct

SEQ ID NO: 123465 - DNA, 1228 bp, Homo sapiens
  misc_feature 1..1228: note = chr4:55092907-55094135
  misc_feature 1..1228: note = Hyper
  source 1..1228: mol_type = genomic DNA
aggggagaaaagacccgcagcccgcctcaggagggcaaggtttctagccccctgcggctccgggaccacccaggacccggggcgtcgtgggaccgatctcgaaggatcttagaacgacactgggagagcgcggcaagaactagccccaccttcccccgacgccccggactgactgccgggcgcagacccgacttctcccgaaccagcctcggaccagccttagaaggcggaaaacaggattcaaacccgcctatgagcagtggtaggggcgggggctgtgggggcaggactcggtttaaggaaccaaccgcctcggttcgagggcctcctgtccggaggttgctcctgaccactgggtttattttgcttttgcagaggaggcagatgttgacctctcttctttgcacagtctctccgcaaaattttcccccaaccatttgctttcttgcgccaccccccaccggggcactatccctggagtcagctcctcaggcctttaaaccttccagaatgtcacacatggaaacctttagcaaatgtttgttaatgatcataacaaaggcatcattcaaattaggcaggtaattactaccagaaggacaactgggtgctcgcttgctcatccattgctttctgctttaaactcccgaggagtcgctgcctggagacactcccgcccggactgcttctcgggccccattaaacggctctgaaatgaactgtgaagttaccatttgtgggcggagagcgctggggccctgcggacggaagaccctggcttgaccggactaacagtgtcgccgaagcaaagcagcccctctgggtaggctgtctgtctcgcctcctaccctctggggcaactagcctaaaaacccggttctcaacttaacagcatgtggcccagcacccgcttttgccttttattccgcactctgatttttggggggatcgtttgttcccgctcattttctacaaacattacggtatcctgttagcattccgaacaaggggctgttcatatatttgccttcaatgatttcctgaagggacatgtggaagtaatagcgagcggtgcagtcacccaagctgaagatgcacgagagcgggtcgcgtagaagaactgcggcaatgggacccccagcgcagccccaggcgccctgttttcgaggctgacatcccaagatcctgtcctggttaggcacagcaccgcgcccgttggagtacttct

SEQ ID NO: 123466 - DNA, 170 bp, Homo sapiens; identical to SEQ ID NO: 92290
  misc_feature 1..170: note = chr4:55094514-55094684
  misc_feature 1..170: note = Hyper
  source 1..170: mol_type = genomic DNA

SEQ ID NO: 123467 - DNA, 58 bp, Homo sapiens; identical to SEQ ID NO: 28934
  misc_feature 1..58: note = chr4:55096214-55096272
  misc_feature 1..58: note = Hyper
  source 1..58: mol_type = genomic DNA

SEQ ID NO: 123468 - DNA, 103 bp, Homo sapiens; identical to SEQ ID NO: 28935
  misc_feature 1..103: note = chr4:55096538-55096641
  misc_feature 1..103: note = Hyper
  source 1..103: mol_type = genomic DNA

SEQ ID NO: 123469 - DNA, 60 bp, Homo sapiens; identical to SEQ ID NO: 28936
  misc_feature 1..60: note = chr4:55097404-55097464
  misc_feature 1..60: note = Hyper
  source 1..60: mol_type = genomic DNA

SEQ ID NO: 123470 - DNA, 976 bp, Homo sapiens
  misc_feature 1..976: note = chr4:55097812-55098788
  misc_feature 1..976: note = Hyper
  source 1..976: mol_type = genomic DNA
cgacaggcgcaaggccgaccaggctcgctttgacgccctggtcaggccctgcttcggagcttgcagttttgggttgacccaagtgcagctggacctcgttcacaagagtgaggggaagccaagaatgaacccgtcgttagcccccggtgccctggctcttgtttaaatccttagatcgagaaggacttgaaggagatcccaggctcccagctctgcgcccctgggccagtttcctctcgggacgcggactgaggagggatgcagggggaggggcattgggccgggctttccagctgcaaacacgtctggcgccgaggcgggcccattttgtgcctcctggggacggaccgtgggcggcgcgcagcggcgggacgcgttttggggacgtggtggccagcgccttcctgcagaccccacagggaagtactccctttgacctccggggagctgcgaccaggttatacgttgctggtggaaaagtgacaattctaggaaaagagctaaaagccggatcggtgaccgaaaggtgtgggtctcagggttccccgggtctaactcgccgggtccaaccgcagcatcagccttggggcggcagataatctttcggtctcgcctggggcgcaagatgcaggatcgggggcaaatggcttctcccaacttccccctaattcgggttctgccagatggttgtcgtttgctgaagtggctcggcggcatttccttttgttttaaactgatcaatgagcgaacctgggatgggctgaaaaagtagattgtaggagggaataatgggaaacccgacttggggcgcctccttccctgcctcctactgcagtttctcggcccccgcgaaaggggagcgacaagcgcgggtgggcgcggactcttgagggggcagaggcggctatggcgcgtgtcgggcaaggtggcaccagaaggcacttttgtgtgtgtgtgtgacaagagtctcgctctg

SEQ ID NO: 123471 - DNA, 436 bp, Homo sapiens; identical to SEQ ID NO: 92296
  misc_feature 1..436: note = chr4:55099028-55099464
  misc_feature 1..436: note = Hyper
  source 1..436: mol_type = genomic DNA

SEQ ID NO: 123472 - DNA, 278 bp, Homo sapiens; identical to SEQ ID NO: 92297
  misc_feature 1..278: note = chr4:55100066-55100344
  misc_feature 1..278: note = Hyper
  source 1..278: mol_type = genomic DNA

SEQ ID NO: 123473 - DNA, 214 bp, Homo sapiens; identical to SEQ ID NO: 92299
  misc_feature 1..214: note = chr4:55350697-55350911
  misc_feature 1..214: note = Hypo
  source 1..214: mol_type = genomic DNA

SEQ ID NO: 123474 - DNA, 184 bp, Homo sapiens; identical to SEQ ID NO: 92300
  misc_feature 1..184: note = chr4:55393636-55393820
  misc_feature 1..184: note = Hypo
  source 1..184: mol_type = genomic DNA

SEQ ID NO: 123475 - DNA, 33 bp, Homo sapiens; identical to SEQ ID NO: 92301
  misc_feature 1..33: note = chr4:55406440-55406473
  misc_feature 1..33: note = Hypo
  source 1..33: mol_type = genomic DNA

SEQ ID NO: 123476 - DNA, 36 bp, Homo sapiens; identical to SEQ ID NO: 92302
  misc_feature 1..36: note = chr4:55456469-55456505
  misc_feature 1..36: note = Hypo
  source 1..36: mol_type = genomic DNA

SEQ ID NO: 123477 - DNA, 328 bp, Homo sapiens; identical to SEQ ID NO: 92303
  misc_feature 1..328: note = chr4:55523645-55523973
  misc_feature 1..328: note = Hyper
  source 1..328: mol_type = genomic DNA

SEQ ID NO: 123478 - DNA, 74 bp, Homo sapiens; identical to SEQ ID NO: 92304
  misc_feature 1..74: note = chr4:55524220-55524294
  misc_feature 1..74: note = Hyper
  source 1..74: mol_type = genomic DNA

SEQ ID NO: 123479 - DNA, 839 bp, Homo sapiens; identical to SEQ ID NO: 92305
  misc_feature 1..839: note = chr4:55524518-55525357
  misc_feature 1..839: note = Hyper
  source 1..839: mol_type = genomic DNA

SEQ ID NO: 123480 - DNA, 227 bp, Homo sapiens; identical to SEQ ID NO: 92306
  misc_feature 1..227: note = chr4:55990946-55991173
  misc_feature 1..227: note = Hyper
  source 1..227: mol_type = genomic DNA

SEQ ID NO: 123481 - DNA, 39 bp, Homo sapiens; identical to SEQ ID NO: 92307
  misc_feature 1..39: note = chr4:55991454-55991493
  misc_feature 1..39: note = Hyper
  source 1..39: mol_type = genomic DNA

SEQ ID NO: 123482 - DNA, 358 bp, Homo sapiens
  misc_feature 1..358: note = chr4:55991863-55992221
  misc_feature 1..358: note = Hyper
  source 1..358: mol_type = genomic DNA
cctcacccgggtacccggcggcgatctccagctccccaagcccatttacatctccccatttccccacacaactggactgcgctgggccccaagtcgcccaggagagaacatcccagagcaacaactttgtttctggtgtaaataaaaagtactcggtaacgggcgctgagcaactccaagatttaatcgcttgccggtccccgaaatttggggagcatcaccaggagcgctgcgaagagcagcgctccctcaccaggcgcgtcaaagtgcaggaccctcttcgccatcgcgcgcgtctgaagtggccgagaatctgcagcagtttggagccacaagggagaagcggatactcagccaa

SEQ ID NO: 123483 - DNA, 23 bp, Homo sapiens
  misc_feature 1..23: note = chr4:56213501-56213524
  misc_feature 1..23: note = Hypo
  source 1..23: mol_type = genomic DNA
agatgcatcttaggccgggcgca

SEQ ID NO: 123484 - DNA, 30 bp, Homo sapiens; identical to SEQ ID NO: 92311
  misc_feature 1..30: note = chr4:56422506-56422536
  misc_feature 1..30: note = Hypo
  source 1..30: mol_type = genomic DNA

SEQ ID NO: 123485 - DNA, 121 bp, Homo sapiens; identical to SEQ ID NO: 92312
  misc_feature 1..121: note = chr4:56501604-56501725
  misc_feature 1..121: note = Hyper
  source 1..121: mol_type = genomic DNA

SEQ ID NO: 123486 - DNA, 37 bp, Homo sapiens; identical to SEQ ID NO: 92313
  misc_feature 1..37: note = chr4:56502430-56502467
  misc_feature 1..37: note = Hyper
  source 1..37: mol_type = genomic DNA

SEQ ID NO: 123487 - DNA, 61 bp, Homo sapiens; identical to SEQ ID NO: 92314
  misc_feature 1..61: note = chr4:56503474-56503535
  misc_feature 1..61: note = Hyper
  source 1..61: mol_type = genomic DNA

SEQ ID NO: 123488 - DNA, 476 bp, Homo sapiens
  misc_feature 1..476: note = chr4:56659621-56660097
  misc_feature 1..476: note = Hyper
  source 1..476: mol_type = genomic DNA
agtggcgagtgggcacggctctcgggagagggaaggcagcgattccaggagtcggggtcgcctcgctgcgatggcaggttcagcttcggttcactaatcgcaaccagccccaccgcgggagacggggagagccctggctgctgcaggccggcacctgggtagatgttaccttttcccgcacagggtcagtccacagacgtgcaccagcaccccggcgaccggtcacagccttcccctcgccccgggcgggcgcggcctcagggagccctcagggcttggggccaggaccatggccatccacgcgcttcggcctcgcactccccgggtatgctgcgggccctctccatccggggaggcggggtccggggaggacacatccccggcccggcctctccgagagaccctttggatttttctcttccacaccgcctcatccgaggggagccccccaccccacaccccgcagtgatctgggg

SEQ ID NO: 123489 - DNA, 30 bp, Homo sapiens; identical to SEQ ID NO: 92320
  misc_feature 1..30: note = chr4:56936174-56936204
  misc_feature 1..30: note = Hypo
  source 1..30: mol_type = genomic DNA

SEQ ID NO: 123490 - DNA, 44 bp, Homo sapiens; identical to SEQ ID NO: 92324
  misc_feature 1..44: note = chr4:57063851-57063895
  misc_feature 1..44: note = Hypo
  source 1..44: mol_type = genomic DNA

SEQ ID NO: 123491 - DNA, 48 bp, Homo sapiens; identical to SEQ ID NO: 92330
  misc_feature 1..48: note = chr4:57180924-57180972
  misc_feature 1..48: note = Hypo
  source 1..48: mol_type = genomic DNA

SEQ ID NO: 123492 - DNA, 79 bp, Homo sapiens; identical to SEQ ID NO: 92331
  misc_feature 1..79: note = chr4:57182183-57182262
  misc_feature 1..79: note = Hypo
  source 1..79: mol_type = genomic DNA

SEQ ID NO: 123493 - DNA, 24 bp, Homo sapiens
  misc_feature 1..24: note = chr4:57252055-57252079
  misc_feature 1..24: note = Hypo
  source 1..24: mol_type = genomic DNA
gagccaccgcgcccggccgagtca

SEQ ID NO: 123494 - DNA, 101 bp, Homo sapiens; identical to SEQ ID NO: 92333
  misc_feature 1..101: note = chr4:57252411-57252512
  misc_feature 1..101: note = Hypo
  source 1..101: mol_type = genomic DNA

SEQ ID NO: 123495 - DNA, 30 bp, Homo sapiens; identical to SEQ ID NO: 92334
  misc_feature 1..30: note = chr4:57370899-57370929
  misc_feature 1..30: note = Hypo
  source 1..30: mol_type = genomic DNA

SEQ ID NO: 123496 - DNA, 417 bp, Homo sapiens
  misc_feature 1..417: note = chr4:57371618-57372035
  misc_feature 1..417: note = Hyper
  source 1..417: mol_type = genomic DNA
aggttgcttagactgcggcccacgtggaaggctcttagccaccctgcctggcccgaggtaatcgcgctagggacgctttttctgcagcaatgatataccccgccgaactgtcccacgtcctggttgggacctcttggtttcgcttggctgggctcaatccatccgtacgcctccgcccttccctctttgcgaacccctgcgggttcagcgaatcggctgcaagaagccctgcatccgcgaggtaagcggcggttggcggcggtgccggggttggcagcgcccgcgggttgtctacgccgcggggcctacgtctctgtcgggcgtgcacctcgggagccacacctggggcccagagccaccgctcagcacgcgggcacgcggcgggagggaaggaaaccgcggcgctggggatggaga

SEQ ID NO: 123497 - DNA, 217 bp, Homo sapiens; identical to SEQ ID NO: 92337
  misc_feature 1..217: note = chr4:57372287-57372504
  misc_feature 1..217: note = Hyper
  source 1..217: mol_type = genomic DNA

SEQ ID NO: 123498 - DNA, 866 bp, Homo sapiens; identical to SEQ ID NO: 92338
  misc_feature 1..866: note = chr4:57396459-57397325
  misc_feature 1..866: note = Hyper
  source 1..866: mol_type = genomic DNA

SEQ ID NO: 123499 - DNA, 1434 bp, Homo sapiens
  misc_feature 1..1434: note = chr4:57521381-57522815
  misc_feature 1..1434: note = Hyper
  source 1..1434: mol_type = genomic DNA
aattttttaaaaaatcggaaccaaatctccgtggcttcgtgcagcgtgagttctgcagctcgggggacgctgcagtgtgatgtggtggagagagcatgcttcaccgctcctgccatcctgacagcgccctccctcccggcctcagcctcctggttcgccaaaccggaggactgaatttatggctagctggtctctggggcgccttccagctctgacattcccgcctagaatagatcttcccgaaggtttcgcagacagaccagaggggaccgagccgggaaggcgagacagggacaggcgagagacgctgctcccaactcgcagagggagaaagcgtgtatcccgggctgccggggagagtggaaaagaaaggactggtgaccgaggggtttctgcgcagctcccggggaaccacggctggatgggggtggcggggagaccgggcgcccatgggagcggggaagcggggaggcggcggcgggagccatgcagggtctgggcccctgggatgcgggcagaagcgatgggagatcatggggagggcagcccggcgggaggcgcggacgaacaggaccgcccagccgcgagaaggctcagcccaggcaggggtcggggcgcgctgggcgcgtgtggggacgcacctgggtctcctcctcggaaaggcctgcctcggccgcgatgaggcacagcgtggtggaatccgggtgcttgtcgaccttgttgaagttgtactccaggatttccacctggtcctctgtggggccgctcgcggtctccgccgacatggtccctgcgcgctgcggggcagggagaagcggcggcggtgagcgaggcgtggagcgggcgggacgcagcgaaggaaggcggtcgcggcgccgccgggcagccccagccccaggccgccccctccagcggtgccacggccgcgcaagtccccggtggctgcacgctgagcgggggcttacggctgccccccacccgggcctccctccctggactgagcgctgttgcgggctgacggcagagcctagcgtcctgcgcctcccgcgccccccgggaccccttgcaggaactgtatccctgcctgcgacgggggcgagatagatgattccgcgggccctcaccgacctccggctctaaggaaggagtgaaggaagcgcgggggtgattttgagaaatccccttaaaaacttcctcccgaaagggggacctcccctggggacagacttgacagatcgcgagggtgggttcgcccgagtccgcgactagccggcctccggcctccccggtaggcggccttctgtctccgcagtgggttggcgctttggggccctctccaggcagggctgcacaccccacccttcctccaaaaaagttccccgcaagacaagttacttctcaaagttggggagacggaggcggtgcttttaatgt

SEQ ID NO: 123500 - DNA, 249 bp, Homo sapiens; identical to SEQ ID NO: 92343
  misc_feature 1..249: note = chr4:57687638-57687887
  misc_feature 1..249: note = Hyper
  source 1..249: mol_type = genomic DNA

SEQ ID NO: 123501 - DNA, 95 bp, Homo sapiens; identical to SEQ ID NO: 92344
  misc_feature 1..95: note = chr4:57775782-57775877
  misc_feature 1..95: note = Hyper
  source 1..95: mol_type = genomic DNA

SEQ ID NO: 123502 - DNA, 39 bp, Homo sapiens; identical to SEQ ID NO: 92345
  misc_feature 1..39: note = chr4:57777437-57777476
  misc_feature 1..39: note = Hypo
  source 1..39: mol_type = genomic DNA

SEQ ID NO: 123503 - DNA, 30 bp, Homo sapiens; identical to SEQ ID NO: 92346
  misc_feature 1..30: note = chr4:57803508-57803538
  misc_feature 1..30: note = Hypo
  source 1..30: mol_type = genomic DNA

SEQ ID NO: 123504 - DNA, 135 bp, Homo sapiens; identical to SEQ ID NO: 92347
  misc_feature 1..135: note = chr4:57906901-57907036
  misc_feature 1..135: note = Hypo
  source 1..135: mol_type = genomic DNA

SEQ ID NO: 123505 - DNA, 1330 bp, Homo sapiens
  misc_feature 1..1330: note = chr4:57975777-57977107
  misc_feature 1..1330: note = Hyper
  source 1..1330: mol_type = genomic DNA
ttctacatatacacccggccctcactttctggacgcacgcagcaaactctcaaaataaaaccaccaaaaaggagaagggggggcgtcgcccaccgctcctggcattccgcggctgccaactctttccctcccatctggctcctgggatgcccgcgggggaatcgcagtgagcagcgcggggcgaggccgccgcggacgccccgtcggatgtgcccttcgctgggccgagcggcgcagggttggagagggaagcgctcgtgcccaccttgctcgcaggtgcccttgctgacctgggtgatggccttctccccgcggctctcggccctctggctggcggcgcgcagctggcagccgctcgggtaggtggtgccgtcgctgccgcacaccgggtagcggctcttgcacacgcacacgccgcttacacccggaccgccggctgctgccccggctttacccttccgcctcttgcggctcttcacgcactccatgcccggcgcgcagtaccccctgccggcgccgccacccccgcacggctcgccctcgccgcgggcgcacatagggcagcagccgcacgcgtcgcgggtctcgcccagcaggcagcccagcgggggcaggggcgggcaggaggccggctcgcaggggccgcaggtgtccgaagaggaggaagaggagaggggcaggagcaggagcagcagcccagcggcgccgaggagcagggcgcgcagcgacggccgctccatggcggggtgcggtggcagcggcaagggcgcgagtgagccgtgtcgggccggccggcgccttaaacccgccgccccgcccggcctgtccgcgggaaccacaccccggggcggtgagagcacgggggccccgcccgtgccgccctcccggccccgcggggcctgcgcgcgcgctcctgctggcgtcggggggtgagcgggcacccggcgtgaccggcccatgggcgctcggtctcacgcccgcttcgcagagctcaccccgccagctcctgctcggtccccagtcccctgccccgagccctcagggatcgcaccgcagtgcgagcggctcttccaccctctggtttctccccgtttccggtcaatatatttaaacttcttaacaaccacggcttcgagacgatccagggtttcatctattaaatcctccgtgggcctgagacacctgagtgctcattactctgtggtttgggaagctctcttaagaacaagctgttaaaaacccccacttgtggactgtgtccccgctggccacaggcctgctgtggtcttgggtgtcaagcactaaaaggacaaaccgttgccaaccactt

SEQ ID NO: 123506 - DNA, 30 bp, Homo sapiens; identical to SEQ ID NO: 92350
  misc_feature 1..30: note = chr4:57977334-57977364
  misc_feature 1..30: note = Hyper
  source 1..30: mol_type = genomic DNA

SEQ ID NO: 123507 - DNA, 30 bp, Homo sapiens; identical to SEQ ID NO: 92360
  misc_feature 1..30: note = chr4:60685051-60685081
  misc_feature 1..30: note = Hypo
  source 1..30: mol_type = genomic DNA

SEQ ID NO: 123508 - DNA, 16 bp, Homo sapiens
  misc_feature 1..16: note = chr4:61380678-61380694
  misc_feature 1..16: note = Hypo
  source 1..16: mol_type = genomic DNA
gaagcagtctggatgc

SEQ ID NO: 123509 - DNA, 1821 bp, Homo sapiens
  misc_feature 1..1821: note = chr4:62065803-62067624
  misc_feature 1..1821: note = Hyper
  source 1..1821: mol_type = genomic DNA
cgaggcgggcctcgaagccactggagaggtaccctttgtctgacaaaccctgaaagggaagcctctagtagcagccctcccgttcccacctccaagcgtttgccgaactgctaggtggagcccgcgccgcggagcccacgagcactccatatccgggttttgccggccacccctttccctggcgcgagccccctccccggctctcggagctcttgccgctggcccgcccgaccgctgctcattctggcctccgctccggccccggctgcgcctaccccgcgcgcaggctgcacggtccccgcgcgcccgcgctctgacccgctgtctgcgcgtcgcccccctcgcctgctggcccggcaccgctcgctccagttcccaggagcggggatgcagatgctgcagctggtcggggtgggcgccgccgccgccgccgccgccgctgctgctggtttttctcggactgctcgttgcctccgctccggcagctgctgccgccgccaccgccgcctgtgactcgccccctcccctttctttcttctctttttgccttggtcctcttcctacgggtgtgcgcgcgcgcgggttgcacggtttgctttggcaggagctcgctcgtgtgtgcgcgtgtgtgagtgtgcgtgtctggagagcgccagtgcctcgctcgctcttggggagtcgaagaagagaaagaaccgaagagacagcggcggcggcgcagagcccggggccgcgcgatgaagctcccacatgcccgcagctgcccggcccggccggcgagctaatcatccaccccacgggctcggggttcgccggcccccgggacgcagccctcggcggccgggcgcccgctctgtctgcgcgccccctccgtgcaccggggaaggagtttgtgtggctctcgctccggctgtccgcggaggttgcgggcttgagaggggaccctcggctgggagagagcctcgggaggacgaagaggaggacggtttggcggagaagccacccctggccctcgcggctccccctacctattccatcgctcccgctccgaggcggaaaggggaggacgtggaagaagaaaaagaaagagaaggggggtggggtgggagaactggatataaagatcggctggggggatggtggaagatttttggtctcttcggcagcgtcttttcttaagcggcggcggcagcagcagcagcaagagaaggagaagcagccccagctatgactgccgcatgttaatagctgccgctgggtccctcggctgctgctggagacagagcctgactccgaagttgtgcaactgtggactgggagagacatttgaaccctcttttcttttcgctccccttttgcccccttggggtgtgtgaagcgaggaacgtaaaggaaggcgaacatttggctctctttttccttcccctttctccgtggctgtgtagcggaagaaagggaagagagactttttgttgttgtttccttgactggggtctccaccctcctgctgctttctctgcgcttcgattctcgttatttgccgcgtgtggttgggggtgtctgcacaggggccggccggtcttttgccccgggctcaatggctggattgtggaaactgcacccgccttcaggttgttgagcaactgatgggacgatctcagggaccggcgtttacgaaaggtaatttattcttcgcactcttcataataggggtcgccctggccgggcgcaggcggcggcatccaccgggcgggcaacaagagggggtgcggggtgcatgcacactcgcccttccactcacacactcgccctcacacacac

SEQ ID NO: 123510 - DNA, 522 bp, Homo sapiens
  misc_feature 1..522: note = chr4:62067873-62068395
  misc_feature 1..522: note = Hyper
  source 1..522: mol_type = genomic DNA
agggcgacttttctccgtcaggctggaactggtgccgctggaggcgggagcgggctggaggacggacagggtctgggtgagaagctgggctctgggaagatggaaaatgcagggtgccgagcccggcgcgattctccctcaacgcttgcctggagcatccctggccccttttgcccaggtcgcgcccctgagtcttggagtcgcgctgcctccccgcgccctgcctgttgtgtctccttcacggcagtttggtttagacctgcgtgcccaggctttgttaggcggttttggctggagaaagctgccactttcgtgggtggcccgggctgcgctgtgctggtagtgggcactgggcggggggcggcggtgttgcacgaatccgggcggccgcggcgccggggcggggtgggcagagcattggtggtcgcggttggcgggttacaggtaggagagaaggcacctcggcgcttctctgaggagaagggaaggctccaggctgcagcgcagcgtctgagctgccgc

SEQ ID NO: 123511 - DNA, 30 bp, Homo sapiens; identical to SEQ ID NO: 28967
  misc_feature 1..30: note = chr4:62068633-62068663
  misc_feature 1..30: note = Hyper
  source 1..30: mol_type = genomic DNA

SEQ ID NO: 123512 - DNA, 699 bp, Homo sapiens; identical to SEQ ID NO: 92395
  misc_feature 1..699: note = chr4:66533984-66534683
  misc_feature 1..699: note = Hyper
  source 1..699: mol_type = genomic DNA

SEQ ID NO: 123513 - DNA, 1742 bp, Homo sapiens
  misc_feature 1..1742: note = chr4:66534894-66536636
  misc_feature 1..1742: note = Hyper
  source 1..1742: mol_type = genomic DNA
ccactccttcaagcccgaaatgtcacttccccacgcgccttaagtgaggcccagccgcacccatccccctggaacgggcctccattccccaaaggaggcctcgacctcctttcccccaaggttttccaccttcccagccccccaaccagcctctgtccacacgcatgttccttgcccagcactccgcagctaacgtcaaacaatgcaaccaaaaaccgcagaggggagcgaaaaggccagtggaaggggacgacaaataccaatttgagatgagactgcgatttagtctgcagcagcagcgtccagcgcgctgagacctgaactcccaggccccgcctagcccctccgccccaggtcgccacggtccccacccccatctccctaccttcgttgctggggctggccaggagggtccggagtgcggcgcacaggagaaggcacgtccagaggggagcccgtcgaggtgcagagtagcagccggccagggacgctggggtgatgggggtgtcgccgccgccgcttgggggccgccggcgtcccgcaccccggggccccgagccccgcatcttctccgagcctcctccggtgccgctgtcccgagcggctcagtccaccgcttcggcctcgcagagcggcgaagggagactcgggagtcctccttgtccccccttggggtcctacgccttctggcacgcggctcctccaaatgtaggaaccacggatccggctgagacagctgaagtttgcttctggctcctctcgcctccccctttggtggggttaaatgaaatattagttctggttgctagtgcagatctggactcggatcaagggtgtcgagagggtcctgggtcctgttcctttgcctttcaaaaagactttttacggattgagaatttttaaataccactaggggaaaggtgaaggttctttgcagccttcagtgttgaaatggacgaaggtaaggaaggcaaatcattttaagacgaaatctccgattttttaaaaaaggaggaaaaaagcagggtggctaaggataaagaaagaggacttgagaaaatgtggagaatgaaaaacaggagagcagcgagcaaaagcaaagatccagagttcaaagagactggcagaaggaaatagctgcgggctgagtgctgaagaggggagggactgacggctgccggccggtaggagcgcggagctgcgctgcggcggcccaggagctgctgcggttcccgctgctcggggagcaggcggtgtgtgcgcggctgcgaagtcgaggttgaaactgcaccgccaaggcgcgctcctgctgtgtctggagctccggcgtctcctctgcctcccagctcagcgcctcccaccctccttccctcctcctcttcccagctcccccgccctctgctgctcgcagcctcgccagtgagaatctactgtaagtgtgagttgcttcgacgaagtcacacacccacggagggaagtaatctggaggctgccttggtgagtgttgcctagcggtctccgggaaaggcgcgtcttcctcccgggataattagggcaaggaatcctgacgacgctggcgaggactggggttcccgggaggcggaagggagatcagccccagctcagccggcggcccttagagacgcgggtccctccgtttggcatcttgcctgctgtccctcacaggctgtggcatcaacaaccttgtcgtcacatcgccgcgcattcgcaggctctgctgg

SEQ ID NO: 123514 - DNA, 228 bp, Homo sapiens; identical to SEQ ID NO: 28972
  misc_feature 1..228: note = chr4:71600396-71600624
  misc_feature 1..228: note = Hyper
  source 1..228: mol_type = genomic DNA

SEQ ID NO: 123515 - DNA, 25 bp, Homo sapiens
  misc_feature 1..25: note = chr4:71925563-71925588
  misc_feature 1..25: note = Hypo
  source 1..25: mol_type = genomic DNA
gctcctcccccgaggtttgctcgtt

SEQ ID NO: 123516 - DNA, 237 bp, Homo sapiens; identical to SEQ ID NO: 92424
  misc_feature 1..237: note = chr4:72226735-72226972
  misc_feature 1..237: note = Hypo
  source 1..237: mol_type = genomic DNA

SEQ ID NO: 123517 - DNA, 264 bp, Homo sapiens; identical to SEQ ID NO: 92430
  misc_feature 1..264: note = chr4:73433899-73434163
  misc_feature 1..264: note = Hyper
  source 1..264: mol_type = genomic DNA

SEQ ID NO: 123518 - DNA, 439 bp, Homo sapiens; identical to SEQ ID NO: 92431
  misc_feature 1..439: note = chr4:73434804-73435243
  misc_feature 1..439: note = Hyper
  source 1..439: mol_type = genomic DNA

SEQ ID NO: 123519 - DNA, 32 bp, Homo sapiens; identical to SEQ ID NO: 40297
  misc_feature 1..32: note = chr4:74468507-74468539
  misc_feature 1..32: note = Hypo
  source 1..32: mol_type = genomic DNA

SEQ ID NO: 123520 - DNA, 194 bp, Homo sapiens
  misc_feature 1..194: note = chr4:74702331-74702525
  misc_feature 1..194: note = Hyper
  source 1..194: mol_type = genomic DNA
gagtttcctgccagtcgggagggatgaatgcagataaagggagtgcagaaggcacgaggaaaccaaagtgctctgtatcctccagtctccgcgcctccacccagctcaggaacccgcgaaccctctcttgaccactatgagcctcccgtccagccgcgcggcccgtgtcccgggtccttcgggctccttgtgcg

SEQ ID NO: 123521 - DNA, 497 bp, Homo sapiens; identical to SEQ ID NO: 92439
  misc_feature 1..497: note = chr4:74809854-74810351
  misc_feature 1..497: note = Hyper
  source 1..497: mol_type = genomic DNA

SEQ ID NO: 123522 - DNA, 458 bp, Homo sapiens; identical to SEQ ID NO: 92440
  misc_feature 1..458: note = chr4:74903976-74904434
  misc_feature 1..458: note = Hyper
  source 1..458: mol_type = genomic DNA

SEQ ID NO: 123523 - DNA, 30 bp, Homo sapiens; identical to SEQ ID NO: 92441
  misc_feature 1..30: note = chr4:75200375-75200405
  misc_feature 1..30: note = Hypo
  source 1..30: mol_type = genomic DNA

SEQ ID NO: 123524 - DNA, 30 bp, Homo sapiens; identical to SEQ ID NO: 92443
  misc_feature 1..30: note = chr4:75230457-75230487
  misc_feature 1..30: note = Hyper
  source 1..30: mol_type = genomic DNA

SEQ ID NO: 123525 - DNA, 394 bp, Homo sapiens; identical to SEQ ID NO: 92444
  misc_feature 1..394: note = chr4:75230736-75231130
  misc_feature 1..394: note = Hyper
  source 1..394: mol_type = genomic DNA

SEQ ID NO: 123526 - DNA, 29 bp, Homo sapiens
  misc_feature 1..29: note = chr4:75241002-75241031
  misc_feature 1..29: note = Hypo
  source 1..29: mol_type = genomic DNA
taaagtaatgactagcgattctttttttt

SEQ ID NO: 123527 - DNA, 148 bp, Homo sapiens; identical to SEQ ID NO: 40299
  misc_feature 1..148: note = chr4:75241331-75241479
  misc_feature 1..148: note = Hypo
  source 1..148: mol_type = genomic DNA

SEQ ID NO: 123528 - DNA, 66 bp, Homo sapiens; identical to SEQ ID NO: 92449
  misc_feature 1..66: note = chr4:75858458-75858524
  misc_feature 1..66: note = Hyper
  source 1..66: mol_type = genomic DNA

SEQ ID NO: 123529 - DNA, 79 bp, Homo sapiens; identical to SEQ ID NO: 92450
  misc_feature 1..79: note = chr4:75858919-75858998
  misc_feature 1..79: note = Hyper
  source 1..79: mol_type = genomic DNA

SEQ ID NO: 123530 - DNA, 65 bp, Homo sapiens; identical to SEQ ID NO: 92451
  misc_feature 1..65: note = chr4:75859363-75859428
  misc_feature 1..65: note = Hyper
  source 1..65: mol_type = genomic DNA

SEQ ID NO: 123531 - DNA, 19 bp, Homo sapiens
  misc_feature 1..19: note = chr4:76394243-76394262
  misc_feature 1..19: note = Hypo
  source 1..19: mol_type = genomic DNA
ccagcatcctgttcccgta

SEQ ID NO: 123532 - DNA, 574 bp, Homo sapiens
  misc_feature 1..574: note = chr4:76555331-76555905
  misc_feature 1..574: note = Hyper
  source 1..574: mol_type = genomic DNA
aactagcaattccagcgctgttgtgatttcttctgcggacgcagtcacgagtccagggcgaagcaggcagggaggcaggtgggcctcggtccgccgcaagctcacacttaggaggaccacgggccgcatgctgtcgtcgtcaaggcaacgacctcactctgtccccaaccataggcacaaagtcttgggagacagatacggcccaggtcagaatgcgttcacggcaggcaccaacacctgtgaaggccaagggctagagagcaattagctgggtgagaggcaccacctcccagctcgtaaggcgcccagtacctggagcctgggaacctgcaccgctccaactacccctgggcgaaggcgttggccgcggagctgcaagggggggcggtttctcacccgccccgagagcgccaggcctcccttcttctgattggccgagccgagtcgtcacgagccatgattggctcagggccaaccaccccgccccttcacctagggctcggcccaggttctgctccctgacacgcagaggccctgcgtccccacacgccttggttctcgtcaggaggcgcct

SEQ ID NO: 123533 - DNA, 30 bp, Homo sapiens; identical to SEQ ID NO: 92459
  misc_feature 1..30: note = chr4:76860425-76860455
  misc_feature 1..30: note = Hypo
  source 1..30: mol_type = genomic DNA

SEQ ID NO: 123534 - DNA, 44 bp, Homo sapiens; identical to SEQ ID NO: 92460
  misc_feature 1..44: note = chr4:76912367-76912411
  misc_feature 1..44: note = Hypo
  source 1..44: mol_type = genomic DNA

SEQ ID NO: 123535 - DNA, 223 bp, Homo sapiens; identical to SEQ ID NO: 92461
  misc_feature 1..223: note = chr4:76912711-76912934
  misc_feature 1..223: note = Hypo
  source 1..223: mol_type = genomic DNA

SEQ ID NO: 123536 - DNA, 39 bp, Homo sapiens; identical to SEQ ID NO: 92462
  misc_feature 1..39: note = chr4:77156176-77156215
  misc_feature 1..39: note = Hypo
  source 1..39: mol_type = genomic DNA

SEQ ID NO: 123537 - DNA, 85 bp, Homo sapiens; identical to SEQ ID NO: 92463
  misc_feature 1..85: note = chr4:77172970-77173055
  misc_feature 1..85: note = Hyper
  source 1..85: mol_type = genomic DNA

SEQ ID NO: 123538 - DNA, 52 bp, Homo sapiens; identical to SEQ ID NO: 92464
  misc_feature 1..52: note = chr4:77227473-77227525
  misc_feature 1..52: note = Hyper
  source 1..52: mol_type = genomic DNA

SEQ ID NO: 123539 - DNA, 423 bp, Homo sapiens; identical to SEQ ID NO: 92465
  misc_feature 1..423: note = chr4:77228029-77228452
  misc_feature 1..423: note = Hyper
  source 1..423: mol_type = genomic DNA

SEQ ID NO: 123540 - DNA, 30 bp, Homo sapiens; identical to SEQ ID NO: 92469
  misc_feature 1..30: note = chr4:77488004-77488034
  misc_feature 1..30: note = Hypo
  source 1..30: mol_type = genomic DNA

SEQ ID NO: 123541 - DNA, 69 bp, Homo sapiens; identical to SEQ ID NO: 92471
  misc_feature 1..69: note = chr4:77610972-77611041
  misc_feature 1..69: note = Hyper
  source 1..69: mol_type = genomic DNA

SEQ ID NO: 123542 - DNA, 177 bp, Homo sapiens; identical to SEQ ID NO: 92472
  misc_feature 1..177: note = chr4:77818008-77818185
  misc_feature 1..177: note = Hyper
  source 1..177: mol_type = genomic DNA

SEQ ID NO: 123543 - DNA, 97 bp, Homo sapiens; identical to SEQ ID NO: 92473
  misc_feature 1..97: note = chr4:77818657-77818754
  misc_feature 1..97: note = Hyper
  source 1..97: mol_type = genomic DNA

SEQ ID NO: 123544 - DNA, 35 bp, Homo sapiens; identical to SEQ ID NO: 92474
  misc_feature 1..35: note = chr4:77819538-77819573
  misc_feature 1..35: note = Hyper
  source 1..35: mol_type = genomic DNA

SEQ ID NO: 123545 - DNA, 101 bp, Homo sapiens; identical to SEQ ID NO: 92475
  misc_feature 1..101: note = chr4:77869970-77870071
  misc_feature 1..101: note = Hyper
  source 1..101: mol_type = genomic DNA

SEQ ID NO: 123546 - DNA, 152 bp, Homo sapiens; identical to SEQ ID NO: 92478
  misc_feature 1..152: note = chr4:78584348-78584500
  misc_feature 1..152: note = Hypo
  source 1..152: mol_type = genomic DNA

SEQ ID NO: 123547 - DNA, 320 bp, Homo sapiens
  misc_feature 1..320: note = chr4:79472791-79473111
  misc_feature 1..320: note = Hyper
  source 1..320: mol_type = genomic DNA
tacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttgggtaagttcagcctcccggcgcgtccccgcgagcctcgcccacagccgcctgctgacgggtggcttggggaggtcgcggcgcctcgcccagttcccccg

SEQ ID NO: 123548 - DNA, 166 bp, Homo sapiens; identical to SEQ ID NO: 92487
  misc_feature 1..166: note = chr4:79689605-79689771
  misc_feature 1..166: note = Hypo
  source 1..166: mol_type = genomic DNA

SEQ ID NO: 123549 - DNA, 99 bp, Homo sapiens; identical to SEQ ID NO: 92488
  misc_feature 1..99: note = chr4:79861382-79861481
  misc_feature 1..99: note = Hypo
  source 1..99: mol_type = genomic DNA

SEQ ID NO: 123550 - DNA, 63 bp, Homo sapiens; identical to SEQ ID NO: 92489
  misc_feature 1..63: note = chr4:80329437-80329500
  misc_feature 1..63: note = Hypo
  source 1..63: mol_type = genomic DNA

SEQ ID NO: 123551 - DNA, 506 bp, Homo sapiens; identical to SEQ ID NO: 92491
  misc_feature 1..506: note = chr4:81106086-81106592
  misc_feature 1..506: note = Hyper
  source 1..506: mol_type = genomic DNA

SEQ ID NO: 123552 - DNA, 1676 bp, Homo sapiens
  misc_feature 1..1676: note = chr4:81123055-81124731
  misc_feature 1..1676: note = Hyper
  source 1..1676: mol_type = genomic DNA
ctcactaagcagggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaa

SEQ ID NO: 123553 - DNA, 1853 bp, Homo sapiens
  misc_feature 1..1853: note = chr4:81186703-81188556
  misc_feature 1..1853: note = Hyper
  source 1..1853: mol_type = genomic DNA
ataacagtctggggacgttgcccgtacagggaaattctctgttctcaaggaaattttcccttctcgggtttcctgaggttgaaatccagcgcgcacgtcattaatcattcactgaggtcggtccctcagtcaatggcaggtctgggtaagctaaagcgagcagttagctaacccttcctgccacggggatcctggggcgaaagaggacaactgggcggtcagttacatgtgctggtgtccagccgctgcctctctttccccggtcggagcgcgggggtgcgtgtgccctcactctcacgaatacagacggagagcttcccagaaggaaaaacaaattcgtcataatgttcagcgcagccgagagtttccaacaagaaagcagctccagtcgtggcatgatgactcagggtggcgttttaaacgctgaataaacccattccttagctctttaataaatcgctaataacagcaaaaacagccttctccccgaaccgcgccacaccaaaggcttcccaagttgggctgcgaatccctgtttggttttccaacgccgaaagacgtagaagcagtgggatctcctggtgggacgcatttctccaagggctcccagagagaggacgagatagcagggtttacagggcaaagagaggagaacctggaaatcgtgtcctggggggcaagagtgcgttgcccagtcacaagtgtgctgtagaggtgggagaggacaaggacccatttccacatttcaaccctccgtttctatcgctgcccctggaggactcagctgctaacgccgagctcgtttccacgcggctctggtcctagtcggggaatccgggtggccgcgcgacgcgagagaactgctgggatgcgtggccctggtatgggcgcacccagcgtccggggcgcaggttctctcagcccagcttctcctcccactcactcgctcggatctcctccctccttcacatcccccgcccccgggaccgcgaggctccctccccgcaccggccagtgagtacacaaagccgcgggtgaggggaagcttcgcaggcgtgcacggagcagtgagatcactggcgttataaatatcccggtgccagcgcggagatccgctcgggtggcctctctcttcccctctccccttctcttccccgaggctatgtccacccggtgcggcgaggcgggcagagccagaggcacgcagccgcacaggggctacagagcccagaatcagccctacaagatgcacttaggacccccgcggctggaagaatgagcttgtccttcctcctcctcctcttcttcagccacctgatcctcagcgcctgggctcacggggagaagcgtctcgcccccaaagggcaacccggacccgctgccactgataggaaccctagaggctccagcagcagacagagcagcagtagcgctatgtcttcctcttctgcctcctcctcccccgcagcttctctgggcagccaaggaagtggcttggagcagagcagtttccagtggagcccctcggggcgccggaccggcagcctctactgcagagtgggcatcggtttccatctgcagatctacccggatggcaaagtcaatggatcccacgaagccaatatgttaagtaagttactcgctctcctacaaaacccgtcctaggcggccgcggaagattcgggagggacagcaggtattcgccgggacacaggctcaccttcctgagcccaggccactgggaccaagctgatactcagaaacagccgggcgggttgggtggagatgcatctatatggcgtgcgcacacgcacccctctcctgggcatgaggaattgcgatttctcaggtgt

SEQ ID NO: 123554 - DNA, 589 bp, Homo sapiens
  misc_feature 1..589: note = chr4:81189430-81190019
  misc_feature 1..589: note = Hyper
  source 1..589: mol_type = genomic DNA
agatcgctcttccagcgcgggttggtccaccaggcagagccccagccagggcctgtcaggtacccagggagaccggaaatgtagccaggagacagcagcgctcacagtcacctggtttcagtgtcagcctggttgctcctagatgttcctaacttgctccatctcagaccaaagactccacgggccattgggctccttcttacacaggctccagaggagcgtggacaccaccggcggtctgaagatttggcagccagcagtctccagaggggggtcggaggcgcgcaagtgggtaaggcggtaggctggctagcctcctccggtgggttaagggggcctaatgcggaagacctgatggttcatgctgagagaaaagcaggtctatgcccgcccctctgcgcctgtctagtctatctgatcgcgctgattcagcagcctgcggcgcacgtggtgagggcgcctggagcgcccagctggagagagggccctccgcacacgcaccagcgagtcccagggcctccctcacactcccgagaggaatctatttccatattttagagtttatttcactcatcgaataactgctcat

SEQ ID NO: 123555 - DNA, 463 bp, Homo sapiens; identical to SEQ ID NO: 92502
  misc_feature 1..463: note = chr4:81256776-81257239
  misc_feature 1..463: note = Hyper
  source 1..463: mol_type = genomic DNA

SEQ ID NO: 123556 - DNA, 465 bp, Homo sapiens; identical to SEQ ID NO: 92504
  misc_feature 1..465: note = chr4:81307611-81308076
  misc_feature 1..465: note = Hypo
  source 1..465: mol_type = genomic DNA

SEQ ID NO: 123557 - DNA, 191 bp, Homo sapiens; identical to SEQ ID NO: 92506
  misc_feature 1..191: note = chr4:81951310-81951501
  misc_feature 1..191: note = Hyper
  source 1..191: mol_type = genomic DNA

SEQ ID NO: 123558 - DNA, 100 bp, Homo sapiens; identical to SEQ ID NO: 28997
  misc_feature 1..100: note = chr4:81951777-81951877
  misc_feature 1..100: note = Hyper
  source 1..100: mol_type = genomic DNA

SEQ ID NO: 123559 - DNA, 999 bp, Homo sapiens
  misc_feature 1..999: note = chr4:81951937-81952936
  misc_feature 1..999: note = Hyper
  source 1..999: mol_type = genomic DNA
aactcggaccagccgcgccgcagctgctccaatccctggaaaaggcaatcgagcgccctccggaccgctgcgcacagccccggctccgacctggcgcccaaaacagagctagtcctagtccctcgcgcggccagtttggccgggtgttcccaaaaataaagcgaggagggaaggtacagacagatcttgaaaacacccgggccacacacgccgcgacctacagctctttctcagcgttggagtggagacggcgcccgcagcgccctgcgcgggtgaggtccgcgcagctgctggggaagagcccacctgtcaggctgcgctgggtcagcgcagcaagtggggctggccgctatctcgctgcacccggccgcgtcccgggctccgtgcgccctcgccccagctggtttggagttcaaccctcggctccgccgccggctccttgcgccttcggagtgtcccgcagcgacgccgggagccgacgcgccgcgcgggtacctagccatggctggggcgagcaggctgctctttctgtggctgggctgcttctgcgtgagcctggcgcagggagagagaccgaagccacctttcccggagctccgcaaagctgtgccaggtgaccgcacggcaggtggtggcccggactccgagctgcagccgcaagacaaggtctctgaacacatgctgcggctctatgacaggtacagcacggtccaggcggcccggacaccgggctccctggagggaggctcgcagccctggcgccctcggctcctgcgcgaaggcaacacggttcgcagctttcgggcggcagcagcaggtgagtgcgcgaggtgagactcccttcccgcggtcccgccccagctttctcccgggaccccccacagcttccttgtctgccccttgcttggtggcgctgcctagggacctttctccgccctcctcagctgccctctggattcctccgtccagtcacaccccgcgtgtcgccagctgcatctc

SEQ ID NO: 123560 - DNA, 1291 bp, Homo sapiens
  misc_feature 1..1291: note = chr4:82135686-82136977
  misc_feature 1..1291: note = Hyper
  source 1..1291: mol_type = genomic DNA
caactacccagagctcgacgaagcaaagccgggagcgcaagccctgacagcaccgccaagcccctagctcggagcaacagcctccaccgcttctcctcgctaaacctagagaaccctgaggactccccactggggctgagcccctcccgccctcaacagaacctctaaacacaagtagcctttccctgcctccaggagctcacgaaacgctgccacaccgagcgaatgcaacgcgtacacacgtccacactcgaacagcacaagcaagagaccggctgggtgtggaatagaggcgcacatcgcgcaacgcattcacagcatgcacacgcgcgcaccccgaccccgtccctccccgcgcgccctcacaccccggcgcccaagacccccggcccacgaacctcaccagacagccgggtaactttccaggtgcgcagcttgtcacctcggcgcggccgcccctgcgtctcagcgtcctctcccacgccgccctccccagccgcctgcggcgccggagcccagcgcaggtcagctcagccagccccgccgtgcacacggtgcgcagcgtgggcccggggctgccggctcagtcgctccggctacgtgtgagccgggggcgcgggttagcgcgatgcgggcaggagctgcggcggcgtcggtgctgccgcctggctccgcggcgggggccggtgcagaggagacacgcagggagggagggaagagaggagggaaggaggagggagggggtcagccggggctactgcctggatagttgggcgccggcttccctaaaggtggggtcacccgcgcccgcacgcacactagcccgaacctttactcccgacacagccgcagtctgcactttataccccataccctccatagtgaggcaacttaagtagggcgataacatcgtggttgtaagcatttttgttcatgttattatttctatttcaagtgtgtgggacgaggggagaggaaagttcagggaggtgttcattttttccttcccctccctttcctccatccttccagtctgttttcactgcaggctctctccacttcgccttccctcccagagctcaaacaggcgcacgtaccctggacatgccctcctctgtcacaccaatgcctttctacgaagacatgtgaccccgaagcagctcgtcgacgcgcccctcccggactctggggccataacttacatctagtttgccagttcacgtgatgctgggggcaggggttgaatcgagtttcgagggacagagattataccttccgaatctgcaggtct

SEQ ID NO: 123561 - DNA, 86 bp, Homo sapiens; identical to SEQ ID NO: 92515
  misc_feature 1..86: note = chr4:82157454-82157540
  misc_feature 1..86: note = Hypo
  source 1..86: mol_type = genomic DNA

SEQ ID NO: 123562 - DNA, 577 bp, Homo sapiens; identical to SEQ ID NO: 92522
  misc_feature 1..577: note = chr4:82965332-82965909
  misc_feature 1..577: note = Hyper
  source 1..577: mol_type = genomic DNA

SEQ ID NO: 123563 - DNA, 34 bp, Homo sapiens; identical to SEQ ID NO: 92523
  misc_feature 1..34: note = chr4:83149079-83149113
  misc_feature 1..34: note = Hypo
  source 1..34: mol_type = genomic DNA

SEQ ID NO: 123564 - DNA, 153 bp, Homo sapiens; identical to SEQ ID NO: 92525
  misc_feature 1..153: note = chr4:83301224-83301377
  misc_feature 1..153: note = Hypo
  source 1..153: mol_type = genomic DNA

SEQ ID NO: 123565 - DNA, 169 bp, Homo sapiens; identical to SEQ ID NO: 92526
  misc_feature 1..169: note = chr4:83323412-83323581
  misc_feature 1..169: note = Hypo
  source 1..169: mol_type = genomic DNA

SEQ ID NO: 123566 - DNA, 688 bp, Homo sapiens; identical to SEQ ID NO: 92527
  misc_feature 1..688: note = chr4:83482684-83483372
  misc_feature 1..688: note = Hyper
  source 1..688: mol_type = genomic DNA

SEQ ID NO: 123567 - DNA, 144 bp, Homo sapiens; identical to SEQ ID NO: 92528
  misc_feature 1..144: note = chr4:83551716-83551860
  misc_feature 1..144: note = Hypo
  source 1..144: mol_type = genomic DNA

SEQ ID NO: 123568 - DNA, 42 bp, Homo sapiens; identical to SEQ ID NO: 92529
  misc_feature 1..42: note = chr4:83718792-83718834
  misc_feature 1..42: note = Hyper
  source 1..42: mol_type = genomic DNA

SEQ ID NO: 123569 - DNA, 91 bp, Homo sapiens; identical to SEQ ID NO: 92530
  misc_feature 1..91: note = chr4:83719334-83719425
  misc_feature 1..91: note = Hyper
  source 1..91: mol_type = genomic DNA

SEQ ID NO: 123570 - DNA, 21 bp, Homo sapiens
  misc_feature 1..21: note = chr4:83955217-83955238
  misc_feature 1..21: note = Hypo
  source 1..21: mol_type = genomic DNA
tacagacgtgagccacggcgc

SEQ ID NO: 123571 - DNA, 30 bp, Homo sapiens; identical to SEQ ID NO: 92534
  misc_feature 1..30: note = chr4:84030886-84030916
  misc_feature 1..30: note = Hyper
  source 1..30: mol_type = genomic DNA

SEQ ID NO: 123572 - DNA, 41 bp, Homo sapiens; identical to SEQ ID NO: 14696
  misc_feature 1..41: note = chr4:84169961-84170002
  misc_feature 1..41: note = Hypo
  source 1..41: mol_type = genomic DNA

SEQ ID NO: 123573 - DNA, 704 bp, Homo sapiens
  misc_feature 1..704: note = chr4:85402721-85403425
  misc_feature 1..704: note = Hyper
  source 1..704: mol_type = genomic DNA
atttgtaactgaaggcggctctgcctcccctctgtctaccttgcggagactattcaaacgccctcgcttgcggggtttcggagccagaagtctcgagctccgcgcctccgcgcccccgcgccgcgcccttccacctgcacccgttaggcgcgctgcgggacaacagcgcagatgcaaacagctttctcgcaaggaaaaagggaattgaggagaaagtttcctctctgagccgagggaagcggaaaaagatcaaaggtcgggggcgggtagagtgggggtggggggaaccgcgggacgccctagctgtgtgcgtttcgggaggcctcgcagtgccattctgcaagagtacctgctatctcgaaaatcttttgccaccgccgaccgcagcgggagggggcaaggggctctctctgactcagctccggatttgtgcatccccgcagtgcggcacccgcagtcttgacttccccagtctctgactgaacagatgtttttgtccctcgcggagatttgtaaccgatgttgggaacagctagtggacggtgctagcaacctgtatctgttctagaacacacctagtgggagctgcggggtagagtggagaggtaggaatgcagcgggactggggcaggggacaaatcaaggtgtgtgggtaaatgtgaacatatgaacacacgtgtgtacgcacgtctctaaatgtgtca

SEQ ID NO: 123574 - DNA, 956 bp, Homo sapiens
  misc_feature 1..956: note = chr4:85403776-85404732
  misc_feature 1..956: note = Hyper
  source 1..956: mol_type = genomic DNA
ctgtggttgccttttcggtttcaaagtaataaccaagcaaggaagagagaagaccgaaaactaccccgcggaaactagcacagtgtgcctggatgtctgtgtcccgggacctcggggaagagggcccgcaccggtctgcgaattgcaaggcccggccttccccagcgacgctctggtatccgctgtcccctccctgtacctccgcgacccaggggacgcccagtgcaccaggcccttccccggggtcagcggaggcgcagggcgttagccacatcagaggtgcaaatttaccccgggcccaggggaaaatggcgacagcgttcgcggctccacccggggcgcgtgtcagcgttggagagcctgcccggcctgcagagggcgtaacaggcaccgctggggagagccaagcacccctgcgtccaggatccgtagcgccgagctgcaggcccgacctgcagggggcgtgcccggcatgggaagctcaggctacgtctccgaagcttgcgctgaaaacaccagaggtagggaaaacggggagagcgtactgtgctgggctctaccctggacaccccagtttcattctctgcgaagccacgcgctggcagggctctcgggacggcgatacccagggatgatggtacccctggtctcggcgggacctcccgggaacttgtcctgggggagggagcccaactggccacgtactggtagcagcagtgggtggagcgcacaaactccgaggcccgcgtatgcccagcaccccaggctgaggctgcagggccccggacccgggtcccagggacggagcctgcccccagcactagggaactgggccaggtatggtgaccaacgtcctaaatcccaaacagacttcgttcggccgggctcagtaaagaatttgccgaaaggtagaaactggaccagagaagggaacacagtgccgggcacatcctagc

SEQ ID NO: 123575 - DNA, 30 bp, Homo sapiens; identical to SEQ ID NO: 92542
  misc_feature 1..30: note = chr4:85405081-85405111
  misc_feature 1..30: note = Hyper
  source 1..30: mol_type = genomic DNA

SEQ ID NO: 123576 - DNA, 957 bp, Homo sapiens
  misc_feature 1..957: note = chr4:85414067-85415024
  misc_feature 1..957: note = Hyper
  source 1..957: mol_type = genomic DNA
ccctaccccgccgcccgcgggggcaaaatctgggggcgagggggacccgggcgctgaggccgctgcccgcctatggggacgcggctgggaccgtggcccggctgcgggtttcagtagcgacatttacgcagtgcatttggtggtctttcttgccttatcaaccccggagtctctctcccctacatcccctcccacaacttcaaggttaaaaaaatagatatgtacatctcaaaaatagcaaagggtccccgcaggcagggccgggtcctccgggccccgaggagcgggcaggcgcggcgtgcacgcggtccccgcgcccctcgcggccccagaggtggaggccggagccgggaaggtgcggcgggcggcggcgttcaggatgagctctccggctcggacgcgtgcagtaggaggccgccgccgccgccgctgctggacttgtgcttcttcaacagctgcgtgattttctcgtcgtccgagttgggatccagaggcttattgtagtcgtcgtcctcttcctcgttctccgaggcccccttgaggcgctctgtctccgagtcctgcttcttcttggccgtggccatctcggcagcgtgcttcttcctccacttggtccggcggttctggaaccagacctgagggcggagaaaagggaggagaggggaggcaagggcgaggaattaaacgagcagatccaggccatgctaccactcccgcatctcgatggccctcccgcggccccccgaaggcctgctgccctccctcgcagccctcccttttctcggccgtcaaagtcagtctccgtcgccccaagttccccctgagtaactggcaccaacaaactgactgccgttgccatagcgatggtaacacaagagtattgaggttgtcagtgagcgagttctcaaaagtaaaaacaaaactcggaaacttaaaaatgagcgtccctaaaagtga

SEQ ID NO: 123577 - DNA, 30 bp, Homo sapiens; identical to SEQ ID NO: 92546
  misc_feature 1..30: note = chr4:85416612-85416642
  misc_feature 1..30: note = Hyper
  source 1..30: mol_type = genomic DNA

SEQ ID NO: 123578 - DNA, 479 bp, Homo sapiens; identical to SEQ ID NO: 29016
  misc_feature 1..479: note = chr4:85416904-85417383
  misc_feature 1..479: note = Hyper
  source 1..479: mol_type = genomic DNA

SEQ ID NO: 123579 - DNA, 107 bp, Homo sapiens; identical to SEQ ID NO: 92548
  misc_feature 1..107: note = chr4:85417612-85417719
  misc_feature 1..107: note = Hyper
  source 1..107: mol_type = genomic DNA

SEQ ID NO: 123580 - DNA, 1938 bp, Homo sapiens
  misc_feature 1..1938: note = chr4:85417953-85419891
  misc_feature 1..1938: note = Hyper
  source 1..1938: mol_type = genomic DNA
gggtgttgagctccacgatgtccccaaatgtgcccggacgcagcgtgtgccagcccccagagtggaggcaggtgggaaagcgcgggcccagcgctggtgagcggctggaagcgctcgccctgccctggggacgctggactgtcttcaatgggctcacccaggccgagtgtactcgggcggcgagggcgaagaggtgaggtggggacaccccaggcggagacgtgcatgcaaatacactcacttcccgggcggtggagggctcaccgctgccgggcctcactgcttcgaagagaggcagcgggttaggctggcgaaggcggaatggggcgctggacgacagggaggagccgggaaagcagagatgcagtggcctctcctcccctctcctccccatctttctaatccaggccaggcctgcggtcctggccaggccgtttcaggaacagccagggcctcggacgagacacacgtccctcaccgcgttgtggtccacacgaacacacacacaccggctcagcccaggcgtactcaagacttagagagagggaggcgcttggatacagccacgcgagctcagaaaagcgagaatccctttctggaagccctggcccaacctaactggtgtgattccggcgctgtcaaactactggggcgggccacaggatggactgagcggcatgcacaccaggggccgcgacccgggagtgggcagaacaggcacggcaggcaggcatcggggcgcgggtggtagtactcacgaggggtacaggccaggcgtgcgtccctccagggcgggctctgcatcactccgggccagaagatgggcgtccggccaggcagctcagccagcggcttggggtaccggcccacggcggccacggccgcggcgctggggctgaagtagagcccgggcggcggcggcggcgggctcaggctgctaaagcgtggcagtccggccagcagccccgccggggatgaggcggcggctgcggccgcggcagcagccgcggcggcggcagaggcggaggaggcagaggcggacgaggaagaggaggaggaggaaccggagggcgaggcggagggcagggcggcccccgaggccacgggcatggagggccggctcaggatatcgttgatgccgtgtggggtggcggccgagagctgctgcggggggctgccgagggatgagagcccccccgtggccgggggcttcaggccgcctgggttgtgggtgcccagaggcggggagggcgacgaggaggacgacgacgaggacgaggaggagggggggccggcaggcagcgggggatacgcggcagggtacagcggggtcttcatctcggccatgctgtgcagggcggccaggggagggctgctgagcaggaatgcgctctgccgggtgccctccattgcccccaccgctaacatcccacggccacgccggagaccgtagccttgcagcgagggcgctggctggtgccccccgcggggctcagaggagccggaagcgccgagggcgcgagcggagaggcactcggcgcgcccggaggcgagctgccaactgaaccaaaaatgccgctgccgggagttgctcgcctagctgcgcagcagagatgtccaaaccctccacgcgggaggcggcagctcgccgagaaaagcaggcgtcccggcgggctaggcagtcctttcgttccgcgagtcctagattcgatccctggctattctctcttcctcacttttcctagctgttcaaagtgcgctacttctcatcttctgcccccgggaaataagcaaaacaaaacccaggctggctccggagagtttgtagcaaagttagttgccgaatctccactttgaagttggagggtgggggtggcttgctttctttggggaggttcaaaggacgccttgtgcagcccgtggcgctcctctgatctt

SEQ ID NO: 123581 - DNA, 30 bp, Homo sapiens; identical to SEQ ID NO: 92554
  misc_feature 1..30: note = chr4:85421883-85421913
  misc_feature 1..30: note = Hyper
  source 1..30: mol_type = genomic DNA

SEQ ID NO: 123582 - DNA, 279 bp, Homo sapiens; identical to SEQ ID NO: 29023
  misc_feature 1..279: note = chr4:85422188-85422467
  misc_feature 1..279: note = Hyper
  source 1..279: mol_type = genomic DNA

SEQ ID NO: 123583 - DNA, 629 bp, Homo sapiens
  misc_feature 1..629: note = chr4:85422771-85423400
  misc_feature 1..629: note = Hyper
  source 1..629: mol_type = genomic DNA
agtaaatagttgcaacgcttggtgtaaggatgtctccatcgttcacttttacgtatcatttgcattgccaaattaaaatggcagcattgttcttaattatgacaataaaaaattccggatccgtgtaccttgatccctggtagtgagggggtgagccccgggtgctcgatcccgcgtagagcagcgtgtattgcagacgcacgctgggcagcacgggaaggcaggccggtgcctcctgccaggtgctagttgtagtggatctgctgcctgtctacagctgggagcggtgacaacgatggagcgtcctcggagagggtgggctgccccctgtcactcccgggggaagatcgccctgccctccgctctaactgcgtggttgaaaccagtttcgggacccgagtcctggtcccgctgacgcgggaggcttgtttctggtggggcagtcttaacgcattgccttcagatgcctttgagagtcaggacttgctctttcttggggatcctccgaaaccagcatgccttcctgcccacgacctaataaagtgggactttttcaagtaccccttgggagtggacgtgtaacacgtggtcgcaaggatcccggcgcatctctacgcagtatatctaat

SEQ ID NO: 123584 - DNA, 197 bp, Homo sapiens; identical to SEQ ID NO: 29025
  misc_feature 1..197: note = chr4:85423633-85423830
  misc_feature 1..197: note = Hyper
  source 1..197: mol_type = genomic DNA

SEQ ID NO: 123585 - DNA, 372 bp, Homo sapiens; identical to SEQ ID NO: 92559
  misc_feature 1..372: note = chr4:85424135-85424507
  misc_feature 1..372: note = Hyper
  source 1..372: mol_type = genomic DNA

SEQ ID NO: 123586 - DNA, 36 bp, Homo sapiens; identical to SEQ ID NO: 92560
  misc_feature 1..36: note = chr4:85503856-85503892
  misc_feature 1..36: note = Hyper
  source 1..36: mol_type = genomic DNA

SEQ ID NO: 123587 - DNA, 558 bp, Homo sapiens; identical to SEQ ID NO: 92561
  misc_feature 1..558: note = chr4:85504235-85504793
  misc_feature 1..558: note = Hyper
  source 1..558: mol_type = genomic DNA

SEQ ID NO: 123588 - DNA, 86 bp, Homo sapiens; identical to SEQ ID NO: 92564
  misc_feature 1..86: note = chr4:85887114-85887200
  misc_feature 1..86: note = Hyper
  source 1..86: mol_type = genomic DNA

SEQ ID NO: 123589 - DNA, 49 bp, Homo sapiens; identical to SEQ ID NO: 92565
  misc_feature 1..49: note = chr4:85887878-85887927
  misc_feature 1..49: note = Hyper
  source 1..49: mol_type = genomic DNA

SEQ ID NO: 123590 - DNA, 34 bp, Homo sapiens; identical to SEQ ID NO: 92566
  misc_feature 1..34: note = chr4:85888365-85888399
  misc_feature 1..34: note = Hyper
  source 1..34: mol_type = genomic DNA

SEQ ID NO: 123591 - DNA, 30 bp, Homo sapiens; identical to SEQ ID NO: 40312
  misc_feature 1..30: note = chr4:86922651-86922681
  misc_feature 1..30: note = Hypo
  source 1..30: mol_type = genomic DNA

SEQ ID NO: 123592 - DNA, 495 bp, Homo sapiens; identical to SEQ ID NO: 92583
  misc_feature 1..495: note = chr4:87281168-87281663
  misc_feature 1..495: note = Hyper
  source 1..495: mol_type = genomic DNA

SEQ ID NO: 123593 - DNA, 1009 bp, Homo sapiens; identical to SEQ ID NO: 92584
  misc_feature 1..1009: note = chr4:87515216-87516225
  misc_feature 1..1009: note = Hyper
  source 1..1009: mol_type = genomic DNA

SEQ ID NO: 123594 - DNA, 30 bp, Homo sapiens; identical to SEQ ID NO: 29031
  misc_feature 1..30: note = chr4:87813050-87813080
  misc_feature 1..30: note = Hyper
  source 1..30: mol_type = genomic DNA

SEQ ID NO: 123595 - DNA, 92 bp, Homo sapiens; identical to SEQ ID NO: 92588
  misc_feature 1..92: note = chr4:87813420-87813512
  misc_feature 1..92: note = Hyper
  source 1..92: mol_type = genomic DNA

SEQ ID NO: 123596 - DNA, 37 bp, Homo sapiens; identical to SEQ ID NO: 14697
  misc_feature 1..37: note = chr4:87899606-87899643
  misc_feature 1..37: note = Hypo
  source 1..37: mol_type = genomic DNA

SEQ ID NO: 123597 - DNA, 32 bp, Homo sapiens; identical to SEQ ID NO: 92591
  misc_feature 1..32: note = chr4:88010203-88010235
  misc_feature 1..32: note = Hypo
  source 1..32: mol_type = genomic DNA

SEQ ID NO: 123598 - DNA, 30 bp, Homo sapiens; identical to SEQ ID NO: 40315
  misc_feature 1..30: note = chr4:88025280-88025310
  misc_feature 1..30: note = Hypo
  source 1..30: mol_type = genomic DNA

SEQ ID NO: 123599 - DNA, 25 bp, Homo sapiens
  misc_feature 1..25: note = chr4:88296877-88296902
  misc_feature 1..25: note = Hypo
  source 1..25: mol_type = genomic DNA
agcaaaactccgtctcaaaaaataa

SEQ ID NO: 123600 - DNA, 30 bp, Homo sapiens; identical to SEQ ID NO: 92623
  misc_feature 1..30: note = chr4:89054393-89054423
  misc_feature 1..30: note = Hypo
  source 1..30: mol_type = genomic DNA

SEQ ID NO: 123601 - DNA, 128 bp, Homo sapiens; identical to SEQ ID NO: 40316
  misc_feature 1..128: note = chr4:89116521-89116649
  misc_feature 1..128: note = Hypo
  source 1..128: mol_type = genomic DNA

SEQ ID NO: 123602 - DNA, 106 bp, Homo sapiens; identical to SEQ ID NO: 92626
  misc_feature 1..106: note = chr4:89291663-89291769
  misc_feature 1..106: note = Hypo
  source 1..106: mol_type = genomic DNA

SEQ ID NO: 123603 - DNA, 628 bp, Homo sapiens
  misc_feature 1..628: note = chr4:89378317-89378945
  misc_feature 1..628: note = Hyper
  source 1..628: mol_type = genomic DNA
gttcccgctctgcagcgcaacgcctgaggcagtgggcgcgctcagtcccgggaccaggcgttctctcctctcgcctctgggcctgggaccccgcaaagcggcgatggagcggaggtcgcggaggaagtcgcggcgcaacgggcgctcgaccgcgggcaaggccgccgcgacccagcccgcgaagtctccgggcgcacagctctggctctttcccagcgccgcgggcctccaccgcgcgctgctccggagggtggaggtgacgcgccaactctgctgctcgccggggcgcctcgcggtcttggaacgcggcggggcgggcgtccaggttcaccagctgctcgccgggagcggcggcgcccggacgccgagtgagtggggctggtgtgtgagggctgtgagggctgtgaggggtgagggctgagggctgtgaggggcgggcagccgggggtccgcgcctgagggaggagagcccagaaggccgcagacgcgcgcctggctcggatagtttcgccgacggcgcacctgagctgtcttttatcccggtcagtgtcaggcgcggggtgagcgggatactggcgaccagcggatcctccgctcagcaaagtggccggtgcggggcatgcgggca

SEQ ID NO: 123604 - DNA, 133 bp, Homo sapiens; identical to SEQ ID NO: 92630
  misc_feature 1..133: note = chr4:89660145-89660278
  misc_feature 1..133: note = Hypo
  source 1..133: mol_type = genomic DNA

SEQ ID NO: 123605 - DNA, 20 bp, Homo sapiens
  misc_feature 1..20: note = chr4:89912577-89912597
  misc_feature 1..20: note = Hypo
  source 1..20: mol_type = genomic DNA
gactccgtctcaaaataaaa

SEQ ID NO: 123606 - DNA, 91 bp, Homo sapiens; identical to SEQ ID NO: 92633
  misc_feature 1..91: note = chr4:90031770-90031861
  misc_feature 1..91: note = Hyper
  source 1..91: mol_type = genomic DNA

SEQ ID NO: 123607 - DNA, 106 bp, Homo sapiens; identical to SEQ ID NO: 40318
  misc_feature 1..106: note = chr4:90043853-90043959
  misc_feature 1..106: note = Hypo
  source 1..106: mol_type = genomic DNA

SEQ ID NO: 123608 - DNA, 1882 bp, Homo sapiens
  misc_feature 1..1882: note = chr4:90757517-90759399
  misc_feature 1..1882: note = Hyper
  source 1..1882: mol_type = genomic DNA
tcattatttgccaaacgcagcttgcttactttacagagaaaaaccaagagagcgggcagacagattttatgtgagagaaaagttggatgctcacgctccatggagcatcctcgcgtttcccggggaaaagcggatcccggagaagcagcctaatctctcagcccttgtggagaagggaatatcagaagcaggacgaaagccaggtcaagtctctttccttaggctccccaaagggacaagtactcacctcccagagacctggcccagcgggtcctcatggcagcaccaccccctcccggtgcccacgaccattcgtctcccatccggcgttctccaggatttccaaagacgcccgtttagatccacaggtacttacctgagtccctctgcttctccacaactccgactcctccccgcctctctctttttttaaaaaaaaaatttaaacaattcccaaataatatttaataggaaagaagaaggaaaaggagcgcacaggaagggcggaggcggcacccgggggggactgtccccagaggaggccgctgtgagccggcgacgcgaggctgggggagtgggaggcaaacccgctaacctgtcgtcgaatggccactcccagttctccgctcacgagggtggaaaggcagaaggcttgaaggcaaggcgtgagggagcgcccaggacgctctcggaggggccgggccggggtctgcgctgcagcccgcacgcacctcacttccgcgtcgcggcgctcggtcgctcgccccctctcttgggccccttctggtcgtcgccgtcctcctcctcctagtcctcctccttctccttctcctcggctctccgcccccaccgctgatttgtcagcgcttctgcccgcccctctcccggcgctcgctgctttccctgcagcgtgctcctcgtccctatctcggatggggatggggcagggggcgcggggtgagccatcaactccagccgcctgcctggccgcgcaaggcgggaaagtgggggcgcttttgcgcctcacgttaagtttagggtcacgagcactcttgtggagatcgggagcggttgggctagggatgatgcctcttcctctttccccttcccctcccttcttgtccccgcctttcctctgggtcctcccggggaccaccccctacccctcgtcagagtcgccctgggagagccgagggcctgagggtcgaccaccaagggcagagcctatcccttggggagctgctggaggagacaggcagcgccgggaggtggctcacaccgcaccgccgagagcgctttgccctcgcatcgctgaaatttaatcacggtcacaggttacaacgttaggggtcgctttagttcaaatatcttcaaggttttcgtttgctcttaatctaggaagagccggaaagggtcctgagggtgaaagggagactactaaggaagagtcacaggttgaggaggcaggagaaggctcagcaaatcctctttccacgccactatcaccattttcctttccaccaatcagcgcctgccagacgctgattttcccatcagtggaacaaggaataaatattccccagccgtctaaaacaagcggtcctaaggcttttcgctctagaaatgggacttactttgcagacctccctttatctgggagacaaatccagcgtgatttagcctaccggaccatcatatccaatttcttcttcagccccttctgaaagggagatgctacacaccactcacctttctgacttctgattctcgttgccctcagaattgacacccccttttctctccccccacccaccacacgcacatgcacacagacatacacacgcgaacttcaagacaatttttgcatcgcttaacacatttt

SEQ ID NO: 123609 - DNA, 94 bp, Homo sapiens; identical to SEQ ID NO: 92638
  misc_feature 1..94: note = chr4:91049775-91049869
  misc_feature 1..94: note = Hyper
  source 1..94: mol_type = genomic DNA

SEQ ID NO: 123610 - DNA, 203 bp, Homo sapiens; identical to SEQ ID NO: 40319
  misc_feature 1..203: note = chr4:91168356-91168559
  misc_feature 1..203: note = Hypo
  source 1..203: mol_type = genomic DNA

SEQ ID NO: 123611 - DNA, 163 bp, Homo sapiens; identical to SEQ ID NO: 92641
  misc_feature 1..163: note = chr4:93225260-93225423
  misc_feature 1..163: note = Hyper
  source 1..163: mol_type = genomic DNA

SEQ ID NO: 123612 - DNA, 30 bp, Homo sapiens; identical to SEQ ID NO: 92642
  misc_feature 1..30: note = chr4:93225709-93225739
  misc_feature 1..30: note = Hyper
  source 1..30: mol_type = genomic DNA

SEQ ID NO: 123613 - DNA, 49 bp, Homo sapiens; identical to SEQ ID NO: 92643
  misc_feature 1..49: note = chr4:93226097-93226146
  misc_feature 1..49: note = Hyper
  source 1..49: mol_type = genomic DNA

SEQ ID NO: 123614 - DNA, 46 bp, Homo sapiens; identical to SEQ ID NO: 92644
  misc_feature 1..46: note = chr4:93226463-93226509
  misc_feature 1..46: note = Hyper
  source 1..46: mol_type = genomic DNA

SEQ ID NO: 123615 - DNA, 35 bp, Homo sapiens; identical to SEQ ID NO: 92645
  misc_feature 1..35: note = chr4:93226820-93226855
  misc_feature 1..35: note = Hyper
  source 1..35: mol_type = genomic DNA

SEQ ID NO: 123616 - DNA, 30 bp, Homo sapiens; identical to SEQ ID NO: 92647
  misc_feature 1..30: note = chr4:94749499-94749529
  misc_feature 1..30: note = Hyper
  source 1..30: mol_type = genomic DNA

SEQ ID NO: 123617 - DNA, 246 bp, Homo sapiens; identical to SEQ ID NO: 92648
  misc_feature 1..246: note = chr4:94750031-94750277
  misc_feature 1..246: note = Hyper
  source 1..246: mol_type = genomic DNA

SEQ ID NO: 123618 - DNA, 1043 bp, Homo sapiens; identical to SEQ ID NO: 92649
  misc_feature 1..1043: note = chr4:94750556-94751599
  misc_feature 1..1043: note = Hyper
  source 1..1043: mol_type = genomic DNA

SEQ ID NO: 123619 - DNA, 20 bp, Homo sapiens
  misc_feature 1..20: note = chr4:94752906-94752926
  misc_feature 1..20: note = Hyper
  source 1..20: mol_type = genomic DNA
ggaaaagctaatagtcgtgc

SEQ ID NO: 123620 - DNA, 268 bp, Homo sapiens; identical to SEQ ID NO: 92651
  misc_feature 1..268: note = chr4:94753279-94753547
  misc_feature 1..268: note = Hyper
  source 1..268: mol_type = genomic DNA

SEQ ID NO: 123621 - DNA, 555 bp, Homo sapiens
  misc_feature 1..555: note = chr4:94755600-94756155
  misc_feature 1..555: note = Hyper
  source 1..555: mol_type = genomic DNA
aaaggggaaactgagcggagaatgggttaaatccttggaagcaggggagaggcaggggaggagagaagtcggaggagtataaagaaaaggacaggaaccaagaagcgtgggggtggtttgccgtaatgtgagtgtttcttaattagagaacggttgacaatagagggtctggcagaggctcctggccgcggtgcggagcgtctggagcggagcacgcgctgtcagctggtgagcgcactctcctttcaggcagctccccggggagctgtgcggccacatttaacaccatcatcacccctccccggcctcctcaacctcggcctcctcctcgtcgacagccttccttggccccccaccagcagagctcacagtagcgagcgtctctcgccgtctcccgcactcggccggggcccctctcctcccccagctgcgcagcgggagccgccactgcccactgcacctcccagcaaccagcccagcacgcaaagaagctgcgcaaagttaaagccaagcaatgccaaggggaggggaagctggaggcggcagaggcggcgg

SEQ ID NO: 123622 - DNA, 89 bp, Homo sapiens; identical to SEQ ID NO: 92656
  misc_feature 1..89: note = chr4:95127590-95127679
  misc_feature 1..89: note = Hypo
  source 1..89: mol_type = genomic DNA

SEQ ID NO: 123623 - DNA, 29 bp, Homo sapiens
  misc_feature 1..29: note = chr4:95128039-95128068
  misc_feature 1..29: note = Hypo
  source 1..29: mol_type = genomic DNA
gctgggattacaggcgtgagccaccactc

SEQ ID NO: 123624 - DNA, 146 bp, Homo sapiens; identical to SEQ ID NO: 92660
  misc_feature 1..146: note = chr4:95678853-95678999
  misc_feature 1..146: note = Hyper
  source 1..146: mol_type = genomic DNA

SEQ ID NO: 123625 - DNA, 266 bp, Homo sapiens; identical to SEQ ID NO: 92661
  misc_feature 1..266: note = chr4:95679059-95679325
  misc_feature 1..266: note = Hyper
  source 1..266: mol_type = genomic DNA

SEQ ID NO: 123626 - DNA, 106 bp, Homo sapiens; identical to SEQ ID NO: 92662
  misc_feature 1..106: note = chr4:95679639-95679745
  misc_feature 1..106: note = Hyper
  source 1..106: mol_type = genomic DNA

SEQ ID NO: 123627 - DNA, 29 bp, Homo sapiens
  misc_feature 1..29: note = chr4:95762900-95762929
  misc_feature 1..29: note = Hypo
  source 1..29: mol_type = genomic DNA
gagctgttcctattcggccatcttggctc

SEQ ID NO: 123628 - DNA, 30 bp, Homo sapiens; identical to SEQ ID NO: 92665
  misc_feature 1..30: note = chr4:96061185-96061215
  misc_feature 1..30: note = Hypo
  source 1..30: mol_type = genomic DNA

SEQ ID NO: 123629 - DNA, 25 bp, Homo sapiens
  misc_feature 1..25: note = chr4:96180202-96180227
  misc_feature 1..25: note = Hypo
  source 1..25: mol_type = genomic DNA
cgcccggcctcgaccatcttattct

SEQ ID NO: 123630 - DNA, 400 bp, Homo sapiens; identical to SEQ ID NO: 92667
  misc_feature 1..400: note = chr4:96469013-96469413
  misc_feature 1..400: note = Hyper
  source 1..400: mol_type = genomic DNA

SEQ ID NO: 123631 - DNA, 496 bp, Homo sapiens; identical to SEQ ID NO: 92668
  misc_feature 1..496: note = chr4:96469768-96470264
  misc_feature 1..496: note = Hyper
  source 1..496: mol_type = genomic DNA

SEQ ID NO: 123632 - DNA, 499 bp, Homo sapiens
  misc_feature 1..499: note = chr4:96470693-96471192
  misc_feature 1..499: note = Hyper
  source 1..499: mol_type = genomic DNA
ttgcagggagatcagcgcccaggagaccagctgtgggtttgcccgctgaagccgaggcgagacagaccaggggacgaagcggctgcggagagtggcagcgcgcctgcctcccgcggtgcgccagacctggacgccgggagtgcagcgggcgcgccccgggccactaggctgtgtccagtggagctcagcctgccgcctgccaccttcttcgccgcgccggcaaagcctcagccgaattccctaggactggactcggtctacgacttcgggtctcgcggttgacgaagccggtgcgggctcgaactgaagtccttcttggttggggaagaaggcatgaagcttttgcactgccccagccggctgctgtcctggggttgtcagcgccagtcagactgctttatgttctgagcgcgtatgacccctttgcagtggaacagaaactaaaagctcgacggaaactcattctgcaacagtgctttctttgcgtgcatgttggtgg

SEQ ID NO: 123633 - DNA, 79 bp, Homo sapiens; identical to SEQ ID NO: 92673
  misc_feature 1..79: note = chr4:97118687-97118766
  misc_feature 1..79: note = Hypo
  source 1..79: mol_type = genomic DNA

SEQ ID NO: 123634 - DNA, 18 bp, Homo sapiens
  misc_feature 1..18: note = chr4:97118826-97118844
  misc_feature 1..18: note = Hypo
  source 1..18: mol_type = genomic DNA
ccgcggatctgacaggag

SEQ ID NO: 123635 - DNA, 106 bp, Homo sapiens; identical to SEQ ID NO: 40325
  misc_feature 1..106: note = chr4:99495888-99495994
  misc_feature 1..106: note = Hypo
  source 1..106: mol_type = genomic DNA

SEQ ID NO: 123636 - DNA, 30 bp, Homo sapiens; identical to SEQ ID NO: 92683
  misc_feature 1..30: note = chr4:99503312-99503342
  misc_feature 1..30: note = Hypo
  source 1..30: mol_type = genomic DNA

SEQ ID NO: 123637 - DNA, 30 bp, Homo sapiens; identical to SEQ ID NO: 92684
  misc_feature 1..30: note = chr4:99559227-99559257
  misc_feature 1..30: note = Hypo
  source 1..30: mol_type = genomic DNA

SEQ ID NO: 123638 - DNA, 171 bp, Homo sapiens; identical to SEQ ID NO: 92685
  misc_feature 1..171: note = chr4:99579127-99579298
  misc_feature 1..171: note = Hyper
  source 1..171: mol_type = genomic DNA

SEQ ID NO: 123639 - DNA, 30 bp, Homo sapiens; identical to SEQ ID NO: 92689
  misc_feature 1..30: note = chr4:99846517-99846547
  misc_feature 1..30: note = Hypo
  source 1..30: mol_type = genomic DNA

SEQ ID NO: 123640 - DNA, 78 bp, Homo sapiens; identical to SEQ ID NO: 91402
  misc_feature 1..78: note = chr4:100729677-100729755
  misc_feature 1..78: note = Hyper
  source 1..78: mol_type = genomic DNA

SEQ ID NO: 123641 - DNA, 725 bp, Homo sapiens
  misc_feature 1..725: note = chr4:101111245-101111970
  misc_feature 1..725: note = Hyper
  source 1..725: mol_type = genomic DNA
ggctcctaaaatgcccggcgtcccgggagcgaactagcggaggaactcctttgccaaaggggtggaaccggcctctgcaactcaatttgacaaagccctgggagcggagccgcaacctgaaactaactcaacagttcgcaaaacttggaagcgacctgccccgcggagcgccccccggccccgctgcccccaccaaggccgcagcttcgctcacctgccaggagttcgcgggggcctgcgcgctcgctgccgggtaaacacaggcaggtggcttcttaggagtcccctctcctggggactcggtgacctgcagaccccagcagccagcggcaccctgctcacccctcccgggccaccctgcgccggctcctcgcagtagcatagcctccggggcagcgagaactttataggtccagtccccaccctgctcaggcccgcccacctgcaccgcccctccccggccagcgccccgcccctcccctccagagtctggtcccctttcaacctctacacttccagggagcccgagcctagccacagggagttgaggataagcctgtggtagagcggacacctgttgcttccagggtagatctcgggccactgggaccgcaattccgggtgcacgactcgtcaaagcctgaacctgattgttcagtgcgacccctccccgagcgtccgcgctttcacactcaggctgctcccggcagcgggaagctttaagc

SEQ ID NO: 123642 - DNA, 24 bp, Homo sapiens
  misc_feature 1..24: note = chr4:103350988-103351012
  misc_feature 1..24: note = Hypo
  source 1..24: mol_type = genomic DNA
ctgaggcaggagaatcgcttgaac

SEQ ID NO: 123643 - DNA, 17 bp, Homo sapiens
  misc_feature 1..17: note = chr4:103399288-103399305
  misc_feature 1..17: note = Hypo
  source 1..17: mol_type = genomic DNA
ctagccaagggaagccg

SEQ ID NO: 123644 - DNA, 30 bp, Homo sapiens; identical to SEQ ID NO: 91417
  misc_feature 1..30: note = chr4:103658311-103658341
  misc_feature 1..30: note = Hypo
  source 1..30: mol_type = genomic DNA

SEQ ID NO: 123645 - DNA, 27 bp, Homo sapiens
  misc_feature 1..27: note = chr4:103811714-103811741
  misc_feature 1..27: note = Hypo
  source 1..27: mol_type = genomic DNA
ggcttggtgcagtgacgacacacctgt

SEQ ID NO: 123646 - DNA, 30 bp, Homo sapiens; identical to SEQ ID NO: 91420
  misc_feature 1..30: note = chr4:103941455-103941485
  misc_feature 1..30: note = Hypo
  source 1..30: mol_type = genomic DNA

SEQ ID NO: 123647 - DNA, 298 bp, Homo sapiens; identical to SEQ ID NO: 91421
  misc_feature 1..298: note = chr4:103997871-103998169
  misc_feature 1..298: note = Hyper
  source 1..298: mol_type = genomic DNA

SEQ ID NO: 123648 - DNA, 30 bp, Homo sapiens; identical to SEQ ID NO: 91422
  misc_feature 1..30: note = chr4:104073705-104073735
  misc_feature 1..30: note = Hypo
  source 1..30: mol_type = genomic DNA

SEQ ID NO: 123649 - DNA, 30 bp, Homo sapiens; identical to SEQ ID NO: 91429
  misc_feature 1..30: note = chr4:106046597-106046627
  misc_feature 1..30: note = Hypo
  source 1..30: mol_type = genomic DNA

SEQ ID NO: 123650 - DNA, 147 bp, Homo sapiens; identical to SEQ ID NO: 91430
  misc_feature 1..147: note = chr4:106067073-106067220
  misc_feature 1..147: note = Hyper
  source 1..147: mol_type = genomic DNA

SEQ ID NO: 123651 - DNA, 15 bp, Homo sapiens
  misc_feature 1..15: note = chr4:106689465-106689480
  misc_feature 1..15: note = Hypo
  source 1..15: mol_type = genomic DNA
cgtaagtcatcgcgc

SEQ ID NO: 123652 - DNA, 47 bp, Homo sapiens; identical to SEQ ID NO: 91432
  misc_feature 1..47: note = chr4:106816754-106816801
  misc_feature 1..47: note = Hyper
  source 1..47: mol_type = genomic DNA

SEQ ID NO: 123653 - DNA, 30 bp, Homo sapiens; identical to SEQ ID NO: 40328
  misc_feature 1..30: note = chr4:107134495-107134525
  misc_feature 1..30: note = Hypo
  source 1..30: mol_type = genomic DNA

SEQ ID NO: 123654 - DNA, 668 bp, Homo sapiens; identical to SEQ ID NO: 91435
  misc_feature 1..668: note = chr4:107955181-107955849
  misc_feature 1..668: note = Hyper
  source 1..668: mol_type = genomic DNA

SEQ ID NO: 123655 - DNA, 1579 bp, Homo sapiens
  misc_feature 1..1579: note = chr4:107956414-107957993
  misc_feature 1..1579: note = Hyper
  source 1..1579: mol_type = genomic DNA
ctgtatctggggccacgctccgaatgttgcaagatgcaatggcaaaccgctagcccaagagagctggcccctgcctcttctgtctgaagaatgtgtttgggggttttcctacctgccccaggtttttgcccttcttactgccgccgaatgccagtccttggtacatgcccgcagatcgattggcggcctgaccaggcgtctccccgcccagagaggacttgatggagttgagtttggcccgcgaactgccgatctgtgagctctccaccatcagcaccgcggccagtaggagcaggcagcaggacgaatccttgctccgcatcaacgcggccatctcccggcgagggggtccccaggaagacgcaaagcccggaggggtgggaatgcaaagggagggaggaccccaacacggggcccctcacttgggtcgcgggggcttgcagattgtgttccctcaacccttcctggttcggggacccaggaccctatgaactcagtctcacgcctcaggacagaaattagcggaacccaagcgagacccgcttctccaccaggacaggaagttctgcaataactggaagcaatcaaatgcgaggcgctttctcgccaaggaggcgtgacccaaggtgcaagaaaacccagccctgtggatcgcaccgcttccgttccttcttgccccgcacctccttggtcccgccgggatctcggcggtttaactctcctcttaattgatcaggaggcccgcatcagctccttctccttcaactcagttgcttttctctcctctcttttcctatcctttatgtgtcaaactttgcaggacacagtgctccttttcaaagttagcaggcgctttagtaggggatcaggagacgtccccggaccgaatcctcgagatctgaagagaatcgaggtcccccacacgcgcactcacagttgccccgaagcgttgtcccctgactcacaagagacagcgaatcgctgccagcgcagcgatgcctagggagcggacttgcgctacgctcgccgcgggctcccgctttctctctctctgctctctccccagtcctctttgctttttatagcttcccacagtgaggactttttttttttttttacctccgcccccaattcaagagtgacaaagagtgaaaatttttctctcactccccaccgcttccgcccccctcctctctgcgtgctgcttctgcttctgcggctttcactccagcttttcctcctcctcatcctcccgctctgtctccacccacaactactggaaaagggggatctagcttttccatgaggtgaatggaacataggggctcctaattcctgacaacaactccagcggttggaggggtctttggaaactggcagagaccaaaggtggaaacggagtggggcaagctgacaccacttgatcgctgccaccctttcttagatcttcccacccatcttcagcccctgactccgcgaggagagctggaaaagccctatggaagctttagagaagtgagcatctgcgcatctgctcattagtattgtgttctttgtgagctcacgtttggttttagac

SEQ ID NO: 123656 - DNA, 247 bp, Homo sapiens; identical to SEQ ID NO: 91438
  misc_feature 1..247: note = chr4:107958393-107958640
  misc_feature 1..247: note = Hyper
  source 1..247: mol_type = genomic DNA

SEQ ID NO: 123657 - DNA, 33 bp, Homo sapiens; identical to SEQ ID NO: 91439
  misc_feature 1..33: note = chr4:107994285-107994318
  misc_feature 1..33: note = Hypo
  source 1..33: mol_type = genomic DNA

SEQ ID NO: 123658 - DNA, 30 bp, Homo sapiens; identical to SEQ ID NO: 91440
  misc_feature 1..30: note = chr4:108044889-108044919
  misc_feature 1..30: note = Hypo
  source 1..30: mol_type = genomic DNA

SEQ ID NO: 123659 - DNA, 200 bp, Homo sapiens; identical to SEQ ID NO: 91441
  misc_feature 1..200: note = chr4:108302104-108302304
  misc_feature 1..200: note = Hypo
  source 1..200: mol_type = genomic DNA

SEQ ID NO: 123660 - DNA, 30 bp, Homo sapiens; identical to SEQ ID NO: 91442
  misc_feature 1..30: note = chr4:108745720-108745750
  misc_feature 1..30: note = Hyper
  source 1..30: mol_type = genomic DNA

SEQ ID NO: 123661 - DNA, 57 bp, Homo sapiens; identical to SEQ ID NO: 91443
  misc_feature 1..57: note = chr4:108746014-108746071
  misc_feature 1..57: note = Hyper
  source 1..57: mol_type = genomic DNA

SEQ ID NO: 123662 - DNA, 128 bp, Homo sapiens; identical to SEQ ID NO: 91444
  misc_feature 1..128: note = chr4:108746391-108746519
  misc_feature 1..128: note = Hyper
  source 1..128: mol_type = genomic DNA

SEQ ID NO: 123663 - DNA, 111 bp, Homo sapiens; identical to SEQ ID NO: 91445
  misc_feature 1..111: note = chr4:108853176-108853287
  misc_feature 1..111: note = Hyper
  source 1..111: mol_type = genomic DNA

SEQ ID NO: 123664 - DNA, 473 bp, Homo sapiens; identical to SEQ ID NO: 91446
  misc_feature 1..473: note = chr4:109087990-109088463
  misc_feature 1..473: note = Hyper
  source 1..473: mol_type = genomic DNA

SEQ ID NO: 123665 - DNA, 645 bp, Homo sapiens; identical to SEQ ID NO: 91447
  misc_feature 1..645: note = chr4:109088669-109089314
  misc_feature 1..645: note = Hyper
  source 1..645: mol_type = genomic DNA

SEQ ID NO: 123666 - DNA, 50 bp, Homo sapiens; identical to SEQ ID NO: 91448
  misc_feature 1..50: note = chr4:109090370-109090420
  misc_feature 1..50: note = Hyper
  source 1..50: mol_type = genomic DNA

SEQ ID NO: 123667 - DNA, 122 bp, Homo sapiens; identical to SEQ ID NO: 29069
  misc_feature 1..122: note = chr4:109092563-109092685
  misc_feature 1..122: note = Hyper
  source 1..122: mol_type = genomic DNA

SEQ ID NO: 123668 - DNA, 1182 bp, Homo sapiens; identical to SEQ ID NO: 91450
  misc_feature 1..1182: note = chr4:109093101-109094283
  misc_feature 1..1182: note = Hyper
  source 1..1182: mol_type = genomic DNA

SEQ ID NO: 123669 - DNA, 55 bp, Homo sapiens; identical to SEQ ID NO: 29071
  misc_feature 1..55: note = chr4:109094529-109094584
  misc_feature 1..55: note = Hyper
  source 1..55: mol_type = genomic DNA

SEQ ID NO: 123670 - DNA, 184 bp, Homo sapiens; identical to SEQ ID NO: 91452
  misc_feature 1..184: note = chr4:109183797-109183981
  misc_feature 1..184: note = Hypo
  source 1..184: mol_type = genomic DNA

SEQ ID NO: 123671 - DNA, 16 bp, Homo sapiens
  misc_feature 1..16: note = chr4:109311251-109311267
  misc_feature 1..16: note = Hypo
  source 1..16: mol_type = genomic DNA
aataaaaacagccaac

SEQ ID NO: 123672 - DNA, 506 bp, Homo sapiens; identical to SEQ ID NO: 91455
  misc_feature 1..506: note = chr4:109683609-109684115
  misc_feature 1..506: note = Hyper
  source 1..506: mol_type = genomic DNA

SEQ ID NO: 123673 - DNA, 1479 bp, Homo sapiens
  misc_feature 1..1479: note = chr4:110222955-110224434
  misc_feature 1..1479: note = Hyper
  source 1..1479: mol_type = genomic DNA
aaggggcccctttggcggattcgagagcggcgatcctcgcctggaggtcgttggttttcacacccaggtacaggcaagacaccacggccaccactgacaggagggccgccaggacggcacacgggggcatggtccgggcacaatgctgttcggcaggggtcgggtcctcggatctgggctcccggccccctcctttccctgcgtgcttcttcagcagcatcgtggcggggtcggccgtctcggcttcgcttcccaccctctacacctcaaataatcctaaaaggaaagaaaaaggtcgattcctccaaagttcagtccctgtggctgcacaactagttggtggagtcaagcccacgagcggatacggacccctgccttgctcagcgtccagacccgcaggcgtgcaccatccccgctttcttctctcctcccagctggaagtgaaaagcaccctccgtccggggactgggtggcggtggggtaaaaagcaagacgaaacccacccagacagctcttccgactcccagaggaccgacacctctttcgagggccccaacagtggccgctcagggtccgagggcaacggccgaggcgccacgcggggccgcggctcgccctggccacggaggaccggacctgttgcgcctctgtgagtttgccttatttctacctactcggtgtctttcggcacgccgacctgtttcccacctgcattcagttcaaggcaaaaaggctgtgagagcacgctacagcgcagcgcgaaaggggcgactaaggtggagaagagagaggaaaacgaaataaacccaaggaaccaatgctactcgcgaagccgaagtcgcggctgcccgaaggatctccgcagccccgcgtgcgcgatccttaaatacccttcgcgatgctcgcgtgagtgtgtgtgtgagtgtgtgagtgcgcgcgcgctccgagcacgacgtccctcccccgaccccctcccggcgcccggcgtccggcctgccgctcccgctgctgcgcgccccccttccgaaggcaaagcaggagcccgccttattatcataatgtattcaccttggcccagcccgcgggccggcccggggaacccccaagggaggcgggaagcttgggtgggagcggggcaggaggtctgttattagcataatgtatgcaaatagctggagcggccaccgtgattggagaggagcctggcgacccctccccctgcgcggagtaacttcagcatctccgagggccacctctctggcctgggccggggccgaagcggggtcggctgcgcaagaggcggcaactttggcttatactgactcagcccagcgccccctttttatcccacataaaaatggagaaatggcctccgggaggaagatgtgaagcggcacgctctatctctactgatcttcactcaaaagcagccgcaggagctgttgctatctcgctgtggtgcagcgcttttccctcctc

SEQ ID NO: 123674 - DNA, 79 bp, Homo sapiens; identical to SEQ ID NO: 40332
  misc_feature 1..79: note = chr4:110735440-110735519
  misc_feature 1..79: note = Hypo
  source 1..79: mol_type = genomic DNA

SEQ ID NO: 123675 - DNA, 19 bp, Homo sapiens
  misc_feature 1..19: note = chr4:110735819-110735838
  misc_feature 1..19: note = Hypo
  source 1..19: mol_type = genomic DNA
gccccgcctacaaaggtat

SEQ ID NO: 123676 - DNA, 30 bp, Homo sapiens; identical to SEQ ID NO: 91462
  misc_feature 1..30: note = chr4:111215543-111215573
  misc_feature 1..30: note = Hypo
  source 1..30: mol_type = genomic DNA

SEQ ID NO: 123677 - DNA, 136 bp, Homo sapiens
  misc_feature 1..136: note = chr4:111531853-111531989
  misc_feature 1..136: note = Hyper
  source 1..136: mol_type = genomic DNA
agcctaggacttcagcgcgacctcaagccaggacttctgcgaggtctcaggtccgagggccaggtcgggcgccggttgcaccgcccaccgcgcgcctccccttcgtccccaggccctggtccggggctcttgctgc

SEQ ID NO: 123678 - DNA, 1115 bp, Homo sapiens
  misc_feature 1..1115: note = chr4:111532245-111533360
  misc_feature 1..1115: note = Hyper
  source 1..1115: mol_type = genomic DNA
ccctcatttgtcctccgcttcctgcggctgaacggtccttgataagtggcctccagaagattcggtactttgggccaggggcaaggctggggctgctctaggtgcagaactctctataggtcctctctcccaggaccggatagatgattcatttttatacgtaacgttttaccccagtctattcccgcagctggttaatgttcaacccccgggcctcgagaggcagctccaaggaggcaggcaggcatgacccattcaaggtatatggctgctcgggagtgaaggcgcggaggcccgagaaagggtgagaagggatgtggcggggggctcctccggccctggactccctgggtggactagaaaagggcaaagaagtggtcacatctgtgggccagactggtgcgcgatctttggaggcgcagcagcaaggccgcgccagggctgagcccagaccgcccacgaggaggcccgccaggcccggagcagcggcgcgtgcgggggcgtgccgagcgcaggctctagggcccctgcttcgccccagctggaccccgcgggcggtcggtgcagctcgagcgtgtgggctgcgatgccctgcctgagacttcgggctagggatgcgggcgggaagtgggggtgcggcggcagctgcagattagattccttttttttttggccggagggacgtgcaaacttctagtgcccgggccaagagggcgaccccggaggtgcgtaggtggccctccgggttcccgcttctcctagtgcctctgaaaataccgtcagggtaaagggagacaggcagtaagtcttaccaccaccgccctttccccatgtcattggccaaaaactgaacattaagataaagcagctgtttcagtcaatggaaagcggtagggcgaggttgtacccaaaacccggtttagacggccaatgaagtcctaggaaaagccgccccgggggcacgttcaggtggagcggctgcacctcgggtcgttctaagggatgggctgcgtggtacccacggaattcatgggtccaaaaggtcctggtcacctgtccaaacatccatcccctggcgcatggcggttgacaagatggcccggccacccagagga

SEQ ID NO: 123679 - DNA, 44 bp, Homo sapiens
  misc_feature 1..44: note = chr4:111535304-111535348
  misc_feature 1..44: note = Hyper
  source 1..44: mol_type = genomic DNA
ttcttcagtcaaccacgtttcttgcttcccggtgtgcttagatt

SEQ ID NO: 123680 - DNA, 30 bp, Homo sapiens
  misc_feature 1..30: note = chr4:111535679-111535709
  misc_feature 1..30: note = Hyper
  source 1..30: mol_type = genomic DNA
cagggttaatttatacggctttcgaggaat

SEQ ID NO: 123681 - DNA, 1151 bp, Homo sapiens
  misc_feature 1..1151: note = chr4:111536093-111537244
  misc_feature 1..1151: note = Hyper
  source 1..1151: mol_type = genomic DNA
taataaaacaaaacccgaggataggccaaagataccgagagaagaaaaggtgcctgctagtaacaggtgagggatggaagggggtggcggggagaaagcccccagacggcggatcgtctgcgcggggttcctgccccaggcctggcgaacctctgagcgctcaaggagcacggcggcagtgcgctgaggccagtgaggcctgggcgcctccgggcccaacctcgagctcgccatttttgaacccaagcggggaaggttggtgctcatgctatagattatgttaaaggttcctttaagcactttaatacacaactagctcagaaatcattaagagacctagagaaggagaaaaaataccctcacactcaccggtaataagtgttgacatgcagcaaaaatcggttgagtggaaccgaggtggtggttgcagcgacggctagagggggacccgtgcaggggcgggaggggcgaggggactgactgcaccggctctgggagctaggtttctctcgctggatgggaaaaggaggtgcggaaaggggcaggcggcctgcgggctagcggggatgagagttgtggggagaacggaggagagagtaaaattattccttttggaagtccaagggaagggagctgaggtgagagaaatggcctctcttaggtcccaagtctccgcccccagcctgcaccactcaagtcggggaagtgacaactcttcctaaacctcgacttccattttttgtttcctgcagattgattgatgtcctcgcgttgttctagttcagcaaccaaactaggccgaggtacacctcttttacccagagctcccaaatcactcaccaacctgcaggagacctaaatcctccgggcaggtctcgttagcgcttccagcccccatccccaaatcccctcttctagctccttccttcccctccgccctttggccctccccgccccctaccaggctgagaggcggagaggccgggaccgctgggccctgcggctccagaagccaaagtccgcccgtggggaccgttttcctctccactgctctcaagtgaacaacatggtgggaggtgaccctcgtccaaagggcttttatctgccccccactgctgcgtgatccctccgcaagtcggaggcagagcttt

SEQ ID NO: 123682 - DNA, 45 bp, Homo sapiens; identical to SEQ ID NO: 91472
  misc_feature 1..45: note = chr4:111537452-111537497
  misc_feature 1..45: note = Hyper
  source 1..45: mol_type = genomic DNA

SEQ ID NO: 123683 - DNA, 132 bp, Homo sapiens
  misc_feature 1..132: note = chr4:111539463-111539595
  misc_feature 1..132: note = Hyper
  source 1..132: mol_type = genomic DNA
caccgcggaattcagcgacgggctactcaggttgttcaagttattcaggctgttgagactggagcccgggacgcctgtcactgctgagggcaccatgctggacgacatgctcatggacgagatagagttggg

SEQ ID NO: 123684 - DNA, 57 bp, Homo sapiens; identical to SEQ ID NO: 91474
  misc_feature 1..57: note = chr4:111539809-111539866
  misc_feature 1..57: note = Hyper
  source 1..57: mol_type = genomic DNA

SEQ ID NO: 123685 - DNA, 632 bp, Homo sapiens
  misc_feature 1..632: note = chr4:111540088-111540720
  misc_feature 1..632: note = Hyper
  source 1..632: mol_type = genomic DNA
gccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtatt

SEQ ID NO: 123686 - DNA, 286 bp, Homo sapiens
  misc_feature 1..286: note = chr4:111542187-111542473
  misc_feature 1..286: note = Hyper
  source 1..286: mol_type = genomic DNA
gcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagac

SEQ ID NO: 123687 - DNA, 915 bp, Homo sapiens
  misc_feature 1..915: note = chr4:111542809-111543724
  misc_feature 1..915: note = Hyper
  source 1..915: mol_type = genomic DNA
atttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgct

SEQ ID NO: 123688 - DNA, 740 bp, Homo sapiens
  misc_feature 1..740: note = chr4:111543967-111544707
  misc_feature 1..740: note = Hyper
  source 1..740: mol_type = genomic DNA
aataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaacta

SEQ ID NO: 123689 - DNA, 1098 bp, Homo sapiens; identical to SEQ ID NO: 91481
  misc_feature 1..1098: note = chr4:111549751-111550849
  misc_feature 1..1098: note = Hyper
  source 1..1098: mol_type = genomic DNA

SEQ ID NO: 123690 - DNA, 139 bp, Homo sapiens; identical to SEQ ID NO: 91482
  misc_feature 1..139: note = chr4:111552072-111552211
  misc_feature 1..139: note = Hyper
  source 1..139: mol_type = genomic DNA

SEQ ID NO: 123691 - DNA, 60 bp, Homo sapiens; identical to SEQ ID NO: 91483
  misc_feature 1..60: note = chr4:111552448-111552508
  misc_feature 1..60: note = Hyper
  source 1..60: mol_type = genomic DNA

SEQ ID NO: 123692 - DNA, 1225 bp, Homo sapiens; identical to SEQ ID NO: 91484
  misc_feature 1..1225: note = chr4:111552914-111554139
  misc_feature 1..1225: note = Hyper
  source 1..1225: mol_type = genomic DNA

SEQ ID NO: 123693 - DNA, 30 bp, Homo sapiens; identical to SEQ ID NO: 91485
  misc_feature 1..30: note = chr4:111554631-111554661
  misc_feature 1..30: note = Hyper
  source 1..30: mol_type = genomic DNA

SEQ ID NO: 123694 - DNA, 846 bp, Homo sapiens
  misc_feature 1..846: note = chr4:111554950-111555796
  misc_feature 1..846: note = Hyper
  source 1..846: mol_type = genomic DNA
tccccctttctctcccgggcgagccaaatctttttcacgttttcaaccacaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagat

SEQ ID NO: 123695 - DNA, 1623 bp, Homo sapiens
  misc_feature 1..1623: note = chr4:111557628-111559251
  misc_feature 1..1623: note = Hyper
  source 1..1623: mol_type = genomic DNA
tgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaa

SEQ ID NO: 123696 - DNA, 556 bp, Homo sapiens; identical to SEQ ID NO: 91490
  misc_feature 1..556: note = chr4:111560186-111560742
  misc_feature 1..556: note = Hyper
  source 1..556: mol_type = genomic DNA

SEQ ID NO: 123697 - DNA, 348 bp, Homo sapiens
  misc_feature 1..348: note = chr4:111562342-111562690
  misc_feature 1..348: note = Hyper
  source 1..348: mol_type = genomic DNA
aacagaccaatatctcgcactcaaaacggagtttccggtgattcccagctttaattttggagcaggggtctttctcctctgctgttaaaaagattttgtgcttgtttgtgagtgagtgcattcaagtggaaggaacgctcccacggctacggtggctcaggccctttgctcggaccgggaccttacagttctaacccaggagcgttaaactctggaagactccgggccagccctggaggtgcgtggccccgcaagtcgccaggccaagcttgctttttctgtctgcccctccggcaggctgggcgcgctatggcagtgagctttccgcgcaaacggagagctggaacc

SEQ ID NO: 123698 - DNA, 30 bp, Homo sapiens; identical to SEQ ID NO: 91493
  misc_feature 1..30: note = chr4:112059654-112059684
  misc_feature 1..30: note = Hypo
  source 1..30: mol_type = genomic DNA

SEQ ID NO: 123699 - DNA, 209 bp, Homo sapiens; identical to SEQ ID NO: 91494
  misc_feature 1..209: note = chr4:112244823-112245032
  misc_feature 1..209: note = Hypo
  source 1..209: mol_type = genomic DNA

SEQ ID NO: 123700 - DNA, 198 bp, Homo sapiens; identical to SEQ ID NO: 91495
  misc_feature 1..198: note = chr4:113154853-113155051
  misc_feature 1..198: note = Hypo
  source 1..198: mol_type = genomic DNA

SEQ ID NO: 123701 - DNA, 164 bp, Homo sapiens; identical to SEQ ID NO: 91496
  misc_feature 1..164: note = chr4:113199029-113199193
  misc_feature 1..164: note = Hypo
  source 1..164: mol_type = genomic DNA

SEQ ID NO: 123702 - DNA, 539 bp, Homo sapiens; identical to SEQ ID NO: 91497
  misc_feature 1..539: note = chr4:113430619-113431158
  misc_feature 1..539: note = Hyper
  source 1..539: mol_type = genomic DNA

SEQ ID NO: 123703 - DNA, 886 bp, Homo sapiens
  misc_feature 1..886: note = chr4:113431723-113432609
  misc_feature 1..886: note = Hyper
  source 1..886: mol_type = genomic DNA
cccaggctgggggagcgagaaaggggggtattggagccctcacgttttattggtctaacctaatttcactaattctcttttcacacatttcttttgcagattcggaggccgggactttcacgctcccgggagcgcactgcattggcgcgattcaagagctgcccgctttatttaattaatacattcaaagctcgcttgggagcccgagggggctcggggaagaccgaggctggcggtgaggaggaggcgcttttaaccggttccaggtgtcggtgcccagaagtcacaaccagctcaagggtgtgcaatgcaggggggtgtacccagcgggtgggggcgccgcagctcccagcctcgccctcaagcccggccctttagcagcctgtgacccagactggcgggtgggcagctgaagccggccttgggtctaaacgcccttcctgggccatcggactaggctttgggaagtgccgaatgggtccttcctccctcctggccaaagccgcccagggccttcgcctcagctgggacaccaggagcgcccatccggctctggtccaggtgctgcgggcccgggaagcctcagcccctcctcctgcctccggctgagcctaggtccggctcccgtggcgggcccagcggttggcagtccgcctctctactttttttttcctccttcttggcactcagatggatgtatttaaaatctagtgaaggaaaaatgagccgtaacaaggcctgagcactttagaacaaataaatacagccagtcccggaacgccggccgcgctaaagcgacgctccaatgagaacaggacccaccttcgcgcctctccgcacttaggaaaacgcgccgcagcgcgctagctggcgttggaaagatcta

SEQ ID NO: 123704 - DNA, 33 bp, Homo sapiens; identical to SEQ ID NO: 91502
  misc_feature 1..33: note = chr4:113435442-113435475
  misc_feature 1..33: note = Hyper
  source 1..33: mol_type = genomic DNA

SEQ ID NO: 123705 - DNA, 811 bp, Homo sapiens; identical to SEQ ID NO: 91503
  misc_feature 1..811: note = chr4:113435774-113436585
  misc_feature 1..811: note = Hyper
  source 1..811: mol_type = genomic DNA

SEQ ID NO: 123706 - DNA, 488 bp, Homo sapiens; identical to SEQ ID NO: 91504
  misc_feature 1..488: note = chr4:113436827-113437315
  misc_feature 1..488: note = Hyper
  source 1..488: mol_type = genomic DNA

SEQ ID NO: 123707 - DNA, 656 bp, Homo sapiens; identical to SEQ ID NO: 91505
  misc_feature 1..656: note = chr4:113437622-113438278
  misc_feature 1..656: note = Hyper
  source 1..656: mol_type = genomic DNA

SEQ ID NO: 123708 - DNA, 198 bp, Homo sapiens; identical to SEQ ID NO: 7510
  misc_feature 1..198: note = chr4:113438506-113438704
  misc_feature 1..198: note = Hyper
  source 1..198: mol_type = genomic DNA

SEQ ID NO: 123709 - DNA, 1028 bp, Homo sapiens
  misc_feature 1..1028: note = chr4:113441524-113442552
  misc_feature 1..1028: note = Hyper
  source 1..1028: mol_type = genomic DNA
attccctccacacttcgacctcacaagttgcgaaagaggacaaatggtcgccgcgctagtcccttgctgttgcaggtgactgtcgggggcgcgaaagagggcgcccttccctgagaggacaaaagccaaggtttggctatccagcgagcctgtcccccaattcacagtaaaccaccgtcggccaaaggagatggcgtgtctactctctgctaaaataacaagatgaagtacctgacaagggggctttgtaacccaaatcctaatcctccgagtgagttctcagaaagatggaaagatggcgggaaaaagttggtaaatcctaaacatcttttacatcaacggtctctagttcttcgctgcaggctagaaacgcagcttccagagcaggagagcctggtatggaaacaattagctttctccgcagagcaccccttgcaacgctaggattcgttattgatagtggtgagcgctgggaatgagtgtgaattcggagtttctgacggtcccctatccgggagccaaggaagccaaggagaaaacaatgtaaattcgccccgatccccagttactgcatcccacatggtattctcggtctcccccacgttttccccttgaatcctgtccggggaggattcggcttgaacctagccctggagaggtcccggccaggtcactgaactgcgcttcactgcgccagcccctccccttcagtattttcatcgcgtccgaggaatcggcatccaccacagcagacagaaggcagggaagatcatcccccaggccccaagccccactctagagaccctggccccaagcccgcacgacgtgctctggtgcctccaagccaaacattccgggattcggcttgacacacaaggtcagtcagcttgctagcgcggaatcggccccgcaggtgctaggaggctcacttccttcttcgcagacgctataccctatccccacctgctctggggaaggcaaagctccgcagacttcttatccctgaggcaacccgctacccaaatgtc

SEQ ID NO: 123710 - DNA, 178 bp, Homo sapiens; identical to SEQ ID NO: 91509
  misc_feature 1..178: note = chr4:113442754-113442932
  misc_feature 1..178: note = Hyper
  source 1..178: mol_type = genomic DNA

SEQ ID NO: 123711 - DNA, 446 bp, Homo sapiens
  misc_feature 1..446: note = chr4:113444002-113444448
  misc_feature 1..446: note = Hyper
  source 1..446: mol_type = genomic DNA
gaaaaaaattgttttatatatcagaaaaggatacgtgtatgtaacaataaaactgtgtaatgcaatagtgttgggagacgggggtatggtttattttcagggatctaaagatatactttagaatctaaaacattgggggttgacacttattgctgatttatccattctttctttccccccgaagtatttctcgagcgcctaccgagtgccaggcgcctagcgaggcgcagcgttagcaccaggcgcgaaccagacagctgtggcctgcctggtagaaacgaccctgcgataacgcagttgctagtacagctctcggcggaggagccagggccgggtctccaggccgggagggggcggccgcggtgcgcccgggcagcgctccctgcgcaagtagttcttctatgtctttacacgcacttccaaaaaaacttcgcaagtcacagaaa

SEQ ID NO: 123712 - DNA, 500 bp, Homo sapiens; identical to SEQ ID NO: 29125
  misc_feature 1..500: note = chr4:113444944-113445444
  misc_feature 1..500: note = Hyper
  source 1..500: mol_type = genomic DNA

SEQ ID NO: 123713 - DNA, 41 bp, Homo sapiens; identical to SEQ ID NO: 91513
  misc_feature 1..41: note = chr4:113559124-113559165
  misc_feature 1..41: note = Hypo
  source 1..41: mol_type = genomic DNA

SEQ ID NO: 123714 - DNA, 101 bp, Homo sapiens; identical to SEQ ID NO: 91514
  misc_feature 1..101: note = chr4:113559405-113559506
  misc_feature 1..101: note = Hypo
  source 1..101: mol_type = genomic DNA

SEQ ID NO: 123715 - DNA, 30 bp, Homo sapiens; identical to SEQ ID NO: 91515
  misc_feature 1..30: note = chr4:113626216-113626246
  misc_feature 1..30: note = Hyper
  source 1..30: mol_type = genomic DNA

SEQ ID NO: 123716 - DNA, 469 bp, Homo sapiens; identical to SEQ ID NO: 91516
  misc_feature 1..469: note = chr4:113626447-113626916
  misc_feature 1..469: note = Hyper
  source 1..469: mol_type = genomic DNA

SEQ ID NO: 123717 - DNA, 97 bp, Homo sapiens; identical to SEQ ID NO: 91517
  misc_feature 1..97: note = chr4:113627374-113627471
  misc_feature 1..97: note = Hyper
  source 1..97: mol_type = genomic DNA

SEQ ID NO: 123718 - DNA, 30 bp, Homo sapiens; identical to SEQ ID NO: 40338
  misc_feature 1..30: note = chr4:114176916-114176946
  misc_feature 1..30: note = Hypo
  source 1..30: mol_type = genomic DNA

SEQ ID NO: 123719 - DNA, 64 bp, Homo sapiens; identical to SEQ ID NO: 29128
  misc_feature 1..64: note = chr4:114900586-114900650
  misc_feature 1..64: note = Hyper
  source 1..64: mol_type = genomic DNA

SEQ ID NO: 123720 - DNA, 373 bp, Homo sapiens; identical to SEQ ID NO: 91523
  misc_feature 1..373: note = chr4:115519455-115519828
  misc_feature 1..373: note = Hyper
  source 1..373: mol_type = genomic DNA

SEQ ID NO: 123721 - DNA, 94 bp, Homo sapiens; identical to SEQ ID NO: 91524
  misc_feature 1..94: note = chr4:115520056-115520150
  misc_feature 1..94: note = Hyper
  source 1..94: mol_type = genomic DNA

SEQ ID NO: 123722 - DNA, 571 bp, Homo sapiens; identical to SEQ ID NO: 91525
  misc_feature 1..571: note = chr4:115520374-115520945
  misc_feature 1..571: note = Hyper
  source 1..571: mol_type = genomic DNA

SEQ ID NO: 123723 - DNA, 25 bp, Homo sapiens
  misc_feature 1..25: note = chr4:116217409-116217434
  misc_feature 1..25: note = Hypo
  source 1..25: mol_type = genomic DNA
cccaaagtgccgggattataagctt

SEQ ID NO: 123724 - DNA, 19 bp, Homo sapiens
  misc_feature 1..19: note = chr4:117179151-117179170
  misc_feature 1..19: note = Hypo
  source 1..19: mol_type = genomic DNA
ctcacgctgggagctgtag

SEQ ID NO: 123725 - DNA, 279 bp, Homo sapiens
  misc_feature 1..279: note = chr4:117847229-117847508
  misc_feature 1..279: note = Hyper
  source 1..279: mol_type = genomic DNA
tccccagggcggccccgcgtccgggcggctctctgaggctacgcggtgcccggtgtccggcggggacgactagcgggcgacccctcccatctcgctccccacatccccgcggacacagctggtggcgactcagacctctcgggcagcggctgcagggcgagcacagaggggactccgatgcgaaccgaggccccgggacccgccaggccacccgcgccgccgcccctctccgggtacgcgcgggcccgctcgtcctgggactaacgaagcaaaggcggg

SEQ ID NO: 123726 - DNA, 80 bp, Homo sapiens; identical to SEQ ID NO: 91535
  misc_feature 1..80: note = chr4:118954370-118954450
  misc_feature 1..80: note = Hyper
  source 1..80: mol_type = genomic DNA

SEQ ID NO: 123727 - DNA, 120 bp, Homo sapiens; identical to SEQ ID NO: 91536
  misc_feature 1..120: note = chr4:118955005-118955125
  misc_feature 1..120: note = Hyper
  source 1..120: mol_type = genomic DNA

SEQ ID NO: 123728 - DNA, 61 bp, Homo sapiens; identical to SEQ ID NO: 91537
  misc_feature 1..61: note = chr4:118955468-118955529
  misc_feature 1..61: note = Hyper
  source 1..61: mol_type = genomic DNA

SEQ ID NO: 123729 - DNA, 71 bp, Homo sapiens; identical to SEQ ID NO: 91538
  misc_feature 1..71: note = chr4:119273444-119273515
  misc_feature 1..71: note = Hyper
  source 1..71: mol_type = genomic DNA

SEQ ID NO: 123730 - DNA, 166 bp, Homo sapiens; identical to SEQ ID NO: 91539
  misc_feature 1..166: note = chr4:119273737-119273903
  misc_feature 1..166: note = Hyper
  source 1..166: mol_type = genomic DNA

SEQ ID NO: 123731 - DNA, 110 bp, Homo sapiens; identical to SEQ ID NO: 91540
  misc_feature 1..110: note = chr4:119274104-119274214
  misc_feature 1..110: note = Hyper
  source 1..110: mol_type = genomic DNA

SEQ ID NO: 123732 - DNA, 147 bp, Homo sapiens; identical to SEQ ID NO: 91541
  misc_feature 1..147: note = chr4:119483379-119483526
  misc_feature 1..147: note = Hypo
  source 1..147: mol_type = genomic DNA

SEQ ID NO: 123733 - DNA, 157 bp, Homo sapiens; identical to SEQ ID NO: 91544
  misc_feature 1..157: note = chr4:121843147-121843304
  misc_feature 1..157: note = Hyper
  source 1..157: mol_type = genomic DNA

SEQ ID NO: 123734 - DNA, 167 bp, Homo sapiens; identical to SEQ ID NO: 91545
  misc_feature 1..167: note = chr4:121843564-121843731
  misc_feature 1..167: note = Hyper
  source 1..167: mol_type = genomic DNA

SEQ ID NO: 123735 - DNA, 199 bp, Homo sapiens; identical to SEQ ID NO: 29138
  misc_feature 1..199: note = chr4:121844007-121844206
  misc_feature 1..199: note = Hyper
  source 1..199: mol_type = genomic DNA

SEQ ID NO: 123736 - DNA, 30 bp, Homo sapiens; identical to SEQ ID NO: 91547
  misc_feature 1..30: note = chr4:121844427-121844457
  misc_feature 1..30: note = Hyper
  source 1..30: mol_type = genomic DNA

SEQ ID NO: 123737 - DNA, 648 bp, Homo sapiens; identical to SEQ ID NO: 91548
  misc_feature 1..648: note = chr4:121992048-121992696
  misc_feature 1..648: note = Hyper
  source 1..648: mol_type = genomic DNA

SEQ ID NO: 123738 - DNA, 524 bp, Homo sapiens; identical to SEQ ID NO: 91549
  misc_feature 1..524: note = chr4:121993212-121993736
  misc_feature 1..524: note = Hyper
  source 1..524: mol_type = genomic DNA

SEQ ID NO: 123739 - DNA, 359 bp, Homo sapiens; identical to SEQ ID NO: 91550
  misc_feature 1..359: note = chr4:121993995-121994354
  misc_feature 1..359: note = Hyper
  source 1..359: mol_type = genomic DNA

SEQ ID NO: 123740 - DNA, 21 bp, Homo sapiens
  misc_feature 1..21: note = chr4:122144242-122144263
  misc_feature 1..21: note = Hypo
  source 1..21: mol_type = genomic DNA
agccaccgcgcccagccaggt

SEQ ID NO: 123741 - DNA, 923 bp, Homo sapiens
  misc_feature 1..923: note = chr4:122301422-122302345
  misc_feature 1..923: note = Hyper
  source 1..923: mol_type = genomic DNA
ttaagagagaaggagcgaaggagcggggcgcgactcttaccccccagccagttgtcggaaatgttctggagcatggtgacgggaatgcagaagaaggtgatgagcaggtcactgagcgccaaggagcagataaagatgttggtgacggtgcgcatggccttgctgcgggtcaccacgtagaacaccagagcattgccaaagagcgccagggcgaagatgagcacgccggtgagcacgagggccagcttggcgcgtcccggcagctctggggtgtagacgagcggtcgcagccggtacagagcgatgaactgctcccgcgtcaggttgtggtcccgcagcagccgagagaactgctccggggtaatgttaagcgcctgcattgctgtgcgctcccgggacgcggggccaccgcccgctactggctggccatccgcatctgcggggcagcgagggcttcgggggaccagccggaggccgcctcccttcctctactctggagtcagccgcgcgggagggctctaggctgcaccccgggaggttcgggaaaggagagcagctcagggatcaaacccacgataaagaggcgggaagccaaagcactgggagactcgatctcagtgaccaaaaaatgttcgcggttcaaataaagttcttcccttgctcttccctaaggcgaggcgccgccacggtctggggtgctggagcgccacgcgagggtcctggcgcctctggctccccgccttctggccatgcgatgcggacgccggacccgcttggggagcggtggagggtggggctgaactcggtgacgcctccctcacacccagcttcagtggcgccaacgccgcttccccgcaccctcagggcgagggaagacttccctggctcaccaacttgctgccgcccagcgcctttctcagggc

SEQ ID NO: 123742 - DNA, 867 bp, Homo sapiens
  misc_feature 1..867: note = chr4:122685819-122686686
  misc_feature 1..867: note = Hyper
  source 1..867: mol_type = genomic DNA
tctcgaagagcacagcgccagcccagaccccatacacccaccgtccctggcacccgaacgcgctgcgagccccgggcctcccacaggagcggagacgcgggtccctgcgcctcacgccggaacggacccgtcagagccgccgagccccgcacctggaagctgggaggccgcgaggacggagaatcgaggcggagacccagcccagcgcccgcgcagctcggtgccctcccgccagtgcccgcactcgggtcacaccgcttgctctcgggagaagccccaaggctcgcggtgcaccgagaggcgcccgggctggagcgccccggccgtgttggccacggagttcttcagctgcttgatgaccacgaagagcaggaggaaaagtaagaagagcaggaagaagaagagcgccaggtagagcagcaagttgagttcccactccatgctggaggcgccggcgctcgctggccctgcgcgctcggcgcgggctgcagctggagggcgagcgcgccgcccgcacacccacctcccgcactcccgcccctcgcgagggcgtcccgctatgggcgccgactccggggtccgtgctttgcctcccccggctccgaggaaacgcgccaaggagctgaggaaatccggcgcagactctcccagctggcaccaaagccttccgcttcgccgagatcctctcaggtgctcttgaggacgcgagcgacttccctaggagcgaacttccgcgggcacggacgccagaagaggtaacagctcagtcttccaggggaggtcgggactggtgttttgtaaatgatttaaaagttccacccccaacatccagtagggtccctagctccgctgcgttcccaattaatt

SEQ ID NO: 123743 - DNA, 2006 bp, Homo sapiens; identical to SEQ ID NO: 91557
  misc_feature 1..2006: note = chr4:122871189-122873195
  misc_feature 1..2006: note = Hyper
  source 1..2006: mol_type = genomic DNA

SEQ ID NO: 123744 - DNA, 30 bp, Homo sapiens; identical to SEQ ID NO: 91558
  misc_feature 1..30: note = chr4:123505042-123505072
  misc_feature 1..30: note = Hypo
  source 1..30: mol_type = genomic DNA

SEQ ID NO: 123745 - DNA, 30 bp, Homo sapiens; identical to SEQ ID NO: 91559
  misc_feature 1..30: note = chr4:123591397-123591427
  misc_feature 1..30: note = Hypo
  source 1..30: mol_type = genomic DNA

SEQ ID NO: 123746 - DNA, 69 bp, Homo sapiens; identical to SEQ ID NO: 91560
  misc_feature 1..69: note = chr4:123664094-123664163
  misc_feature 1..69: note = Hypo
  source 1..69: mol_type = genomic DNA

SEQ ID NO: 123747 - DNA, 1268 bp, Homo sapiens; identical to SEQ ID NO: 91561
  misc_feature 1..1268: note = chr4:123747725-123748993
  misc_feature 1..1268: note = Hyper
  source 1..1268: mol_type = genomic DNA

SEQ ID NO: 123748 - DNA, 137 bp, Homo sapiens; identical to SEQ ID NO: 91562
  misc_feature 1..137: note = chr4:123866916-123867053
  misc_feature 1..137: note = Hypo
  source 1..137: mol_type = genomic DNA

SEQ ID NO: 123749 - DNA, 154 bp, Homo sapiens; identical to SEQ ID NO: 91563
  misc_feature 1..154: note = chr4:124320676-124320830
  misc_feature 1..154: note = Hyper
  source 1..154: mol_type = genomic DNA

SEQ ID NO: 123750 - DNA, 17 bp, Homo sapiens
  misc_feature 1..17: note = chr4:124335280-124335297
  misc_feature 1..17: note = Hypo
  source 1..17: mol_type = genomic DNA
acaatgtttgcaggccg

SEQ ID NO: 123751 - DNA, 185 bp, Homo sapiens; identical to SEQ ID NO: 91565
  misc_feature 1..185: note = chr4:124426676-124426861
  misc_feature 1..185: note = Hyper
  source 1..185: mol_type = genomic DNA

SEQ ID NO: 123752 - DNA, 67 bp, Homo sapiens; identical to SEQ ID NO: 91566
  misc_feature 1..67: note = chr4:124427070-124427137
  misc_feature 1..67: note = Hyper
  source 1..67: mol_type = genomic DNA

SEQ ID NO: 123753 - DNA, 67 bp, Homo sapiens; identical to SEQ ID NO: 91568
  misc_feature 1..67: note = chr4:125633717-125633784
  misc_feature 1..67: note = Hyper
  source 1..67: mol_type = genomic DNA

SEQ ID NO: 123754 - DNA, 291 bp, Homo sapiens; identical to SEQ ID NO: 91569
  misc_feature 1..291: note = chr4:126235709-126236000
  misc_feature 1..291: note = Hyper
  source 1..291: mol_type = genomic DNA

SEQ ID NO: 123755 - DNA, 210 bp, Homo sapiens; identical to SEQ ID NO: 91570
  misc_feature 1..210: note = chr4:126236242-126236452
  misc_feature 1..210: note = Hyper
  source 1..210: mol_type = genomic DNA

SEQ ID NO: 123756 - DNA, 346 bp, Homo sapiens; identical to SEQ ID NO: 91571
  misc_feature 1..346: note = chr4:126236714-126237060
  misc_feature 1..346: note = Hyper
  source 1..346: mol_type = genomic DNA

SEQ ID NO: 123757 - DNA, 32 bp, Homo sapiens; identical to SEQ ID NO: 29153
  misc_feature 1..32: note = chr4:126237355-126237387
  misc_feature 1..32: note = Hyper
  source 1..32: mol_type = genomic DNA

SEQ ID NO: 123758 - DNA, 754 bp, Homo sapiens; identical to SEQ ID NO: 91573
  misc_feature 1..754: note = chr4:126237654-126238408
  misc_feature 1..754: note = Hyper
  source 1..754: mol_type = genomic DNA

SEQ ID NO: 123759 - DNA, 30 bp, Homo sapiens; identical to SEQ ID NO: 91574
  misc_feature 1..30: note = chr4:126444051-126444081
  misc_feature 1..30: note = Hypo
  source 1..30: mol_type = genomic DNA

SEQ ID NO: 123760 - DNA, 30 bp, Homo sapiens; identical to SEQ ID NO: 91575
  misc_feature 1..30: note = chr4:127173962-127173992
  misc_feature 1..30: note = Hypo
  source 1..30: mol_type = genomic DNA

SEQ ID NO: 123761 - DNA, 31 bp, Homo sapiens; identical to SEQ ID NO: 91576
  misc_feature 1..31: note = chr4:127411324-127411355
  misc_feature 1..31: note = Hypo
  source 1..31: mol_type = genomic DNA

SEQ ID NO: 123762 - DNA, 388 bp, Homo sapiens; identical to SEQ ID NO: 91578
  misc_feature 1..388: note = chr4:128544016-128544404
  misc_feature 1..388: note = Hyper
  source 1..388: mol_type = genomic DNA

SEQ ID NO: 123763 - DNA, 160 bp, Homo sapiens; identical to SEQ ID NO: 29156
  misc_feature 1..160: note = chr4:128544646-128544806
  misc_feature 1..160: note = Hyper
  source 1..160: mol_type = genomic DNA

SEQ ID NO: 123764 - DNA, 51 bp, Homo sapiens
  misc_feature 1..51: note = chr4:128554131-128554182
  misc_feature 1..51: note = Hyper
  source 1..51: mol_type = genomic DNA
agcaagctatagctgcgagatttgaattactccactcgtagctattgcatt

SEQ ID NO: 123765 - DNA, 30 bp, Homo sapiens; identical to SEQ ID NO: 91580
  misc_feature 1..30: note = chr4:128801420-128801450
  misc_feature 1..30: note = Hypo
  source 1..30: mol_type = genomic DNA

SEQ ID NO: 123766 - DNA, 76 bp, Homo sapiens; identical to SEQ ID NO: 91581
  misc_feature 1..76: note = chr4:128887678-128887754
  misc_feature 1..76: note = Hypo
  source 1..76: mol_type = genomic DNA

SEQ ID NO: 123767 - DNA, 37 bp, Homo sapiens; identical to SEQ ID NO: 91582
  misc_feature 1..37: note = chr4:128889082-128889119
  misc_feature 1..37: note = Hypo
  source 1..37: mol_type = genomic DNA

SEQ ID NO: 123768 - DNA, 100 bp, Homo sapiens; identical to SEQ ID NO: 40341
  misc_feature 1..100: note = chr4:128984233-128984333
  misc_feature 1..100: note = Hypo
  source 1..100: mol_type = genomic DNA

SEQ ID NO: 123769 - DNA, 40 bp, Homo sapiens; identical to SEQ ID NO: 91585
  misc_feature 1..40: note = chr4:129233933-129233973
  misc_feature 1..40: note = Hypo
  source 1..40: mol_type = genomic DNA

SEQ ID NO: 123770 - DNA, 30 bp, Homo sapiens; identical to SEQ ID NO: 91586
  misc_feature 1..30: note = chr4:129729959-129729989
  misc_feature 1..30: note = Hypo
  source 1..30: mol_type = genomic DNA

SEQ ID NO: 123771 - DNA, 30 bp, Homo sapiens; identical to SEQ ID NO: 91588
  misc_feature 1..30: note = chr4:130931683-130931713
  misc_feature 1..30: note = Hypo
  source 1..30: mol_type = genomic DNA

SEQ ID NO: 123772 - DNA, 20 bp, Homo sapiens
  misc_feature 1..20: note = chr4:131702671-131702691
  misc_feature 1..20: note = Hypo
  source 1..20: mol_type = genomic DNA
taccgcgcctggccattttt

SEQ ID NO: 123773 - DNA, 30 bp, Homo sapiens; identical to SEQ ID NO: 91590
  misc_feature 1..30: note = chr4:133093073-133093103
  misc_feature 1..30: note = Hypo
  source 1..30: mol_type = genomic DNA

SEQ ID NO: 123774 - DNA, 227 bp, Homo sapiens; identical to SEQ ID NO: 29157
  misc_feature 1..227: note = chr4:134067790-134068017
  misc_feature 1..227: note = Hyper
  source 1..227: mol_type = genomic DNA

SEQ ID NO: 123775 - DNA, 649 bp, Homo sapiens
  misc_feature 1..649: note = chr4:134068272-134068921
  misc_feature 1..649: note = Hyper
  source 1..649: mol_type = genomic DNA
tcccacatgcaaacacgcgcgcactcgcgcgcacacacacaagtgtttccatacgtacaaatgaacgcattagaaaattaccgtcattttttaaaaggctccaggattctgacgagtcagcttgaagagctcaaaacatttcatttcaattctgcagatctgaagaaaaagaaaggggggaggggtggaagtacagatgcaataccgtattaatattcagatacactataatctccttttcattgatccacaggtccctttatacactgccgctccattctcagccgcagacgtgatgctaaaatcattttaactgcagcggttttcgcttggctttggccagtcttcaatttactgcagctggaaaaggattagccatttttgctggaatcctttccttctaagcgctcaaaggcaggacccatcttcatgaaagagccaagtgcgggggccggggggacccggcgttgcggggagttggggcgcggaaatcagggcagtagacgtgcattcgcgggactctcagaagcacgtctcaggctactatcacgcccatggacactagccctccttaactccttgccaggaggaaatggcaacgtatctccaggtcggaaaacgactctacttttcccgcaggttgtggtgg

SEQ ID NO: 123776 - DNA, 592 bp, Homo sapiens; identical to SEQ ID NO: 91600
  misc_feature 1..592: note = chr4:134069304-134069896
  misc_feature 1..592: note = Hyper
  source 1..592: mol_type = genomic DNA

SEQ ID NO: 123777 - DNA, 262 bp, Homo sapiens
  misc_feature 1..262: note = chr4:134070193-134070455
  misc_feature 1..262: note = Hyper
  source 1..262: mol_type = genomic DNA
ggactgggaactttccgcggcattgtccccagccagcgcctcgggacctgcggggctgttctcgctctcacactcacactcaccccggccgctcgggcgagagttctgtcccgccccgcccggctgccgcgtgacgtgtctgtttggcggccagtttggccaatcatcggcagctcggtgggtggtgctcctgggcgattggttggcagaatgagggcgctgcgcaaaaacggagaagccgagcgctcggagctcagaaact

SEQ ID NO: 123778 - DNA, 2653 bp, Homo sapiens
  misc_feature 1..2653: note = chr4:134071052-134073705
  misc_feature 1..2653: note = Hyper
  source 1..2653: mol_type = genomic DNA
gatgaggaaaggggacgcctgtcacccttcctgtgctaagatttaaaaaaaaatgaggctggattgcgggaagctctaaaatgaagcaaaaggagtaagatttttaaagacagaaagccacaggagcccccacgtagcgcacttttatttgtattttttcagatttttttttgtttcgtggtggtgggggaggtgattgggtggctgactggctgcgggaagctacttcctttccttttggagatgattgtgctattattgtttgccttgctctggatggtggaaggagtcttttcccagcttcactacacggtacaggaggagcaggaacatggcactttcgtggggaatatcgctgaagatctgggtctggacattacaaaactttcggctcgcgggtttcagacggtgcccaactcaaggaccccttacttagacctcaacctggagacaggggtgctgtacgtgaacgagaaaatagaccgcgaacaaatctgcaaacagagcccctcctgtgtcctgcacctggaggtctttctggagaaccccctggagctgttccaggtggagatcgaggtgctggacattaatgacaaccccccctctttcccggagccagacctgacggtggaaatctctgagagcgccacgccaggcactcgcttccccttggagagcgcattcgacccagacgtgggcaccaactccttgcgcgactacgagatcacccccaacagctacttctccctggacgtgcagacccagggggatggcaaccgattcgctgagctggtgctggagaagccactggaccgagagcagcaagcggtgcaccgctacgtgctgaccgcggtggacggaggaggtgggggaggagtaggagaaggagggggaggtggcgggggagcaggcctgcccccccagcagcagcgcaccggcacggccctactcaccatccgagtgctggactccaatgacaatgtgcccgctttcgaccaacccgtctacactgtgtccctaccagagaactctcccccaggcactctcgtgatccagctcaacgccaccgacccggacgagggccagaacggtgaggtcgtgtactccttcagcagccacatttcgccccgggcgcgggagcttttcggactctcgccgcgcactggcagactggaggtaagcggcgagttggactatgaagagagcccagtgtaccaagtgtacgtgcaagccaaggacctgggccccaacgccgtgcctgcgcactgcaaggtgctagtgcgagtactggatgctaatgacaacgcgccagagatcagcttcagcaccgtgaaggaagcggtgagtgagggcgcggcgcccggcactgtggtggcccttttcagcgtgactgaccgcgactcagaggagaatgggcaggtgcagtgcgagctactgggagacgtgcctttccgcctcaagtcttcctttaagaattactacaccatcgttaccgaagcccccctggaccgagaggcgggggactcctacaccctgactgtagtggctcgggaccggggcgagcctgcgctctccaccagtaagtcgatccaggtacaagtgtcggatgtgaacgacaacgcgccgcgtttcagccagccggtctacgacgtgtatgtgactgaaaacaacgtgcctggcgcctacatctacgcggtgagcgccaccgaccgggatgagggcgccaacgcccagcttgcctactctatcctcgagtgccagatccagggcatgagcgtcttcacctacgtttctatcaactctgagaacggctacttgtacgccctgcgctccttcgactatgagcagctgaaggacttcagttttcaggtggaagcccgggacgctggcagcccccaggcgctggctggtaacgccactgtcaacatcctcatagtggatcaaaatgacaacgcccctgccatcgtggcgcctctaccagggcgcaacgggactccagcgcgtgaggtgctgccccgctcggcggagccgggttacctgctcacccgcgtggccgccgtggacgcggacgacggcgagaacgcccggctcacttacagcatcgtgcgtggcaacgaaatgaacctctttcgcatggactggcgcaccggggagctgcgcacagcacgccgagtcccggccaagcgcgacccccagcggccttatgagctggtgatcgaggtgcgcgaccatgggcagccgcccctttcctccaccgccaccctggtggttcagctggtggatggcgccgtggagccccagggcgggggcgggagcggaggcggagggtcaggagagcaccagcgccccagtcgctctggcggcggggaaacctcgctagacctcaccctcatcctcatcatcgcgttgggctcggtgtccttcatcttcctgctggccatgatcgtgctggccgtgcgttgccaaaaagagaagaagctcaacatctatacttgtctggccagcgattgctgcctctgctgctgctgctgcggtggcggaggttcgacctgctgtggccgccaagcccgggcgcgcaagaagaaactcagcaagtcagacatcatgctggtgcagagctccaatgtacccagtaacccggcccaggtgccga

SEQ ID NO: 123779 - DNA, 126 bp, Homo sapiens; identical to SEQ ID NO: 29167
  misc_feature 1..126: note = chr4:134074030-134074156
  misc_feature 1..126: note = Hyper
  source 1..126: mol_type = genomic DNA

SEQ ID NO: 123780 - DNA, 30 bp, Homo sapiens; identical to SEQ ID NO: 91609
  misc_feature 1..30: note = chr4:135248649-135248679
  misc_feature 1..30: note = Hypo
  source 1..30: mol_type = genomic DNA

SEQ ID NO: 123781 - DNA, 30 bp, Homo sapiens; identical to SEQ ID NO: 40342
  misc_feature 1..30: note = chr4:136320705-136320735
  misc_feature 1..30: note = Hypo
  source 1..30: mol_type = genomic DNA

SEQ ID NO: 123782 - DNA, 140 bp, Homo sapiens; identical to SEQ ID NO: 91630
  misc_feature 1..140: note = chr4:138453793-138453933
  misc_feature 1..140: note = Hyper
  source 1..140: mol_type = genomic DNA

SEQ ID NO: 123783 - DNA, 47 bp, Homo sapiens; identical to SEQ ID NO: 91638
  misc_feature 1..47: note = chr4:139952127-139952174
  misc_feature 1..47: note = Hyper
  source 1..47: mol_type = genomic DNA

SEQ ID NO: 123784 - DNA, 28 bp, Homo sapiens
  misc_feature 1..28: note = chr4:140100690-140100718
  misc_feature 1..28: note = Hypo
  source 1..28: mol_type = genomic DNA
tgggcaacgagagcgaaactccgtctca

SEQ ID NO: 123785 - DNA, 1165 bp, Homo sapiens
  misc_feature 1..1165: note = chr4:140200429-140201594
  misc_feature 1..1165: note = Hyper
  source 1..1165: mol_type = genomic DNA
gctttcctatatgtccgtttttatttaataagcctccagttcacactgcaactccccctttagttaattgctgagtattctgctttttctcgcgtatcctcagaaccaaaggtgtcgatatttggactacagagccaagcagttgcaggacgacgtgcaacctcaaaggaaagtgtcccgaaggccgcttcctttttgggggttgtggatctcagagccaggcgctcgcggggttcaggctgctgagaccctgccaagggttaggtttatttaccccacgaacattcgcccagcgtccactgagcgggccctgcctcactgcctcccagcgcttgccgggcccgctcgctgatcggcgtccaccttcccaccgttcctctgcttcctcaggagattggagagcgaatggtgcctctaacaataaaagtggtaagctgcgactttgtcagccaggcacgtttttaagtgcttttaaccatacattaactcattaaaaaggaaaaccatcatcgccctcattttatagatgaggaaacaggttaagccatttgtccaagatcaggatgcgaacccagataatctggactctgaggcaccctggaaaagttccctacttccaaagtctgcaggagcttcgggacgtcttcccgggagtctcccccagtctcctcgacctccaatccaggcttctgctgctctgggtcgggtttggccaactgggtgccggccggttccctggcgcgggcgaaatctgcacccgaggcgcccgtcctcctctccgggctagacctccttactcaccgtcctttccgagcggcgcggggttggggggcgccctcagcggcagcgccagagtcttggagaccgccctgcggagatacatcgcgcccgctgtccgccgcgcagcagcctcggtacccaggcgcaggctgcccttccacagagaggctgagagcctggcagcgccccgcccggaggaggcacgtcgaccttcatccagccccgcctccgcggcccccgggaggtggggagacctttgtagtcctcaccatcctcccctaacccatctccagctctgttgctatccctgaggtctctagagctgaccgcggcatctcagaaaagggatggggaacctacaagtcgccgtcgcctgcctggctca

SEQ ID NO: 123786 - DNA, 39 bp, Homo sapiens; identical to SEQ ID NO: 91649
  misc_feature 1..39: note = chr4:140566713-140566752
  misc_feature 1..39: note = Hypo
  source 1..39: mol_type = genomic DNA

SEQ ID NO: 123787 - DNA, 1305 bp, Homo sapiens
  misc_feature 1..1305: note = chr4:140655870-140657175
  misc_feature 1..1305: note = Hyper
  source 1..1305: mol_type = genomic DNA
atttataaatctgtgcgtagggaagctttatttttctgaagtgttttcaagaacatgcatagtgtttgggtgagaggggccagccttgctggcggcgaaccaaagagcagggaatcacaaaagacggccggcggcgagcaggctggggtgacggggaccccgtggataacgggcttgaggacgcccagggcttcagccttttccaggcgtccctcgccggggcaacgcagagcagctgccgttcttcccgcgccccagcagatggtggtgtcagcccggcctcgtgcccggccgccgctgcgcccgcgccccctcccctcgcagatggcttaatcagggctcccgcccgcccctccgcggcccccgccccgcgcgtctgggcgagcgctgcgaacgtggagccaggcagtcaagtgttactgcgtacagcaggtagcctggcaactgagagcacaataccgagcagatggtgttcgcacggcgtgatggacatcacacacgacagcctgagacaatccaggaattccctggtgactcgaggccctctttgcacaaaatgagttctctctccattgccgtgtatctctggggttatctgcccccctcctccgactgacactgaactggtttctcattaccgacttttcttccagccggaggggaggaagaattcaagtgggggagggcgcgggaaggggacgtggagggaaacggaagggctgggagtggggtaggggggcagtggcgacctccggggggggagggtggcggacaccagaccccagggccgacagcccgggagggaccgggttccaggaccccagctgcacaaagccggcccggggagggggcgataaggagcgagcctcgggtcggcccggcaccgctgcttcggctcagagtccttgcaatcgcttggcctacgaacaacctaaatgaaatttagggttttattgaaaaagtcccctggggcctaatttagcctctcgactccagcctatatgcttacaagtcctcaggggactccggctaggaagtcaggagtggggcccgtgcgtccccggcaggacctagactgcctctcggcgcaggcggccctaacaaagaagcccacgaggcggtcccgggcgcgggcaggggcggtgcggcggcgctcgggagacccgcgaggggccctggaggtcctcggcccgcgcgcgccgctcgggagcccgcgaggctgcggtgtgctccagcgggcgcatttcccaggccccgccacatcgtgtgtgttagtggctgggaaggacacgaggacagagatga

SEQ ID NO: 123788 - DNA, 30 bp, Homo sapiens; identical to SEQ ID NO: 40344
  misc_feature 1..30: note = chr4:140753539-140753569
  misc_feature 1..30: note = Hypo
  source 1..30: mol_type = genomic DNA

SEQ ID NO: 123789 - DNA, 139 bp, Homo sapiens; identical to SEQ ID NO: 91653
  misc_feature 1..139: note = chr4:140754226-140754365
  misc_feature 1..139: note = Hypo
  source 1..139: mol_type = genomic DNA

SEQ ID NO: 123790 - DNA, 30 bp, Homo sapiens; identical to SEQ ID NO: 91656
  misc_feature 1..30: note = chr4:140970389-140970419
  misc_feature 1..30: note = Hyper
  source 1..30: mol_type = genomic DNA

SEQ ID NO: 123791 - DNA, 321 bp, Homo sapiens; identical to SEQ ID NO: 91657
  misc_feature 1..321: note = chr4:141031289-141031610
  misc_feature 1..321: note = Hypo
  source 1..321: mol_type = genomic DNA

SEQ ID NO: 123792 - DNA, 30 bp, Homo sapiens; identical to SEQ ID NO: 91658
  misc_feature 1..30: note = chr4:141272492-141272522
  misc_feature 1..30: note = Hypo
  source 1..30: mol_type = genomic DNA

SEQ ID NO: 123793 - DNA, 102 bp, Homo sapiens; identical to SEQ ID NO: 91659
  misc_feature 1..102: note = chr4:141294316-141294418
  misc_feature 1..102: note = Hyper
  source 1..102: mol_type = genomic DNA

SEQ ID NO: 123794 - DNA, 654 bp, Homo sapiens; identical to SEQ ID NO: 91660
  misc_feature 1..654: note = chr4:141294633-141295287
  misc_feature 1..654: note = Hyper
  source 1..654: mol_type = genomic DNA

SEQ ID NO: 123795 - DNA, 813 bp, Homo sapiens; identical to SEQ ID NO: 91661
  misc_feature 1..813: note = chr4:141348027-141348840
  misc_feature 1..813: note = Hyper
  source 1..813: mol_type = genomic DNA

SEQ ID NO: 123796 - DNA, 590 bp, Homo sapiens; identical to SEQ ID NO: 29176
  misc_feature 1..590: note = chr4:141418867-141419457
  misc_feature 1..590: note = Hyper
  source 1..590: mol_type = genomic DNA

SEQ ID NO: 123797 - DNA, 266 bp, Homo sapiens; identical to SEQ ID NO: 29177
  misc_feature 1..266: note = chr4:141488816-141489082
  misc_feature 1..266: note = Hyper
  source 1..266: mol_type = genomic DNA

SEQ ID NO: 123798 - DNA, 598 bp, Homo sapiens; identical to SEQ ID NO: 91664
  misc_feature 1..598: note = chr4:141489783-141490381
  misc_feature 1..598: note = Hyper
  source 1..598: mol_type = genomic DNA

SEQ ID NO: 123799 - DNA, 1363 bp, Homo sapiens
  misc_feature 1..1363: note = chr4:142053231-142054594
  misc_feature 1..1363: note = Hyper
  source 1..1363: mol_type = genomic DNA
gaacccctgtccaagcggcgctatgccaagctctccggcagcctctcccctacccaatacagttaatcttctcctctttgtaaaccccccaagtgacgcggagcaaaacttaatcggtccagggaacccagacacgtcttccgcgccgcacggacttcccagaaggagcctggaggcaggcgctggatccctctaggcacctccgtccccgccggctcccctcccccgcgcccgctgggccactcacccgcgtggggcatggtgatggtctcgttggtgttggagcccacgttgaagatgaccacggctgaggcgttctgcaggaacgcgttccggatcttatccctgtacgtgcagttgcccttggggatgagggctatccagttcttgccgcgggtcggggcggcgaacttggtgttggggtcgcaggccaggcggtcgtgggccgagctggccatgaccacctccccgcgggcgtcctgcttgggcgagtgctctccgtagcgcccgcactccgtcttctccgtgtgcagctccgcgccgccgccgcccgccgccccggccccggggtccggcgcgggctcggcgtaggtgatgttcacgaaggcggtgtaccattcctccttctcggccacggtaaagtccaggcagagcagatgcacgaaacaaaaggaaagcagccatgttgagagagccagactgcagcacgcttggatgagagacattgccatctttatccgccggggccccctccccgcccccgcgccctccctccgtcccgtccctcctccccagccccggccaaccccgggccgctgcctctcctcctgctgctgctcactcccgggccggaggggccgcggccgggacgcgcagccgccgcggggaccggattccgggcgagcggatggcgctggccccttcccctctcagctgtagcgcggtggttgcattttgcttcttgggcgcccggggggcgcgggaacagagggcccgcggggcttgcggaggagtcctgctgccgagcgtcctgctccttcgcccggcttcgccttctctcataagggtggccgggggcccacgaacttgcagggtggcggccctgcgccctccagccccggcggggacgggcacgattgctcgtagtctggggtgctgcggtgcggggtgctgcccagggtgtcccggccgccgccactgagcgctggggcgcgcgaatccagctgcagccgctgctgccctgcgccggttccctcaggctgcgggcgctgcgctcctgatctcgccggtggctgcgcctgggcacgcacttgccgcgggcggggcgggcttggggacagtgggagcgagcaggcagagcgga

SEQ ID NO: 123800 - DNA, 103 bp, Homo sapiens; identical to SEQ ID NO: 91667
  misc_feature 1..103: note = chr4:142054654-142054757
  misc_feature 1..103: note = Hyper
  source 1..103: mol_type = genomic DNA

SEQ ID NO: 123801 - DNA, 30 bp, Homo sapiens; identical to SEQ ID NO: 91668
  misc_feature 1..30: note = chr4:142846491-142846521
  misc_feature 1..30: note = Hypo
  source 1..30: mol_type = genomic DNA

SEQ ID NO: 123802 - DNA, 24 bp, Homo sapiens
  misc_feature 1..24: note = chr4:142846965-142846989
  misc_feature 1..24: note = Hypo
  source 1..24: mol_type = genomic DNA
ccacccgcccggccacatttgtac

SEQ ID NO: 123803 - DNA, 604 bp, Homo sapiens
  misc_feature 1..604: note = chr4:143766796-143767400
  misc_feature 1..604: note = Hyper
  source 1..604: mol_type = genomic DNA
aaaaaacaaggcaaccgggaccaccaacatcagtcaccctcactccccaccactgcctctattccttaaggacttcttcccaggccggcggcggcggcggcggcggcggcggcagcttgcgatcatcaggattggaagtgagagcgagtgcccgggccaacctcagcgtctctcagggacagcgcaggtgggcgcagccttggaaggtcagcgaggccagagctcagagttccacgggggcccggagagtgtgcgtgtgtgagtgagaatgcgaaaacgcgcgcgcgccgggcagaggggcgctcggcgagagggtaggcgcggtgacaggggtaccccagcagccgaggagagacagcccaccccaccctttaagctaaagagctggaggggtgatggaggctgcaagacggagaaacttgatgcaaaacagacaggctcccccctccaagacgtgccgccacgctctcagacacgctccctcgcctcccggattacccaccatcaaccaccccaccctgcaaaattcccccaccgagccctaggatcccaggcgggtaattacctctcccggaggcggagtggggggcggcagcagcagcag

SEQ ID NO: 123804 - DNA, 653 bp, Homo sapiens; identical to SEQ ID NO: 91671
  misc_feature 1..653: note = chr4:143767625-143768278
  misc_feature 1..653: note = Hyper
  source 1..653: mol_type = genomic DNA

SEQ ID NO: 123805 - DNA, 328 bp, Homo sapiens; identical to SEQ ID NO: 91672
  misc_feature 1..328: note = chr4:144100297-144100625
  misc_feature 1..328: note = Hypo
  source 1..328: mol_type = genomic DNA

SEQ ID NO: 123806 - DNA, 31 bp, Homo sapiens; identical to SEQ ID NO: 91673
  misc_feature 1..31: note = chr4:144220336-144220367
  misc_feature 1..31: note = Hypo
  source 1..31: mol_type = genomic DNA

SEQ ID NO: 123807 - DNA, 30 bp, Homo sapiens; identical to SEQ ID NO: 91674
  misc_feature 1..30: note = chr4:144265355-144265385
  misc_feature 1..30: note = Hypo
  source 1..30: mol_type = genomic DNA

SEQ ID NO: 123808 - DNA, 29 bp, Homo sapiens
  misc_feature 1..29: note = chr4:144434031-144434060
  misc_feature 1..29: note = Hyper
  source 1..29: mol_type = genomic DNA
catggtagtgtgcacgttatttgcttaac

SEQ ID NO: 123809 - DNA, 42 bp, Homo sapiens; identical to SEQ ID NO: 29183
  misc_feature 1..42: note = chr4:144480322-144480364
  misc_feature 1..42: note = Hyper
  source 1..42: mol_type = genomic DNA

SEQ ID NO: 123810 - DNA, 1264 bp, Homo sapiens
  misc_feature 1..1264: note = chr4:144620967-144622231
  misc_feature 1..1264: note = Hyper
  source 1..1264: mol_type = genomic DNA
gcggaccagcacacccgcggacccagcgtcttggccctcaggccccagcagctccaccatcatgggcacgtagtcacggttgggcgaggaggtggctgtgtgctgatagcgcaccccagcacggaggaaagcctcacagtctacgcccttgcccctggggagaggggcccccaccgcgtccaccaagcgcccgtacttgggcagggggccgtcctcgtgaggaagtggggtaagccggcacctgcgggtggccgtggctccagacttcagggaggcgaagtccagcactctcctgtctatggcgcggctccagcttcgcagcttctccactaccaaaggcctgttacgcgtcaccagctccagctgggagaagaccaagtccaccgccagcgtgaagggcagcaccagagtgtgagtcggggcgtcgtagcgcagctgcagcagcacccgggcgcgtccggggctgtgggagccgaagtgagtgtactggacttggcggggcccgaaggtgcaggggaagcggcgcggggagagcgcgcccttgagccgcggcagggcgtccagtaccgtgacttcgcaccggtcccccggctgcactccaatcaccagatcccggagcgggtcgagccaaagggaacgacccaggggcacccggagtccagggttggcaatcagcacgctggggccgtcggggcgagtgccgtcaagcgcaccccgggcgggcaggtaaagcgccgggtcgggctcggtcccaagtgaggatgcccgtccctgcagcgcggggcgactcaagagcaggcaggcgagcgccacaaggagctgccggggcgtcccagtcgggtgccgagaagcccccgccatggccacggatggctcctggcgttgggattcccggggtggggtgccctgtgcaaagagggatctgctgagcggcaggtgcaggcagtggaagcagtagctgctgtccagtcggtagccgacttgcggatccagcaagagccagcggctgcgcttcggctgctgcaggtaacggcagcgggggaaggggctctgcccacttcctgctcagccccggtcgcaagtctctctctgctggcttctggggaccccagatacgcgcccagcgcggcgagacttagcgagggtgcagcgctgtcccctccgctcctgggcgcttcacccagcctaccttacacaccttctcgccgggagccgtggccgccgcactgctgcccgcgctgccagactccgaccagctgtctgg

SEQ ID NO: 123811 - DNA, 30 bp, Homo sapiens; identical to SEQ ID NO: 91679
  misc_feature 1..30: note = chr4:144742636-144742666
  misc_feature 1..30: note = Hypo
  source 1..30: mol_type = genomic DNA

SEQ ID NO: 123812 - DNA, 85 bp, Homo sapiens; identical to SEQ ID NO: 91680
  misc_feature 1..85: note = chr4:144766556-144766641
  misc_feature 1..85: note = Hypo
  source 1..85: mol_type = genomic DNA

SEQ ID NO: 123813 - DNA, 237 bp, Homo sapiens; identical to SEQ ID NO: 91681
  misc_feature 1..237: note = chr4:144785182-144785419
  misc_feature 1..237: note = Hypo
  source 1..237: mol_type = genomic DNA

SEQ ID NO: 123814 - DNA, 18 bp, Homo sapiens
  misc_feature 1..18: note = chr4:144981012-144981030
  misc_feature 1..18: note = Hypo
  source 1..18: mol_type = genomic DNA
gagcgagactctgtctca

SEQ ID NO: 123815 - DNA, 257 bp, Homo sapiens; identical to SEQ ID NO: 91683
  misc_feature 1..257: note = chr4:145567145-145567402
  misc_feature 1..257: note = Hyper
  source 1..257: mol_type = genomic DNA

SEQ ID NO: 123816 - DNA, 1040 bp, Homo sapiens; identical to SEQ ID NO: 91684
  misc_feature 1..1040: note = chr4:145567625-145568665
  misc_feature 1..1040: note = Hyper
  source 1..1040: mol_type = genomic DNA

SEQ ID NO: 123817 - DNA, 23 bp, Homo sapiens
  misc_feature 1..23: note = chr4:145689704-145689727
  misc_feature 1..23: note = Hypo
  source 1..23: mol_type = genomic DNA
tgctttcaagatggccgaatagg

SEQ ID NO: 123818 - DNA, 98 bp, Homo sapiens; identical to SEQ ID NO: 91686
  misc_feature 1..98: note = chr4:146853883-146853981
  misc_feature 1..98: note = Hypo
  source 1..98: mol_type = genomic DNA

SEQ ID NO: 123819 - DNA, 32 bp, Homo sapiens; identical to SEQ ID NO: 40349
  misc_feature 1..32: note = chr4:147048518-147048550
  misc_feature 1..32: note = Hypo
  source 1..32: mol_type = genomic DNA

SEQ ID NO: 123820 - DNA, 157 bp, Homo sapiens; identical to SEQ ID NO: 91688
  misc_feature 1..157: note = chr4:147554067-147554224
  misc_feature 1..157: note = Hyper
  source 1..157: mol_type = genomic DNA

SEQ ID NO: 123821 - DNA, 643 bp, Homo sapiens
  misc_feature 1..643: note = chr4:147558009-147558652
  misc_feature 1..643: note = Hyper
  source 1..643: mol_type = genomic DNA
agcacttacttgaaccgtccggcacaagccacattcattcacgtgaacactcccctttccctaccccatgtccaggtttcgctgagctcacacccggcaacactgctgctaggagttcccttcggctactatttattattttcctccacacaggggaagagaaagggaagcccgagaggatccagggaaagcagaagggggttaaggaccatggacagagcccgtcgcgcgctcgttgctgccgccttccccagcactctggcggctcctgaggacagcggtcccatcttgaaaccgctattccgcccggctgaggtcaggggtggacaggcggtcccctactctccaccgccgcttccgggagctgaccacccgagggttccccttttccactctccttcccactctgtttttgtcccagcgcgcgccagcgcctctcaggcctgccgcctgctctcgcacctgctcgccttccccaggcgcccagtgcctgcacctgctcccggtcaacccccgtccggattgggccacccgcgggttcctgcgtcggggtcccggggccttctcaccctcgcctgcaccctgctccttccgctctctagggaggtgacagcagcccccaacaccgcgggaagtatagaga

SEQ ID NO: 123822 - DNA, 1378 bp, Homo sapiens
  misc_feature 1..1378: note = chr4:147559190-147560568
  misc_feature 1..1378: note = Hyper
  source 1..1378: mol_type = genomic DNA
gggagggggaggagtcgcatgcgcacagacgacccgagcctgctccgcggctgtccaatccgctgagagctgcgagaaatcgagtgagagaaagccctgcagcccctccgaccccatgtctctttggcaccaggcacccgccgggccgtggggggctcgtagccgaacgccgacctccgctcgtattgggctgggagttcagagccgcgcgcagaacccgggttggccgcaacgtctgtgttctcagcggtggccgggaacctgggatcagggtcacctgagctgacggggtgggggcgggccgagtggggttggaagcctggaacttagtggtaagcaggaggcgtaggaggtggcagccaggtaagaggcactcttacctacccaacgctggcttgggccgcaactttatttgggagtttctttttccggtgagacagagacccggcagaagaagcgggaggggctggaggctggtccttaggtaggcactgcccggcgactggagcgcggacctggccatttgggtggggttgagtgggggcgcgattgtgagtagcagccgcgggacgctgcgaaggggcggcggcaacagagcacgggcgggggcagaaaagaggcggcggagggcgcggtgggggagcgcgaggcgagtgctgagagagcagaaaggactcaagcctgaggggagtagagaggaagaaggggcaacgcgagaaaccgaacaggagccggcgtttcctggcaagggagggcggaggcgcgcgggagagagggagagagggagggcggggggcgcgggggtaggcgcggggagaggggagtataactcgccggccgcgaggagcgggggcagtttcgggtgccgaggtctgcagctagcggcaagcggagtcaggcatccgttcagactgacagcagaggcggcgaaggagcgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccctcggccagctcccccagcagctcgagcaacgctggtggtggcggcggcggcggcggcggcggcggcggcggcggaggccgaagcagcagctccagcagcagtggcagcagcggcggcgggggctcggaggctatgcggagagcctgtctt

SEQ ID NO: 123823 - DNA, 1234 bp, Homo sapiens
  misc_feature 1..1234: note = chr4:147560887-147562121
  misc_feature 1..1234: note = Hyper
  source 1..1234: mol_type = genomic DNA
ttattattattttaacgatctgggaatgttgtaggcgcggcgacggtgtcgagccctgggccggggcttccggagagagggcgtacaattccctgctgagcgtaatgtgtgccttctacttacaattgcagagcaatatattcggcgggctggatgagagtctgctggcccgcgccgaggctctggcagccgtggacatcgtctcccagagcaagagccaccaccaccatccaccccaccacagccccttcaaaccggacgccacctaccacactatgaataccatcccgtgcacgtcggccgcctcttcttcatcggtgcccatctcgcacccttccgcgttggcgggcacgcaccaccaccaccaccatcaccaccaccaccaccaccaaccgcaccaggcgctggagggcgagctgctggagcacctgagtcccgggctggccctgggcgctatggcgggccccgacggcgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgccggcatttagaagactcttggcctctccagagacgcccctttcctcgtccgctcttttctctcctctcttctgcctcttttcacttttggcgactagaaacaattccagtaaatgtgaatctcgacaaatcgaggactgaagagggagcgaacgagcgaacaactgagccc

SEQ ID NO: 123824 - DNA, 957 bp, Homo sapiens
  misc_feature 1..957: note = chr4:147568636-147569593
  misc_feature 1..957: note = Hyper
  source 1..957: mol_type = genomic DNA
ttttcaggaacaaatcgatgagatagggatgcgagagagggaagatgaaggcttttcccaatctaggtcacttctttgcggagaggccttctcagagctttgggtaagtgaagaggcgccttaagttcgcggtcccagctgctcaggctccgcagcctggaggcgggaaagggaacagtgagactgagaagcaggacgcggggacagcgatctcccagaagctttcctcgcttttggtggctaatgctacgcgcctgcctgcggagctcaggcggcaccgaggaatcaagatcctcgtccccaccctccgactcaccacctaatgctttgcacaagctggccttgggttccctgctagtcccatctcccctctccacccctctggttcctggtgcgcactggtgacaggcggtttgggagagggtgaggggtagagtccaaagggctggggctgcgtggggtcagagcagaacctccctccctcgctggaggagctcgcccggtccccgaggggcccccagagctggggaagcaggcgtctcgccaggcgctcagcaaggaacccgcaagaaagagaggcccgggcgcctcgcccccttgcattttactaatcacgtctatttaaattctagcgcggtccgccgcgctctcaccgggaaagctctggagaactggacccatcaattattctgaaaaaatccctgactacgtgaggcttccagccagcgggagggaggcggcgggaggaggtggagaacccagcccctacccctctcccctcctccccgcccctcccagcgcggcctcttgatatacactcatcttcagggttctggggccccagggagacttgtgcgcattttcagggttcgagcttttgtggacgaggaaggaaggtggtgggagaaagttgggacctggcctgtgcagggcatccgcttccggagctgctatccc

SEQ ID NO: 123825 - DNA, 286 bp, Homo sapiens; identical to SEQ ID NO: 91699
  misc_feature 1..286: note = chr4:147569793-147570079
  misc_feature 1..286: note = Hyper
  source 1..286: mol_type = genomic DNA

SEQ ID NO: 123826 - DNA, 812 bp, Homo sapiens
  misc_feature 1..812: note = chr4:147576032-147576844
  misc_feature 1..812: note = Hyper
  source 1..812: mol_type = genomic DNA
acaggaatgagacagcggtgacagatgagcggctgggtcaggaaggagcccagttggtggaaatgacactctttccccgctccgggtcccctcccccaccccattcgcgttttctctctcggcctctcctccctcctcgccttgccctcaggcagccgaccggggacacacgggtcaaaattgcgtttgggcggcgcggcgatgcgcggtctcgggcagccgcgcaggggcgtcccgagccccgggagccgcaggctcgtccaaggatccgccgcgcggcgggcgcctgggccctccgggggcccctctggggccgcctggactcgcaggtctcccgcgccaccccctaccccattccccgcctgcgccccctgctgcgctcggcgcgcgtcctgctgcagcctgctggggacagcgcacgcagtgaccgggcgcggcagccgcttccctttcccatcgacctcgctgccttctggcttttctcaaagccttttctccagagccagacagcagacgccccggcgatgccttcgccgcccatttggccgaggtagcccaggcctgcccttgctgcctccgccggccgctccgccgcggcccaaagccggggaagcgtcccaagcccgcgcggtctgccccggagccccggaggacccgaatactcagcggaatgtcaccctggccgggttctttggattcccctccggggccatcctacggaatccagccgtccccacaagctacctcatgtaactggagacctaagaaaagactctccataccttttgacaaaaagacgtaccagaagcaat

SEQ ID NO: 123827 - DNA, 67 bp, Homo sapiens; identical to SEQ ID NO: 91702
  misc_feature 1..67: note = chr4:148079423-148079490
  misc_feature 1..67: note = Hyper
  source 1..67: mol_type = genomic DNA

SEQ ID NO: 123828 - DNA, 528 bp, Homo sapiens; identical to SEQ ID NO: 91703
  misc_feature 1..528: note = chr4:148402212-148402740
  misc_feature 1..528: note = Hyper
  source 1..528: mol_type = genomic DNA

SEQ ID NO: 123829 - DNA, 37 bp, Homo sapiens; identical to SEQ ID NO: 91704
  misc_feature 1..37: note = chr4:148628963-148629000
  misc_feature 1..37: note = Hypo
  source 1..37: mol_type = genomic DNA

SEQ ID NO: 123830 - DNA, 30 bp, Homo sapiens; identical to SEQ ID NO: 91705
  misc_feature 1..30: note = chr4:148652683-148652713
  misc_feature 1..30: note = Hyper
  source 1..30: mol_type = genomic DNA

SEQ ID NO: 123831 - DNA, 546 bp, Homo sapiens; identical to SEQ ID NO: 91706
  misc_feature 1..546: note = chr4:149364884-149365430
  misc_feature 1..546: note = Hyper
  source 1..546: mol_type = genomic DNA

SEQ ID NO: 123832 - DNA, 43 bp, Homo sapiens; identical to SEQ ID NO: 91707
  misc_feature 1..43: note = chr4:149365868-149365911
  misc_feature 1..43: note = Hyper
  source 1..43: mol_type = genomic DNA

SEQ ID NO: 123833 - DNA, 140 bp, Homo sapiens; identical to SEQ ID NO: 91709
  misc_feature 1..140: note = chr4:150756466-150756606
  misc_feature 1..140: note = Hypo
  source 1..140: mol_type = genomic DNA

SEQ ID NO: 123834 - DNA, 235 bp, Homo sapiens; identical to SEQ ID NO: 91710
  misc_feature 1..235: note = chr4:150999354-150999589
  misc_feature 1..235: note = Hyper
  source 1..235: mol_type = genomic DNA

SEQ ID NO: 123835 - DNA, 430 bp, Homo sapiens; identical to SEQ ID NO: 91711
  misc_feature 1..430: note = chr4:151000151-151000581
  misc_feature 1..430: note = Hyper
  source 1..430: mol_type = genomic DNA

SEQ ID NO: 123836 - DNA, 30 bp, Homo sapiens; identical to SEQ ID NO: 91712
  misc_feature 1..30: note = chr4:151177716-151177746
  misc_feature 1..30: note = Hypo
  source 1..30: mol_type = genomic DNA

SEQ ID NO: 123837 - DNA, 30 bp, Homo sapiens; identical to SEQ ID NO: 91715
  misc_feature 1..30: note = chr4:152246132-152246162
  misc_feature 1..30: note = Hyper
  source 1..30: mol_type = genomic DNA

SEQ ID NO: 123838 - DNA, 50 bp, Homo sapiens; identical to SEQ ID NO: 91716
  misc_feature 1..50: note = chr4:152246492-152246542
  misc_feature 1..50: note = Hyper
  source 1..50: mol_type = genomic DNA

SEQ ID NO: 123839 - DNA, 117 bp, Homo sapiens; identical to SEQ ID NO: 91717
  misc_feature 1..117: note = chr4:152928973-152929090
  misc_feature 1..117: note = Hypo
  source 1..117: mol_type = genomic DNA

SEQ ID NO: 123840 - DNA, 55 bp, Homo sapiens; identical to SEQ ID NO: 91718
  misc_feature 1..55: note = chr4:152932523-152932578
  misc_feature 1..55: note = Hypo
  source 1..55: mol_type = genomic DNA

SEQ ID NO: 123841 - DNA, 20 bp, Homo sapiens
  misc_feature 1..20: note = chr4:153437373-153437393
  misc_feature 1..20: note = Hypo
  source 1..20: mol_type = genomic DNA
caactggtactggtccgtgg

SEQ ID NO: 123842 - DNA, 100 bp, Homo sapiens; identical to SEQ ID NO: 40351
  misc_feature 1..100: note = chr4:153535608-153535708
  misc_feature 1..100: note = Hypo
  source 1..100: mol_type = genomic DNA

SEQ ID NO: 123843 - DNA, 30 bp, Homo sapiens; identical to SEQ ID NO: 91721
  misc_feature 1..30: note = chr4:153601131-153601161
  misc_feature 1..30: note = Hyper
  source 1..30: mol_type = genomic DNA

SEQ ID NO: 123844 - DNA, 146 bp, Homo sapiens; identical to SEQ ID NO: 91722
  misc_feature 1..146: note = chr4:153702689-153702835
  misc_feature 1..146: note = Hypo
  source 1..146: mol_type = genomic DNA

SEQ ID NO: 123845 - DNA, 99 bp, Homo sapiens; identical to SEQ ID NO: 91723
  misc_feature 1..99: note = chr4:153774393-153774492
  misc_feature 1..99: note = Hypo
  source 1..99: mol_type = genomic DNA

SEQ ID NO: 123846 - DNA, 96 bp, Homo sapiens; identical to SEQ ID NO: 91724
  misc_feature 1..96: note = chr4:153821363-153821459
  misc_feature 1..96: note = Hypo
  source 1..96: mol_type = genomic DNA

SEQ ID NO: 123847 - DNA, 197 bp, Homo sapiens; identical to SEQ ID NO: 91726
  misc_feature 1..197: note = chr4:153918948-153919145
  misc_feature 1..197: note = Hypo
  source 1..197: mol_type = genomic DNA

SEQ ID NO: 123848 - DNA, 30 bp, Homo sapiens; identical to SEQ ID NO: 91727
  misc_feature 1..30: note = chr4:153943304-153943334
  misc_feature 1..30: note = Hypo
  source 1..30: mol_type = genomic DNA

SEQ ID NO: 123849 - DNA, 369 bp, Homo sapiens; identical to SEQ ID NO: 91729
  misc_feature 1..369: note = chr4:154143815-154144184
  misc_feature 1..369: note = Hyper
  source 1..369: mol_type = genomic DNA

SEQ ID NO: 123850 - DNA, 79 bp, Homo sapiens; identical to SEQ ID NO: 29210
  misc_feature 1..79: note = chr4:154144397-154144476
  misc_feature 1..79: note = Hyper
  source 1..79: mol_type = genomic DNA

SEQ ID NO: 123851 - DNA, 525 bp, Homo sapiens; identical to SEQ ID NO: 91731
  misc_feature 1..525: note = chr4:154216373-154216898
  misc_feature 1..525: note = Hypo
  source 1..525: mol_type = genomic DNA

SEQ ID NO: 123852 - DNA, 30 bp, Homo sapiens; identical to SEQ ID NO: 40356
  misc_feature 1..30: note = chr4:154372568-154372598
  misc_feature 1..30: note = Hypo
  source 1..30: mol_type = genomic DNA

SEQ ID NO: 123853 - DNA, 115 bp, Homo sapiens; identical to SEQ ID NO: 40357
  misc_feature 1..115: note = chr4:154540115-154540230
  misc_feature 1..115: note = Hypo
  source 1..115: mol_type = genomic DNA

SEQ ID NO: 123854 - DNA, 43 bp, Homo sapiens; identical to SEQ ID NO: 91734
  misc_feature 1..43: note = chr4:154605841-154605884
  misc_feature 1..43: note = Hyper
  source 1..43: mol_type = genomic DNA

SEQ ID NO: 123855 - DNA, 606 bp, Homo sapiens
  misc_feature 1..606: note = chr4:154680759-154681365
  misc_feature 1..606: note = Hyper
  source 1..606: mol_type = genomic DNA
gagggactggcaccccgcacggtggcatcttccagaaggtcatgcgtccgtccccacgtctttccagggccggttctccccggtggggcccggggtcttggagaccagtctgtgcagcctgcccggcaccagcgtgagccccgggaccccggcctggcgtcccccacgcccgcgcccccgcgccagtacctgctcctgctgcgggggggcctccagcaccggcgctgccttccgcgccgccgtccccgcggccatgcctgagccactgtgccttctccagggcacagcgcctgccggggagggtcccgcagagtccgcagaaggaggcgccgcggggcctcgggagccgagggtgagagccggatctgcggcggcggcggagcggcggccctgcccgggttgtgcggggcgggagatgggagcctcccggcacgccccgcctccgccccctgcacgctggccagcgtcctccccagcagcggcctcgaggtcccggtcgccagcaccccggttccttcagaacctcaggcctcccattcagccagccattgtcgccgataaagcgtcttgagccctaccgggtgcgtgtggcgggaaccccggttt

SEQ ID NO: 123856 - DNA, 232 bp, Homo sapiens; identical to SEQ ID NO: 91737
  misc_feature 1..232: note = chr4:154702510-154702742
  misc_feature 1..232: note = Hypo
  source 1..232: mol_type = genomic DNA

SEQ ID NO: 123857 - DNA, 1534 bp, Homo sapiens
  misc_feature 1..1534: note = chr4:154709106-154710640
  misc_feature 1..1534: note = Hyper
  source 1..1534: mol_type = genomic DNA
aaacaccacttccaacgctctgcgcagctccagtgctagcatctttaacaataatcgtgtatctatttttttttaaaccgccgttcagttcttcgtttttttagttttgttgtttttgtttgtttgttttatttttaaactgcccttaagtatagctggtacaactcgggaggagaatgcgcgagacttgggcggcgtgggaggggtgcctcaaatttgatacaggcttgttgtgatgacagaccaggtcaggcagaacttctgcccttcccgctactggcaccccaagcagggatgcactgggatgcgtggcaggggcgggatctcctgggagcgtctcagcccagcagggagtggggaagcaagagggaaggcttaccttcctcggtggctggcaggaggtggtcgctgctagcgagggggatgcaaaggtcgttgtcctgggggaaacggtcgcactcaagcatgtcgggccaggggaagccgaaggcggacatgaccggggcgcagcggtccttcacctgcacgcagagcgagtggcatggctggatggtctcgtctaggtcatcgaggcagacgggggcgaagagcgagcacaggaacttcttggtgtccgggtggcactgcttcatgaccagcgggatccaagcgccggcctgctccagcacctccttcatggtctcgtggcccagcaggttgggcagccgcatgttctggtattcgatgccgtggcacagctgcaggttggcagggatgggcttgcaattgctgcgcttgtaggagaagtcgggctggccaaagaggaagagcccgcgcgccgagcccaggcagcagtgcgaggcgaggaagagcagcagcagcgagccagggccctgcagcatcgtgggcgcgcgaccccgagggggcagagggagcggagccggggaagggcgaggcggccggagttcgagcttgtcccgggcccgctctcttcgctgggtgcgactcggggccccgaaaagctggcagccggcggctggggcgcggagaagcgggacaccgggaggacagcgcgggcgaggcgctgcaagcccgcgcgcagctccggggggctccgacccgggggagcagaatgagccgttgctggggcacagccagagttttcttggccttttttatgcaaatctggagggtggggggagcaagggaggagccaatgaagggtaatccgaggagggctggtcactactttctgggtctggttttgcgttgagaatgcccctcacgcgcttgctggaagggaattctggctgcgccccctcccctagatgccgccgctcgcccgccctaggatttctttaaacaacaaacagagaagcctggccgctgcgcccccacagtgagcgagcagggcgcgggctgcgggagtggggggcacgcagggcaccccgcgagcggcctcgcgaccaggtactggcgggaacgcgcctagccccgcgtgccgccggggcccgggcttgttttgccccagtccgaagtttctgctgggttgcca

SEQ ID NO: 123858 - DNA, 214 bp, Homo sapiens
  misc_feature 1..214: note = chr4:154710700-154710914
  misc_feature 1..214: note = Hyper
  source 1..214: mol_type = genomic DNA
tgttggggggctgcgtccctggtagccgcgtgtgccctgtgatggagcccgggacctgcccgcccgaggccgcctcggcgaacttcgttttccctcgaatctccagccaccgttcagcagcctgtcggtgtgctccccaatgccgtaaaaaaatcagaattataaatatattcgtatgagcagaactttacatggaaaacgaaatactaataaa

SEQ ID NO: 123859 - DNA, 708 bp, Homo sapiens; identical to SEQ ID NO: 29220
  misc_feature 1..708: note = chr4:154712003-154712711
  misc_feature 1..708: note = Hyper
  source 1..708: mol_type = genomic DNA

SEQ ID NO: 123860 - DNA, 510 bp, Homo sapiens
  misc_feature 1..510: note = chr4:154713500-154714010
  misc_feature 1..510: note = Hyper
  source 1..510: mol_type = genomic DNA
aggtgaagtgactaccgggctagccttggggacctgtcgcgacttgtcgggtgtctccaaccgcgttgccgcctggctttcagccgtgcgctggccagccgggcgggtgacgtcacctctccccgggtccgtgcacccaggccttccctgctccgggtgagtattttttcatgggattcagccatctgggggcgccatttcccaaaacagagattgtccctttgaggttgcaagtcaggttcctttacgctgagatcccttacatttttacttttaggaaggttttttcgaggggtggggggatgacctcattccttcgcctttggccctccctctacccggccccacaacgaggacgcccctgcagctggctgggccgcttcctcttgccacgcggggggacctgtgcccgcggccgtgcacctccgtgtacgcttctgctcctcggaccccatcggttcagacgcggatttccgagaacgagaccagagtctgcgtctggagagcctt

SEQ ID NO: 123861 - DNA, 52 bp, Homo sapiens; identical to SEQ ID NO: 91746
  misc_feature 1..52: note = chr4:154727418-154727470
  misc_feature 1..52: note = Hypo
  source 1..52: mol_type = genomic DNA

SEQ ID NO: 123862 - DNA, 569 bp, Homo sapiens; identical to SEQ ID NO: 91747
  misc_feature 1..569: note = chr4:155254047-155254616
  misc_feature 1..569: note = Hyper
  source 1..569: mol_type = genomic DNA

SEQ ID NO: 123863 - DNA, 40 bp, Homo sapiens; identical to SEQ ID NO: 40359
  misc_feature 1..40: note = chr4:155321157-155321197
  misc_feature 1..40: note = Hypo
  source 1..40: mol_type = genomic DNA

SEQ ID NO: 123864 - DNA, 73 bp, Homo sapiens; identical to SEQ ID NO: 91749
  misc_feature 1..73: note = chr4:155337912-155337985
  misc_feature 1..73: note = Hyper
  source 1..73: mol_type = genomic DNA

SEQ ID NO: 123865 - DNA, 390 bp, Homo sapiens
  misc_feature 1..390: note = chr4:155411321-155411711
  misc_feature 1..390: note = Hyper
  source 1..390: mol_type = genomic DNA
tggcaacctcaggctcggcgcctccatcgcgggcctccaccaccaactggtgccaggcctgtgcctcgcggtccagaggtctccacactcgcaccacgccgctcagctcctccaccgcgaagtaggccgcgtcgcccagtgccccgccgccgctacccgccccaggcacttgccgggcgcggacgctgtagcgcacgaagccattgggccccaggtcgcggtcggtggcgcgcacgcgacagacctcggcgcccggctgggcgtcctcgcgcaccgcggcgcggtactcgtcctgctcaaagaccggcgggttgtcgttctcatccagcacgcgcagctccacgctcaggaggccggtgcgccggggtcggccgccgtcccatgcctcga

SEQ ID NO: 123866 - DNA, 429 bp, Homo sapiens; identical to SEQ ID NO: 29225
  misc_feature 1..429: note = chr4:155412014-155412443
  misc_feature 1..429: note = Hyper
  source 1..429: mol_type = genomic DNA

SEQ ID NO: 123867 - DNA, 30 bp, Homo sapiens; identical to SEQ ID NO: 91752
  misc_feature 1..30: note = chr4:155412753-155412783
  misc_feature 1..30: note = Hyper
  source 1..30: mol_type = genomic DNA

SEQ ID NO: 123868 - DNA, 33 bp, Homo sapiens; identical to SEQ ID NO: 91753
  misc_feature 1..33: note = chr4:155413097-155413130
  misc_feature 1..33: note = Hyper
  source 1..33: mol_type = genomic DNA

SEQ ID NO: 123869 - DNA, 185 bp, Homo sapiens; identical to SEQ ID NO: 29226
  misc_feature 1..185: note = chr4:155413374-155413559
  misc_feature 1..185: note = Hyper
  source 1..185: mol_type = genomic DNA

SEQ ID NO: 123870 - DNA, 88 bp, Homo sapiens; identical to SEQ ID NO: 91755
  misc_feature 1..88: note = chr4:155444677-155444765
  misc_feature 1..88: note = Hypo
  source 1..88: mol_type = genomic DNA

SEQ ID NO: 123871 - DNA, 72 bp, Homo sapiens; identical to SEQ ID NO: 91756
  misc_feature 1..72: note = chr4:155445409-155445481
  misc_feature 1..72: note = Hypo
  source 1..72: mol_type = genomic DNA

SEQ ID NO: 123872 - DNA, 289 bp, Homo sapiens; identical to SEQ ID NO: 91757
  misc_feature 1..289: note = chr4:155548046-155548335
  misc_feature 1..289: note = Hyper
  source 1..289: mol_type = genomic DNA

SEQ ID NO: 123873 - DNA, 1295 bp, Homo sapiens
  misc_feature 1..1295: note = chr4:155663050-155664345
  misc_feature 1..1295: note = Hyper
  source 1..1295: mol_type = genomic DNA
ataagcattataagccgccttagtgaccaccagggacggaaaccgttaattatcacgtttcctttcatctccaggggccctttggcccgtgacacaagaggcttcggtattggcgctttcccagaactggcccagaggagccagttcagagtgtgaggtcgggtctgcattgaacgtacacaccgaggtctatcagactcccccgattttagcgaagggtgctgactgctgtgctgctagaggctagcaagctccctgtgcgcagctgatgagtttcagcaactcgccacctgggcgcttttctttaaattttgggagtaaactgggaaaataaaaaaatctccacgtccactggctctctccccttctccaacttcctctttcgactcgtttgtgggagttttctcctctttgctgggactataatgtgatgcgcaatcgtttgtgaatgaacaaaagtcaccggcaagcagggagacggggacagatcgctgacggcagattgagggtggcagcaaaggcccggcctccaaggataatggggagccgttttccctcacgcctggtctctatggcccccttcgtcttccaggtaaaatgaatgttccttcatccatcatccgcagagtaccctcaggcgtgcgtagaatctgctgatgaaacctattagcgccgactgggcagctttgtggagccacccgaggctctccattgtggcctttgtctgcagaatttaagcatttacataatgcattagcacggaactcagcacccggtggggacatcgcgtgccaagcctggcgcggccaacgcttcagcggctccctcacccggcagctccctaggaccaccctcgaggaggcattggagtcgggctgcaggcgcacgggcaaagaacttagcatctcatccaagtacttcgccttccttggccgtctccgggaggttatgcttaaaaacataaaaataaaaataaaaataaaaataaagggaggcggacaaagtttcggtgggtgaactgaagctgggtccatgtgaccctgaagccggagaaataaacttaacatgaatcttgctttcctggcgggcgttgggaccccgccgtttttcatgccaaccgttggaagcttcgtactcaacggccacaggtgcctaggagcgcagagaggcctcgggttcaaatcaccggcgcgcagggactggactcgcgggtagcgacccccccaacccccccccccccgccctacacacacaccctcgcgccggctgaaagcatggaggattcagggcatttg

SEQ ID NO: 123874 - DNA, 398 bp, Homo sapiens
  misc_feature 1..398: note = chr4:155665077-155665475
  misc_feature 1..398: note = Hyper
  source 1..398: mol_type = genomic DNA
tttccgggtctgtgacggccttcggctccgccccctcgacggccataaaaagtcgcagcgaagcctgcacctccgagcaccgcgcgcggccctgcccccggcacggcccccaggtgcgctccttctccggctgcttgtagcactggtctcactgtccccgccgtcagccaccggttccttatccgtctcattccccattgtggcttggctgagccggtcgccaggcctcgctgtcctcctttgccttcctctctcctcagcggccgtactttgcgccgtacctcacctggcctgcaggtgagcagcagcgcagcacccctgcccggcgagcttaacttgcccagcccggcccctgccggagtggcaccggcacctctccaagacgccctcttccctgc

SEQ ID NO: 123875 - DNA, 57 bp, Homo sapiens; identical to SEQ ID NO: 29231
  misc_feature 1..57: note = chr4:155665721-155665778
  misc_feature 1..57: note = Hyper
  source 1..57: mol_type = genomic DNA

SEQ ID NO: 123876 - DNA, 179 bp, Homo sapiens; identical to SEQ ID NO: 91765
  misc_feature 1..179: note = chr4:155677682-155677861
  misc_feature 1..179: note = Hypo
  source 1..179: mol_type = genomic DNA

SEQ ID NO: 123877 - DNA, 1144 bp, Homo sapiens
  misc_feature 1..1144: note = chr4:156129153-156130297
  misc_feature 1..1144: note = Hyper
  source 1..1144: mol_type = genomic DNA
agcaggatctgaactcgctttaccttctcgtttggagcacagggaccgcccagctagaggagcaccagcgcactgcgccccagccctgggcgagggtgcggaggatttgttctcggtgcaatcctgctggcgcttttccggggttctgcgcggatccagctccccatctctgctcctacacacacaaaagaaaacaactctcgattggaagttgtggaattttctcagcccctacgaggcgcggggattctccagccccggccctcctcccgccagcctgaggtctccttcgctcgcctgccttgctagggaccgcagtccctcagccgcagctgggtctgtccgccccgcctttgccctcgccttttcccggggcggatttggtgaagtcggcctcaagtccaggaggtctgtcttcgccgggccagctctcgcggaactggggggtagagagcaaagggagagattcgtggaagggaagggaggtaggggtggcgcaaacgcccagagtatcaaacttgggggtggcacagtaggtgacagcagcagctgcaggtggtggctggggacccgcgagggggcgcccctctgggtagggtctggctgagcgggcttgcaagcccgggaggcggctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagtaagtgtaattcctaactctgatcacctcctgggaacaagaaaatccctagaggagcgctcggttcctatgaaga

SEQ ID NO: 123878 - DNA, 646 bp, Homo sapiens
  misc_feature 1..646: note = chr4:156297387-156298033
  misc_feature 1..646: note = Hyper
  source 1..646: mol_type = genomic DNA
cttcaaaataagtcacgtcttatttaaaaggccatcaaaaggatcgtcggcgtaaaaattatgagcaccaccaccaaaaaaaaaatgtatctatatatttgcatacagcgctattcaaagaaaaagatcgtaatgctaacccgcaaacagccagcgagatgtattgcaagccaatttttcctctcacaaaagtgttaaagagagccagacaaaacgacgaagctttcgcgatgagccgcattaaaatcgcggtttcccgtactcggagcagaggcctggcagggccgcccatagcgttgtgcgccccgggttccgttccctaccaggccaggtgacgtccgggtgctcgccgctcctcaccgcgccgtatgctgagcaccagcgaacgccaggcccgtgcacgtccaagcgcggtctctgtccggatcccccatggcccccaggtcccgctttctgttcccggccccggacgcccgcggccagttctccgcgaccctgagaatcaagagccaagcatcgggtaggagctgctcaccttggtctgggcctggcggcgcccgcagagccggtcctggaccgagcgaggaggaggggctaataacagaggcggagggcggttgctaggaaacagcgtcttcgggaggaa

SEQ ID NO: 123879 - DNA, 84 bp, Homo sapiens; identical to SEQ ID NO: 91773
  misc_feature 1..84: note = chr4:156588083-156588167
  misc_feature 1..84: note = Hyper
  source 1..84: mol_type = genomic DNA

SEQ ID NO: 123880 - DNA, 653 bp, Homo sapiens
  misc_feature 1..653: note = chr4:156588456-156589109
  misc_feature 1..653: note = Hyper
  source 1..653: mol_type = genomic DNA
gcctgccacccctgacgcctgctctctttctccattcgcagtgcggatttgcgaggcgcgccctggagctgctagagatccggaagcacagccccgaggtgtgcgaagccaccaagtaagtggtcgctgcatccccacgcgggtcggggttcttcagacaggcggtccctcttccgggacccccgcttgggctgggtctccttcctctcctgagaaaccttcggtacgctcccagttgcccagccctgggaagccagcatcgggttcccacgctggggaggagcgagaggaaaggagaggacgcccgaggggccggcccagggcccgggggacccgcggcgcccgagggaggagcacagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccggcgcgccggcaggcaagcgagcgggcgcagctgggggatgcctggaccccggaggcagcagggctggaggcggtggcgggcttcagggcaacttcacccggccggctgcggcgtgggtaagaggcgcgtcctcctccacag

SEQ ID NO: 123881 - DNA, 30 bp, Homo sapiens; identical to SEQ ID NO: 91777
  misc_feature 1..30: note = chr4:156589333-156589363
  misc_feature 1..30: note = Hyper
  source 1..30: mol_type = genomic DNA

SEQ ID NO: 123882 - DNA, 85 bp, Homo sapiens; identical to SEQ ID NO: 91778
  misc_feature 1..85: note = chr4:156676892-156676977
  misc_feature 1..85: note = Hypo
  source 1..85: mol_type = genomic DNA

SEQ ID NO: 123883 - DNA, 217 bp, Homo sapiens; identical to SEQ ID NO: 91779
  misc_feature 1..217: note = chr4:156680166-156680383
  misc_feature 1..217: note = Hyper
  source 1..217: mol_type = genomic DNA

SEQ ID NO: 123884 - DNA, 271 bp, Homo sapiens
  misc_feature 1..271: note = chr4:156680699-156680970
  misc_feature 1..271: note = Hyper
  source 1..271: mol_type = genomic DNA
agggtgggaagatagcgtgggggtggggcggatggtgacggggagaatccaccagggattggggggttgcgcccccacgatccgactcctttagtgcatagtacccctaagggagaggagtcaggggcggggtgaaaggttaagccagcgccatgggagcagaggcagcagcctcgcccccaagccgcttctcaggtacagcgggtccctgacgctcaagtctctccctgtccccgcagtacggatttgtgaatcacgccctggagttgct

SEQ ID NO: 123885 - DNA, 198 bp, Homo sapiens; identical to SEQ ID NO: 91782
  misc_feature 1..198: note = chr4:156681186-156681384
  misc_feature 1..198: note = Hyper
  source 1..198: mol_type = genomic DNA

SEQ ID NO: 123886 - DNA, 17 bp, Homo sapiens
  misc_feature 1..17: note = chr4:157119858-157119875
  misc_feature 1..17: note = Hypo
  source 1..17: mol_type = genomic DNA
gtcgtgaggaacaccta

SEQ ID NO: 123887 - DNA, 41 bp, Homo sapiens; identical to SEQ ID NO: 29244
  misc_feature 1..41: note = chr4:157892721-157892762
  misc_feature 1..41: note = Hyper
  source 1..41: mol_type = genomic DNA

SEQ ID NO: 123888 - DNA, 278 bp, Homo sapiens
  misc_feature 1..278: note = chr4:157997385-157997663
  misc_feature 1..278: note = Hyper
  source 1..278: mol_type = genomic DNA
actgccacctgggcccggagcctccacgatctcgcccggcgattgtgggcaggggcgcctccgggtaagtgccaggagctccacttaggaggaggggacgcgggttggggcggcgacggtggtctgaggacgggaatagacgcctttgcggaaacagcgggtcaagcccggggcggcggagcgcgaggagcactgcggcgtgcccgggaggacgcgcgctgccctgcgcgggagaggggcgcggggcgcctggcagcggcagccgggtccccgctgcg

SEQ ID NO: 123889 - DNA, 120 bp, Homo sapiens; identical to SEQ ID NO: 91793
  misc_feature 1..120: note = chr4:157997864-157997984
  misc_feature 1..120: note = Hyper
  source 1..120: mol_type = genomic DNA

SEQ ID NO: 123890 - DNA, 30 bp, Homo sapiens; identical to SEQ ID NO: 91794
  misc_feature 1..30: note = chr4:158006556-158006586
  misc_feature 1..30: note = Hypo
  source 1..30: mol_type = genomic DNA

SEQ ID NO: 123891 - DNA, 217 bp, Homo sapiens
  misc_feature 1..217: note = chr4:158141554-158141771
  misc_feature 1..217: note = Hyper
  source 1..217: mol_type = genomic DNA
gctgaaaggccgaggcgcgcggtgggcgcgacagccccggagacccgaggtctcgcggagggacagcggctacgggccccgagctgtgctttctcagcgccgcgcacgcgacgcgtccacggtggtgcggggtgccgggcgccgtgcgggggagggggcgcgcgctcccgcctcctgccgcgagtcgcgcacgcgcgcccgggactgcctgcccctc

SEQ ID NO: 123892 - DNA, 156 bp, Homo sapiens; identical to SEQ ID NO: 91797
  misc_feature 1..156: note = chr4:158141831-158141987
  misc_feature 1..156: note = Hyper
  source 1..156: mol_type = genomic DNA

SEQ ID NO: 123893 - DNA, 265 bp, Homo sapiens; identical to SEQ ID NO: 91798
  misc_feature 1..265: note = chr4:158142758-158143023
  misc_feature 1..265: note = Hyper
  source 1..265: mol_type = genomic DNA

SEQ ID NO: 123894 - DNA, 413 bp, Homo sapiens
  misc_feature 1..413: note = chr4:158143291-158143704
  misc_feature 1..413: note = Hyper
  source 1..413: mol_type = genomic DNA
cacctcgctccccatcgagcgcctgttggcaccctgcccacagagaacacgttgttccccagggcgcgcagtcgggctgttggacaaatcccacgagggactgccggagcccagtggcctcctgccccagcagctgccgctctcgcccgctgcccccagtttagatccgcagcaccggctgggctcaccctgcggccctcgcgagctccatgttctcctctttgggacaagttgttgaaatggttccggagttgggatcggggctgttacataacgcccacccgaggggcgaggagcggggctgacgcaggctcaggccggccgggtggcgtgggggtggggcggggaggcggtggaaagggggagcgctgtcaatttctcctgctcagttgcgcttccgcttaagttggagg

SEQ ID NO: 123895 - DNA, 252 bp, Homo sapiens; identical to SEQ ID NO: 91801
  misc_feature 1..252: note = chr4:158144020-158144272
  misc_feature 1..252: note = Hyper
  source 1..252: mol_type = genomic DNA

SEQ ID NO: 123896 - DNA, 428 bp, Homo sapiens; identical to SEQ ID NO: 91803
  misc_feature 1..428: note = chr4:158740662-158741090
  misc_feature 1..428: note = Hypo
  source 1..428: mol_type = genomic DNA

SEQ ID NO: 123897 - DNA, 43 bp, Homo sapiens; identical to SEQ ID NO: 91805
  misc_feature 1..43: note = chr4:159927254-159927297
  misc_feature 1..43: note = Hypo
  source 1..43: mol_type = genomic DNA

SEQ ID NO: 123898 - DNA, 30 bp, Homo sapiens; identical to SEQ ID NO: 91817
  misc_feature 1..30: note = chr4:162044644-162044674
  misc_feature 1..30: note = Hypo
  source 1..30: mol_type = genomic DNA

SEQ ID NO: 123899 - DNA, 237 bp, Homo sapiens; identical to SEQ ID NO: 91819
  misc_feature 1..237: note = chr4:163085242-163085479
  misc_feature 1..237: note = Hyper
  source 1..237: mol_type = genomic DNA

SEQ ID NO: 123900 - DNA, 898 bp, Homo sapiens
  misc_feature 1..898: note = chr4:164252883-164253781
  misc_feature 1..898: note = Hyper
  source 1..898: mol_type = genomic DNA
ctcctaacccagccacgttccatcattacttttctaaaagaaagagctaaagagttccctgattagaactccgatgattaaaagcttcgggtgtctatcggggcgcagcgccacactcgaagcgcccggtactgcggagcgcggctcgattgcagccgagaagcgcggaacccgcaagtgggggtgggcttgcgcgctggggtccgcgccgagggctactcccacctccgccagctcccagcccgacacctgccgcgggacccgtgcgacgctgggcgacgcgccaagcccacccttctccggctcatcccagccagttactccgcgaaaactccggtgcggccagagccagcgcctccagccagctcaagacacgtaaggaaaatgagcgggtgtgggataggcgaactcgggcgccttcccagtgcctcggccttttaaagagaaccggggtaaaggaaaacttggatccccatccagaaattccccgggagcaggtggtgggaaagcccgaactccgcgtagggtaccctctcctttcacccgcgtcgtccccatacccttcggcaggagcccgcgaacggtccggtgatttggagcaacctgcgacctgcctgcactggagaccccaccttggtcccccagagccagtttcggacactcgcatcgtttttcttcccctctcatccttcaccttgtcaatgagagatttcgcagaagtctctggaaaggcataaactcgcaacttaccctctttggaatttgtctttttcgctcctgcttattaaagaaggaagggtgggaatggaagggagcagagtggggaagatccgctggtatttctcctgctcagatcctaaagattgatgaagctaggaagagacgcctccttaaagcc

SEQ ID NO: 123901 - DNA, 1179 bp, Homo sapiens
  misc_feature 1..1179: note = chr4:164264670-164265849
  misc_feature 1..1179: note = Hyper
  source 1..1179: mol_type = genomic DNA
ataaaacctgagagtcgaagcttgttctcaggaatactaagaacttaggggcacagccatcctcacaccagtccaagacttctcagagttcactacacagggttgagggctggaccggcaaaactcgatttgcccatcaagttaacttggtcggcctgggacccgaggccagggtgaagggacgacatcccggggccctgtggcttctccctagagcgcccaaacagcggcgtaggtctgggacgcccccggcccccggctttggaagaggctggcgcggagcaggcgccttggagcagggtctcgggggtccccggaacagtcacgtgttctcgagacgccgttaaacccccgccccctcttccccaccgccgcctccaggtcctgctcccgctgctgccgccaccgccggggtgcaggagcgatcgcgctgggccgcgctcccgggagcccagggcctgcagcggccggggcgccccgaggtacgggctcccgcccctccctgccaacccctttcgcgccgggtaggcctgcaccgaggggccgtggcgggtccccgcgcgggctgcgagtctgcgcaggtccctgggagcccgcacccgtctctggtgccagggcgttgtcgggggtcccaagagagcggggtggggaaggtgaagggagcgcggctggaaaaatggggattagggtggcggaacaggcacttgtcaggagtgaagagacagcggagagggtactgggctgaattctttcgtgccgagcaggtccctccggttcccaactcacccgggtggagcaggcgcgggccgaacccgggaggagagtgtcggggatccgcgaaggagcctcctggggatggggcgggggatggacaaagcgctgcccccggctggacgcgctctggctgcagcccggctggcatccggagctgggaacagcagcccgcggggtgcccgggtcagggctcaaccctagcgggtctctggcgaggccgggggcgcagcccgcggggcgccactcaggccgtccagctgccgcgcggtccagcgctgacccgagcccgggaggcagctgcgctctaaggtttgcgctcctgtttgcgaggtgtcttcatataacaaatgcgagcaataacaaacatccatagaactcgaattccagaaacgggaattctttttt

SEQ ID NO: 123902 - DNA, 777 bp, Homo sapiens
  misc_feature 1..777: note = chr4:165304413-165305190
  misc_feature 1..777: note = Hyper
  source 1..777: mol_type = genomic DNA
tctcgcccaggagggcggttgcagggaaccgaaatcggacacaacagttgcagtgaacccgactcagggttgagcgcatcagcgctaaacccaagacaaaggctgccctgtgtcttccgtactcagcgctctcctttggtaatcggtccccgtccccttcaagcccacactaggagcgcgtgagcctgtgaagtggctgtcatcgactccgcgctttccgaggggtgcggctccgtgactagtaccacgccggtgtaaacagcgcgccgcgcactggggatccgccagaaacggcgcgcgcgcagagcgggcgctgggggccaatagtagcaactaccccaggctgcgggctggagccgcctcctctcaccagagaggcgcctactgggcgagcccgccgcccgcaggttgggtggcagcacccgccgcgaaccccagccacgctccccagtggacccaccaggcaaaggcacctgctgcctgccctccagggctgatgctgtgccaagccccgctcgggatcagggacaagccgcccaggactaccagccggagagaaggggctcccagtgaggctgattgaatgaatgatgtttgcagtcacttaccggcggagggtgaagtagctcaggcggccgccaggctgcgtgcggccggcatcccggggcgcgggcattctcccatcctttgtcagttgcgggtggagcgctcctccccagctagcggacgagcagccgggtggcaggcagcccggctctggctcggctccccagtcct

SEQ ID NO: 123903 - DNA, 36 bp, Homo sapiens; identical to SEQ ID NO: 91828
  misc_feature 1..36: note = chr4:165854310-165854346
  misc_feature 1..36: note = Hypo
  source 1..36: mol_type = genomic DNA

SEQ ID NO: 123904 - DNA, 526 bp, Homo sapiens; identical to SEQ ID NO: 91829
  misc_feature 1..526: note = chr4:166299918-166300444
  misc_feature 1..526: note = Hyper
  source 1..526: mol_type = genomic DNA

SEQ ID NO: 123905 - DNA, 42 bp, Homo sapiens
  misc_feature 1..42: note = chr4:166414393-166414435
  misc_feature 1..42: note = Hyper
  source 1..42: mol_type = genomic DNA
ggaaggaatagaccacgatgttacatccggtgggtctttgcc

SEQ ID NO: 123906 - DNA, 30 bp, Homo sapiens
  misc_feature 1..30: note = chr4:166414891-166414921
  misc_feature 1..30: note = Hyper
  source 1..30: mol_type = genomic DNA
tccgtataataaatccgcagggattcaagg

SEQ ID NO: 123907 - DNA, 30 bp, Homo sapiens; identical to SEQ ID NO: 91833
  misc_feature 1..30: note = chr4:166463182-166463212
  misc_feature 1..30: note = Hypo
  source 1..30: mol_type = genomic DNA

SEQ ID NO: 123908 - DNA, 265 bp, Homo sapiens; identical to SEQ ID NO: 91834
  misc_feature 1..265: note = chr4:166793773-166794038
  misc_feature 1..265: note = Hyper
  source 1..265: mol_type = genomic DNA

SEQ ID NO: 123909 - DNA, 1064 bp, Homo sapiens
  misc_feature 1..1064: note = chr4:166794574-166795638
  misc_feature 1..1064: note = Hyper
  source 1..1064: mol_type = genomic DNA
ggctttgggctcaggcggcggcggctcgcgctcggccgcggagtcctggcagcagcggggacgcggcgcgggagtccgagctctggtggcagctgagcccgcggggcgccgctcgccgagccgcggccgcgggaagttcggcagccagaaggacgacctggcaggctgcgagcgccagcgccgccagagccgagtttgcctgcgccctccccgcctccgagtgcagagttccttacctgccctccgcccacccgtgggcccctagccaacttctccctgcgactgggggtaacaggcagtgcttgccctctctactgtcccggcggcatccacatgtttccggacacctgagcaccccggtcccgccgaggagcctccgggtggggagaagagcaccggtgcccctagccccgcacatcagcgcggaccgcggctgcctaacctctgggtcccgtcccctccttttcctccgggggaggaggatggggttgggaacgctttccccgaggatgctcgtgtggctggtggcctcggggattgttttctacggggagctatgggtctgcgctggcctcgattatgattacacttttgatgggaacgaagaggataaaacagagactatagattacaaggacccgtgtaaagccggtaagtggctctccaggttgggacggtggcgcgccgggggccgctgcgctgggtttcccatgggtggcggtgggagctcacctgtttccttccctcccgcgtcagcccctccgccgcccctccttctctccccctccttttccttcccttccccacccgcaagtggcagccgctgcggccccagttgactagagttctgtgccagtgggatccactgccaagctcccatctcccagtttgggaataaggtcctagagtttctgatccctctcccctcccccagcaaaacgaaacaagtcgtaaatatagcttgctgctgtaggttttaaattccaacactcagcgggctttatgcatatggaagggacaccgtcttctttcccctctcccccagggcgcggtttcccagcgct

SEQ ID NO: 123910 - DNA, 307 bp, Homo sapiens
  misc_feature 1..307: note = chr4:166795969-166796276
  misc_feature 1..307: note = Hyper
  source 1..307: mol_type = genomic DNA
ttcccctcccttctacgcctctggcgccgctgccagcctctcgcgcgcgcggggcggcgcttccctctcgccgcctaaggtcggaggcgcacgtgcccggggccgctaccacgtgagcgcagcgcctgagggcgcccagcactggccgcggctcgtgtccgggcttcgggagctcctggttccttgctctattgggctgtggctgaggtgatccgcgctcagtgtggacgcacaagtaacttcgtaaaggttgcatggtggttggggctaacctagcagagcggtttgtaagcggaaggcacgttag

SEQ ID NO: 123911 - DNA, 23 bp, Homo sapiens
  misc_feature 1..23: note = chr4:167721038-167721061
  misc_feature 1..23: note = Hypo
  source 1..23: mol_type = genomic DNA
aagtatgaaaatggccgggcacg

SEQ ID NO: 123912 - DNA, 547 bp, Homo sapiens
  misc_feature 1..547: note = chr4:168154961-168155508
  misc_feature 1..547: note = Hyper
  source 1..547: mol_type = genomic DNA
gctgggagggggcagcggaactgtgaacttctccagcagccctgcgccgccgcgtttccctaaacccctctcctcagaaaacggagcccactccccacccacatccggcggccgcggcccccgcctcggagcagcgcgcgcgtgtgcccggggatgtgggtgcgcggaacttacgtctcggaatttgttccactgtccgacttccttgtcatactgagagattgtggtgagccattgtttatcatccagaaaattaccgccgtccgaccgccccccggctgcagccaccgccgcggcagctgcgagagactgactgcaccaagcggctgcacacacacacagtacggctgacaccttgagcatctgggagaggagacacaacggggggtgggggggcatgtcagtgtcaaataaggggtacgaagccaggagcgaccctggaaaacatgcattagcaacgacgagggtagagggaggaggagacaagcagaggcaagcgtgtcccctccccgcaggctttacccccaaaagccgggcactcacacac

SEQ ID NO: 123913 - DNA, 79 bp, Homo sapiens; identical to SEQ ID NO: 91843
  misc_feature 1..79: note = chr4:168155788-168155867
  misc_feature 1..79: note = Hyper
  source 1..79: mol_type = genomic DNA

SEQ ID NO: 123914 - DNA, 72 bp, Homo sapiens; identical to SEQ ID NO: 91847
  misc_feature 1..72: note = chr4:169553199-169553271
  misc_feature 1..72: note = Hyper
  source 1..72: mol_type = genomic DNA

SEQ ID NO: 123915 - DNA, 169 bp, Homo sapiens; identical to SEQ ID NO: 91848
  misc_feature 1..169: note = chr4:169753974-169754143
  misc_feature 1..169: note = Hyper
  source 1..169: mol_type = genomic DNA

SEQ ID NO: 123916 - DNA, 153 bp, Homo sapiens; identical to SEQ ID NO: 40364
  misc_feature 1..153: note = chr4:170484641-170484794
  misc_feature 1..153: note = Hypo
  source 1..153: mol_type = genomic DNA

SEQ ID NO: 123917 - DNA, 35 bp, Homo sapiens; identical to SEQ ID NO: 91850
  misc_feature 1..35: note = chr4:170537901-170537936
  misc_feature 1..35: note = Hypo
  source 1..35: mol_type = genomic DNA

SEQ ID NO: 123918 - DNA, 26 bp, Homo sapiens
  misc_feature 1..26: note = chr4:170865261-170865287
  misc_feature 1..26: note = Hypo
  source 1..26: mol_type = genomic DNA
ggtttcgtctgcggcttgtcctgcta

SEQ ID NO: 123919 - DNA, 30 bp, Homo sapiens; identical to SEQ ID NO: 91852
  misc_feature 1..30: note = chr4:170899334-170899364
  misc_feature 1..30: note = Hypo
  source 1..30: mol_type = genomic DNA

SEQ ID NO: 123920 - DNA, 30 bp, Homo sapiens; identical to SEQ ID NO: 91853
  misc_feature 1..30: note = chr4:170912774-170912804
  misc_feature 1..30: note = Hypo
  source 1..30: mol_type = genomic DNA

SEQ ID NO: 123921 - DNA, 93 bp, Homo sapiens; identical to SEQ ID NO: 91854
  misc_feature 1..93: note = chr4:170916682-170916775
  misc_feature 1..93: note = Hypo
  source 1..93: mol_type = genomic DNA

SEQ ID NO: 123922 - DNA, 30 bp, Homo sapiens; identical to SEQ ID NO: 40365
  misc_feature 1..30: note = chr4:170919945-170919975
  misc_feature 1..30: note = Hypo
  source 1..30: mol_type = genomic DNA

SEQ ID NO: 123923 - DNA, 592 bp, Homo sapiens; identical to SEQ ID NO: 91856
  misc_feature 1..592: note = chr4:170947275-170947867
  misc_feature 1..592: note = Hyper
  source 1..592: mol_type = genomic DNA

SEQ ID NO: 123924 - DNA, 318 bp, Homo sapiens; identical to SEQ ID NO: 91857
  misc_feature 1..318: note = chr4:170948515-170948833
  misc_feature 1..318: note = Hyper
  source 1..318: mol_type = genomic DNA

SEQ ID NO: 123925 - DNA, 62 bp, Homo sapiens; identical to SEQ ID NO: 91858
  misc_feature 1..62: note = chr4:171544709-171544771
  misc_feature 1..62: note = Hypo
  source 1..62: mol_type = genomic DNA

SEQ ID NO: 123926 - DNA, 15 bp, Homo sapiens
  misc_feature 1..15: note = chr4:171964525-171964540
  misc_feature 1..15: note = Hypo
  source 1..15: mol_type = genomic DNA
cgggcctcagctgcc

SEQ ID NO: 123927 - DNA, 24 bp, Homo sapiens
  misc_feature 1..24: note = chr4:172498649-172498673
  misc_feature 1..24: note = Hypo
  source 1..24: mol_type = genomic DNA
tttttttttttgagacggagtctc

SEQ ID NO: 123928 - DNA, 80 bp, Homo sapiens; identical to SEQ ID NO: 91862
  misc_feature 1..80: note = chr4:172596057-172596137
  misc_feature 1..80: note = Hypo
  source 1..80: mol_type = genomic DNA

SEQ ID NO: 123929 - DNA, 32 bp, Homo sapiens; identical to SEQ ID NO: 91863
  misc_feature 1..32: note = chr4:172596627-172596659
  misc_feature 1..32: note = Hypo
  source 1..32: mol_type = genomic DNA

SEQ ID NO: 123930 - DNA, 1637 bp, Homo sapiens
  misc_feature 1..1637: note = chr4:172733596-172735233
  misc_feature 1..1637: note = Hyper
  source 1..1637: mol_type = genomic DNA
aagaggtgaccatggcgtttatttttggctccagacaggcggattcagcctgcattgcatgcatgcatgtctgtcacctcatctaagtccccattccttccggagttgtgagctccagatccaagagtgcccagtgcacggtgctgggcacgctgtcccttggcgaggctgccacaggttcctgagtgtgcggtcaggggcgttggtgcattgatacgttaggcggagggaggagtaccatctgccagagtcttatctcgagtcccacgttttctggccatcgcggaggagtgtgcgaggacaggtagccctcgcagtgacaaggcgcgcggagtgcggtcgtgcaaggcgggggaggagcggggtggccctgccgaatcttaaccggggccccgggtgtttgcagacccaaataaagccgccttgggtctccacggtgtcctccagaagctgctgcctgagaactctgagcctcagctctgtcttgcttcgggatcctcttcctcctccttccccaccccctacctggcctgaacggcggaacgcgcggctcgggggatcccctctccctgggaccggccctgtcccgggtcgcctccacctcccgcagccgccgcgccccggctcgccgcgctcccgccggcaccatggaggaattcctgggacaaccgcctgcagccggcgacttttccccaggaatctctggcctggcgccctttgggtgagatgacggggtgctggcatccctgtcggtcccagattacccggaaaagccctggcaggtaaagagaggacccgcgcaggctgggagctcccactcctcctccagcgtcacgctcgccctccgccgctgcctcgcgtccgggtctgtttatatagcgtctggaggccgggaggcattgcccacccccgccaggcggcccgccctcccctcctgggctccgggctgccgcacgtggcagacaccagcgacgtctccgcggaaggcaggcgccggggagtggggcgcgggcgaccgtgtgcagccgcggcgcatctccgccttccgctcctcctcgcagcgccctcgtccgcttccaagcccagcacagacttcggtttctccgcctccatcccctttacgagaagaggagatcaaaaaatattgccctttaggtgctcgtgatggtcctgtgggttcgttcagttgccagaaaagaatggtaacatgaacagcggagcgtgagagcgtcaccgggggaagggacgagattgatgggcagagcgctcacttctcagaggatcgcattccgaggaccgcgcgaggaagggacgtcgcggcgccaccacttcctggctggactccgctgacatctgtagcctcctttccaccaggttcccggggctcccagccgctgcctgcagaggagcgtgtagacagcgcgcgagggtccggcacttcgtggacctccatccgaaccggagttctgcccggatcccgagtccctggatcccggtggagcccgccggcaagctggctccggagggagttgaacttgagttcaggtgggttatcccaaggggagcacaggaaaagatgttcagggaagacgaagaaggtgacgctgttccaatgtcaaaagcggacacttttcttc

SEQ ID NO: 123931 - DNA, 24 bp, Homo sapiens
  misc_feature 1..24: note = chr4:172903767-172903791
  misc_feature 1..24: note = Hypo
  source 1..24: mol_type = genomic DNA
tcttccagacgagcttgttggagg

SEQ ID NO: 123932 - DNA, 17 bp, Homo sapiens
  misc_feature 1..17: note = chr4:174307595-174307612
  misc_feature 1..17: note = Hypo
  source 1..17: mol_type = genomic DNA
gccgtgtttatatacac

SEQ ID NO: 123933 - DNA, 55 bp, Homo sapiens; identical to SEQ ID NO: 91872
  misc_feature 1..55: note = chr4:174429633-174429688
  misc_feature 1..55: note = Hyper
  source 1..55: mol_type = genomic DNA

SEQ ID NO: 123934 - DNA, 917 bp, Homo sapiens
  misc_feature 1..917: note = chr4:174430233-174431150
  misc_feature 1..917: note = Hyper
  source 1..917: mol_type = genomic DNA
tattattccacttcacgagtactaaggaggagtccagaattggtggccgtcctccctcttgttttctcatgcaaataactcaacactctaatcgtaaatcaaagctccagggcctacttttgcgaggggcactggagaaagaagagagggttgcgcgcgcgcgtgcgggagcttcggaagctaaatctcactcgcggggaggatgggacgcgtggggactgaaggcggcatctgcctgaataaagccctcgcgcgctctgagcctcccactctgtcctggaggcctgaacctcgcgagtagagcctggcgcttttcctccccgggagcacgacggatagaatgcgcggggtcgagacggtgtcggtagcgggggccgcagcgctttgcaaagccggcctctgcccccggcctccttggagggcggtagcgggacctgcgctcgcagcctctccccagggctgtgcgcttcggcctggcggctgccgggcaaaaacctcatttatttccttccttcccgagtgagctcacttcctccccgcgccgctcccttccgtcggccggaacccgctcctgggccgcgcggctgcagccgggagcgcggactcggggtgtcgggcggtgtccgcgcccctccccaccccagggcccttctcgggggagatatccaggagctgaaagagattcctcaggaggaagtggaaacctctgaaaggagaggaaaccgactcttttgcaagaaaactgagcgccggctggaaggcaaggaagccgaggcggccggggagattcacccacatgcctgttgactcgggcccagtacctgcgtctccttccttctctttctggccctcatttcccctgcttctcactttagttcactgctgttttaaaaattcatatgcgggctcatttaaaa

SEQ ID NO: 123935 - DNA, 620 bp, Homo sapiens
  misc_feature 1..620: note = chr4:174437927-174438547
  misc_feature 1..620: note = Hyper
  source 1..620: mol_type = genomic DNA
tacgcagaggcgcaccgggttccgactccaccgcggcgccgagggggccagaggctcccagttcttccccgcatagttcgacaaagccctactttgcttccctgggtctgggatctcaacgtgaagggggccgagagagcggtgataaggtgctagaaaggaaacggcaagaggaaactaaaaaagtggagagaaattttgtgcgccgtagtgcttagcaagctggggaaacgaggagaaaacgagcaaagtctacaggggagggagagagggaggaggcagggaaggagaggaccacgaggctcccggcgcccaggccgccacttgggaggtcccggccccaaagcaggccgggccaaccgtccccccgggaggctcggggctcgggcggggtcacaattacacctcggctccaggcgaggacttaaaaaccaagtggtggggactgcagtctggaagcaaggccctgcggtcatcggaggggggccaggcccgtgcacaggaaccttttacaaggcatgtgggtacaagaaaaaaaatcaaaataaaccactttcatccagcatgggcagtgaaaagaaaagctgccttccagagggggcgagcgggagttttgaaat

SEQ ID NO: 123936 - DNA, 551 bp, Homo sapiens; identical to SEQ ID NO: 91876
  misc_feature 1..551: note = chr4:174439797-174440348
  misc_feature 1..551: note = Hyper
  source 1..551: mol_type = genomic DNA

SEQ ID NO: 123937 - DNA, 125 bp, Homo sapiens; identical to SEQ ID NO: 91877
  misc_feature 1..125: note = chr4:174440635-174440760
  misc_feature 1..125: note = Hyper
  source 1..125: mol_type = genomic DNA

SEQ ID NO: 123938 - DNA, 30 bp, Homo sapiens; identical to SEQ ID NO: 29281
  misc_feature 1..30: note = chr4:174443212-174443242
  misc_feature 1..30: note = Hyper
  source 1..30: mol_type = genomic DNA

SEQ ID NO: 123939 - DNA, 634 bp, Homo sapiens
  misc_feature 1..634: note = chr4:174443551-174444185
  misc_feature 1..634: note = Hyper
  source 1..634: mol_type = genomic DNA
agatgtccctaatagcggagataaagacggacagagcggccgggaataaatttgtaatcagggctctaccatctgatcatcaaagcggcccaaatgccgggagaatttgaagggaatgcgtgtgaggggggtcgcttgggggaagaggtgagggtgcacttcgcgatgggaactggcttcggtagggtagagcagggagaacagggcgagagatctgtaagttcggtgcacgtaagtcggatactcggtgctctttaacctccattagccctcagaccgaagccgtttagcggttccaggctgattggagctgcgcagttgctgtgcgggaagcacgcgttgcgcagcggctgggtggtaaggcggcgcgatgagaactgtccggcccccggaaacgtgggattggtttcctctcccggagttctcccctcccccttctttctaaacatttaaaaaacacgtagtccgtctcccccaacccccattcccggtagacttaatcccaacagcaattcattgcaccgcggagcttcctcagggagggggctgttggagcctccaaccagggtcctgggccccagtctgagaatgactcctgggtttttctctccaagcgatccgcaggctctgacag

SEQ ID NO: 123940 - DNA, 82 bp, Homo sapiens
  misc_feature 1..82: note = chr4:174446434-174446516
  misc_feature 1..82: note = Hyper
  source 1..82: mol_type = genomic DNA
gcgttgtcagccgcccgcagaagtccgcagagcctctagcttgtctctccctgggcacttctgaattcgcccacgccgggtc

SEQ ID NO: 123941 - DNA, 345 bp, Homo sapiens
  misc_feature 1..345: note = chr4:174448318-174448663
  misc_feature 1..345: note = Hyper
  source 1..345: mol_type = genomic DNA
aaggagtcctcagagcggagcgcggacggcttttccggagtcctgggtctgcatctggcgccttggcccctgctcactcgcgctctcctcctcctccttctcctcctcctcactgcttgagctccagggcccagacgtgctgcggccagcccgtccggcctttggttttcttgtcgttgctgctcactgtgcttttcaagatttcgttctggacagaggaaaggcgagggcgagaaaagtggaaagagaaattcagagaggatacctggttccacaccaacccggagcttcctgcgccggaggagacagtgaaccagagaggaaaggatacgatgggggagtccc

SEQ ID NO: 123942 - DNA, 38 bp, Homo sapiens; identical to SEQ ID NO: 29284
  misc_feature 1..38: note = chr4:174449624-174449662
  misc_feature 1..38: note = Hyper
  source 1..38: mol_type = genomic DNA

SEQ ID NO: 123943 - DNA, 2283 bp, Homo sapiens
  misc_feature 1..2283: note = chr4:174449899-174452182
  misc_feature 1..2283: note = Hyper
  source 1..2283: mol_type = genomic DNA
tcttctcctctttcacgtcggtcttcttgatctctgccttgaaggcctccgcctcgccattctggtcgtccttggccagcaggtccatgaggtaggcgatgtagctggtggccaggcgcagggtcttgattttggagagtttggtgtcggcgggtacgttggggatgcactcgcgcagttcggcgaaggcgctgttgatgctctgagtcctgcgccgctccttgcggttggcggtgcctcggcgcttcaccgggcgcggcccccccaggcccgggggcccggcgcccggcggcacccccccgtaatgggagtggtccaggccggcggcgccgctggcatactcggggctgtaggacagggccatgctgtagtcggggggcgacatctcggggtggccgatgagccagccatggaagtaggggttctcctcatggctgcagcggctggcggcggcggcggcagctgcggcggcggcggcggcaaacgggtagccctcgtggtgcaccaccgggtggtggggaaaaccacctaccagactcatttcgccctccgcgcccctccacgcgccccagcgtgcgcgcagccccgccgcgccctcggcccgggcccctgcctcagcgctcggcgtcctcccccaccccccaccccccagcccccgggcgcccgggcccgcccggcagccgcagagggggctgctgcagcccgggccccgtccccccgcctggccagccgggcccgcctcagcagcgctgcggccgccggctccccatggggcgcggcgagctggtcctggcaccgtgcgcccctggccgccgccgccgccgcctccggttcccgccttgctccacggcccgcgcttcggctcctgcttcccgggctgctgcgcggaggcagaatcctctcgtgctcatacaaaggtgccggggctcccgcgaggctggtacgcggagtctcgggaatccaagcccgggccgcggtcctggcaccgaagctaacccggaatccaggggcgagtctgagccgcggctggaggagccggtccagctgtgccggggggcggcggggtcgactgctcactgcaaagctacctccgtgcgaccctccccttcccgcctcttcccctccccccaccagcccgatctgggttcttgggcgcttattgttttaatgaaatttttggttgttgttgttttggtccttaaatgtgattttagctgcgagtaacgtgtcctcgctcctctcgcgctctctcggagggttttcagagaggtctcagtgcatccattttctcagatcctctcctttcggggcaaggatctggggccctgaatgagccttggagctcgaagaccgcggctcgggctctcggagggctctgcgcggtggccgaggaagctccggggtgacggcggtggttctcctgggctggacgacgtgaggggagcaagcggattttcccagcaagatctccatgtacagctacatctttagggccgctcgggttaatatatgtcgtcagaggctcctcacgccaatcccggggcggcaggggcggcgcctcgagctctcggcaataaaactttttgatgttcacgttgctaattgccgaggtcctcttccaggattggctacctcctcataaccataagataattaaaacttggcggggggggggggcagggttaaaaaaactttttttatcagtcagaggataatgcaagtgtttaacagatgcttcactattaaaatattttccccccaagtctcaaatattgaagaatctctaaccaggtacagtatcactctgctctcttttctggttgaaaagaaagaaagaaagaaaacgcaggtattgcttttcgaagtgctttgtaggtaatcgaggtaagaaaatatacgcaggcagcctcttacaattttatgcaggggcgccgggagcctcgtgacgggcggtgggggcccccacaaaggcgcggctgggagctggcgctctttgccccagcagggacgaggagcggctggagaagggtgtttctttgacccgtttacaggctcgaaacgccggtctcagtggctattgagttacccaccaagttaccccggttagagctgtttggggtggctcacgttattgcggcaaactttggagatgacggctgagtcctccgggcgaacatgtcaagccgattgtaaatgctgttatttccacatccttcagggacaccagtccctacgaagaccttgggcgattttgaagtgcgggcacctcgattccccgaatct

SEQ ID NO: 123944 - DNA, 327 bp, Homo sapiens
  misc_feature 1..327: note = chr4:174452445-174452772
  misc_feature 1..327: note = Hyper
  source 1..327: mol_type = genomic DNA
ttgaacgcattataacggaaaatggatctccacttgtaagtcaccgggccgcggggcacccgggccgcagcgcccgtgtggcatgagcttcttgagaaggctcacgtgcggcgagggcgggtggtaaatggcaggagctgaaatcaccccaggcttggccccaagccgagaggggaggctgatgtgtatatgcagattccacccgaaggagttcggtgtggaaaacggtgtcaacaggagcccgcgggctgtaaattagagggaggcgagggcctgcggcgccagcgcgggacagggcggcctggggctcgccgctggtcaggccag

SEQ ID NO: 123945 - DNA, 529 bp, Homo sapiens
  misc_feature 1..529: note = chr4:174459122-174459651
  misc_feature 1..529: note = Hyper
  source 1..529: mol_type = genomic DNA
atgggaaaatcaaagcgccagccagagcgggtcgcactgttagttcctgtattttctcctcctgcctctggtttcttccgttccgttctagctgcctgaagacccagcccgacagcgatgcctgtcagcccgcgtcgcccaccagggcagctgctctcccaactcgcatggggggcaccaccccgcctcggtgccctagagctgagcgcagccgcggctccacggggatcgccagggcctcagccctcgcggccggcggcgcgggagtgttgcggggcagggaccagagcgcgatcagagcggccacccccgatttaggtcgccagctttccagtcactgcgatggccactggggcgccccttccatcctggttaaattctcattgtgatccccagccctcttctcggttccccacacccaggaggccggttctccgccgctcaggctgggagaggtcaccgctccgggcagggtggacccccagctccgtctcggaggacctttcgccggaggcgagcaggaaggggt

SEQ ID NO: 123946 - DNA, 365 bp, Homo sapiens; identical to SEQ ID NO: 91890
  misc_feature 1..365: note = chr4:174459856-174460221
  misc_feature 1..365: note = Hyper
  source 1..365: mol_type = genomic DNA

SEQ ID NO: 123947 - DNA, 466 bp, Homo sapiens; identical to SEQ ID NO: 91891
  misc_feature 1..466: note = chr4:175132735-175133201
  misc_feature 1..466: note = Hyper
  source 1..466: mol_type = genomic DNA

SEQ ID NO: 123948 - DNA, 1293 bp, Homo sapiens; identical to SEQ ID NO: 91892
  misc_feature 1..1293: note = chr4:175134868-175136161
  misc_feature 1..1293: note = Hyper
  source 1..1293: mol_type = genomic DNA

SEQ ID NO: 123949 - DNA, 83 bp, Homo sapiens; identical to SEQ ID NO: 91893
  misc_feature 1..83: note = chr4:175137696-175137779
  misc_feature 1..83: note = Hyper
  source 1..83: mol_type = genomic DNA

SEQ ID NO: 123950 - DNA, 1458 bp, Homo sapiens; identical to SEQ ID NO: 91894
  misc_feature 1..1458: note = chr4:175138499-175139957
  misc_feature 1..1458: note = Hyper
  source 1..1458: mol_type = genomic DNA

SEQ ID NO: 123951 - DNA, 604 bp, Homo sapiens; identical to SEQ ID NO: 91898
  misc_feature 1..604: note = chr4:175443197-175443801
  misc_feature 1..604: note = Hyper
  source 1..604: mol_type = genomic DNA

SEQ ID NO: 123952 - DNA, 884 bp, Homo sapiens; identical to SEQ ID NO: 91899
  misc_feature 1..884: note = chr4:175749823-175750707
  misc_feature 1..884: note = Hyper
  source 1..884: mol_type = genomic DNA

SEQ ID NO: 123953 - DNA, 22 bp, Homo sapiens
  misc_feature 1..22: note = chr4:175836862-175836884
  misc_feature 1..22: note = Hypo
  source 1..22: mol_type = genomic DNA
ccgcgcccggccccattgttta

SEQ ID NO: 123954 - DNA, 87 bp, Homo sapiens; identical to SEQ ID NO: 91901
  misc_feature 1..87: note = chr4:175940800-175940887
  misc_feature 1..87: note = Hypo
  source 1..87: mol_type = genomic DNA

SEQ ID NO: 123955 - DNA, 45 bp, Homo sapiens; identical to SEQ ID NO: 91903
  misc_feature 1..45: note = chr4:176394073-176394118
  misc_feature 1..45: note = Hypo
  source 1..45: mol_type = genomic DNA

SEQ ID NO: 123956 - DNA, 1036 bp, Homo sapiens
  misc_feature 1..1036: note = chr4:176922653-176923689
  misc_feature 1..1036: note = Hyper
  source 1..1036: mol_type = genomic DNA
gttcttcctcccctccgccacacgcagtcacattcctggagctattccaagctgcctccgctaagcaccgaataagcggaccctgcctggaaacttgagcgaagctgaactgcgccgaactccaccgtccagtgacccgagccagtgtggacgcccttttaatcacgctgtttacccaggtggaatttaggaagaatcagccttcagcctcaacctcaaaccttttgtgcaaatgggcacttcgtttggaaagggactagaaattgtccccagtctggccctgcaccagcaccttcctctgctcaaacctgtacaaagtggaagttttaggaagtttccatttctcgtgccccgtttcaacttgctccccaaagagaacatgaaaacgtgggaactcgggaggacagagatctccctgtaatcgcctcgctattcggatcctgggtctcttagtctttctttatttcccaaataccgcccccagcacggtagaccggacccccaggcttgggtcctggggccggcgcagaggatcagcgcccaagcgcagccccccaccctcccgacccactgtaaacagtcgggcaccctccctcgcctccaggtgccaccccatcgccatcgcctctctcccagaaaaaaaagtccggagacaagagggcggggggcgggggacgccaggcgcggggggaacagagctgggaaggacgcagtctgaggccgaggaacattcattttctttctataatgcccattcccgaggccgagcctttgggcgaggtgtacgcgcccgcccgcgcactcacccatggcccgaggtcctgcttctctgcagtccccagaggagagcgagtgaccagacgctgcgcggggccaagttctccaagccgcgctgaggctcctcgcgccctggcaagtgacagcctcgcccctcccagcggagacaactcgcagggcgcctggcgactctgcgggcgcacagacccctccctctttccacctgcctcctctgcgagaagcccgttttcctcccctt

SEQ ID NO: 123957 - DNA, 537 bp, Homo sapiens
  misc_feature 1..537: note = chr4:176986819-176987356
  misc_feature 1..537: note = Hyper
  source 1..537: mol_type = genomic DNA
ctctgcccaaagcctcgctccagtacggaggagctgcgccttcaacacactttctctgttgccaggtaaccacttctccctcagcctagtctccaagggtcacgagccacttccgcctccccctctcgggcgctccaatcagcgacctgtgtagctgtcacgtgggcctctggggcagaccctggagatcgggctcgcggcgccttccatcgtggctccgcgctggggcttgcggagcacgcttcccgcccctcggagcccgcgggcccggccgccccgcccccgggcgccctgagcgagcaggcggggagggcggggagggtccgcgcgttggtggtgctcgcctcgcagctgcgcccgccggcttcagcaccttccgctgtccgccgctgcagccgcctcctcctccaggtaagaagccggtggggccgcagagataccaaggcaagctcaggattgatgtgggtgatgctggaactgtcgcggcgtcatgcgagaggggctctgacctccctgtgatcgcggaccagggtaatg

SEQ ID NO: 123958 - DNA, 1177 bp, Homo sapiens; identical to SEQ ID NO: 91912
  misc_feature 1..1177: note = chr4:177713228-177714405
  misc_feature 1..1177: note = Hyper
  source 1..1177: mol_type = genomic DNA

SEQ ID NO: 123959 - DNA, 182 bp, Homo sapiens; identical to SEQ ID NO: 91917
  misc_feature 1..182: note = chr4:177973020-177973202
  misc_feature 1..182: note = Hypo
  source 1..182: mol_type = genomic DNA

SEQ ID NO: 123960 - DNA, 20 bp, Homo sapiens
  misc_feature 1..20: note = chr4:178109673-178109693
  misc_feature 1..20: note = Hypo
  source 1..20: mol_type = genomic DNA
tttttttttttgagacggag

SEQ ID NO: 123961 - DNA, 25 bp, Homo sapiens
  misc_feature 1..25: note = chr4:178599692-178599717
  misc_feature 1..25: note = Hypo
  source 1..25: mol_type = genomic DNA
tgcgcccagccgagtccatttggga

SEQ ID NO: 123962 - DNA, 73 bp, Homo sapiens; identical to SEQ ID NO: 91923
  misc_feature 1..73: note = chr4:179443386-179443459
  misc_feature 1..73: note = Hypo
  source 1..73: mol_type = genomic DNA

SEQ ID NO: 123963 - DNA, 30 bp, Homo sapiens; identical to SEQ ID NO: 40370
  misc_feature 1..30: note = chr4:180818589-180818619
  misc_feature 1..30: note = Hypo
  source 1..30: mol_type = genomic DNA

SEQ ID NO: 123964 - DNA, 426 bp, Homo sapiens; identical to SEQ ID NO: 91931
  misc_feature 1..426: note = chr4:180979223-180979649
  misc_feature 1..426: note = Hyper
  source 1..426: mol_type = genomic DNA

SEQ ID NO: 123965 - DNA, 406 bp, Homo sapiens; identical to SEQ ID NO: 91932
  misc_feature 1..406: note = chr4:180980004-180980410
  misc_feature 1..406: note = Hyper
  source 1..406: mol_type = genomic DNA

SEQ ID NO: 123966 - DNA, 40 bp, Homo sapiens; identical to SEQ ID NO: 91933
  misc_feature 1..40: note = chr4:180980984-180981024
  misc_feature 1..40: note = Hyper
  source 1..40: mol_type = genomic DNA

SEQ ID NO: 123967 - DNA, 24 bp, Homo sapiens
  misc_feature 1..24: note = chr4:181546386-181546410
  misc_feature 1..24: note = Hypo
  source 1..24: mol_type = genomic DNA
cttttttttttgagacggagtctc

SEQ ID NO: 123968 - DNA, 155 bp, Homo sapiens; identical to SEQ ID NO: 91936
  misc_feature 1..155: note = chr4:182558152-182558307
  misc_feature 1..155: note = Hypo
  source 1..155: mol_type = genomic DNA

SEQ ID NO: 123969 - DNA, 30 bp, Homo sapiens; identical to SEQ ID NO: 91938
  misc_feature 1..30: note = chr4:182982724-182982754
  misc_feature 1..30: note = Hypo
  source 1..30: mol_type = genomic DNA

SEQ ID NO: 123970 - DNA, 114 bp, Homo sapiens; identical to SEQ ID NO: 91939
  misc_feature 1..114: note = chr4:183062432-183062546
  misc_feature 1..114: note = Hyper
  source 1..114: mol_type = genomic DNA

SEQ ID NO: 123971 - DNA, 1851 bp, Homo sapiens
  misc_feature 1..1851: note = chr4:183063666-183065517
  misc_feature 1..1851: note = Hyper
  source 1..1851: mol_type = genomic DNA
gtttctggttctgcacggtagttaaaaatgcaagtggatttcctaacggccgagtacaggtacaggtggaggtcggcggaatcctctgctctgaagctgaaagtggagggtggcgcgaggcggctggcgcgacgaggctgagagcgcaccagtctccgccacgcttccaaggacaggttggcgacggccggggcaggcctggtcgcgggctcctagccctccacgggcagactgctggtcccaggagagggcggggagatgctcgggcgcgcaccagggagccgcactcactcggcagccccaagcacgcacgccccacctctgccgccgccccgtcccggacccgaaaggagcctgaaggatcccgccgaccacccagccagagagcggttcggctcaggtcgcccattcggagctacaaaactctggaacctccagcagtttcggaagctccgggggagggctttcctgcagacagggggcgggagctagggagccgggagccagcgctgcggtgggaacttcagtgagtagaaagtggccagtgtcttgggaggagcagcaaactttttttttccctcccacagcaaacaaaatcgaggcagggacagtgtccggccgctaatctgaggggagaatggagaggaaagaagagtagtaaaagtggggagtggagccttcggaggactcccgggtccgcccctggccaggtgatgcggggcggaggcctaggtgcttgaacctggggggcagacaattgttctgctgcagtgcccaccaggggctggtaaggaagtctgagtgtttactgcctcccttccctgtccaaaggtcatttgcgcttttcggtctcggacgaaagaacactgtggaaaggaaggcgcgggtcattttcagaggctctgcaaaggacgggccgcctaccgggggtggaaatccttaattacacccttctgcctcggaatccgtcttcccggcagtgtcttgcactgccacctcctcgggtgactcagctgacctgaaatgcccaccctacggaagatcaagaaaagtagttttctaagaaggttagaggtttgattacacagagaagtgtttccacttaagtccaaagcaattacccgccccctcccccagggccgcctccccgccacccgcagcagaaaaggacagacccccacgcacgtacccccattttgttggtgcgtgtgaatttcaaatggcgcagtaagttcattagtgttttcaatcggcggcgggcagacccctcatcagagccgaaagccggcaagagccattcatcagcgtgaagtgttattcacggatgacccctaaatcacggcgagagtagtaaaggcactgattggtcacagcatgggagcctcggtgctttcccgaacccgacgcggccgggaggagggaaggagggaggggcggcgaacgtggttcagtccggcaaatcccatttgacagaaaaaggcagtaaacggggaatctctttttttgaataaagaagaagaagaaataaagtacctgtcatcttgacaagtggcggagcggaggagtcaaggattataaatgatcacagccaggtccagctcgccccgtgattgggctctcccgcgatctgcaccgggggaagcgcatggtaggctcctctcctctcctcctctccctcgcacactcccgcacacacacacacacacacacacacggacacgtgtacgcgcccgggctcgggcacactcggcccggcgcgtcccccgccgcacaattacggtcctggatgccgctccctggccgggcgtcccgcgggcctcctcacctggcccttctcgccttcctcctccc

SEQ ID NO: 123972 - DNA, 360 bp, Homo sapiens; identical to SEQ ID NO: 91942
  misc_feature 1..360: note = chr4:183065946-183066306
  misc_feature 1..360: note = Hyper
  source 1..360: mol_type = genomic DNA

SEQ ID NO: 123973 - DNA, 32 bp, Homo sapiens; identical to SEQ ID NO: 91943
  misc_feature 1..32: note = chr4:183115488-183115520
  misc_feature 1..32: note = Hypo
  source 1..32: mol_type = genomic DNA

SEQ ID NO: 123974 - DNA, 24 bp, Homo sapiens
  misc_feature 1..24: note = chr4:183256665-183256689
  misc_feature 1..24: note = Hypo
  source 1..24: mol_type = genomic DNA
aaaaaaagacgaagcatttgccat

SEQ ID NO: 123975 - DNA, 1005 bp, Homo sapiens
  misc_feature 1..1005: note = chr4:183369261-183370266
  misc_feature 1..1005: note = Hyper
  source 1..1005: mol_type = genomic DNA
ttcagcccctggtaccgtcttctctccccgggtcgcgacactgactcgtcaacgttaatgggggtccgcgactgctgcggggacgagggcgcagagcagcccccgccacgggccggtccacgcaggggccgagaaagtggcggagaggcggtggccgaggcccaggggcgagcgcgggctgagctggtccctgctgcgttcacgagcgacacccaccccttcgctgcggacgccccgcgggcgccaggctgggggccctgcgaccgacccctcccgcccccgaggtaccgccgggcccgcctggcaggcagcgcgtcccgcgagctggagggccgagtttcgcggggccgtggggcgtgtgggtgaaggcgacacctcggatgcgggacgcatgaatggtggcagagcaggggtcgggatccgttcatgggttgggagagagatgcttttgtgagcacgggaaagtagcgctgccggagaacagctctgaggcgggatcaaaagccgccggcgaagccccgccgaggaacacggccgctgcccggggcggctcgcgagcgtgcgtgtgtggaggggaggatgccgccccgcggggtcttcggagggtgccgggagcgggttctcagtgcagttcccccgtcttcgctgggggcacggctgctcacaggccccggcccgcgtgtgtggagcggggcgagggggtgaggcgagggggtgaggcggcggccgagccggggcgctgggcgcggggctggcgggaggcggcggtggcggcccggcgcgaaggggttaagcggcgcaccgccccctcggcggccgggtgtaaacagaggagcctcagcctatcatgtctggccgccgcgcgcagcccgagcccggagccaggcgctgtaacacgatacgctccagacccaggcaacttggcagcgctgggctcggttcctcacggccacagcgagggcgcgccgcggcaaggtgggtgagcggcggcggcggcggcggcct

SEQ ID NO: 123976 - DNA, 158 bp, Homo sapiens; identical to SEQ ID NO: 91947
  misc_feature 1..158: note = chr4:183370559-183370717
  misc_feature 1..158: note = Hyper
  source 1..158: mol_type = genomic DNA

SEQ ID NO: 123977 - DNA, 22 bp, Homo sapiens
  misc_feature 1..22: note = chr4:183447416-183447438
  misc_feature 1..22: note = Hypo
  source 1..22: mol_type = genomic DNA
gccaccgcgcccagctacattt

SEQ ID NO: 123978 - DNA, 16 bp, Homo sapiens
  misc_feature 1..16: note = chr4:183690642-183690658
  misc_feature 1..16: note = Hypo
  source 1..16: mol_type = genomic DNA
agagcagtcctaggcc

SEQ ID NO: 123979 - DNA, 30 bp, Homo sapiens; identical to SEQ ID NO: 91950
  misc_feature 1..30: note = chr4:183696298-183696328
  misc_feature 1..30: note = Hypo
  source 1..30: mol_type = genomic DNA

SEQ ID NO: 123980 - DNA, 212 bp, Homo sapiens; identical to SEQ ID NO: 91951
  misc_feature 1..212: note = chr4:183727706-183727918
  misc_feature 1..212: note = Hyper
  source 1..212: mol_type = genomic DNA

SEQ ID NO: 123981 - DNA, 30 bp, Homo sapiens; identical to SEQ ID NO: 40371
  misc_feature 1..30: note = chr4:183959079-183959109
  misc_feature 1..30: note = Hypo
  source 1..30: mol_type = genomic DNA

SEQ ID NO: 123982 - DNA, 30 bp, Homo sapiens; identical to SEQ ID NO: 91953
  misc_feature 1..30: note = chr4:183994250-183994280
  misc_feature 1..30: note = Hypo
  source 1..30: mol_type = genomic DNA

SEQ ID NO: 123983 - DNA, 691 bp, Homo sapiens; identical to SEQ ID NO: 91954
  misc_feature 1..691: note = chr4:184019209-184019900
  misc_feature 1..691: note = Hyper
  source 1..691: mol_type = genomic DNA

SEQ ID NO: 123984 - DNA, 1152 bp, Homo sapiens; identical to SEQ ID NO: 91955
  misc_feature 1..1152: note = chr4:184020126-184021278
  misc_feature 1..1152: note = Hyper
  source 1..1152: mol_type = genomic DNA

SEQ ID NO: 123985 - DNA, 42 bp, Homo sapiens; identical to SEQ ID NO: 91956
  misc_feature 1..42: note = chr4:184205414-184205456
  misc_feature 1..42: note = Hypo
  source 1..42: mol_type = genomic DNA

SEQ ID NO: 123986 - DNA, 30 bp, Homo sapiens; identical to SEQ ID NO: 91957
  misc_feature 1..30: note = chr4:184278109-184278139
  misc_feature 1..30: note = Hypo
  source 1..30: mol_type = genomic DNA

SEQ ID NO: 123987 - DNA, 120 bp, Homo sapiens; identical to SEQ ID NO: 91958
  misc_feature 1..120: note = chr4:184375288-184375408
  misc_feature 1..120: note = Hypo
  source 1..120: mol_type = genomic DNA

SEQ ID NO: 123988 - DNA, 18 bp, Homo sapiens
  misc_feature 1..18: note = chr4:184375708-184375726
  misc_feature 1..18: note = Hypo
  source 1..18: mol_type = genomic DNA
ggccgatcctgcttcttt

SEQ ID NO: 123989 - DNA, 30 bp, Homo sapiens; identical to SEQ ID NO: 91960
  misc_feature 1..30: note = chr4:184532559-184532589
  misc_feature 1..30: note = Hypo
  source 1..30: mol_type = genomic DNA

SEQ ID NO: 123990 - DNA, 36 bp, Homo sapiens; identical to SEQ ID NO: 91961
  misc_feature 1..36: note = chr4:184667629-184667665
  misc_feature 1..36: note = Hypo
  source 1..36: mol_type = genomic DNA

SEQ ID NO: 123991 - DNA, 636 bp, Homo sapiens; identical to SEQ ID NO: 91962
  misc_feature 1..636: note = chr4:184718199-184718835
  misc_feature 1..636: note = Hyper
  source 1..636: mol_type = genomic DNA

SEQ ID NO: 123992 - DNA, 213 bp, Homo sapiens; identical to SEQ ID NO: 91963
  misc_feature 1..213: note = chr4:184719200-184719413
  misc_feature 1..213: note = Hyper
  source 1..213: mol_type = genomic DNA

SEQ ID NO: 123993 - DNA, 419 bp, Homo sapiens; identical to SEQ ID NO: 91964
  misc_feature 1..419: note = chr4:184826238-184826657
  misc_feature 1..419: note = Hyper
  source 1..419: mol_type = genomic DNA

SEQ ID NO: 123994 - DNA, 213 bp, Homo sapiens; identical to SEQ ID NO: 91965
  misc_feature 1..213: note = chr4:184827078-184827291
  misc_feature 1..213: note = Hyper
  source 1..213: mol_type = genomic DNA

SEQ ID NO: 123995 - DNA, 102 bp, Homo sapiens; identical to SEQ ID NO: 91966
  misc_feature 1..102: note = chr4:184827557-184827659
  misc_feature 1..102: note = Hyper
  source 1..102: mol_type = genomic DNA

SEQ ID NO: 123996 - DNA, 120 bp, Homo sapiens
  misc_feature 1..120: note = chr4:184827940-184828060
  misc_feature 1..120: note = Hyper
  source 1..120: mol_type = genomic DNA
accatgaagaagacccggagcacaaccttgcggcgagcctggcctagctcggatttctcggaccgggcctcggaccgcatgaggtcccgcagcgagaaggactaccgcctgcacaagcgt

SEQ ID NO: 123997 - DNA, 208 bp, Homo sapiens; identical to SEQ ID NO: 91967
  misc_feature 1..208: note = chr4:184921881-184922089
  misc_feature 1..208: note = Hypo
  source 1..208: mol_type = genomic DNA

SEQ ID NO: 123998 - DNA, 339 bp, Homo sapiens; identical to SEQ ID NO: 91968
  misc_feature 1..339: note = chr4:185089642-185089981
  misc_feature 1..339: note = Hyper
  source 1..339: mol_type = genomic DNA

SEQ ID NO: 123999 - DNA, 30 bp, Homo sapiens; identical to SEQ ID NO: 91969
  misc_feature 1..30: note = chr4:185592328-185592358
  misc_feature 1..30: note = Hypo
  source 1..30: mol_type = genomic DNA

SEQ ID NO: 124000 - DNA, 30 bp, Homo sapiens; identical to SEQ ID NO: 40375
  misc_feature 1..30: note = chr4:185833058-185833088
  misc_feature 1..30: note = Hypo
  source 1..30: mol_type = genomic DNA

SEQ ID NO: 124001 - DNA, 30 bp, Homo sapiens; identical to SEQ ID NO: 40376
  misc_feature 1..30: note = chr4:185913935-185913965
  misc_feature 1..30: note = Hypo
  source 1..30: mol_type = genomic DNA

SEQ ID NO: 124002 - DNA, 30 bp, Homo sapiens; identical to SEQ ID NO: 91972
  misc_feature 1..30: note = chr4:185931321-185931351
  misc_feature 1..30: note = Hypo
  source 1..30: mol_type = genomic DNA

SEQ ID NO: 124003 - DNA, 711 bp, Homo sapiens; identical to SEQ ID NO: 91973
  misc_feature 1..711: note = chr4:185937273-185937984
  misc_feature 1..711: note = Hyper
  source 1..711: mol_type = genomic DNA

SEQ ID NO: 124004 - DNA, 717 bp, Homo sapiens; identical to SEQ ID NO: 91974
  misc_feature 1..717: note = chr4:185938230-185938947
  misc_feature 1..717: note = Hyper
  source 1..717: mol_type = genomic DNA

SEQ ID NO: 124005 - DNA, 66 bp, Homo sapiens; identical to SEQ ID NO: 91975
  misc_feature 1..66: note = chr4:185939377-185939443
  misc_feature 1..66: note = Hyper
  source 1..66: mol_type = genomic DNA

SEQ ID NO: 124006 - DNA, 3261 bp, Homo sapiens
  misc_feature 1..3261: note = chr4:185939673-185942934
  misc_feature 1..3261: note = Hyper
  source 1..3261: mol_type = genomic DNA
ctgcaggcgcttgctcgcccgccggccccagtttaccgcctccttttcccgcccgagctgttgccatgcaaatgttattcctgggccgatcacgtgtcctttgaagggccacgtggattaacaaagctgatctgcccccagctcgcccccctcggctgctaattttttttttttcttaacttctttaaaactgatcttgaatgcatacatcctccaaacgcagctcccctaatcctatggaataattcaactcgtgaatgcatctggagccctagatgaccgctttataaggcagccctcggagttgggaggctgcagtctacctgggacactcgaggaggcacacgaggcggaaaagtggacgggtgccccgcgccaccgcctctcccgagggcgcgtactgaccaggatgtcagacaagctcaaggaacgcaaagtgagtcggctgagcccaaatggcacttgcgccctggtggtggaggcatctgactcaccgacccgccacttgggtggaccgatggcagggaagtgcccgcacgggactttgagtgtggaggaatctcgagtggtttgggaagggggtggggtagagagaggagggtgctcaaccaggtagaagtcctgcctggaggctggcggccacctccccaaaggcctgggtagggtggctggaaggggagcgcgccagcgcgggcgtcagaaggcagagctcacctggcccgagcgtggcgggccaggagtcccttcctagagcgaatctgagcagtgtgcgcggctggagaggcggcttgcacccagctgctagagccgcgcctttgacgacttcccgggcaaagccatcctaaacatacaaccctctcttcgcagagaacccccgtttctcataaagtgatagaaaagcggaggagggacaggatcaaccgctgcttgaacgagctgggcaagacagtgcccatggccttggcgaagcaggtaacgttggcgacccggagccgggtgccaggcgttgggaggcctctgcggccactctgcggagacgcccgagcccgcggacacagaggacctcacttgcgggcccctcccaggcggggggcctgagcgcagggcgaacctcaggaggctctggcgcagatccgcagccgcgtccgctcgctggtcctctccagcgccacagtgcccgaccagcaggcgctgggccgctgcgaggggcccttcctccttttgcagagttccgggaagctggagaaggcggagatcctcgagatgaccgttcagtacctgagagcactgcactccgctgattttccccggggaagggaaaaaggtgggcacaggttagggaatgggacgcctgggccaggcgcctgcgccacccagagaccctggggctgggaggggagtgactgagtgttcccgagagctctactagagctccactctccaggagggcaggggtcctgcgaaggcgcctctccctgctcggcgacagcaaggcggcgagggagaactggttcccagggaggctggttccacctccttctcccgggtggggtgggtggggtcaggctctcagggaaagagggcgtttgcgcgtgcctcgccagtctctaagactgcgcagaggagagggcgggcctcaaatgggaactttggccagaaaatgtggtgggaggtgccctgcacccgctttgggctcgcgtggggaaggggcactcagggtgtgtccgtcctacgggctttctcgttcctccagcagaacttctagcggagtttgccaactacttccactatggctaccacgagtgcatgaagaacctggtgcattacctcaccacggtggagcggatggagaccaaggacacgaagtacgcgcgcatcctcgccttcttgcagtccaaggcccgcctgggcgcggagcccgcctttccgccgctgggttcgctcccggagccggatttctcctatcagctgcaccctgcggggcccgaattcgctggtcacagcccgggcgaggccgctgtgttcccgcagggctctggtgccgggcctttcccctggccgcctggcgcggcccgcagccccgcgctgccctacctgcccagcgcgccagtgccgctcgctagcccagcgcagcagcacagccccttcctgacaccggtgcagggcctggaccggcattacctcaacctgatcggccacgcgcaccccaacgcccttaacctgcacacgccccagcaccccccggtgctctgacgcccactcgcccgccagatttctcctcgctttgggcgcttttaggagaaatgctgtatatattgtacacataatgtgtaaatattgtaccccaaaaatctgggctgggggaggcaaagagcgaatgagtcttctgaaggatctccccctggtaataaacgttttctgataaagacccaaagagagggatttatgtattaccttctgctcatccacacccgtcccctccgcggtgcccagggcgcaaggctgacagggttcaaggtaacagccctcagtaacttggtgaggggcccgctgtggagtctgagggagggggacgttaaatggaggttcaggcagatattctaggcatcgcttaagggcgggattcgcggcttcctgcacccgccccatcttgagcattagcctcagagaaacaggggaggcgaagaacactgcccttggctctcaggaaaatgcaaattgaaggacctgccccaaactgacttaggcggaccgttgccagctgcgacccgggcgcccgtcctacccggagccaagtgcccgacgcgcgcgcaccgcacgcccgcgggtctggaatgcggcgaaacccgggccagcggggcgcgtggctgagtttacagaattaaaaatcctctaaaaaataccggaaccaagtacagttctgagttgcggattagaaacaacatcgttgatgacaactgctcagcgccagaggcttccgagaagctggcgttgccttttgcgcacagagcaggccagcttcgggggcgctgggcgtctcggcgagaggtcggcacctgccgggttgggagacgccccttccccaccccttaggggattgttccctacacgccatcctttaccattcggacactggtgcaggatggagaccctggggtctccgtttaagttctcaggcttggagagaaaagtcctccttatcctttccccagtgagatttttttttttatctcgccccacccagaacgtggtgaggaaagt

SEQ ID NO: 124007 - DNA, 30 bp, Homo sapiens; identical to SEQ ID NO: 91978
  misc_feature 1..30: note = chr4:185964663-185964693
  misc_feature 1..30: note = Hypo
  source 1..30: mol_type = genomic DNA

SEQ ID NO: 124008 - DNA, 277 bp, Homo sapiens; identical to SEQ ID NO: 91979
  misc_feature 1..277: note = chr4:186048714-186048991
  misc_feature 1..277: note = Hyper
  source 1..277: mol_type = genomic DNA

SEQ ID NO: 124009 - DNA, 572 bp, Homo sapiens; identical to SEQ ID NO: 91980
  misc_feature 1..572: note = chr4:186049493-186050065
  misc_feature 1..572: note = Hyper
  source 1..572: mol_type = genomic DNA

SEQ ID NO: 124010 - DNA, 99 bp, Homo sapiens; identical to SEQ ID NO: 91981
  misc_feature 1..99: note = chr4:186347807-186347906
  misc_feature 1..99: note = Hypo
  source 1..99: mol_type = genomic DNA

SEQ ID NO: 124011 - DNA, 161 bp, Homo sapiens; identical to SEQ ID NO: 40377
  misc_feature 1..161: note = chr4:186348467-186348628
  misc_feature 1..161: note = Hypo
  source 1..161: mol_type = genomic DNA

SEQ ID NO: 124012 - DNA, 214 bp, Homo sapiens; identical to SEQ ID NO: 29342
  misc_feature 1..214: note = chr4:186456012-186456226
  misc_feature 1..214: note = Hyper
  source 1..214: mol_type = genomic DNA

SEQ ID NO: 124013 - DNA, 198 bp, Homo sapiens; identical to SEQ ID NO: 91986
  misc_feature 1..198: note = chr4:186456727-186456925
  misc_feature 1..198: note = Hyper
  source 1..198: mol_type = genomic DNA

SEQ ID NO: 124014 - DNA, 218 bp, Homo sapiens; identical to SEQ ID NO: 91987
  misc_feature 1..218: note = chr4:187026668-187026886
  misc_feature 1..218: note = Hyper
  source 1..218: mol_type = genomic DNA

SEQ ID NO: 124015 - DNA, 30 bp, Homo sapiens; identical to SEQ ID NO: 91988
  misc_feature 1..30: note = chr4:187182190-187182220
  misc_feature 1..30: note = Hypo
  source 1..30: mol_type = genomic DNA

SEQ ID NO: 124016 - DNA, 184 bp, Homo sapiens; identical to SEQ ID NO: 91989
  misc_feature 1..184: note = chr4:187459279-187459463
  misc_feature 1..184: note = Hypo
  source 1..184: mol_type = genomic DNA

SEQ ID NO: 124017 - DNA, 30 bp, Homo sapiens; identical to SEQ ID NO: 91990
  misc_feature 1..30: note = chr4:187647639-187647669
  misc_feature 1..30: note = Hyper
  source 1..30: mol_type = genomic DNA

SEQ ID NO: 124018 - DNA, 57 bp, Homo sapiens; identical to SEQ ID NO: 91991
  misc_feature 1..57: note = chr4:187648062-187648119
  misc_feature 1..57: note = Hyper
  source 1..57: mol_type = genomic DNA

SEQ ID NO: 124019 - DNA, 30 bp, Homo sapiens
  misc_feature 1..30: note = chr4:188916851-188916881
  misc_feature 1..30: note = Hyper
  source 1..30: mol_type = genomic DNA
agcctgattagaccgcgtcagtccggaggg

SEQ ID NO: 124020 - DNA, 18 bp, Homo sapiens
  misc_feature 1..18: note = chr4:189257706-189257724
  misc_feature 1..18: note = Hypo
  source 1..18: mol_type = genomic DNA
gcccggccccccaactcc

SEQ ID NO: 124021 - DNA, 160 bp, Homo sapiens; identical to SEQ ID NO: 91994
  misc_feature 1..160: note = chr4:190474936-190475096
  misc_feature 1..160: note = Hypo
  source 1..160: mol_type = genomic DNA

SEQ ID NO: 124022 - DNA, 30 bp, Homo sapiens; identical to SEQ ID NO: 91995
  misc_feature 1..30: note = chr4:190529509-190529539
  misc_feature 1..30: note = Hypo
  source 1..30: mol_type = genomic DNA

SEQ ID NO: 124023 - DNA, 30 bp, Homo sapiens; identical to SEQ ID NO: 91996
  misc_feature 1..30: note = chr4:190536670-190536700
  misc_feature 1..30: note = Hypo
  source 1..30: mol_type = genomic DNA

SEQ ID NO: 124024 - DNA, 30 bp, Homo sapiens; identical to SEQ ID NO: 91997
  misc_feature 1..30: note = chr4:190662219-190662249
  misc_feature 1..30: note = Hypo
  source 1..30: mol_type = genomic DNA

SEQ ID NO: 124025 - DNA, 30 bp, Homo sapiens; identical to SEQ ID NO: 91998
  misc_feature 1..30: note = chr4:190763878-190763908
  misc_feature 1..30: note = Hypo
  source 1..30: mol_type = genomic DNA

SEQ ID NO: 124026 - DNA, 950 bp, Homo sapiens
  misc_feature 1..950: note = chr5:53147-54097
  misc_feature 1..950: note = Hyper
  source 1..950: mol_type = genomic DNA
aggtcagaacttgttcgggaccgccgggtggagacaaggacgcgggaacaaaacgtatgtgtgtgttggggggtgttgctgcgagagcgggcaagggcggggacgccgcgctgacccggtcctggatcccacccgcgctgggctcagggccgcgggttcgggtcctgccgggcgtcccacgcaccggggacgggcacgaaaccgtccacctgcctcagacctcggctgacctctgggccgcgggagggcccgagggtcttttccgcctctgctcgctgttgtgtctccaaggtcagaatccctgcggccggggctgcgcaaaacgccccccacccccgcctcactgccgcccccgagtccccttctcaggcaggctgtgggggttggggttgggcttcgcgagcccaagcggacgccgcaaagagaatgagaacctcggagcgctcggggcgggcgggcccagcccaggctcttcctacccctgcgggggtccgagggccagcggcatcggcggcgggaggagggggcgggggcggggaattagggggaggcgggtgttaaagaggagaagggcgggggcggagggggaggaggagacggggcggggaggacccccaggtttccgagtctccgcccgggctttcgttcccggctgtgtggccccgcgcggttcccgagcagctccaggaactgaaacgtgaaggggacctcggtgcccggagctgctgcccaggtaaccgcgctgcgcccggcgagcagatggggggtagtcgccccagtcctggactccgcgagggggcgcggggagtccacgctgcggccgcgcagacgggcggggcggttcgttcctgcgagcgccggaaccggggaggaggctggggaagagaaaggggcagaggggcgggcccgggggccggggccgagggggcggagcgcgaagtttccagagg

SEQ ID NO: 124027 - DNA, 166 bp, Homo sapiens; identical to SEQ ID NO: 94088
  misc_feature 1..166: note = chr5:54332-54498
  misc_feature 1..166: note = Hyper
  source 1..166: mol_type = genomic DNA

SEQ ID NO: 124028 - DNA, 248 bp, Homo sapiens; identical to SEQ ID NO: 94413
  misc_feature 1..248: note = chr5:91876-92124
  misc_feature 1..248: note = Hyper
  source 1..248: mol_type = genomic DNA

SEQ ID NO: 124029 - DNA, 36 bp, Homo sapiens; identical to SEQ ID NO: 40379
  misc_feature 1..36: note = chr5:109867-109903
  misc_feature 1..36: note = Hypo
  source 1..36: mol_type = genomic DNA

SEQ ID NO: 124030 - DNA, 59 bp, Homo sapiens; identical to SEQ ID NO: 92991
  misc_feature 1..59: note = chr5:139686-139745
  misc_feature 1..59: note = Hypo
  source 1..59: mol_type = genomic DNA

SEQ ID NO: 124031 - DNA, 30 bp, Homo sapiens; identical to SEQ ID NO: 92993
  misc_feature 1..30: note = chr5:139993-140023
  misc_feature 1..30: note = Hypo
  source 1..30: mol_type = genomic DNA

SEQ ID NO: 124032 - DNA, 37 bp, Homo sapiens; identical to SEQ ID NO: 40381
  misc_feature 1..37: note = chr5:140350-140387
  misc_feature 1..37: note = Hypo
  source 1..37: mol_type = genomic DNA

SEQ ID NO: 124033 - DNA, 134 bp, Homo sapiens; identical to SEQ ID NO: 93704
  misc_feature 1..134: note = chr5:192173-192307
  misc_feature 1..134: note = Hypo
  source 1..134: mol_type = genomic DNA

SEQ ID NO: 124034 - DNA, 1764 bp, Homo sapiens
  misc_feature 1..1764: note = chr5:320654-322418
  misc_feature 1..1764: note = Hyper
  source 1..1764: mol_type = genomic DNA
agacttttcctgagccgacagcagacagcgagtgcaaaggccccaaggcccgcacgccttattcagagaacagcaggaggcgcggggcgggttgggggcgtcagggagacggggtttgactgagaacctgggggcgccagtgacagcctcggccgcgttgctgaaaaccgaccttgcgggatgaagagggcgcggttcccccggctgggatgaggaccgcggatgctgaggagcggactccagggaccaccgactccatggccggccccagcgagggcgagaacgggtggaagccggccagggtctgtggagacgtcagggtgcgaggccaggctgaggtgtccccagggatcccctgagggtacagggaattcagccagggcctgcgcgcccggacggaggactagagggggccaaggaccaccgggagggggaaggagaaggcgcagcccgaggtcggaggggccggcgggcgcgcagagggcgcggggtgagccctaaggacctgcaggcaggaccctgctctcggccgcgcggtcccgggtgccgaccggcggggtgggcggggcaggggcacccagggccgcacacctgccgcgtgggaccctgaaatgcccaggacgaagaacgtcgcacggacgaccctgccgtgcctggcgcgcgtccgcttcctgggaagctcaggatccaaaagcatcttaatattctctataattcgccaaaaaccatgactccttttacattttcgaaacgacctcatggggcaggcgagggggcacacgctctcctcactttacctgttcgggtctacaccgcccggctctagggccggcagctcagcacagccggccgcgagcgctggggaggggacgggggcgcagggagaaccgggggaccctgggcgcacacagaccccagggggaacgcagggcctggaggggctcagcgcgcgacccccgcctcggggcacggagactccgggggatcactgggacgcgaagggcgcagggcggaccccaggggaaccggatggcgtctccggttcgccagggcagctggggcagccggacccgagacagccggacccgcgggcgccctctgccgcctcccggccctggatgctgcggggcggggcgggcggctcgcgtgccggggtggggcagtccctggagccgccgcgggttcccgggatgcgagcgccggcacccgccgccacagctcctggccagggcgcgctgccccgcgggtgtgcctgagcctccgcgccccgcaggccctgggtaagtgtcctgggcgcccccgcaggcccccgccgcgtgccgcccgcggtggagacgggatgcgctcccgggtgtggggctgagggacgggcgccggcgtcgggaccctcctcacgccgcatcctcgcgtcgccaggcccggcggccccgggacggggcggacactctggggtgcggctggctggtctcacttaaaactcggacctcggagggaagccgcggcgcgtccacggttcgtggtcctcagcgtcccctcgagagtgttctgagccttcactccccgggcgttccgtgcgggccgcgctccctggggctgggcgggtgcgggcggcggagcggggccccgctgtcgggccgagggcgccaggtccggggggcctcacccccgggaaaggcccatgttcaggcttggtttcagtagcacccagtagcgctgaagtcttattttgagcggccagaattcccagaccggatgccctgagag

SEQ ID NO: 124035 - DNA, 262 bp, Homo sapiens; identical to SEQ ID NO: 93857
  misc_feature 1..262: note = chr5:344035-344297
  misc_feature 1..262: note = Hyper
  source 1..262: mol_type = genomic DNA

SEQ ID NO: 124036 - DNA, 33 bp, Homo sapiens; identical to SEQ ID NO: 93869
  misc_feature 1..33: note = chr5:353889-353922
  misc_feature 1..33: note = Hypo
  source 1..33: mol_type = genomic DNA

SEQ ID NO: 124037 - DNA, 30 bp, Homo sapiens; identical to SEQ ID NO: 93882
  misc_feature 1..30: note = chr5:359746-359776
  misc_feature 1..30: note = Hypo
  source 1..30: mol_type = genomic DNA

SEQ ID NO: 124038 - DNA, 276 bp, Homo sapiens; identical to SEQ ID NO: 93910
  misc_feature 1..276: note = chr5:374077-374353
  misc_feature 1..276: note = Hyper
  source 1..276: mol_type = genomic DNA

SEQ ID NO: 124039 - DNA, 30 bp, Homo sapiens; identical to SEQ ID NO: 93934
  misc_feature 1..30: note = chr5:386774-386804
  misc_feature 1..30: note = Hypo
  source 1..30: mol_type = genomic DNA

SEQ ID NO: 124040 - DNA, 130 bp, Homo sapiens; identical to SEQ ID NO: 93940
  misc_feature 1..130: note = chr5:398801-398931
  misc_feature 1..130: note = Hypo
  source 1..130: mol_type = genomic DNA

SEQ ID NO: 124041 - DNA, 32 bp, Homo sapiens; identical to SEQ ID NO: 93941
  misc_feature 1..32: note = chr5:400157-400189
  misc_feature 1..32: note = Hyper
  source 1..32: mol_type = genomic DNA

SEQ ID NO: 124042 - DNA, 30 bp, Homo sapiens; identical to SEQ ID NO: 93951
  misc_feature 1..30: note = chr5:411982-412012
  misc_feature 1..30: note = Hypo
  source 1..30: mol_type = genomic DNA

SEQ ID NO: 124043 - DNA, 30 bp, Homo sapiens; identical to SEQ ID NO: 93959
  misc_feature 1..30: note = chr5:423138-423168
  misc_feature 1..30: note = Hypo
  source 1..30: mol_type = genomic DNA

SEQ ID NO: 124044 - DNA, 30 bp, Homo sapiens; identical to SEQ ID NO: 93963
  misc_feature 1..30: note = chr5:427604-427634
  misc_feature 1..30: note = Hypo
  source 1..30: mol_type = genomic DNA

SEQ ID NO: 124045 - DNA, 33 bp, Homo sapiens; identical to SEQ ID NO: 93966
  misc_feature 1..33: note = chr5:427958-427991
  misc_feature 1..33: note = Hypo
  source 1..33: mol_type = genomic DNA

SEQ ID NO: 124046 - DNA, 126 bp, Homo sapiens; identical to SEQ ID NO: 93972
  misc_feature 1..126: note = chr5:429675-429801
  misc_feature 1..126: note = Hypo
  source 1..126: mol_type = genomic DNA

SEQ ID NO: 124047 - DNA, 331 bp, Homo sapiens; identical to SEQ ID NO: 93980
  misc_feature 1..331: note = chr5:430042-430373
  misc_feature 1..331: note = Hypo
  source 1..331: mol_type = genomic DNA

SEQ ID NO: 124048 - DNA, 96 bp, Homo sapiens; identical to SEQ ID NO: 93999
  misc_feature 1..96: note = chr5:435478-435574
  misc_feature 1..96: note = Hypo
  source 1..96: mol_type = genomic DNA

SEQ ID NO: 124049 - DNA, 30 bp, Homo sapiens; identical to SEQ ID NO: 94019
  misc_feature 1..30: note = chr5:465822-465852
  misc_feature 1..30: note = Hypo
  source 1..30: mol_type = genomic DNA

SEQ ID NO: 124050 - DNA, 30 bp, Homo sapiens; identical to SEQ ID NO: 94020
  misc_feature 1..30: note = chr5:475028-475058
  misc_feature 1..30: note = Hyper
  source 1..30: mol_type = genomic DNA

SEQ ID NO: 124051 - DNA, 54 bp, Homo sapiens; identical to SEQ ID NO: 94021
  misc_feature 1..54: note = chr5:478158-478212
  misc_feature 1..54: note = Hypo
  source 1..54: mol_type = genomic DNA

SEQ ID NO: 124052 - DNA, 298 bp, Homo sapiens; identical to SEQ ID NO: 94022
  misc_feature 1..298: note = chr5:479376-479674
  misc_feature 1..298: note = Hypo
  source 1..298: mol_type = genomic DNA

SEQ ID NO: 124053 - DNA, 39 bp, Homo sapiens; identical to SEQ ID NO: 94023
  misc_feature 1..39: note = chr5:480581-480620
  misc_feature 1..39: note = Hypo
  source 1..39: mol_type = genomic DNA

SEQ ID NO: 124054 - DNA, 164 bp, Homo sapiens; identical to SEQ ID NO: 14710
  misc_feature 1..164: note = chr5:480880-481044
  misc_feature 1..164: note = Hypo
  source 1..164: mol_type = genomic DNA

SEQ ID NO: 124055 - DNA, 38 bp, Homo sapiens; identical to SEQ ID NO: 94025
  misc_feature 1..38: note = chr5:484540-484578
  misc_feature 1..38: note = Hypo
  source 1..38: mol_type = genomic DNA

SEQ ID NO: 124056 - DNA, 46 bp, Homo sapiens; identical to SEQ ID NO: 94028
  misc_feature 1..46: note = chr5:487718-487764
  misc_feature 1..46: note = Hypo
  source 1..46: mol_type = genomic DNA

SEQ ID NO: 124057 - DNA, 58 bp, Homo sapiens; identical to SEQ ID NO: 94030
  misc_feature 1..58: note = chr5:488495-488553
  misc_feature 1..58: note = Hypo
  source 1..58: mol_type = genomic DNA

SEQ ID NO: 124058 - DNA, 146 bp, Homo sapiens; identical to SEQ ID NO: 40391
  misc_feature 1..146: note = chr5:488846-488992
  misc_feature 1..146: note = Hypo
  source 1..146: mol_type = genomic DNA

SEQ ID NO: 124059 - DNA, 64 bp, Homo sapiens; identical to SEQ ID NO: 94032
  misc_feature 1..64: note = chr5:490702-490766
  misc_feature 1..64: note = Hypo
  source 1..64: mol_type = genomic DNA

SEQ ID NO: 124060 - DNA, 948 bp, Homo sapiens; identical to SEQ ID NO: 94033
  misc_feature 1..948: note = chr5:491223-492171
  misc_feature 1..948: note = Hypo
  source 1..948: mol_type = genomic DNA

SEQ ID NO: 124061 - DNA, 30 bp, Homo sapiens; identical to SEQ ID NO: 94036
  misc_feature 1..30: note = chr5:500270-500300
  misc_feature 1..30: note = Hypo
  source 1..30: mol_type = genomic DNA

SEQ ID NO: 124062 - DNA, 30 bp, Homo sapiens; identical to SEQ ID NO: 94037
  misc_feature 1..30: note = chr5:500505-500535
  misc_feature 1..30: note = Hypo
  source 1..30: mol_type = genomic DNA

SEQ ID NO: 124063 - DNA, 146 bp, Homo sapiens; identical to SEQ ID NO: 94048
  misc_feature 1..146: note = chr5:506753-506899
  misc_feature 1..146: note = Hypo
  source 1..146: mol_type = genomic DNA

SEQ ID NO: 124064 - DNA, 197 bp, Homo sapiens; identical to SEQ ID NO: 40393
  misc_feature 1..197: note = chr5:516758-516955
  misc_feature 1..197: note = Hypo
  source 1..197: mol_type = genomic DNA

SEQ ID NO: 124065 - DNA, 30 bp, Homo sapiens; identical to SEQ ID NO: 40394
  misc_feature 1..30: note = chr5:519988-520018
  misc_feature 1..30: note = Hypo
  source 1..30: mol_type = genomic DNA

SEQ ID NO: 124066 - DNA, 1102 bp, Homo sapiens
  misc_feature 1..1102: note = chr5:523778-524880
  misc_feature 1..1102: note = Hyper
  source 1..1102: mol_type = genomic DNA
ctgctgggtttcatgcgggtagcaccgcttttcttttctgcccttgtaactcacgaaaaaacgccatcactccaaggacgtttctctaaaaagcctgagaaccccgaaggaaacccggccccggggactccctgggcgcgagcagcctgcagtctgcggggctcggagcggaggcggggcggagaccccacagggacccgggagccgggagtccggggctccgaggctgtgcccccgccggggaggggagacctcgggacccgcaggggcggcttagcgcggccagagtcgctcccgagtctcgctctgctggacccgagagccggactctcccgggcggccgccgcgcggctccgacctgatgcgcgcggccacaacgaagcccccaggcccagcagaggcggccgcacaccccgcgggcagatccggagaccccggggccacttaccgatcttggccaagctggccacgaggatccagagcgcgatgacgtagggatcctgcacgtgggcccactcgaaggtgaccacctggaagcccccgctctcgccgtgcgcgccgccgggctccacctcgacgcccccggcccgcgccagcccgcccagcgccagcgccagcagcagcccccggtcggggccccgggccccgagtccccacattgccgcctgctcagcgcagggctgggacgcgcatgtcgcggggggtcccggctgggctgggccgacgcgcggggctgggacccggcgaggacccggcgcgctccggtgccggtaccggctacagtccgatccccgcccgccggggtggcctttaatcccgcggccccctcccgccccggggcggagcctgcccgcccccgccgcgcactcgcgagcgcagacaccgccgcagctcccggcacgcccgccccgcccgcgcacgcccaccccgcgctccctggtgcccaccctcccccggagcccgcggcctggaggtccgggaggtcgcggcaagagcgagcccgggactgcgcggccgccttcctggggcgtggggagcacagcgcggggcagcgggacaggcggttccgcgcagctcctgggatgcccgggcagctgtgggt

SEQ ID NO: 124067 - DNA, 284 bp, Homo sapiens
  misc_feature 1..284: note = chr5:528599-528883
  misc_feature 1..284: note = Hyper
  source 1..284: mol_type = genomic DNA
ccatgggcctctctccgcatccgcatgtgcatccgcaaccgcttccgtcccgctgagcgcacgaaccctctcgctcctgtccctcccgccccgcccgccccgcccgccccggacgcctctgctgcggtgtcttagcggtccgcggacaggcgacctcccccgtggacgcccctctcccggccgccgccccgccccgcgccccgctcccccgcgcccctgggccgagacctccggtcgcctcgccccgtctccggccacgaaaggcgctgcggacctggcggtca

SEQ ID NO: 124068 - DNA, 88 bp, Homo sapiens; identical to SEQ ID NO: 94081
  misc_feature 1..88: note = chr5:537288-537376
  misc_feature 1..88: note = Hypo
  source 1..88: mol_type = genomic DNA

SEQ ID NO: 124069 - DNA, 193 bp, Homo sapiens; identical to SEQ ID NO: 94082
  misc_feature 1..193: note = chr5:537854-538047
  misc_feature 1..193: note = Hypo
  source 1..193: mol_type = genomic DNA

SEQ ID NO: 124070 - DNA, 370 bp, Homo sapiens; identical to SEQ ID NO: 94083
  misc_feature 1..370: note = chr5:538581-538951
  misc_feature 1..370: note = Hypo
  source 1..370: mol_type = genomic DNA

SEQ ID NO: 124071 - DNA, 272 bp, Homo sapiens; identical to SEQ ID NO: 94098
  misc_feature 1..272: note = chr5:554299-554571
  misc_feature 1..272: note = Hypo
  source 1..272: mol_type = genomic DNA

SEQ ID NO: 124072 - DNA, 120 bp, Homo sapiens; identical to SEQ ID NO: 94099
  misc_feature 1..120: note = chr5:554631-554751
  misc_feature 1..120: note = Hypo
  source 1..120: mol_type = genomic DNA

SEQ ID NO: 124073 - DNA, 120 bp, Homo sapiens; identical to SEQ ID NO: 94100
  misc_feature 1..120: note = chr5:554811-554931
  misc_feature 1..120: note = Hypo
  source 1..120: mol_type = genomic DNA

SEQ ID NO: 124074 - DNA, 151 bp, Homo sapiens; identical to SEQ ID NO: 94101
  misc_feature 1..151: note = chr5:555171-555322
  misc_feature 1..151: note = Hypo
  source 1..151: mol_type = genomic DNA

SEQ ID NO: 124075 - DNA, 789 bp, Homo sapiens; identical to SEQ ID NO: 94102
  misc_feature 1..789: note = chr5:555668-556457
  misc_feature 1..789: note = Hypo
  source 1..789: mol_type = genomic DNA

SEQ ID NO: 124076 - DNA, 30 bp, Homo sapiens; identical to SEQ ID NO: 94107
  misc_feature 1..30: note = chr5:559409-559439
  misc_feature 1..30: note = Hypo
  source 1..30: mol_type = genomic DNA

SEQ ID NO: 124077 - DNA, 71 bp, Homo sapiens; identical to SEQ ID NO: 94114
  misc_feature 1..71: note = chr5:583170-583241
  misc_feature 1..71: note = Hypo
  source 1..71: mol_type = genomic DNA

SEQ ID NO: 124078 - DNA, 30 bp, Homo sapiens; identical to SEQ ID NO: 40403
  misc_feature 1..30: note = chr5:595300-595330
  misc_feature 1..30: note = Hypo
  source 1..30: mol_type = genomic DNA

SEQ ID NO: 124079 - DNA, 85 bp, Homo sapiens; identical to SEQ ID NO: 94129
  misc_feature 1..85: note = chr5:601137-601222
  misc_feature 1..85: note = Hypo
  source 1..85: mol_type = genomic DNA

SEQ ID NO: 124080 - DNA, 58 bp, Homo sapiens; identical to SEQ ID NO: 94132
  misc_feature 1..58: note = chr5:602421-602479
  misc_feature 1..58: note = Hypo
  source 1..58: mol_type = genomic DNA

SEQ ID NO: 124081 - DNA, 30 bp, Homo sapiens; identical to SEQ ID NO: 94149
  misc_feature 1..30: note = chr5:643539-643569
  misc_feature 1..30: note = Hypo
  source 1..30: mol_type = genomic DNA

SEQ ID NO: 124082 - DNA, 112 bp, Homo sapiens; identical to SEQ ID NO: 94167
  misc_feature 1..112: note = chr5:675631-675743
  misc_feature 1..112: note = Hypo
  source 1..112: mol_type = genomic DNA

SEQ ID NO: 124083 - DNA, 158 bp, Homo sapiens; identical to SEQ ID NO: 94171
  misc_feature 1..158: note = chr5:676768-676926
  misc_feature 1..158: note = Hypo
  source 1..158: mol_type = genomic DNA

SEQ ID NO: 124084 - DNA, 464 bp, Homo sapiens; identical to SEQ ID NO: 94172
  misc_feature 1..464: note = chr5:677630-678094
  misc_feature 1..464: note = Hypo
  source 1..464: mol_type = genomic DNA

SEQ ID NO: 124085 - DNA, 54 bp, Homo sapiens; identical to SEQ ID NO: 40407
  misc_feature 1..54: note = chr5:684241-684295
  misc_feature 1..54: note = Hypo
  source 1..54: mol_type = genomic DNA

SEQ ID NO: 124086 - DNA, 136 bp, Homo sapiens; identical to SEQ ID NO: 94180
  misc_feature 1..136: note = chr5:697176-697312
  misc_feature 1..136: note = Hypo
  source 1..136: mol_type = genomic DNA

SEQ ID NO: 124087 - DNA, 206 bp, Homo sapiens; identical to SEQ ID NO: 94363
  misc_feature 1..206: note = chr5:851688-851894
  misc_feature 1..206: note = Hypo
  source 1..206: mol_type = genomic DNA

SEQ ID NO: 124088 - DNA, 622 bp, Homo sapiens; identical to SEQ ID NO: 94409
  misc_feature 1..622: note = chr5:891065-891687
  misc_feature 1..622: note = Hypo
  source 1..622: mol_type = genomic DNA

SEQ ID NO: 124089 - DNA, 353 bp, Homo sapiens
  misc_feature 1..353: note = chr5:926707-927060
  misc_feature 1..353: note = Hyper
  source 1..353: mol_type = genomic DNA
cgcttcttccccgcccgcccctcctgggcccctcgcgtcccccttccctgtcacccgagcttcgtttgtgactgaaactctgctgcgtctgtcatcttggtgtcctctatgaaaaccttcccagagctcttcacactccacacgtggcttttatttagtgttttctacctactcggcagcgtttcctggggagggaaggcacccagagcctccggagccacgcggcgctgtgttcccgcgccctcggcttccctgttgctcagggttatttcttcctgccatcagctggagaagcgctctccgaatatttccccgggaacgcggacttgccggccctgcgaggcacccggcgg

SEQ ID NO: 124090 - DNA, 173 bp, Homo sapiens; identical to SEQ ID NO: 94426
  misc_feature 1..173: note = chr5:931145-931318
  misc_feature 1..173: note = Hypo
  source 1..173: mol_type = genomic DNA

SEQ ID NO: 124091 - DNA, 95 bp, Homo sapiens; identical to SEQ ID NO: 40410
  misc_feature 1..95: note = chr5:1003105-1003200
  misc_feature 1..95: note = Hypo
  source 1..95: mol_type = genomic DNA

SEQ ID NO: 124092 - DNA, 30 bp, Homo sapiens; identical to SEQ ID NO: 92698
  misc_feature 1..30: note = chr5:1007449-1007479
  misc_feature 1..30: note = Hypo
  source 1..30: mol_type = genomic DNA

SEQ ID NO: 124093 - DNA, 43 bp, Homo sapiens; identical to SEQ ID NO: 92699
  misc_feature 1..43: note = chr5:1008040-1008083
  misc_feature 1..43: note = Hypo
  source 1..43: mol_type = genomic DNA

SEQ ID NO: 124094 - DNA, 367 bp, Homo sapiens; identical to SEQ ID NO: 92700
  misc_feature 1..367: note = chr5:1009258-1009625
  misc_feature 1..367: note = Hyper
  source 1..367: mol_type = genomic DNA

SEQ ID NO: 124095 - DNA, 177 bp, Homo sapiens; identical to SEQ ID NO: 92705
  misc_feature 1..177: note = chr5:1021313-1021490
  misc_feature 1..177: note = Hypo
  source 1..177: mol_type = genomic DNA

SEQ ID NO: 124096 - DNA, 30 bp, Homo sapiens; identical to SEQ ID NO: 92712
  misc_feature 1..30: note = chr5:1028378-1028408
  misc_feature 1..30: note = Hypo
  source 1..30: mol_type = genomic DNA

SEQ ID NO: 124097 - DNA, 62 bp, Homo sapiens; identical to SEQ ID NO: 92715
  misc_feature 1..62: note = chr5:1033612-1033674
  misc_feature 1..62: note = Hypo
  source 1..62: mol_type = genomic DNA

SEQ ID NO: 124098 - DNA, 431 bp, Homo sapiens; identical to SEQ ID NO: 92716
  misc_feature 1..431: note = chr5:1034304-1034735
  misc_feature 1..431: note = Hypo
  source 1..431: mol_type = genomic DNA

SEQ ID NO: 124099 - DNA, 30 bp, Homo sapiens; identical to SEQ ID NO: 92717
  misc_feature 1..30: note = chr5:1037486-1037516
  misc_feature 1..30: note = Hypo
  source 1..30: mol_type = genomic DNA

SEQ ID NO: 124100 - DNA, 40 bp, Homo sapiens; identical to SEQ ID NO: 92718
  misc_feature 1..40: note = chr5:1037995-1038035
  misc_feature 1..40: note = Hypo
  source 1..40: mol_type = genomic DNA

SEQ ID NO: 124101 - DNA, 126 bp, Homo sapiens; identical to SEQ ID NO: 92719
  misc_feature 1..126: note = chr5:1039154-1039280
  misc_feature 1..126: note = Hypo
  source 1..126: mol_type = genomic DNA

SEQ ID NO: 124102 - DNA, 70 bp, Homo sapiens; identical to SEQ ID NO: 92720
  misc_feature 1..70: note = chr5:1039613-1039683
  misc_feature 1..70: note = Hypo
  source 1..70: mol_type = genomic DNA

SEQ ID NO: 124103 - DNA, 909 bp, Homo sapiens; identical to SEQ ID NO: 92736
  misc_feature 1..909: note = chr5:1073480-1074389
  misc_feature 1..909: note = Hypo
  source 1..909: mol_type = genomic DNA

SEQ ID NO: 124104 - DNA, 30 bp, Homo sapiens; identical to SEQ ID NO: 92740
  misc_feature 1..30: note = chr5:1094019-1094049
  misc_feature 1..30: note = Hypo
  source 1..30: mol_type = genomic DNA

SEQ ID NO: 124105 - DNA, 91 bp, Homo sapiens; identical to SEQ ID NO: 92746
  misc_feature 1..91: note = chr5:1104793-1104884
  misc_feature 1..91: note = Hyper
  source 1..91: mol_type = genomic DNA

SEQ ID NO: 124106 - DNA, 37 bp, Homo sapiens; identical to SEQ ID NO: 92757
  misc_feature 1..37: note = chr5:1118984-1119021
  misc_feature 1..37: note = Hypo
  source 1..37: mol_type = genomic DNA

SEQ ID NO: 124107 - DNA, 36 bp, Homo sapiens; identical to SEQ ID NO: 92761
  misc_feature 1..36: note = chr5:1122889-1122925
  misc_feature 1..36: note = Hypo
  source 1..36: mol_type = genomic DNA

SEQ ID NO: 124108 - DNA, 164 bp, Homo sapiens; identical to SEQ ID NO: 92767
  misc_feature 1..164: note = chr5:1131227-1131391
  misc_feature 1..164: note = Hypo
  source 1..164: mol_type = genomic DNA

SEQ ID NO: 124109 - DNA, 30 bp, Homo sapiens; identical to SEQ ID NO: 92786
  misc_feature 1..30: note = chr5:1151152-1151182
  misc_feature 1..30: note = Hypo
  source 1..30: mol_type = genomic DNA

SEQ ID NO: 124110 - DNA, 884 bp, Homo sapiens; identical to SEQ ID NO: 92795
  misc_feature 1..884: note = chr5:1155674-1156558
  misc_feature 1..884: note = Hyper
  source 1..884: mol_type = genomic DNA

SEQ ID NO: 124111 - DNA, 30 bp, Homo sapiens; identical to SEQ ID NO: 92804
  misc_feature 1..30: note = chr5:1169521-1169551
  misc_feature 1..30: note = Hypo
  source 1..30: mol_type = genomic DNA

SEQ ID NO: 124112 - DNA, 125 bp, Homo sapiens; identical to SEQ ID NO: 5026
  misc_feature 1..125: note = chr5:1174263-1174388
  misc_feature 1..125: note = Hypo
  source 1..125: mol_type = genomic DNA

SEQ ID NO: 124113 - DNA, 149 bp, Homo sapiens; identical to SEQ ID NO: 92807
  misc_feature 1..149: note = chr5:1189557-1189706
  misc_feature 1..149: note = Hypo
  source 1..149: mol_type = genomic DNA

SEQ ID NO: 124114 - DNA, 30 bp, Homo sapiens; identical to SEQ ID NO: 40418
  misc_feature 1..30: note = chr5:1193360-1193390
  misc_feature 1..30: note = Hypo
  source 1..30: mol_type = genomic DNA

SEQ ID NO: 124115 - DNA, 249 bp, Homo sapiens; identical to SEQ ID NO: 92814
  misc_feature 1..249: note = chr5:1193747-1193996
  misc_feature 1..249: note = Hypo
  source 1..249: mol_type = genomic DNA

SEQ ID NO: 124116 - DNA, 67 bp, Homo sapiens; identical to SEQ ID NO: 92815
  misc_feature 1..67: note = chr5:1196184-1196251
  misc_feature 1..67: note = Hypo
  source 1..67: mol_type = genomic DNA

SEQ ID NO: 124117 - DNA, 30 bp, Homo sapiens; identical to SEQ ID NO: 92819
  misc_feature 1..30: note = chr5:1210123-1210153
  misc_feature 1..30: note = Hypo
  source 1..30: mol_type = genomic DNA

SEQ ID NO: 124118 - DNA, 30 bp, Homo sapiens; identical to SEQ ID NO: 92820
  misc_feature 1..30: note = chr5:1210355-1210385
  misc_feature 1..30: note = Hypo
  source 1..30: mol_type = genomic DNA

SEQ ID NO: 124119 - DNA, 162 bp, Homo sapiens; identical to SEQ ID NO: 92821
  misc_feature 1..162: note = chr5:1213550-1213712
  misc_feature 1..162: note = Hypo
  source 1..162: mol_type = genomic DNA

SEQ ID NO: 124120 - DNA, 30 bp, Homo sapiens; identical to SEQ ID NO: 92826
  misc_feature 1..30: note = chr5:1218808-1218838
  misc_feature 1..30: note = Hypo
  source 1..30: mol_type = genomic DNA

SEQ ID NO: 124121 - DNA, 223 bp, Homo sapiens; identical to SEQ ID NO: 92827
  misc_feature 1..223: note = chr5:1221121-1221344
  misc_feature 1..223: note = Hypo
  source 1..223: mol_type = genomic DNA

SEQ ID NO: 124122 - DNA, 37 bp, Homo sapiens; identical to SEQ ID NO: 40421
  misc_feature 1..37: note = chr5:1223271-1223308
  misc_feature 1..37: note = Hypo
  source 1..37: mol_type = genomic DNA

SEQ ID NO: 124123 - DNA, 82 bp, Homo sapiens; identical to SEQ ID NO: 92846
  misc_feature 1..82: note = chr5:1228694-1228776
  misc_feature 1..82: note = Hypo
  source 1..82: mol_type = genomic DNA

SEQ ID NO: 124124 - DNA, 472 bp, Homo sapiens; identical to SEQ ID NO: 92847
  misc_feature 1..472: note = chr5:1232819-1233291
  misc_feature 1..472: note = Hypo
  source 1..472: mol_type = genomic DNA

SEQ ID NO: 124125 - DNA, 30 bp, Homo sapiens; identical to SEQ ID NO: 92854
  misc_feature 1..30: note = chr5:1245053-1245083
  misc_feature 1..30: note = Hypo
  source 1..30: mol_type = genomic DNA

SEQ ID NO: 124126 - DNA, 30 bp, Homo sapiens; identical to SEQ ID NO: 92855
  misc_feature 1..30: note = chr5:1254554-1254584
  misc_feature 1..30: note = Hypo
  source 1..30: mol_type = genomic DNA

SEQ ID NO: 124127 - DNA, 30 bp, Homo sapiens; identical to SEQ ID NO: 92865
  misc_feature 1..30: note = chr5:1264364-1264394
  misc_feature 1..30: note = Hypo
  source 1..30: mol_type = genomic DNA

SEQ ID NO: 124128 - DNA, 30 bp, Homo sapiens; identical to SEQ ID NO: 92868
  misc_feature 1..30: note = chr5:1272253-1272283
  misc_feature 1..30: note = Hypo
  source 1..30: mol_type = genomic DNA

SEQ ID NO: 124129 - DNA, 31 bp, Homo sapiens; identical to SEQ ID NO: 92880
  misc_feature 1..31: note = chr5:1291862-1291893
  misc_feature 1..31: note = Hypo
  source 1..31: mol_type = genomic DNA

SEQ ID NO: 124130 - DNA, 144 bp, Homo sapiens; identical to SEQ ID NO: 92885
  misc_feature 1..144: note = chr5:1294182-1294326
  misc_feature 1..144: note = Hypo
  source 1..144: mol_type = genomic DNA

SEQ ID NO: 124131 - DNA, 671 bp, Homo sapiens
  misc_feature 1..671: note = chr5:1294543-1295214
  misc_feature 1..671: note = Hyper
  source 1..671: mol_type = genomic DNA
gcaggtgaaccagcacgtcgtcgcccacgcggcgcagcagcagcccccacgccccgctcccccgcagtgcgtcggtcaccgtgttgggcaggtagctgcgcacgctggtggtgaaggcctcgggggggcccccgcgggccccgtccagcagcgcgaagccgaaggccagcacgttcttcgcgccgcgctcgcacagcctctgcagcactcgggccaccagctccttcaggcaggacacctgcgggggaagcgccctgagtcgcctgcgctgctctccgcatgtcgctggttccccccggccgccctcaaccccagccggacgccgaccccggggaggcccacctggcggaaggagggggcggcggggggcggccgtgcgtcccagggcacgcacaccaggcactgggccaccagcgcgcggaaagccgccgggtccccgcgctgcaccagccgccagccctggggccccaggcgccgcacgaacgtggccagcggcagcacctcgcggtagtggctgcgcagcagggagcgcacggctcggcagcggggagcgcgcggcatcgcgggggtggccggggccagggcttcccacgtgcgcagcaggacgcagcgctgcctgaaactcgcgccgcgaggagagggcggggccgcggaaaggaaggggaggggct

SEQ ID NO: 124132 - DNA, 454 bp, Homo sapiens
  misc_feature 1..454: note = chr5:1295265-1295719
  misc_feature 1..454: note = Hyper
  source 1..454: mol_type = genomic DNA
gcggggtccgcgcggaggaggcggagctggaaggtgaaggggcaggacgggtgcccgggtccccagtccctccgccacgtgggaagcgcggtcctgggcgtctgtgcccgcgaatccactgggagcccggcctggccccgacagcgcagctgctccgggcggacccgggggtctgggccgcgcttccccgcccgcgcgccgctcgcgctcccagggtgcagggacgccagcgagggccccagcggagagaggtcgaatcggcctaggctgtggggtaacccgagggaggggccatgatgtggaggccctgggaacaggtgcgtgcggcgaccctttggccgctggcctgatccggagacccagggctgcctccaggtccggacgcggggcgtcgggctccgggcaccacgaatgccggacgtgaaggggaggacggaggcgcgtagacgcggct

SEQ ID NO: 124133 - DNA, 166 bp, Homo sapiens; identical to SEQ ID NO: 92929
  misc_feature 1..166: note = chr5:1346140-1346306
  misc_feature 1..166: note = Hypo
  source 1..166: mol_type = genomic DNA

SEQ ID NO: 124134 - DNA, 50 bp, Homo sapiens; identical to SEQ ID NO: 40424
  misc_feature 1..50: note = chr5:1346659-1346709
  misc_feature 1..50: note = Hypo
  source 1..50: mol_type = genomic DNA

SEQ ID NO: 124135 - DNA, 28 bp, Homo sapiens
  misc_feature 1..28: note = chr5:1356625-1356653
  misc_feature 1..28: note = Hypo
  source 1..28: mol_type = genomic DNA
cggctcacgtggccacggagcagcaccg

SEQ ID NO: 124136 - DNA, 182 bp, Homo sapiens; identical to SEQ ID NO: 92953
  misc_feature 1..182: note = chr5:1357154-1357336
  misc_feature 1..182: note = Hypo
  source 1..182: mol_type = genomic DNA

SEQ ID NO: 124137 - DNA, 186 bp, Homo sapiens; identical to SEQ ID NO: 92954
  misc_feature 1..186: note = chr5:1362617-1362803
  misc_feature 1..186: note = Hypo
  source 1..186: mol_type = genomic DNA

SEQ ID NO: 124138 - DNA, 30 bp, Homo sapiens; identical to SEQ ID NO: 92966
  misc_feature 1..30: note = chr5:1379058-1379088
  misc_feature 1..30: note = Hypo
  source 1..30: mol_type = genomic DNA

SEQ ID NO: 124139 - DNA, 38 bp, Homo sapiens; identical to SEQ ID NO: 92968
  misc_feature 1..38: note = chr5:1381049-1381087
  misc_feature 1..38: note = Hypo
  source 1..38: mol_type = genomic DNA

SEQ ID NO: 124140 - DNA, 97 bp, Homo sapiens; identical to SEQ ID NO: 92969
  misc_feature 1..97: note = chr5:1381147-1381244
  misc_feature 1..97: note = Hypo
  source 1..97: mol_type = genomic DNA

SEQ ID NO: 124141 - DNA, 75 bp, Homo sapiens; identical to SEQ ID NO: 92971
  misc_feature 1..75: note = chr5:1384936-1385011
  misc_feature 1..75: note = Hypo
  source 1..75: mol_type = genomic DNA

SEQ ID NO: 124142 - DNA, 170 bp, Homo sapiens; identical to SEQ ID NO: 93022
  misc_feature 1..170: note = chr5:1406427-1406597
  misc_feature 1..170: note = Hypo
  source 1..170: mol_type = genomic DNA

SEQ ID NO: 124143 - DNA, 68 bp, Homo sapiens; identical to SEQ ID NO: 93051
  misc_feature 1..68: note = chr5:1422073-1422141
  misc_feature 1..68: note = Hypo
  source 1..68: mol_type = genomic DNA

SEQ ID NO: 124144 - DNA, 30 bp, Homo sapiens; identical to SEQ ID NO: 93058
  misc_feature 1..30: note = chr5:1429032-1429062
  misc_feature 1..30: note = Hypo
  source 1..30: mol_type = genomic DNA

SEQ ID NO: 124145 - DNA, 30 bp, Homo sapiens; identical to SEQ ID NO: 93059
  misc_feature 1..30: note = chr5:1429795-1429825
  misc_feature 1..30: note = Hypo
  source 1..30: mol_type = genomic DNA

SEQ ID NO: 124146 - DNA, 213 bp, Homo sapiens; identical to SEQ ID NO: 93060
  misc_feature 1..213: note = chr5:1431070-1431283
  misc_feature 1..213: note = Hypo
  source 1..213: mol_type = genomic DNA

SEQ ID NO: 124147 - DNA, 607 bp, Homo sapiens
  misc_feature 1..607: note = chr5:1444675-1445282
  misc_feature 1..607: note = Hyper
  source 1..607: mol_type = genomic DNA
tcacgagctatgccacgcacccggtgacaacctcaaccggcacgacccctccggtgggtaaaacacccgacgaaggggttccgcggcgcgagcaggaggccgcgttgggagagggcgtcgggtgcggagctcgcgagtctccggcaagccgccgccgccctggggccacctgaccccgctcctgaacgcggggcctcagaggcgagttttgggtctacacagcaaaatgtggcccgttagaaagcgtccttcctcaccgcgcccagaacaagaagcggcgctgcctggcgagtcctcgcccggcctccccgccctgcccagagcaccagcgcgcagcccgcgcccgccaccacccccaacacagacaaagcccccgcgagatggagcggcggtgtacaaaacccactccgatcggatctgggatgcgccgcacccctagtagggttaagttccacgagaagaaaccaggacccccgagtcacagccatagacacccacgcgtcccctaagccggtgactgcaccaggtgcccacccggttctgagcctggagcggggccaggggcagccctgcaccctcctcgcgcctcggacggcctcagggtccc

SEQ ID NO: 124148 - DNA, 1114 bp, Homo sapiens
  misc_feature 1..1114: note = chr5:1445485-1446599
  misc_feature 1..1114: note = Hyper
  source 1..1114: mol_type = genomic DNA
gcacgcgagtcctggcgccgagagcgttccgcgaagcctcccctcccgctccgcagcgctgggcggtctcagcctcggcctcgggctcttatccagtagacagggtccgccccgccccgccctcccgccgacggggtcgccctcgcgtcctggctcctcctcctcacctccccgggccgcgcccccgcccccgcctcccggacgcagatggctgggagcaagcggcggccacggctccactgtcctgcgcgtcccggagcctcggacacggggtgcgggggcctgggggtccgagacgtcgcggatctagacgggcgccttccacgcgggaactgtctgggccgccctgcgccctcgcccgcacccctgggggctgccccgggcacccgctatcttcggacgcccagggctggcggctcccagctggacggggagggagccgagcggctgcgcgcggggaactgctgggaccccgtcgggccgacccttccctccctccccatcaggggcccctacggtggccccgcgctctggggaccacgtccctcccaccccgccgctccacgctctgaccagcgggctcgggaccccgccgaggactctgcacgcttcccggcgtgcgggctgcggagacgcgggtccttccgtggccttggggtctccgcgacctcgaggcgaccgaggtcccctaggcctagtccccgccttgccggcatctagtgcgcctgcatcggaaccgaggggcccgcctcgcactcgcctaagaaaaccatttcccgggacgggcctggaaagccctggcggttggtatccggctccagggccgaatggactccgaggctttccttccgagatgcccgggcgggatttcttccattcagcgcgcggaggaatggagcccccaggccgccaaggcccaggatgtccaggtccttagaaggcaccgaggtgagtggccgcgcccagctctgtgcgtcgcccctagggtcgcccgaaccccggcgttcctccccgtgtaccctcgatgctcccgtgagcaccctgccctgggcgtccaggcgagccctggggctctccagccattccagcctgcagcccgcgctcagcagtgagg

SEQ ID NO: 124149 - DNA, 180 bp, Homo sapiens; identical to SEQ ID NO: 93176
  misc_feature 1..180: note = chr5:1549177-1549357
  misc_feature 1..180: note = Hypo
  source 1..180: mol_type = genomic DNA

SEQ ID NO: 124150 - DNA, 35 bp, Homo sapiens; identical to SEQ ID NO: 93186
  misc_feature 1..35: note = chr5:1563387-1563422
  misc_feature 1..35: note = Hypo
  source 1..35: mol_type = genomic DNA

SEQ ID NO: 124151 - DNA, 91 bp, Homo sapiens; identical to SEQ ID NO: 93255
  misc_feature 1..91: note = chr5:1654294-1654385
  misc_feature 1..91: note = Hyper
  source 1..91: mol_type = genomic DNA

SEQ ID NO: 124152 - DNA, 330 bp, Homo sapiens; identical to SEQ ID NO: 93256
  misc_feature 1..330: note = chr5:1662561-1662891
  misc_feature 1..330: note = Hypo
  source 1..330: mol_type = genomic DNA

SEQ ID NO: 124153 - DNA, 580 bp, Homo sapiens
  misc_feature 1..580: note = chr5:1667514-1668094
  misc_feature 1..580: note = Hyper
  source 1..580: mol_type = genomic DNA
cgttgccctgggaaccggggactgcagccgcggacttcggggtctcggctccggcccctgcaggaccgcgggcgccgccggggaagcgaggcctttgggtctgagggtccgagcggctcccggaggtgcgggcggagataggagaccccccccgagcctggggggggcgcaggaagggggcgcgcggggcgggggcgcgcaggaagggggcgcgcggggcgggggcgcgcgttctccctccgggcagcctcgtgggcggtagatgcagccaacgcgtccgtcaaagcggttcaggggcgctgggaagaggcggcggtgaccccgggacggcagtgggcccgaccgagcctcagtgggggtcccgcgtgtacgctggcctcgccctcccgcctcgcttctgggcttttgctccaactctcagccgccgtggagatcgcagggggcgtagggccaagccagggattccgctgtgccccgggctcgggagaggtgtcccgggagtctatggcagaatttccccctcatcctgcgctgggagaggggtctcgccccggatggaactccgcgttcccacctccag

SEQ ID NO: 124154 - DNA, 146 bp, Homo sapiens; identical to SEQ ID NO: 93265
  misc_feature 1..146: note = chr5:1668306-1668452
  misc_feature 1..146: note = Hyper
  source 1..146: mol_type = genomic DNA

SEQ ID NO: 124155 - DNA, 42 bp, Homo sapiens; identical to SEQ ID NO: 93325
  misc_feature 1..42: note = chr5:1704607-1704649
  misc_feature 1..42: note = Hypo
  source 1..42: mol_type = genomic DNA

SEQ ID NO: 124156 - DNA, 30 bp, Homo sapiens; identical to SEQ ID NO: 93386
  misc_feature 1..30: note = chr5:1726678-1726708
  misc_feature 1..30: note = Hypo
  source 1..30: mol_type = genomic DNA

SEQ ID NO: 124157 - DNA, 71 bp, Homo sapiens; identical to SEQ ID NO: 93404
  misc_feature 1..71: note = chr5:1729815-1729886
  misc_feature 1..71: note = Hypo
  source 1..71: mol_type = genomic DNA

SEQ ID NO: 124158 - DNA, 36 bp, Homo sapiens; identical to SEQ ID NO: 93406
  misc_feature 1..36: note = chr5:1730216-1730252
  misc_feature 1..36: note = Hypo
  source 1..36: mol_type = genomic DNA

SEQ ID NO: 124159 - DNA, 1175 bp, Homo sapiens; identical to SEQ ID NO: 93431
  misc_feature 1..1175: note = chr5:1746002-1747177
  misc_feature 1..1175: note = Hypo
  source 1..1175: mol_type = genomic DNA

SEQ ID NO: 124160 - DNA, 90 bp, Homo sapiens; identical to SEQ ID NO: 93435
  misc_feature 1..90: note = chr5:1749854-1749944
  misc_feature 1..90: note = Hypo
  source 1..90: mol_type = genomic DNA

SEQ ID NO: 124161 - DNA, 37 bp, Homo sapiens; identical to SEQ ID NO: 93437
  misc_feature 1..37: note = chr5:1750588-1750625
  misc_feature 1..37: note = Hypo
  source 1..37: mol_type = genomic DNA

SEQ ID NO: 124162 - DNA, 30 bp, Homo sapiens; identical to SEQ ID NO: 93489
  misc_feature 1..30: note = chr5:1764822-1764852
  misc_feature 1..30: note = Hypo
  source 1..30: mol_type = genomic DNA

SEQ ID NO: 124163 - DNA, 30 bp, Homo sapiens; identical to SEQ ID NO: 93532
  misc_feature 1..30: note = chr5:1779736-1779766
  misc_feature 1..30: note = Hypo
  source 1..30: mol_type = genomic DNA

SEQ ID NO: 124164 - DNA, 30 bp, Homo sapiens; identical to SEQ ID NO: 40438
  misc_feature 1..30: note = chr5:1780761-1780791
  misc_feature 1..30: note = Hypo
  source 1..30: mol_type = genomic DNA

SEQ ID NO: 124165 - DNA, 178 bp, Homo sapiens; identical to SEQ ID NO: 93610
  misc_feature 1..178: note = chr5:1794492-1794670
  misc_feature 1..178: note = Hypo
  source 1..178: mol_type = genomic DNA

SEQ ID NO: 124166 - DNA, 32 bp, Homo sapiens; identical to SEQ ID NO: 93611
  misc_feature 1..32: note = chr5:1794976-1795008
  misc_feature 1..32: note = Hypo
  source 1..32: mol_type = genomic DNA

SEQ ID NO: 124167 - DNA, 228 bp, Homo sapiens; identical to SEQ ID NO: 40440
  misc_feature 1..228: note = chr5:1795233-1795461
  misc_feature 1..228: note = Hypo
  source 1..228: mol_type = genomic DNA

SEQ ID NO: 124168 - DNA, 105 bp, Homo sapiens; identical to SEQ ID NO: 93675
  misc_feature 1..105: note = chr5:1827709-1827814
  misc_feature 1..105: note = Hypo
  source 1..105: mol_type = genomic DNA

SEQ ID NO: 124169 - DNA, 30 bp, Homo sapiens; identical to SEQ ID NO: 93677
  misc_feature 1..30: note = chr5:1839565-1839595
  misc_feature 1..30: note = Hypo
  source 1..30: mol_type = genomic DNA

SEQ ID NO: 124170 - DNA, 62 bp, Homo sapiens; identical to SEQ ID NO: 93678
  misc_feature 1..62: note = chr5:1844450-1844512
  misc_feature 1..62: note = Hypo
  source 1..62: mol_type = genomic DNA

SEQ ID NO: 124171 - DNA, 51 bp, Homo sapiens; identical to SEQ ID NO: 93679
  misc_feature 1..51: note = chr5:1851149-1851200
  misc_feature 1..51: note = Hyper
  source 1..51: mol_type = genomic DNA

SEQ ID NO: 124172 - DNA, 599 bp, Homo sapiens
  misc_feature 1..599: note = chr5:1851402-1852001
  misc_feature 1..599: note = Hyper
  source 1..599: mol_type = genomic DNA
tgctactccaggggccgcgccagcagcattttcccaggcagccggtcgtcatcctcctccctgcagcctcctcctgcgccctctcacgaggcgctggggcctggtgcggaaggatttacagggaaggaatgtcgggctcctccggctgggagcgcacctgcgcagggagggtcctgtcccaccacacctggccccctggggaacagcgggtgagtgctgctgcaggaaggagcaggagagacgcactgctccccgctcctctctccgcttccctcctctcctcccacctcccccatctcctccgtcccctgtctccgcccctccttgtcctcaggaagccatatcccactctggtggagtggctcaggccgctgatgagggtgctcggggcagggctcttctctgagtgacgttggaggttttcacggtgaacacagaaaggggcactccgtccgagctgagcctcagggaccgtgaggcttgctcttggccctgctgctcatacagccctccgtgcctcgcttccctcccacagcaaggaaggatgacgggtgcggggtctgcacggtggcgcggggtggccgcgttgctcaggaggc

SEQ ID NO: 124173 - DNA, 220 bp, Homo sapiens; identical to SEQ ID NO: 93682
  misc_feature 1..220: note = chr5:1865538-1865758
  misc_feature 1..220: note = Hypo
  source 1..220: mol_type = genomic DNA

SEQ ID NO: 124174 - DNA, 34 bp, Homo sapiens; identical to SEQ ID NO: 40442
  misc_feature 1..34: note = chr5:1869209-1869243
  misc_feature 1..34: note = Hypo
  source 1..34: mol_type = genomic DNA

SEQ ID NO: 124175 - DNA, 2340 bp, Homo sapiens
  misc_feature 1..2340: note = chr5:1874892-1877232
  misc_feature 1..2340: note = Hyper
  source 1..2340: mol_type = genomic DNA
aatggaatcatcagccgcggtttgagaggtcgataaagcttttagatttggagacgttttccgggagcccatttcctgcggctaagagttgttaatggagcttaaggaattatcttaggccgggcggccgggagagccgtatatctcccgcgcctgttcccttgtcgagcctgaatatgctgctgtcagactcgcttaatgaaaagtaacgcaccgctgattacagttttatttgggctctatgtaaagagcgccgttaatttgcatcccctccttggtgtgtttgaattcgccacgcctgaataaccgagcgcgccggccctgccggcctcccggcgccttcccagcccttctctgacaatctccctgggagcccagtcgcccgccccgacccttccccgtcacgcccccgccccactgacatcgacctccctggcgcgtccactcagacacctaaaattcaccccctccgtgtcacctctttgcaaacgccccctccccaccccgctccgacttcggaattgtcctgcctgacacctccccaccccacaagatcagccagagggtgtttgggggcgcctaaggcaaaccggctggactgtgccccaagggaagggtgtgggggaagcgcccagcgaggggatgccatttcctgcgcgtccccttagaatgtggctgaatccgcctccccacccgacgtctttatttaacacaatctcgcagcttattcaaataagccagctttgtcagccagttccaccaagatccgggggctccagcgagatggaattcctatggccagggccacggggaggggctggggtcccgagggcagcaagcttggctggcggcaggagccctgggtcctccccaggagagggacccagagcccagaccaagtccaacccgccaacctgcgccacccatgcgcgcactgggggctgcagagccccgccaggctgcccgcggccgggagcgtaaggccggggtccacgcctcgattttcagtgtccgcagcccctaccccgcctatctgcgacgcaaggcgaaaccttgtttttgcggaaaatgcctggctttgtctagggctggggtgggggcgtctgggcagccaccctcggccacattaaaattcctggcgccccagcctcgggcctcaacgctgtcccccgagacgccactttcgctattactgtcaagtacccttgactctttatttttgcccttttatctattacaactaattcgagttcttttgcccttttcagtctaagacgtgggctttctgcaaagcctccccctgccagcgagctctcggagcgcggagcctttagaaattgaggggtttactgtcaaaatgaaaatttcacttcaaattaccttggctgatgctcgctcgccaggccgggggctcccgccgcagccttttgacaggcacatgagccgcgagcttccgaacctcgataatatcatctcgagcgcgaaagtcaatacggtgacagcgcgcggccggatacaatccaattacgctcggctgcccgggcgctcctggggctcggggtccggcggccgagggtccccctcagggcccggtccaggccctgtcgccagggttcagggcaggccccaccacgcgggggactttggtggcccaggggtccccacgaggccgcagtccgggtccgcccagccccaggctcctagaggaaagccgagcctagtgagtccctccaaggccgcccgcccgcaagacagtcctgcgtctccggctatcctgtcccaggcaagggcctgtggtcgcctcctcgccgcccccgggccgctcccgtagtccttgggacacctgggcctttgatgagcccagcagggcttcgggcggagggctcggggtggggggtggggggcgagaggagaggcctcaagtccgccaggcgcctgcgggggatgcggaaccgcctccgccgcggggatggggaggggagcccggatttctgagcgtagccacggcttggccgggccccccgagccccggatcgctccgcgggttccttccacacgcccttcccgccctgccccgaggcctttcctcccagtcccgcctccggtcggcggcctgtgaagctctgagcatttccccccgcggagccgcggctcgccggctttccgagcagagctgattgcggagcggcgggtccccggaaataggagagccgaggttaggaggtggctgagacggcagaggcgtcgaggccgccctaactcctgcctaggatgggcagaggccgctaacagagaaaagcaacgatgggctcccacgcccccccccgggacacggctctg

SEQ ID NO: 124176 - DNA, 1291 bp, Homo sapiens
  misc_feature 1..1291: note = chr5:1877754-1879045
  misc_feature 1..1291: note = Hyper
  source 1..1291: mol_type = genomic DNA
gcttcagaacggaaccgccttctccatgtaaacttttgacgtaaactttatgcttcagggtatctggcctcttctgctccgagagcctctccttccgcgtcccaaatttgggaatggcccggtcaggctcaggcccaggcggtggaggccccggcgtggcagcgccgggcttgtccatgttcccaggagtccaagttcagaagccccctctccggtgggttggcggcttcgcggtggccgcgctagtcttcctctggaaactcagtgaaaagagtcggcgccgtccgcctgagcgcgggttccctcctgggctcgggacccgcccgcctcaggcgcagaagggtttgccgccggccttgggcagggcgagcagctccctggcggcgcctgcagctggggcgtcctggggcacggcaggcggaaaggcgcgggccaggggtgcagtcagcacgttcgcgcccgcccccagcgagcgtcccagaggcccggggtccaggagggcgcccttggcggtggcccaggcctggttcaaagtgctgtgcctgaggatggggtcgtggaagaccccgtccacccagtttctgagactggttaccggggagtcctggtgcctgtccagggcgccagagtggggaagggccacagacggggacgtggcgggcgcggaggacacagccgcaggggccgcgggaccttggcgcttgagcatgcacgacggaaactcagtctggctcagggaggtggcggcggcggcggcggcggtggctgtgtgggccagggaccagatgcgcggcttagcctccaggcctgccgacgcccccgccggcacaaaccccagcttggcctcgcagacctgagggccgccctctgcgcccggcagtggctccggcccggccgccgcgctgcggagacagctccgggccctctccaggtcctcgtccagagcagctccgccacccgcggccagagacatccggagcgcgcctgaggcctccttgaccgggccgtcgggcgcggcggggacgcgctccagaccgccgtccagggagtggaagggcggcttcagctcgcacgccggcggctctgcttccagcgggtcgaagtcgtccaagtcactaagctccagctccttctcctctttgcccacgggctctgcgggagagaatgcgtggccagtggagggagagggttggtaggtgaatcagaccccctgtccccgtccaccattatgaggcctgttcccgacgctacgaaaagcactcggggcctctcttcgcgtctcccatttcct

SEQ ID NO: 124177 - DNA, 241 bp, Homo sapiens
  misc_feature 1..241: note = chr5:1879506-1879747
  misc_feature 1..241: note = Hyper
  source 1..241: mol_type = genomic DNA
cctaggcatggggctcggcgtttgggacccccaagacgtcctagaaccgcagagaaggcactgtgcctgcactccagggcctcagcccccagtgacaacctcccaacccacctgcgttcttggagctcttgaggggctcctcccgcgcctcctcctcgcccccctcctcctcctcgccctccgcgtagggccgcttctcgtctgcgcacttgttccgcggcggccacgtcatcttgttctc

SEQ ID NO: 124178 - DNA, 3546 bp, Homo sapiens
  misc_feature 1..3546: note = chr5:1882184-1885730
  misc_feature 1..3546: note = Hyper
  source 1..3546: mol_type = genomic DNA
ggccgcgaggactggcgggaagccgggctggaggctggggccctgggccttgccaatcccgcgcgccgcccacgagggcgtgccccgagtacccccgggcctcccgccgtccacaccaggatgctcgcccctttccactagcttgtgcgcgtctggcctcctccgccacgtggggcccagccgagcacctacacccttccccggagggtttccaaggcctctgacgccatttgcgcgccaagcctccttccccaggggttccttggggtcctaggactcccctggggcacagcctgagccttgtggttcaaacatcagggaacccgggcccggcccgtcggattttcttagcgcctcggcctttccccgggggtttggggagcaggggttgggcgtgaggggcgcgcgacccaggccttgctagctcggaagccgcaggcagtcgtaggtcggacactccccaccccccgtccccgccccatccgccctaccggcacctgcggtggcctgggcggggcggggctccgcttacctggggagccgaggagtaggggtatccaaactgcgggtaggacatggcgggcgcggcccggggcggacgggcggggcctgcagggttctgcgcgctggggccggcgtggcgcggccactgctccggagctgcaggcttctaggcgctgggagggcgaagcaggagagccggttagtccatccccgcgctccgcaaacttttctaaccgggtaacaaagtgagcagcggtggccgccgcgattcctttaacttcgcattccggaggctcgagggggctctgggaccgagcggcctcgcagcggcgacagaaatacatattttacgaaaaagaaaaaaaaaaaaacgagtcgcgcgaacccgtcaagtcagatgtgcgcggcttgaagcggaggaggctctgacgtcagccccacctcgcgcagcccggcctggccgcagactcgccggtcactcgccggcggctcaggccgggaggggccaggacagtcccggccgcgcggtggacggaggggccattcctccgggcgttagcaaataaattccatccgagtcaatatcgcccagcgaacggtgtttctctttagtcacccgagaacgagaggcacttttaattagaaattaattaatgagcagctgctccttcccgccccactgtaatcattcgtctcaattacaaatgagacctatgaaaggacacgctgaagatgtaatcaacagttaaaattagcccggcgctgcgcaggcggccggcccggcctcgcgctggcgcgctctgctccgagtggcaggaaggggctcgcaggcgccccgcacgcgtctcgtcactattgtttaatcgagaatcagcaacgcctcccgccggtttccaccctacgccggaatggactttcagaacccactgcggccgcaagacagcccgcaagagctggtcaaaatgccctcaggtgcgtgggggcttcggggccttagttggagcccgacaccctgagactggcggcccgagggctgtagggccgccccgggcgtgcgcccaccggctttgcacctctgggcagccgagtgtcgcggagaacgccccatcttctccaccgcggtcttttaagttcccgctcagcccaccgcccccacctcgcctccccgactttcctccccgatcccctttccgccggccgtgctccgccggcttccccctgcccctcgcggctaagccggggactgccgggcggccctgcgcgctcggaagagcaggttcctcaacccaggccccggcccctcccgctaagctcgtccctcccggcgccccgcagggctggctgcgagggagggggcgttgggtgcctggcggaggcgccctcccctgtccattttgcccagctttctgtctggggcgcacggagcaatcggaagaggggaccgagcgcccaccccaggactccctcggccagtaccctccctgggaccttgcccaagttcaaagcggaggccagtgagcaggcggcaagggggcggcaagggggcgcccgggccatcccgaacccgttccccgccttctgcgccatcgccctccgggaccgggactcgccccggttgccctcgccccctgggccggcctcccgtggtaagttgggaaggaagccgtgcaaggcagcgttgtgcagacttgctcagaaagattcctgggttcagacctgtgaatcgccccagggtcaccctctaattaatgatgacgtcctcgccctctccccagctgcaagcctgcctcccagaaacgaaatctgcctgctcttttgacagctcggttgaaggtgattgatgactatctggagaccacagtacacatcatataatatctgctgcgtaattgctttaatttacagatgaaaatacgagttctccgatcgcgttggaccggagcgggccacgtccgagctgcttgcagagggaaaccatcggaaataatgaatagccgctccatgcaaattattcagacagtttagcgtcggtagccgcgagaaatatataaagaacacgagtcaaatgacattaataattgtttctgaattctgtattgatttcgcggcaggccgcgtttctttctttctcacctgaatcgctaatatcaccttcctgtaaataataagaaactagccaccggggtttctcgctagaaatgaatctctcaacccctttccctctcctcctgctcctcccctcccccaccctccttcctcccctctcccaccctccctcctccccactccttgcagttttctggtttttcccgagcatccttctacttcccattatttattgtttacaaactactcgctctctccaggtaatgaggcccggctgaaggaggggtgtgagcccagccgggccaagggctgggatggggagtagagacccccagaggggaggcattcagctgtggcttgtcctttcctcacctatactcggggacctggcctcggcgactgtgagcactccgccggctgagggggagagccagggcccaggggcccagccacctatgccctgcacctctgggctctagtgcaacagctcagcccacccagacctgaggctggtgcatttccttccttccagacccggcggggcttaactggagccgaagccccagaacaggcggccattcatcttctgagcagagtctgggagaagcagcctccacttcccagggcagccagtacgtgggggccctttcgggggcttcctttgaccaccaccgccaccttctcctgttctcttttgcctttccagcctgtgtgcataaatcgacgctccagtccccaccagcgggcgaccctttctccgtgacccagaaacctggcctctgaatcggctttcccaggccgccgcacacacacgctccacttcctgcccgccagcaggccccagcgcctggggtccgggcccagtcacagtcaccctgcctcgggaagctcgcaactgcccaggaggcctcctgacccgcccggcctcacccaggc

SEQ ID NO: 124179 - DNA, 2113 bp, Homo sapiens
  misc_feature 1..2113: note = chr5:1885934-1888047
  misc_feature 1..2113: note = Hyper
  source 1..2113: mol_type = genomic DNA
tgtccctttcaccaacgataggacgctcagcatctcaggtatcagctgaacgcgtctgcatagactcggagtgctgagccttcctccctctagggacccccggtactaaatacacccgtgagcaggtgggccagaagtcagccggctcccggagtacacagcaccggctcagcttcggggagatgaggtgctcccgctggcctggagcgctccgaagagcggaggaccagggccggagcaggccgcaggggaggcaggggatggtcagcccctaacgcgaagcgcaggcgggtcgcctattttgacggggttaccgttggccgtcggaaccatggaaggcctccggggagacaggccgggccctgacccttcttcggccagcctagccctggtgcttcaggagttaccctgggggccaccagttccccgcaccaagagctcgtccggagggagctccttccagcccagagaagttaactccagccaaaggcgaagccgggagcccggggcaccaggcaagggcctttctttctgagacctggggccagagaccttgggggcgcctgtgcccgcccaccgctcgggacacccggctggggtgtgggtttgagaggcctcacggtcgctgacgccgcactggcgaacctcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggagtcgccgcagccgccgccgcccgctcccctcggcggccgcgcggagcctccgcctcctcggaaggggggaggggtctcggaaccccggggcgggggcgggagcgggggacctcacctacctgcggtggcgctgggccgctcccggcagcccgcgagggctccgcgcggaagctcggcgcgcgcgctccagcggggagccggcgacaactaatggagacatttccaggcggagcacctggcgagcggagcgcgccggcgtccccaggcgccgcggtcgtcagccgagcccgcaccggcgtgacgtgggcgagcgagcgcgctgctcccacccggccgcccattaacgctttctcccgcgggcgccgcgctcttgccaactttcccctccgtccggtctgcgcgcggcgcgccgggtgcaggagctggggtgagggcgccccgggtgccagcaggggcgctgggagctgtttgggcggggacgtagggctccgggaggtcacacagccctaacaggacagtgggaaggcgcgcgagccagatttggccaaacgctaagctcgctgcggcctcgggccctcggcccacggggcccctctccccgtttgggctgccccacccagggacgcttgggccgggcgcgaagagcccggaaatagccacccttgtcgtcggcccggtttccctccgaggtcttagtatttcccccctcccccaccccccaaggcctgtggagggcgaggctgctgctccagccaaccctcggaattggctgcagggcgctcaggtcctgcctttcttcccctgcccctctcccaagcccctccgtgctaagcggcccagttctgggttctctcctggtgcccacgctagtccctagccggctcactctcaaaacagcaggctgtggcaggggcaaagcctaggtccgggcaccaggacccgggcaagtgggcgcgaatggaccacggtgataagccgcccgaggaccaat

SEQ ID NO: 124180 - DNA, 35 bp, Homo sapiens; identical to SEQ ID NO: 93702
  misc_feature 1..35: note = chr5:1892071-1892106
  misc_feature 1..35: note = Hypo
  source 1..35: mol_type = genomic DNA

SEQ ID NO: 124181 - DNA, 135 bp, Homo sapiens; identical to SEQ ID NO: 93703
  misc_feature 1..135: note = chr5:1913952-1914087
  misc_feature 1..135: note = Hypo
  source 1..135: mol_type = genomic DNA

SEQ ID NO: 124182 - DNA, 87 bp, Homo sapiens; identical to SEQ ID NO: 93705
  misc_feature 1..87: note = chr5:1922987-1923074
  misc_feature 1..87: note = Hypo
  source 1..87: mol_type = genomic DNA

SEQ ID NO: 124183 - DNA, 1233 bp, Homo sapiens
  misc_feature 1..1233: note = chr5:1930795-1932028
  misc_feature 1..1233: note = Hyper
  source 1..1233: mol_type = genomic DNA
ctctgcggcgacagccgctggggtggggctacggggaagtcgcgctgcccctcgtctgagcgtgggccagggcccaggtggtgaccaaggcccggcgcagtggccccggagcgtggaggggcagctgctgggcggcctcccgggggagggtgacggcttcacccgccaacgctgcctccctcctgggattaggccggaggaatcttggatcgcccgaggctggtgctcagcctccttcccccatcccacctccaccacccggcgacccccgtagacttgattggcaggccctgccccgacccctacccctccaggtccccgcctcggtgcctcggtgcccggctccgggccactcctgcaggccctgcctagggcagccggcggtgcctggaggcgggctcgccccggctgctccacgcccaggccggtccctggcatttcagccagtgggagggcgtccccgccgcccccgtgcctctccgcaggggctgcgccgcgtccccgggcctctccctccgccgtggcctggtctgcctgctccagggcgcagctgcgcccgcttcagcgcctcccgggtctgcgtggcctgctcggctcagaggcctccaccacggtccgctccctgccggacgccgcgctgctgtggccgcggtggttctgtggctgtgagggccgtttctgtccgtccacaccgccttccctctgcaggtgaggaatggggtctgcttcgtttggaatgtgcctttgccgggtcctgcctgacctccaccttccagccgggacgcgcgagcttttccgtttggctgagtcaaaaagggatcgcgcgcatcccgccgcccctcaccacgaagcgcagacacaggaggttgcagggtcagtgctgcggagaatcccagacggccccacagccgccgccacccgcggggcactcgcccgggctctgccgaggatgtgggggctttggtctccgcagagctgggactcccgaaggccttaccagaaactcaggagcagccccagccctgcagagcccgcgagggtggagacgggagacccgctgtggggcctgaggctgagatgccggcctgcggtgaagccggcgggacgttccaacccgctcagacccgcccactccgcagggcccgggcccaccccccggcctgtggcctgtgctgggctgcgcagccggcggtggagggacctgggaaaccaggtgctcgccaggtgtccctc

SEQ ID NO: 124184 - DNA, 205 bp, Homo sapiens; identical to SEQ ID NO: 93710
  misc_feature 1..205: note = chr5:1949464-1949669
  misc_feature 1..205: note = Hypo
  source 1..205: mol_type = genomic DNA

SEQ ID NO: 124185 - DNA, 492 bp, Homo sapiens; identical to SEQ ID NO: 93711
  misc_feature 1..492: note = chr5:1950766-1951258
  misc_feature 1..492: note = Hypo
  source 1..492: mol_type = genomic DNA

SEQ ID NO: 124186 - DNA, 199 bp, Homo sapiens; identical to SEQ ID NO: 93712
  misc_feature 1..199: note = chr5:1951511-1951710
  misc_feature 1..199: note = Hypo
  source 1..199: mol_type = genomic DNA

SEQ ID NO: 124187 - DNA, 312 bp, Homo sapiens
  misc_feature 1..312: note = chr5:1952624-1952936
  misc_feature 1..312: note = Hyper
  source 1..312: mol_type = genomic DNA
tggggcctggcaggccggggtccgcggagtgaggagtttatcaggatgacataaagaggtgcagtggatgaccgctgtatgaggttaagcacaggcaggcggtgcagatcccaggagtttgtttaggagaagcggagccttgcctctggtgcttcctgtgaactacaatctgaatgacaatccggcagcccagagcctcccctggattccagggaagccgggaaaagctgcttcctgcgggactcatctcagggttccctggaaggagacaaagagcagacctgaaatttagtcagccgcttaaaacacttg

SEQ ID NO: 124188 - DNA, 68 bp, Homo sapiens; identical to SEQ ID NO: 93715
  misc_feature 1..68: note = chr5:1959631-1959699
  misc_feature 1..68: note = Hypo
  source 1..68: mol_type = genomic DNA

SEQ ID NO: 124189 - DNA, 152 bp, Homo sapiens; identical to SEQ ID NO: 93716
  misc_feature 1..152: note = chr5:1983598-1983750
  misc_feature 1..152: note = Hypo
  source 1..152: mol_type = genomic DNA

SEQ ID NO: 124190 - DNA, 62 bp, Homo sapiens; identical to SEQ ID NO: 93717
  misc_feature 1..62: note = chr5:2007735-2007797
  misc_feature 1..62: note = Hypo
  source 1..62: mol_type = genomic DNA

SEQ ID NO: 124191 - DNA, 188 bp, Homo sapiens; identical to SEQ ID NO: 93718
  misc_feature 1..188: note = chr5:2024999-2025187
  misc_feature 1..188: note = Hypo
  source 1..188: mol_type = genomic DNA

SEQ ID NO: 124192 - DNA, 565 bp, Homo sapiens
  misc_feature 1..565: note = chr5:2038424-2038989
  misc_feature 1..565: note = Hyper
  source 1..565: mol_type = genomic DNA
tgcactgttgaaaagcggcatttgcccaggcgtttcctctttacagacgagtcagtgtctttgccgtttggaaccttgtcttcactatgggatggcacttgatcgaggcggccccgcagcctgttccgcggtgctggcgtctccctctccctggcgaggctgccccgaacccctctgcaccctccctccaggtaccgcccctgggaggtccggtggggaccacggcccgcgacggccgccgcacagccacctcccggcgcgtgcagtgcgggcccggagccaacaggtggcacaaacgcatttgacttgggcatcgatcgccgcgcccgcccggggccgcacctccgccgccagcgtccctccagcccggccccgatgccgcgcaggcgcagtgctcttctctccgcgggccgggccgggtcagggtcaggatctgacccgagtctgggtcaagccatggcgggcggcaggcagcggacggcggcgcccaggcagtgcgccctctgctggccactcgtgtacacgctggctccagccagtgctgcactcctggcagacaggggcc

SEQ ID NO: 124193 - DNA, 35 bp, Homo sapiens; identical to SEQ ID NO: 40447
  misc_feature 1..35: note = chr5:2112239-2112274
  misc_feature 1..35: note = Hypo
  source 1..35: mol_type = genomic DNA

SEQ ID NO: 124194 - DNA, 504 bp, Homo sapiens; identical to SEQ ID NO: 93723
  misc_feature 1..504: note = chr5:2136910-2137414
  misc_feature 1..504: note = Hypo
  source 1..504: mol_type = genomic DNA

SEQ ID NO: 124195 - DNA, 30 bp, Homo sapiens; identical to SEQ ID NO: 93724
  misc_feature 1..30: note = chr5:2155918-2155948
  misc_feature 1..30: note = Hypo
  source 1..30: mol_type = genomic DNA

SEQ ID NO: 124196 - DNA, 331 bp, Homo sapiens; identical to SEQ ID NO: 93725
  misc_feature 1..331: note = chr5:2180344-2180675
  misc_feature 1..331: note = Hypo
  source 1..331: mol_type = genomic DNA

SEQ ID NO: 124197 - DNA, 230 bp, Homo sapiens; identical to SEQ ID NO: 93726
  misc_feature 1..230: note = chr5:2199933-2200163
  misc_feature 1..230: note = Hypo
  source 1..230: mol_type = genomic DNA

SEQ ID NO: 124198 - DNA, 180 bp, Homo sapiens; identical to SEQ ID NO: 93727
  misc_feature 1..180: note = chr5:2250142-2250322
  misc_feature 1..180: note = Hypo
  source 1..180: mol_type = genomic DNA

SEQ ID NO: 124199 - DNA, 82 bp, Homo sapiens; identical to SEQ ID NO: 93728
  misc_feature 1..82: note = chr5:2261231-2261313
  misc_feature 1..82: note = Hypo
  source 1..82: mol_type = genomic DNA

SEQ ID NO: 124200 - DNA, 150 bp, Homo sapiens; identical to SEQ ID NO: 93729
  misc_feature 1..150: note = chr5:2261610-2261760
  misc_feature 1..150: note = Hypo
  source 1..150: mol_type = genomic DNA

SEQ ID NO: 124201 - DNA, 32 bp, Homo sapiens; identical to SEQ ID NO: 93730
  misc_feature 1..32: note = chr5:2268219-2268251
  misc_feature 1..32: note = Hypo
  source 1..32: mol_type = genomic DNA

SEQ ID NO: 124202 - DNA, 30 bp, Homo sapiens; identical to SEQ ID NO: 93733
  misc_feature 1..30: note = chr5:2301052-2301082
  misc_feature 1..30: note = Hypo
  source 1..30: mol_type = genomic DNA

SEQ ID NO: 124203 - DNA, 30 bp, Homo sapiens; identical to SEQ ID NO: 40452
  misc_feature 1..30: note = chr5:2324383-2324413
  misc_feature 1..30: note = Hypo
  source 1..30: mol_type = genomic DNA

SEQ ID NO: 124204 - DNA, 39 bp, Homo sapiens; identical to SEQ ID NO: 93736
  misc_feature 1..39: note = chr5:2367627-2367666
  misc_feature 1..39: note = Hypo
  source 1..39: mol_type = genomic DNA

SEQ ID NO: 124205 - DNA, 30 bp, Homo sapiens; identical to SEQ ID NO: 93737
  misc_feature 1..30: note = chr5:2368819-2368849
  misc_feature 1..30: note = Hypo
  source 1..30: mol_type = genomic DNA

SEQ ID NO: 124206 - DNA, 68 bp, Homo sapiens; identical to SEQ ID NO: 14739
  misc_feature 1..68: note = chr5:2369614-2369682
  misc_feature 1..68: note = Hypo
  source 1..68: mol_type = genomic DNA

SEQ ID NO: 124207 - DNA, 164 bp, Homo sapiens; identical to SEQ ID NO: 40454
  misc_feature 1..164: note = chr5:2374826-2374990
  misc_feature 1..164: note = Hypo
  source 1..164: mol_type = genomic DNA

SEQ ID NO: 124208 - DNA, 195 bp, Homo sapiens; identical to SEQ ID NO: 93740
  misc_feature 1..195: note = chr5:2376679-2376874
  misc_feature 1..195: note = Hypo
  source 1..195: mol_type = genomic DNA

SEQ ID NO: 124209 - DNA, 30 bp, Homo sapiens; identical to SEQ ID NO: 93741
  misc_feature 1..30: note = chr5:2412208-2412238
  misc_feature 1..30: note = Hypo
  source 1..30: mol_type = genomic DNA

SEQ ID NO: 124210 - DNA, 166 bp, Homo sapiens; identical to SEQ ID NO: 93743
  misc_feature 1..166: note = chr5:2493697-2493863
  misc_feature 1..166: note = Hypo
  source 1..166: mol_type = genomic DNA

SEQ ID NO: 124211 - DNA, 190 bp, Homo sapiens; identical to SEQ ID NO: 93744
  misc_feature 1..190: note = chr5:2523561-2523751
  misc_feature 1..190: note = Hypo
  source 1..190: mol_type = genomic DNA

SEQ ID NO: 124212 - DNA, 162 bp, Homo sapiens; identical to SEQ ID NO: 40457
  misc_feature 1..162: note = chr5:2541481-2541643
  misc_feature 1..162: note = Hypo
  source 1..162: mol_type = genomic DNA

SEQ ID NO: 124213 - DNA, 30 bp, Homo sapiens; identical to SEQ ID NO: 40458
  misc_feature 1..30: note = chr5:2547162-2547192
  misc_feature 1..30: note = Hypo
  source 1..30: mol_type = genomic DNA

SEQ ID NO: 124214 - DNA, 30 bp, Homo sapiens; identical to SEQ ID NO: 93747
  misc_feature 1..30: note = chr5:2562122-2562152
  misc_feature 1..30: note = Hypo
  source 1..30: mol_type = genomic DNA

SEQ ID NO: 124215 - DNA, 42 bp, Homo sapiens; identical to SEQ ID NO: 93750
  misc_feature 1..42: note = chr5:2642066-2642108
  misc_feature 1..42: note = Hypo
  source 1..42: mol_type = genomic DNA

SEQ ID NO: 124216 - DNA, 2245 bp, Homo sapiens
  misc_feature 1..2245: note = chr5:2738816-2741061
  misc_feature 1..2245: note = Hyper
  source 1..2245: mol_type = genomic DNA
ctcaccacccccagccgcacgcttgggcctccctcctcctgtgcctccgggaccgtctccccacctgcgggaggccaggtgtgtggctccagagaccctccacctgaactacccgctcccagagccccagtcagggccgccagaggtcgcggagggtgaagccaatgggcctggacgccgaggccggggagaggaaggagcgaggtaatggctgtggctggagaccctcttctgactccccaggctgccgggtaggcctactgtgggatgggactcaggcgaccagacgtgctctccgtcgcctccatcccggccgctgactccgctgtgtccccttggatccatcaccacctccaggcagccctccagcgggttctggtggcgccgagagcttcgaggggactcaacgcgctttgtagggcctgtgaaatccggcttgtcgcataagctccctgaagaagagaacaaacttcccagaccaggggcccgcggggagcggtgcagacaccgcggcaacccaccccgagcccgccggccctcgctccgtgcgcccaaggggcgtcccccgaggtgtcgcctgcaaggcagccgcgtacgtcgttctcagtgcgggtcctgggggcggcggtgccgggggtacggcctggggtcccgtcggtgtccactgcccgcctgggcgctggggccgcagatcggggctacacggctcgcgccgaccgaacgctgccgccagagcggtggaaaagcgctgggcaggccggcctggggctttcgagctctgccgccgagcgcagcagaaatacggtgtgcaggcaggacccgaaacaggagagaccggggggaccggggaggagaggaaggctggctgtggcaggaacccgggcgctcggcacctcccctggtcccgggggccctgaacccccgccgccgtcgccgccggaccccgcgatcgtcctgaacccgggccgggcgctttcggtttcccggcgctctgcggcgctgctttgttcaccctgcgcgcgcggttcccagagtccagagctgcgggcctgaggctgagggccagggagcgaggcgagcacccggggccagccacggaggagtcccgaccaccacgggagcagggggactgggaggcaagaggtcgggggaggccggggtcagggcgggaggaacccgatgggtcccgctgcggcttcaggcgcggggtatagggtaggaccaggaaggggactgaagcccgggaccagagctgggggtgccaggagcggggcctccagtgggagctcgggggtcctcgcgggttcttctgggtcggttggtggctacccatccccagaagcctggctgcattcccctataaggaggcttcggagggcccgactgggtttcccctccagggcaccgggtcgcaaaagcggcgtcgaaaactcatgaacaggcggccgggtctggggccgccggggcagtcgtggcgtgcgggggcgggggtcctgcccatcaggctgacttcagggtctcggtctgcggcctccctggccgtcgctgcctccttttccaggtgcgcctcggcccagggctcccagccaccaccttggggccgcagaaggcgagcggtcacaccggggctgaggtcaggagccggctcaccccctctcctgcgactgttccctgacctgcgactgttcggttctcccgactggccttggtcgttgccttttagggtctcggtgtgaccaactaagcagacactcagcggcagcgccgcgcttggggagactgcagggcagaaatgggcctagaggtgaaggagcccttcccaaatcggacagtcccggggctggagagccgggagcaacccagttccctgaagaaatgattgcagctgctcaggcaaaacacgtaggcctggaaccaaccctgggtgggcgtttaagggcttgagccagcttctgcccctcaagactccccagggagcacgcgcctgcggggaaggacgtgggccgggtggaaggtggcccggaaccccgggaagaacgcgggcagggcaccaggcaggcagccgggccagcgcctccagctcccgcaccttcggcccagggtctccagcactgggaaggcgacagcggcgacagtgcaccgtcccccttgcacgcactgaggagcctgtcttggagctgagacctcctcgccccctccgagcttactgagcacccggccggcagccccccgactccccaggatg

SEQ ID NO: 124217 - DNA, 239 bp, Homo sapiens
  misc_feature 1..239: note = chr5:2743505-2743744
  misc_feature 1..239: note = Hyper
  source 1..239: mol_type = genomic DNA
gcgccccggtgctctcggcagcccccggcccccggggcccacctgagattaaagcgcgaattccgataaatcagctctaaggaaaccctgggccgcggagagcagaagggctgtcgcggatccaccacgcgggcgccgggccgcggagccgggagcgcgcccaggcctgcacccgcagcaaagccaaggccaccgccccaaagcccatctgctcctggtcgccccgttttgccgacgtc

SEQ ID NO: 124218 - DNA, 110 bp, Homo sapiens; identical to SEQ ID NO: 93760
  misc_feature 1..110: note = chr5:2747745-2747855
  misc_feature 1..110: note = Hyper
  source 1..110: mol_type = genomic DNA

SEQ ID NO: 124219 - DNA, 1646 bp, Homo sapiens
  misc_feature 1..1646: note = chr5:2748083-2749729
  misc_feature 1..1646: note = Hyper
  source 1..1646: mol_type = genomic DNA
ccaacggcagaaaagcggattcaactctgactccttaacaagacaccgaaacacacccaggctcattagggcgacacgctgtaatttgaatttcgtggcaatctgggtttgccgaaactaagacagccacgatagtaatagtcaaaataacagtaaattaagtaaaaataaataataacagggcaagtctaaaaagagggccacaccttctttggcttccatctcgccctccgccctcactctgctaattctgggtcccaggagtggccccctggatcttcttcccggaccctccctcgggtctcccgggcgctccgcctccccggggctggctctccctcccctcccgggcgccgccggccgcgggccgcctacctttcttgggctcgtagccgccgcccggggaccggtagtgggactcgagcgggtgcgcgcccgccttgcccgcgtcgctggccgcctttggcgcggtgtgcagggcctcgccgggggccgcggccgcagagttgtaccgcaggagaccctggccctgcagcgccgcgttcaagttcccgtagtttgtgtagttgccgtagaagggcgacgtgtagtagagggggcggcccagcagcggcgaggcagggtagggcgagcctcctggcggtgccccggttgaggccggcgcggcggccgcgggcagccccggtggcccgcagcccgggcccaggctcggctgcttgaggtccgacgtggcgatctcggccagcgaccacagcttgggcttgctggcggggggcggcgcgcccggagacgtccggctgccctggggcgtcttgcggccaccgcggggcgcggcctcgggcggggggctcagcagcggcgcctccaagccggtaagcggcgacgaggtcacgggcttgggcggcgccaggccccgctcgccctcctcgtcgtcgtcctcgtcgtcctccaggtcgtcatacttgtccttgcactccgagcccgattcgcacagggggtccccggcgcggcacggaagcttctccccgtccgactcggccgagcacgagtgatccgtgagcgagtccacgtgcaggctgatccctgtgggggcgcgggcacggtgggtggcacgaggggacagcgcaggcacctggagccccctccgccccctgtcctgcggcactgggccctccccacgggacccctcacctcgcccccacccggccacgtgacaggcggagcctgacctccccgggaagggcccgaggaatcgctcgctcaaatcccggcgaccccagggcaatgtggtgcggctggggctccggcccggacctggggtgtccggcgggcaacgtcctccccgccttagctctgcgccccgcctgggaagaaagcgccccgagaccttgcgccggccgctgcccgctcaccttcgtcctctgccgaggtctccgtgccctcctgcgccttgtcgggactctcgtccttgcttctggtagcgtcgccctcgtcctcgtcctcatcttcgcttttgtttctcggggcccaggtcatcttgttctccttcttgaggcgccggcgcgcgttggcgaaccaggtggagacctgggtgagggtcatcttggtgatgatggctagcatgatcttctcgcccttggtggggt

SEQ ID NO: 124220 - DNA, 114 bp, Homo sapiens; identical to SEQ ID NO: 93765
  misc_feature 1..114: note = chr5:2750008-2750122
  misc_feature 1..114: note = Hyper
  source 1..114: mol_type = genomic DNA

SEQ ID NO: 124221 - DNA, 665 bp, Homo sapiens
  misc_feature 1..665: note = chr5:2750703-2751368
  misc_feature 1..665: note = Hyper
  source 1..665: mol_type = genomic DNA
tttgaaagcatggtccgctggacagagtaaggccgaaacctgggcgcctcgggccggactccggagccgcagctgaatgctcggctcctgggcctaactcggtgacccccaccgccctgagccccgcgagtgaatgcgaaccgcccggccgtcggctcagaggccgcagtgacgcggaccctcgcgccccacgccaatgcaggcgagcacacagcccgctccgaacgcctccccaggctgcggtgcggaaaccagggacaaacggcgccagaccccggccccggcggagacgcacttcccaggctctcagagaaaatcagccggcgagccgaggggacgcgcggggggcgcgcgggtcccggccgggctcagggacgtccccgcctgccgcgctgccctccccacccggggcccggctcagcctgcggggcggccaaccgagccggcgactcctgagtcgccagccgcgccacattcccggcggcccccgcccgccgaacccgagccccgctccgcctgagccccgtctgggtcccggcgcccaggagtcccgcgtcccgcccgcgcccggttaccatgtaggacgggaagccggcggcggcggcggcggcgtcggccgagtactgcagcgggctcccgaagccggtggccgcctgcgccgtgaa

SEQ ID NO: 124222 - DNA, 1915 bp, Homo sapiens
  misc_feature 1..1915: note = chr5:2751657-2753572
  misc_feature 1..1915: note = Hyper
  source 1..1915: mol_type = genomic DNA
gggtactagcctgggcggcccgcgggccggggcggcggcggggtggcggtggcggcggcagcagcgcggagccggtgggcgcagccgcgcgccaggccggcggtcggggtttgggggagtctggagtcgggagtgaggagttgaggaaggagcgctcgagtttccgagggacattggaacgcgcagctgtccatcacgcgctcatctgcatattcgggggcccgcccctcccctgctccgcccgctgcagcctccgggccgcggccgggggaggggcagagagacgggagggaggcgggggagggcggaggcgacggaggcgggcggcgggagggaccggcaggcttttgtggcgcagccgcctctctagcagctccggccccagcccgcggctcgcggacctgcagcccagcccggccgcgctgcgtgccccggcgcgcacccctcccactcccatccactcggagccacgtcccctgcccggctccggccggctcccaccgtccccggccaccgtcttcgcccctgcccggcccccgccccttccagccactaccccgcccccacccccttctccaccctcacggactaggcagaggccgcccgcggtcaggccaggccgggtccaattaggggactcacagcctgccccgctgtgcaccccgaggaggcccggcccctgtgtccaatccggaagtcgcagggaagtggggaggtcaggatggtggcgcccgcggctcgggtcttcctccgggcagtgcgcgcggctctcacttccacggtcccggacctgctctgcctcctggcccgaggctccccgcgtggcctcgcgtctggtcgcctacccctcgcggtccactccgcccagcatggacctggatccggggcgccttggttgcgaattgccaggagggccctgaggtgagctttctgcccccaaatccgcagcgcaacccccggggccctgaacgttacgactttccactgttgggaatgacgccagggcttcagctaagaagacgccgtcccctaaagagttttattttattttgtttttctaagttgactcctctttcagatttgtgttgtcaaaacactggggggatgattgttacctgacaaaccgcctctggcaggacctgaagcctcccagtcacgtcgagaacgggcaggagctcaggttggcgccgccggtgcagtgggcattacaggtagctcaggtgacgcgcggctggagtaggggggcggttgccttgcggggctcagaagcgaggcggttggcgagggttcctaggaccccagcttcctagaaccctctccccatcacgcttctccaacccttttccactcggggatggccgaagagggcgtctggctgcccactccgaagggtcacctatggggggcgctcagggggatggaagagtgtcaggtctgtgctggcctattgggagcacccacccagcaggtgcctctatcctcggaagccgtctcgggtgggtgcggtggagaagagagagcgcagtggcctggggcgggcctcagctcaggcctgcagccgactcctgcacccctgctggccctgcagcctgcggagcagccttagtgatctcaggacgcagggcatgttgcggcctccctgtggtgcggctgcagcggcgcggagggagcggagcccgggttgccagtctggtccagggcgcaagagaaacactcacggcatcaggctgtctttccccaggtgcaagggaaccagttgcaaactgcagtgctgtgcttgaggatggctcctcctgagccggcaggctcccggtaggcgcggtccaggcacgttacccctcccgccaggagctcccgagccgagccactcgccccctaccagttatcccacccaccccttcgcccacactgctcc

SEQ ID NO: 124223 - DNA, 255 bp, Homo sapiens; identical to SEQ ID NO: 93771
  misc_feature 1..255: note = chr5:2754365-2754620
  misc_feature 1..255: note = Hyper
  source 1..255: mol_type = genomic DNA

SEQ ID NO: 124224 - DNA, 30 bp, Homo sapiens; identical to SEQ ID NO: 93772
  misc_feature 1..30: note = chr5:2754878-2754908
  misc_feature 1..30: note = Hyper
  source 1..30: mol_type = genomic DNA

SEQ ID NO: 124225 - DNA, 2588 bp, Homo sapiens
  misc_feature 1..2588: note = chr5:2755142-2757730
  misc_feature 1..2588: note = Hyper
  source 1..2588: mol_type = genomic DNA
ccaaagaatttagaacgagtctacgtggacacgcaagtttcagcgagcggggatttcctgcgaggccgagcgcgaggaacagccggccccggaggctcgggctcggggtctccccggggacgcggccgactgagaaggccggggcgctcgccgggcgcggcgccgtcctccgtgtcgcggggacggaaggaggcgacgcaggccaggagtcgtgcgcgcgggcggcgagggggcgctgtggcccgtgtctgccggcccgagtcccggcaacggtgggcgcgacccacctcctcccccggcggcttaattcggggaagaagaaaaaacggcatcgaggcatttcaataaaacctaagcgactcctgatcctttctcattgtggttccttatgagctttcggtgtctggcggggaaacagttaccgttcgggggtgtggcaaacttttttggcaattaagatgaaacagacgcttttatgtgggtttcctttaatgaagtaacattggaaatgtaagtagtttcagtgcatcaaatcacatcgctaccgtattcgcggtcaccggccctcccgttccagggctccccgcgtttgtcgagggagagagcgaggcaggaacagggggccggggacatgagaagtttggctaagaaatttttcttttctttgaaaacaaaagcgttgttataaatggaacaaaatttaagtcaacatggaacccacatctctttcaaacgtcgtttctaggtctagtactctgtgagtaggttggactggatttcacgctcaaccggcatttctaggctctcaaagacgcttccgaggcctaaatgttttcctggaaaacacgtgcagaggagcatccgtggaagactgaaaggtccccgcagctccagtcctggcaggatgtgcaaggcctctcgaggttttcaaatgggcccccgaggcctgggagatccccgagtagccacgcgggcgccacttcagggacgcggggcggcggctactgtgggccgggagggcccccgcacgggctgctctgagcgcctggacccgggaccctgcgcgcgctcttttctttttctttcgtttctttctttcttatttataatttacattctagggacctcgtattcagctaaccagctcttgcttacttaactgccctgttttcagctccggatttctgggaggtctccccatggctaacttgtccctcccggcatcctttagcgctctgcaaaatttgccttcctcccacagatgccccgcctccgacgtgcttcctgaagtttctctcccgctcagggtgcccacaatcctgaattctccagcatctcgccgactccgtctctaccctcctctccttcctaatctcgcgctggcttcgcccttttctctctcctcctccttcctacgcgccccgccccctccccccaggtcgcacctctccccgcccgggtcgggagcccctcgtggccaggcgtccgcgcggctcaagaccgaggtccgccacgctgggccgctcgtgggcggctctcacccggcataccgtggaaacggcgcgtcccgccagctgcggctccagcctgggagggagcgcagcgcggggagcctgcagcgtctggagagtgaggaaaagggacattccttggaaatggacagagccgagttccttaaagggatcgcagttgaaagagaccctcttcaaaatcagcaacgacctggcagccttagttcctcaacaggagatggttcgaagatgaaatgtttgaaactccgccgccgtttcacctttgcacacacgcgcacggcaggcccagatccgcacagagacgcagacacgcgcgcgctcgcgcttcccggagaggtcggcgcgtctcgctgaagctgttctggtcaagtggagttgtcagggctttgttttgtttttgttttgtcttttaaatgtgttttacaagacagtcttcagcagaacttagctccctcaaccctccgtccctccagcagctcctccgtggctctgcaatcttctgtttaaacaccagagcgcacctcggtgctggcctcggcgggggtgcggggtgcgggtcgcggggtgtgcggtcacccaggaggctgcgaagagtgcaggggtcagctccatcccgacgaaagcagataggactcctcgctcgcaagaaacactggagaaaagaaaataattcctcgagtgtttttacaattattttaatccaaccagcgaggctctaaagagcgtttgtcttgaggccgtgttgaataccctttgccaactgtaaattcggcgtgtgtgcccgaaactgctagccctgaccaggggctcggcagcacatggccaggcacacaccgaactcctccttcccaaatccttctgcaggatcctacacccctggagtatataggcagcgggaggggagggttgggttttgctttctttgctttttatttttattttttaatatggctgggaatgcagaaattttaaaaatggatacatttgagtgtgttaaaagtaaaaacttctcttggacaaaacataaactgctaaccgcaacgggggagaagatat

SEQ ID NO: 124226 - DNA, 39 bp, Homo sapiens; identical to SEQ ID NO: 93775
  misc_feature 1..39: note = chr5:2865625-2865664
  misc_feature 1..39: note = Hypo
  source 1..39: mol_type = genomic DNA

SEQ ID NO: 124227 - DNA, 30 bp, Homo sapiens; identical to SEQ ID NO: 93776
  misc_feature 1..30: note = chr5:2889717-2889747
  misc_feature 1..30: note = Hypo
  source 1..30: mol_type = genomic DNA

SEQ ID NO: 124228 - DNA, 196 bp, Homo sapiens; identical to SEQ ID NO: 93777
  misc_feature 1..196: note = chr5:2890721-2890917
  misc_feature 1..196: note = Hypo
  source 1..196: mol_type = genomic DNA

SEQ ID NO: 124229 - DNA, 100 bp, Homo sapiens; identical to SEQ ID NO: 93779
  misc_feature 1..100: note = chr5:3000087-3000187
  misc_feature 1..100: note = Hypo
  source 1..100: mol_type = genomic DNA

SEQ ID NO: 124230 - DNA, 167 bp, Homo sapiens; identical to SEQ ID NO: 93780
  misc_feature 1..167: note = chr5:3027341-3027508
  misc_feature 1..167: note = Hypo
  source 1..167: mol_type = genomic DNA

SEQ ID NO: 124231 - DNA, 63 bp, Homo sapiens; identical to SEQ ID NO: 93781
  misc_feature 1..63: note = chr5:3028232-3028295
  misc_feature 1..63: note = Hypo
  source 1..63: mol_type = genomic DNA

SEQ ID NO: 124232 - DNA, 322 bp, Homo sapiens; identical to SEQ ID NO: 93782
  misc_feature 1..322: note = chr5:3031752-3032074
  misc_feature 1..322: note = Hypo
  source 1..322: mol_type = genomic DNA

SEQ ID NO: 124233 - DNA, 37 bp, Homo sapiens; identical to SEQ ID NO: 93783
  misc_feature 1..37: note = chr5:3051179-3051216
  misc_feature 1..37: note = Hypo
  source 1..37: mol_type = genomic DNA

SEQ ID NO: 124234 - DNA, 41 bp, Homo sapiens; identical to SEQ ID NO: 93785
  misc_feature 1..41: note = chr5:3078657-3078698
  misc_feature 1..41: note = Hypo
  source 1..41: mol_type = genomic DNA

SEQ ID NO: 124235 - DNA, 36 bp, Homo sapiens; identical to SEQ ID NO: 93789
  misc_feature 1..36: note = chr5:3114736-3114772
  misc_feature 1..36: note = Hypo
  source 1..36: mol_type = genomic DNA

SEQ ID NO: 124236 - DNA, 112 bp, Homo sapiens; identical to SEQ ID NO: 93793
  misc_feature 1..112: note = chr5:3122092-3122204
  misc_feature 1..112: note = Hyper
  source 1..112: mol_type = genomic DNA

SEQ ID NO: 124237 - DNA, 40 bp, Homo sapiens; identical to SEQ ID NO: 93794
  misc_feature 1..40: note = chr5:3142468-3142508
  misc_feature 1..40: note = Hypo
  source 1..40: mol_type = genomic DNA

SEQ ID NO: 124238 - DNA, 301 bp, Homo sapiens
  misc_feature 1..301: note = chr5:3197714-3198015
  misc_feature 1..301: note = Hyper
  source 1..301: mol_type = genomic DNA
ttgcacatccgttatcgtggctgcttgatttccgtagaaatcaatctaaagaacccgcggtcctgtggcgtgatttcctgggactgacttcctggagaggctactgcgggatgtgaggggctggcaggagcggccctccctggccttggccattgtctttccggagaggcattctgcccccgctcccgtcacttgcgatgagtcccctttcccagagcggcgcactctccaggccagcagcacaaaagattgctttgctcaatcttgagcttgggtgcgcccggcacgagctccgtgacga

SEQ ID NO: 124239 - DNA, 134 bp, Homo sapiens; identical to SEQ ID NO: 40464
  misc_feature 1..134: note = chr5:3221047-3221181
  misc_feature 1..134: note = Hypo
  source 1..134: mol_type = genomic DNA

SEQ ID NO: 124240 - DNA, 30 bp, Homo sapiens; identical to SEQ ID NO: 40465
  misc_feature 1..30: note = chr5:3269777-3269807
  misc_feature 1..30: note = Hypo
  source 1..30: mol_type = genomic DNA

SEQ ID NO: 124241 - DNA, 191 bp, Homo sapiens; identical to SEQ ID NO: 93832
  misc_feature 1..191: note = chr5:3273116-3273307
  misc_feature 1..191: note = Hypo
  source 1..191: mol_type = genomic DNA

SEQ ID NO: 124242 - DNA, 17 bp, Homo sapiens
  misc_feature 1..17: note = chr5:3283330-3283347
  misc_feature 1..17: note = Hypo
  source 1..17: mol_type = genomic DNA
ggcgcacacacatgaac

SEQ ID NO: 124243 - DNA, 580 bp, Homo sapiens; identical to SEQ ID NO: 93842
  misc_feature 1..580: note = chr5:3324753-3325333
  misc_feature 1..580: note = Hypo
  source 1..580: mol_type = genomic DNA

SEQ ID NO: 124244 - DNA, 35 bp, Homo sapiens; identical to SEQ ID NO: 93846
  misc_feature 1..35: note = chr5:3339624-3339659
  misc_feature 1..35: note = Hypo
  source 1..35: mol_type = genomic DNA

SEQ ID NO: 124245 - DNA, 30 bp, Homo sapiens; identical to SEQ ID NO: 40467
  misc_feature 1..30: note = chr5:3422389-3422419
  misc_feature 1..30: note = Hypo
  source 1..30: mol_type = genomic DNA

SEQ ID NO: 124246 - DNA, 30 bp, Homo sapiens; identical to SEQ ID NO: 93858
  misc_feature 1..30: note = chr5:3452425-3452455
  misc_feature 1..30: note = Hypo
  source 1..30: mol_type = genomic DNA

SEQ ID NO: 124247 - DNA, 263 bp, Homo sapiens; identical to SEQ ID NO: 93859
  misc_feature 1..263: note = chr5:3454166-3454429
  misc_feature 1..263: note = Hypo
  source 1..263: mol_type = genomic DNA

SEQ ID NO: 124248 - DNA, 184 bp, Homo sapiens; identical to SEQ ID NO: 93865
  misc_feature 1..184: note = chr5:3487829-3488013
  misc_feature 1..184: note = Hypo
  source 1..184: mol_type = genomic DNA

SEQ ID NO: 124249 - DNA, 158 bp, Homo sapiens; identical to SEQ ID NO: 93867
  misc_feature 1..158: note = chr5:3535627-3535785
  misc_feature 1..158: note = Hypo
  source 1..158: mol_type = genomic DNA

SEQ ID NO: 124250 - DNA, 30 bp, Homo sapiens; identical to SEQ ID NO: 93868
  misc_feature 1..30: note = chr5:3536520-3536550
  misc_feature 1..30: note = Hypo
  source 1..30: mol_type = genomic DNA

SEQ ID NO: 124251 - DNA, 572 bp, Homo sapiens
  misc_feature 1..572: note = chr5:3590331-3590903
  misc_feature 1..572: note = Hyper
  source 1..572: mol_type = genomic DNA
gtcatttcaagaaggcggagatgcaaacacaacacggagaggggatgtctcctgtctagagattccagggcagtttcagcttaaggctgcgggttaaggttagcgggacccgttgggaagccacagtgatcccagggctctgggtcactgcgggtgcgggtgcgggtgcgggtgcgcacagccagggatcctggcgggagccactgcggtttcagctgcatccgataggccccaagcgggaggcgattctgaggccagcgctggcccaaagaccagaggacctgagcaaaatgaaaagtcactttgttcctcacgccgtgcgcagcccggcctcctctaatgacattaggagccgcagccacgacggcgctcacgggggcgcagaagtcccgctggctttgatccgcgcctctccgctgccgagagctgacagtcggctgcgcagcggccccgctttcatttgtcagacacgcgtttgccggtgtacccgcgcaggcagctacacctgtactgagagaatttacatcgccttgcttcgggatggcattgatttgggacgggtgaaatacaaa

SEQ ID NO: 124252 - DNA, 347 bp, Homo sapiens; identical to SEQ ID NO: 93872
  misc_feature 1..347: note = chr5:3591111-3591458
  misc_feature 1..347: note = Hyper
  source 1..347: mol_type = genomic DNA

SEQ ID NO: 124253 - DNA, 180 bp, Homo sapiens; identical to SEQ ID NO: 93873
  misc_feature 1..180: note = chr5:3591857-3592037
  misc_feature 1..180: note = Hyper
  source 1..180: mol_type = genomic DNA

SEQ ID NO: 124254 - DNA, 380 bp, Homo sapiens
  misc_feature 1..380: note = chr5:3592501-3592881
  misc_feature 1..380: note = Hyper
  source 1..380: mol_type = genomic DNA
gtcaccccccattgccgagcttcgcggggtcttgccagccttctgggccacgtgccttgggtccccggagcactggggcccaagggcttccggactggatccccggcgctaagcaggaggagctccgattccgctgcgcagcgacccctagacctggttttgtcaggctcctcgtctttgtctctggcacagtgaccagggggcagccaccgggtgcggccagctccgccaggagcaacttccggagcagcggcagggcctgcctcagccaccccctttggaggcaggaaaagtggctgaggggccaacaaagtggctctctcctgcctcagaggtccagcgcctcacagctggggcgtcggtttcgaaggccaagcaga

SEQ ID NO: 124255 - DNA, 2963 bp, Homo sapiens
  misc_feature 1..2963: note = chr5:3594047-3597010
  misc_feature 1..2963: note = Hyper
  source 1..2963: mol_type = genomic DNA
gaggaggttgaagatcggaaatctgtcttagggttagaaggtgtctggtggtaggctggggaacaggaaaaagctgcagttaggggcttcccggatttgtgtcaccaagaatccactccccaccaaccctcggcgtccccacaaacccagcccggaatctatgtaaaagcaggaaaggaaccctggaggttgtaggcggatcctggagtgtggaggggcgaattgagcgcgggaagcagcatgactagcaagacaatctgactcagagcagggaaaaatcaagcccgatgtcggagctggttattagtaattactaccatcacgggcattattgttgctaattataggcgatgtctcagtgtctgtcctcaggcccggaaaaccggagcccctcctgatgctgctgaagtccctgggcctcgaggctccgtgaagagagggaagcgaggcagggggtgaagggaccgcctggccggtgtccaggatacgggtggctcaaaccaccagcagaacagcatgccgactctggcccgatggccgccttcatcccgtagccccaacccggcctaaagccgagaagacgccagagtgcgctgctgaaattcccgcggagtccggtgtgctggagagccgcagcggggtgaactcccggccccgtctctgcgtaggaggtggttcgcaaagtggccccgggagccgggactggtacccggttccccacggcaccgtccggagctctccagccacgaggcgcagaagtggcctgccagcgccttcccaggctcagggaggcgaggaggcccgtgcacttggcatcttctcccgggagccgcacggccagggccgcggcgaaacggagcccatctcaagtgcgccgcgcctggccgcgtcctgtagcccgacgaggctgaggatggagaggggagacgcagggagaagagggacgcgggacttggacccaagaggccgctccgttgccggtctggcggcggcgccgactcgggttcgcgcgttccacacaagtttcctgtctgcctctgcacacctggtggacaaaccgggcgtccaggccacaccgtcttcccccttcgcgggggcgcgggggatgtttccctccggctgccagggggctttctgggtgaagagaaagcccctccccccgcgtctcccccacccctccctccgagaacccgcggcgccgactgcgcctgcttcccccgagctggcgacttctccgcgggatttgccctcgctcaaagtttgcacaattgaaagagcccgcagagctcggccgctccccgcttccccaagggcggcgaggccggtcattggcagacgatcggttactacccagtaggggcccacgggaacccgcatctggagtcgggggtgtcacgccacgccggttcagtggctcgcggagagcgtccgggtgcacttctgccaaagatgtcccctggaggccccggccgcgcgggactcgggggagaggccgctcccccctcgctgtcaccagcgtccaggccgccggccccttccccgctgcccaaacagtagaaaagcaggcgccaagttgtttttgttaaaaaggggacacacctcggccgcgaaactgcaaacccggtgtcagacagctgtaaacccgtgtcgacaggttgtcagacagctgcgggggctggtcgggaaggagcccacggcctccgggcccacaccccgccgccccgacgcgcgcgcccaccgcgagagtagctggccgggccggcacggggcaccacgtgctcgcgggaggggcgggagcggccggcgagggcgggcgggaggcagggagggggcgggaggggagccaggggcggggcctgcgctcaaggggatgccaatcaaagcatcaacttcaaattgtgtctgaaagccccgccgccgagcggagggcggccgccgcagtcggcgcgcgattgcggatccgggcgcagccgggagccgggcgcctgcgagcaccgggcagaggagccgcgaccggcctccatctcccggcccgcccgagcgcgcccggccggccgcccgctcctccctagacccctcgcggcgccccctgcaaccccctccggccggcctccgcctccctccccgcgcctttaatactcgcccgctgcggcggtcgccgagtccgcggacatgtccttcccgcagctgggctacccgcagtacctgagcgccgcggggccgggcgcctacggcggcgagcgcccgggggtgctggccgcggccgctgcggcggctgccgccgcctcgtcgggccgaccgggggccgcggagctgggcggcggggcaggcgcggctgcagtcacctcggtgctgggcatgtacgcggcggcggggccgtacgcgggcgcgcccaactacagcgccttcctgccctacgccgcggatctcagcctcttctcgcagatggtgagtgcgcccggcctcccccgcttctcctctgtctcacccgcgccagggcaagggtggcgggtcgcccgggagggagagactacgggtggacctggtccggaagaggaactagaaaggtccgggggcaggttcccggtggccgaggccgcggcccccggggacgcaagagggctgggaggccgggcgggtgacggctgggccatctcggcctgggaaagcggaaggcccgggccagggagcgggtagcgagtgaattcagagaggccgcagaagcaggcccgtggagcggtgcccgcgctggaggtcgggggcaaactcgcctggctcggccagggcgcccgggcaggcccacggggttcctgcaggtcggcccggcgtagcgtagcaggacttcccttcctggccgcgggttccactcgcgcggcctctttagttttcgaaccgagtctggaaaacttggttttctccctctttagcagctccgagatagttgtatccgagtttgccagaca

SEQ ID NO: 124256 - DNA, 510 bp, Homo sapiens; identical to SEQ ID NO: 93881
  misc_feature 1..510: note = chr5:3597357-3597867
  misc_feature 1..510: note = Hyper
  source 1..510: mol_type = genomic DNA

SEQ ID NO: 124257 - DNA, 30 bp, Homo sapiens; identical to SEQ ID NO: 93883
  misc_feature 1..30: note = chr5:3598863-3598893
  misc_feature 1..30: note = Hyper
  source 1..30: mol_type = genomic DNA

SEQ ID NO: 124258 - DNA, 2007 bp, Homo sapiens
  misc_feature 1..2007: note = chr5:3599364-3601371
  misc_feature 1..2007: note = Hyper
  source 1..2007: mol_type = genomic DNA
ccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctggtcgctggcggagacagccacgagccccgacggtgcgcccaaggcttcgccaccaccacccgcgggccaccccggcgcgcacgggccctccgccggggcgccgctgcaacaccccgccttcctgcctagccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaatggagacaaggcctcggtccgcagcagccccacgctcccaggtacagctccaggccgcgtccacctgtcccctagctgggaatgcagaggcctggctaggtgtggtagcgtggggtgcagcatgagccgggagggtaccaggcagtggccgctgagccctggggctgcgcttaatccctgcttcaatttagaaagccagacaaggccctagggctctcccaagagagctttgccctaccggcgggcctgctacggggtggtggtggggtgaggggtgacgtttttcggcgaatctgcctgggcagccggcagaagttggtgggaaggaggcctgggacctctcccgcccgtctctccgtcctaactctgcctcttccgatctctcgcagagagagacctcgtccccaggccagattcgccggcacagcagttaaagtcgcccttccagccggtacgcgacaagtgagtgctgtttgcttttgctatgggagaaggcggtggggaggggggaggaggagtggtcgggacccgggcggagctggctgggtggcggtgggggtcgcgcagtcctagttgaaggagcgctccccgccagccctgggcgccgggcgagccgaggagactggagtttctccccagccgggagccgcgctggctgtcgaccccgcccccagggctccgctactggaaccggcgtcgcccggcgctgcgtcccccactcacagtgcccctgtcttcttgtctcgctgtgtttcccatgcagctctctggccccgcaggagggaacgccgcggatcctagcagccctcccgtccgcctgattaagggtcttcttttacttttgcgggggggaggggggaggagttggggagggagggaatgtgggaggaattaagacaaatatttcagactggtgtaaaggacaaatatgacaacgacgtcaaggactcgcatccgtcgctttctgcagaaaggggcttcttcggtcccgagctcgcgtccaggtggccaggcctctgccggcggctccagtggctg

SEQ ID NO: 124259 - DNA, 49 bp, Homo sapiens
  misc_feature 1..49: note = chr5:3602466-3602515
  misc_feature 1..49: note = Hyper
  source 1..49: mol_type = genomic DNA
cagcatcagtgggttcggagcgggacgcgcgccacgcgccgcagcaggc

SEQ ID NO: 124260 - DNA, 653 bp, Homo sapiens; identical to SEQ ID NO: 93890
  misc_feature 1..653: note = chr5:3602804-3603457
  misc_feature 1..653: note = Hyper
  source 1..653: mol_type = genomic DNA

SEQ ID NO: 124261 - DNA, 880 bp, Homo sapiens
  misc_feature 1..880: note = chr5:3606268-3607148
  misc_feature 1..880: note = Hyper
  source 1..880: mol_type = genomic DNA
ttaataagtttctcacgaagaaggagtctgccttaggcccacggaagtcaccacgtggcctgggactgaggaggcttcaggagcgacctaaaatgttaggattgctctaaatgaggaggcagagaaagggcggccttgaacccgggagggagcaagggatggagctgcgccctgggtggcaagacatggcaagccaggcagctgggacctagagaaggctcggccgcgccgcaggatcccaggctgtgggcctgaatggtgaccacgcggagtcggagtcagctcgcgtccgcgccgtcccagctccccgcctgaacccggcgcccctccgcgaggaaaggccggccctggccctttctgggcagtgaggggggtcaggccgacccggggaagaggccgagcagtcagcgcccctccttcccctcgggcggggcataagtggccgccctctccgcggctgctgttgggcttctgaagacgcagcgggtgtctctgatcccctaatccatttatccagagtcccgagcgcaatggctggtgcggggacacaacggcaggaggtggcgggggtggagggagaccgggcactcagctagcgccaccctcctcccgccccacccgagacgctgagccacgacccaccctccacgggtcccacgccctcaggcagaacgcaatggtgggaatgacgccaaggtcggtgaaatcttccaaattgaagggcttttattttaaattccgattcccctttgaaacagccctttcgatgagggaagaagccagctcggtttctgcgtgcgtgtttatgatctacctgtgagcgcggcgctctggaaggtcacccaggctgcggacgccctgatagcggggtgacagcctg

SEQ ID NO: 124262 - DNA, 34 bp, Homo sapiens; identical to SEQ ID NO: 93894
  misc_feature 1..34: note = chr5:3613874-3613908
  misc_feature 1..34: note = Hypo
  source 1..34: mol_type = genomic DNA

SEQ ID NO: 124263 - DNA, 30 bp, Homo sapiens; identical to SEQ ID NO: 93895
  misc_feature 1..30: note = chr5:3623145-3623175
  misc_feature 1..30: note = Hypo
  source 1..30: mol_type = genomic DNA

SEQ ID NO: 124264 - DNA, 34 bp, Homo sapiens; identical to SEQ ID NO: 93896
  misc_feature 1..34: note = chr5:3639390-3639424
  misc_feature 1..34: note = Hypo
  source 1..34: mol_type = genomic DNA

SEQ ID NO: 124265 - DNA, 176 bp, Homo sapiens; identical to SEQ ID NO: 14743
  misc_feature 1..176: note = chr5:3674048-3674224
  misc_feature 1..176: note = Hypo
  source 1..176: mol_type = genomic DNA

SEQ ID NO: 124266 - DNA, 178 bp, Homo sapiens; identical to SEQ ID NO: 93906
  misc_feature 1..178: note = chr5:3724955-3725133
  misc_feature 1..178: note = Hypo
  source 1..178: mol_type = genomic DNA

SEQ ID NO: 124267 - DNA, 314 bp, Homo sapiens; identical to SEQ ID NO: 93909
  misc_feature 1..314: note = chr5:3740703-3741017
  misc_feature 1..314: note = Hypo
  source 1..314: mol_type = genomic DNA

SEQ ID NO: 124268 - DNA, 121 bp, Homo sapiens; identical to SEQ ID NO: 93911
  misc_feature 1..121: note = chr5:3761119-3761240
  misc_feature 1..121: note = Hypo
  source 1..121: mol_type = genomic DNA

SEQ ID NO: 124269 - DNA, 56 bp, Homo sapiens; identical to SEQ ID NO: 93912
  misc_feature 1..56: note = chr5:3761567-3761623
  misc_feature 1..56: note = Hypo
  source 1..56: mol_type = genomic DNA

SEQ ID NO: 124270 - DNA, 69 bp, Homo sapiens; identical to SEQ ID NO: 93913
  misc_feature 1..69: note = chr5:3775375-3775444
  misc_feature 1..69: note = Hypo
  source 1..69: mol_type = genomic DNA

SEQ ID NO: 124271 - DNA, 165 bp, Homo sapiens; identical to SEQ ID NO: 14745
  misc_feature 1..165: note = chr5:3806428-3806593
  misc_feature 1..165: note = Hypo
  source 1..165: mol_type = genomic DNA

SEQ ID NO: 124272 - DNA, 149 bp, Homo sapiens; identical to SEQ ID NO: 40475
  misc_feature 1..149: note = chr5:3856433-3856582
  misc_feature 1..149: note = Hypo
  source 1..149: mol_type = genomic DNA

SEQ ID NO: 124273 - DNA, 187 bp, Homo sapiens; identical to SEQ ID NO: 93933
  misc_feature 1..187: note = chr5:3859680-3859867
  misc_feature 1..187: note = Hypo
  source 1..187: mol_type = genomic DNA

SEQ ID NO: 124274 - DNA, 194 bp, Homo sapiens; identical to SEQ ID NO: 93948
  misc_feature 1..194: note = chr5:4083866-4084060
  misc_feature 1..194: note = Hypo
  source 1..194: mol_type = genomic DNA

SEQ ID NO: 124275 - DNA, 217 bp, Homo sapiens; identical to SEQ ID NO: 40479
  misc_feature 1..217: note = chr5:4144299-4144516
  misc_feature 1..217: note = Hypo
  source 1..217: mol_type = genomic DNA

SEQ ID NO: 124276 - DNA, 30 bp, Homo sapiens; identical to SEQ ID NO: 93953
  misc_feature 1..30: note = chr5:4145036-4145066
  misc_feature 1..30: note = Hypo
  source 1..30: mol_type = genomic DNA

SEQ ID NO: 124277 - DNA, 34 bp, Homo sapiens; identical to SEQ ID NO: 40480
  misc_feature 1..34: note = chr5:4278472-4278506
  misc_feature 1..34: note = Hypo
  source 1..34: mol_type = genomic DNA

SEQ ID NO: 124278 - DNA, 31 bp, Homo sapiens; identical to SEQ ID NO: 40481
  misc_feature 1..31: note = chr5:4279105-4279136
  misc_feature 1..31: note = Hypo
  source 1..31: mol_type = genomic DNA

SEQ ID NO: 124279 - DNA, 215 bp, Homo sapiens; identical to SEQ ID NO: 94015
  misc_feature 1..215: note = chr5:4581114-4581329
  misc_feature 1..215: note = Hypo
  source 1..215: mol_type = genomic DNA

SEQ ID NO: 124280 - DNA, 35 bp, Homo sapiens; identical to SEQ ID NO: 40483
  misc_feature 1..35: note = chr5:4629575-4629610
  misc_feature 1..35: note = Hypo
  source 1..35: mol_type = genomic DNA

SEQ ID NO: 124281 - DNA, 226 bp, Homo sapiens; identical to SEQ ID NO: 94017
  misc_feature 1..226: note = chr5:4629982-4630208
  misc_feature 1..226: note = Hypo
  source 1..226: mol_type = genomic DNA

SEQ ID NO: 124282 - DNA, 30 bp, Homo sapiens; identical to SEQ ID NO: 40484
  misc_feature 1..30: note = chr5:4630470-4630500
  misc_feature 1..30: note = Hypo
  source 1..30: mol_type = genomic DNA

SEQ ID NO: 124283 - DNA, 36 bp, Homo sapiens; identical to SEQ ID NO: 94026
  misc_feature 1..36: note = chr5:4866865-4866901
  misc_feature 1..36: note = Hypo
  source 1..36: mol_type = genomic DNA

SEQ ID NO: 124284 - DNA, 30 bp, Homo sapiens; identical to SEQ ID NO: 40486
  misc_feature 1..30: note = chr5:4867541-4867571
  misc_feature 1..30: note = Hypo
  source 1..30: mol_type = genomic DNA

SEQ ID NO: 124285 - DNA, 30 bp, Homo sapiens; identical to SEQ ID NO: 94029
  misc_feature 1..30: note = chr5:4879422-4879452
  misc_feature 1..30: note = Hypo
  source 1..30: mol_type = genomic DNA

SEQ ID NO: 124286 - DNA, 30 bp, Homo sapiens; identical to SEQ ID NO: 94044
  misc_feature 1..30: note = chr5:5049628-5049658
  misc_feature 1..30: note = Hypo
  source 1..30: mol_type = genomic DNA

SEQ ID NO: 124287 - DNA, 1374 bp, Homo sapiens
  misc_feature 1..1374: note = chr5:5139610-5140984
  misc_feature 1..1374: note = Hyper
  source 1..1374: mol_type = genomic DNA
gacccccgtggcggccgagacccaggcccatccgcagccctgagacctccctagggattgcacccagcagccagtcaccggcctccgcggcctggccagttgagggtggccgtgaccgcggggccaggagcgccgccacatctcggggcaaatggcgcgggggaagagtttcctcctcagcctccccgtctccgatcgctccgcaaactccagagcgaggcacgcgcctttaaaggcaggtccgcggctctcccacgtcctggcgcccggttttccgcacccagtgtccccacagctgtgcccgggcacagaggcgcggccagaccgcactccgcgggctgcaggtgtcccggcctctggcggcgccggtgcggcccggaggtgggagcccgcggagccactgcagtagctggagtcccgccgagtccccagccccaaggcagggcaggagcgcgcaccggccggaggtccatgctgagcatcgcccgcgccggtgcccggcagcctctccaactgtgtggtccccgcgcgggcagagaggcacggactgcaggccgtgggcagctccatcttcccgcgtcctcctcctctggcgctgcccgctgtctcccgccttccctctgctccccgctcgcctccgcctcagcgccccgctgacctcgcctcctcccctctgctctttgtccctgcactctcccctcctcggtcctctgacccccccgccctcacctcctcccctcctctctcccctgcccgccccgcgctctcccaccgctcccgccgcccccgccgccgcggctgccactccgccccccgcgccgcacggagcttcagtaataaccccggcgcggcggcggagtcgctgtggggaatcctcccgcgctctgcctgggtcgggtcctccctgcccgctcgcacgctgccggccggggaccctccggtggcccctagcccctcggagcgctcctggatgaagccccgcgcgcgcggatggcggggcttggcggcgctgtggatgctgttggcgcaggtggccgagcaggtgagtcccgggcgctcccaccagcgcggaaaccgcgggtccggacagctggaggcgagtcccccgcggctcctctcccgcggaccccgccgtctcaccgcgatgtcgccgctgttttccgcaggcacctgcgtgcgccatgggacccgcagcggcagcgcctgggagcccgagcgtcccgcgtcctcctccacccgcggagcggccgggctggatggaaaagggcggtaagtccgtgaggtgggggcttctaatccttgccatttagcagctcgtaatctccgtgccgctggtttattaggtgctgtgaatgttcacgactctgtggaacc

SEQ ID NO: 124288 - DNA, 178 bp, Homo sapiens; identical to SEQ ID NO: 40487
  misc_feature 1..178: note = chr5:5296474-5296652
  misc_feature 1..178: note = Hypo
  source 1..178: mol_type = genomic DNA

SEQ ID NO: 124289 - DNA, 30 bp, Homo sapiens; identical to SEQ ID NO: 40488
  misc_feature 1..30: note = chr5:5303702-5303732
  misc_feature 1..30: note = Hypo
  source 1..30: mol_type = genomic DNA

SEQ ID NO: 124290 - DNA, 30 bp, Homo sapiens; identical to SEQ ID NO: 94077
  misc_feature 1..30: note = chr5:5320109-5320139
  misc_feature 1..30: note = Hypo
  source 1..30: mol_type = genomic DNA

SEQ ID NO: 124291 - DNA, 185 bp, Homo sapiens; identical to SEQ ID NO: 94103
  misc_feature 1..185: note = chr5:5571260-5571445
  misc_feature 1..185: note = Hypo
  source 1..185: mol_type = genomic DNA

SEQ ID NO: 124292 - DNA, 199 bp, Homo sapiens; identical to SEQ ID NO: 94104
  misc_feature 1..199: note = chr5:5577412-5577611
  misc_feature 1..199: note = Hypo
  source 1..199: mol_type = genomic DNA

SEQ ID NO: 124293 - DNA, 30 bp, Homo sapiens; identical to SEQ ID NO: 40491
  misc_feature 1..30: note = chr5:5652506-5652536
  misc_feature 1..30: note = Hypo
  source 1..30: mol_type = genomic DNA

SEQ ID NO: 124294 - DNA, 211 bp, Homo sapiens; identical to SEQ ID NO: 40492
  misc_feature 1..211: note = chr5:5719870-5720081
  misc_feature 1..211: note = Hypo
  source 1..211: mol_type = genomic DNA

SEQ ID NO: 124295 - DNA, 30 bp, Homo sapiens; identical to SEQ ID NO: 94117
  misc_feature 1..30: note = chr5:5880192-5880222
  misc_feature 1..30: note = Hypo
  source 1..30: mol_type = genomic DNA

SEQ ID NO: 124296 - DNA, 46 bp, Homo sapiens; identical to SEQ ID NO: 94118
  misc_feature 1..46: note = chr5:5886643-5886689
  misc_feature 1..46: note = Hypo
  source 1..46: mol_type = genomic DNA

SEQ ID NO: 124297 - DNA, 109 bp, Homo sapiens
  misc_feature 1..109: note = chr5:5887137-5887246
  misc_feature 1..109: note = Hyper
  source 1..109: mol_type = genomic DNA
acagacccaggcatccggccgggtccccgcagcccgtgtgcccgctcccgcctccgccagcagagggagcgcgcggccccgcccaggcacctggcggtgacacctgcca

SEQ ID NO: 124298 - DNA, 173 bp, Homo sapiens; identical to SEQ ID NO: 94121
  misc_feature 1..173: note = chr5:5890841-5891014
  misc_feature 1..173: note = Hypo
  source 1..173: mol_type = genomic DNA

SEQ ID NO: 124299 - DNA, 88 bp, Homo sapiens; identical to SEQ ID NO: 94123
  misc_feature 1..88: note = chr5:5907706-5907794
  misc_feature 1..88: note = Hypo
  source 1..88: mol_type = genomic DNA

SEQ ID NO: 124300 - DNA, 30 bp, Homo sapiens; identical to SEQ ID NO: 94133
  misc_feature 1..30: note = chr5:6029681-6029711
  misc_feature 1..30: note = Hypo
  source 1..30: mol_type = genomic DNA

SEQ ID NO: 124301 - DNA, 30 bp, Homo sapiens; identical to SEQ ID NO: 94134
  misc_feature 1..30: note = chr5:6080787-6080817
  misc_feature 1..30: note = Hypo
  source 1..30: mol_type = genomic DNA

SEQ ID NO: 124302 - DNA, 256 bp, Homo sapiens; identical to SEQ ID NO: 94136
  misc_feature 1..256: note = chr5:6219037-6219293
  misc_feature 1..256: note = Hypo
  source 1..256: mol_type = genomic DNA

SEQ ID NO: 124303 - DNA, 30 bp, Homo sapiens; identical to SEQ ID NO: 94137
  misc_feature 1..30: note = chr5:6228545-6228575
  misc_feature 1..30: note = Hypo
  source 1..30: mol_type = genomic DNA

SEQ ID NO: 124304 - DNA, 30 bp, Homo sapiens; identical to SEQ ID NO: 94138
  misc_feature 1..30: note = chr5:6264312-6264342
  misc_feature 1..30: note = Hypo
  source 1..30: mol_type = genomic DNA

SEQ ID NO: 124305 - DNA, 880 bp, Homo sapiens; identical to SEQ ID NO: 94150
  misc_feature 1..880: note = chr5:6448738-6449618
  misc_feature 1..880: note = Hyper
  source 1..880: mol_type = genomic DNA

SEQ ID NO: 124306 - DNA, 30 bp, Homo sapiens; identical to SEQ ID NO: 94151
  misc_feature 1..30: note = chr5:6456111-6456141
  misc_feature 1..30: note = Hypo
  source 1..30: mol_type = genomic DNA

SEQ ID NO: 124307 - DNA, 30 bp, Homo sapiens; identical to SEQ ID NO: 40494
  misc_feature 1..30: note = chr5:6478603-6478633
  misc_feature 1..30: note = Hypo
  source 1..30: mol_type = genomic DNA

SEQ ID NO: 124308 - DNA, 39 bp, Homo sapiens; identical to SEQ ID NO: 94157
  misc_feature 1..39: note = chr5:6522524-6522563
  misc_feature 1..39: note = Hypo
  source 1..39: mol_type = genomic DNA

SEQ ID NO: 124309 - DNA, 30 bp, Homo sapiens; identical to SEQ ID NO: 94158
  misc_feature 1..30: note = chr5:6550961-6550991
  misc_feature 1..30: note = Hypo
  source 1..30: mol_type = genomic DNA

SEQ ID NO: 124310 - DNA, 30 bp, Homo sapiens; identical to SEQ ID NO: 94159
  misc_feature 1..30: note = chr5:6582801-6582831
  misc_feature 1..30: note = Hypo
  source 1..30: mol_type = genomic DNA

SEQ ID NO: 124311 - DNA, 578 bp, Homo sapiens; identical to SEQ ID NO: 94160
  misc_feature 1..578: note = chr5:6583176-6583754
  misc_feature 1..578: note = Hyper
  source 1..578: mol_type = genomic DNA

SEQ ID NO: 124312 - DNA, 175 bp, Homo sapiens; identical to SEQ ID NO: 94161
  misc_feature 1..175: note = chr5:6586039-6586214
  misc_feature 1..175: note = Hypo
  source 1..175: mol_type = genomic DNA

SEQ ID NO: 124313 - DNA, 321 bp, Homo sapiens; identical to SEQ ID NO: 29452
  misc_feature 1..321: note = chr5:6687127-6687448
  misc_feature 1..321: note = Hyper
  source 1..321: mol_type = genomic DNA

SEQ ID NO: 124314 - DNA, 70 bp, Homo sapiens; identical to SEQ ID NO: 94179
  misc_feature 1..70: note = chr5:6867674-6867744
  misc_feature 1..70: note = Hypo
  source 1..70: mol_type = genomic DNA

SEQ ID NO: 124315 - DNA, 120 bp, Homo sapiens; identical to SEQ ID NO: 94181
  misc_feature 1..120: note = chr5:6981335-6981455
  misc_feature 1..120: note = Hypo
  source 1..120: mol_type = genomic DNA

SEQ ID NO: 124316 - DNA, 1364 bp, Homo sapiens
  misc_feature 1..1364: note = chr5:7394900-7396264
  misc_feature 1..1364: note = Hyper
  source 1..1364: mol_type = genomic DNA
gggggctctttgggccggaccacactcgaataggaggaaacttccagaagggtgggttcctttggtgataagcaatgaagccccttcggcccccagggcgaaggccagcggcctccgctcccacgcgtgtcgggaggggacactgtccctggtgacatccgcccccacaacgctcctgccgggtctctagcgcctcctgcgtccaggcccccaaggtgacagggagggagctactcccagggccgacccgcccgctcccgcgcccagccgctctccccggcgcccctttgccgccatccccgctcagcagaggggctcggcgaggaccacgaccagccacggggcagctctgtaaacctgtgatatgacaggcttatacggcacctccaaagtgtgactgaagctgagcgtgcagggcgcaacggacgctgcccccgcgaggccgtggcgggggctcccagtgcagtcactgccgcttcacttccacatggtgccggtctccagttaggtcccctggcgtttccgcgccctgccgccctcgcagggagccccggccctctcaagagggtggagaggatgggggagccctcaaccctgctacgctgaggggaagaagggctggacggcaaaccggtgcccaccgcggggaggcgggaagggtgggaaatcctctccagctccccaaaagagtgaaaaggagggagaccccgctgtcctctgacccgcgtactaaaggagggaccccccgggtcctctgaccccggctgcgctctgtgactgtgggggagggtgggagcaggccccgcagcccactaaggggtggaggaaacaggagggtggcagcgtccctgcccgctgaccttgaggtagtggagaggagctgaggagccccgcagtgctccgagccaggtggggcggggggagtggtgggggtaggactccctccctccaccccttaggctgtgttctcacttcgtagcggggagggccgtccctcccaccccacccacgctgcactcgggatagggcagaggaggtggacgacctggtggctgagtgtgggaggccggcgggcgaggacgaccccgggccggggcgcagcgggagcccctcagttcgccactccccccaccgtacagcccccgccgtccccagcctgcagccgggccgtcgggtgggggccgacaccgcccctgcacggaggccggctgcgcgcggggcggggagcggcgggcggagggccccgtggaacccgccccctcccgcgcggtggcggtggcggcggcggcgccgggagctgcccccgaggccgccgcccggcccccgcccgcgcgtcagcgcgcccagcccggggcgccgagctc

SEQ ID NO: 124317 - DNA, 562 bp, Homo sapiens
  misc_feature 1..562: note = chr5:7396473-7397035
  misc_feature 1..562: note = Hyper
  source 1..562: mol_type = genomic DNA
gcggagacgggctgccgcggtcccgggactggctctacgagtcctactactgcatgagccagcagcacccgctcatcgtcttcctgctgctcatcgtcatgggctcctgcctcgccctgctcgccgtcttcttcgcgctcgggctggtgagtggcctccccgcgggtccagcgccgcgccttccccggccctgagaggagcccggccagccgagccgcgtcccgctccgggctgcccctcggcccgcggcagcccctcggcccgcggcagcccctcggcccgcggctccctgcttctcctgctggcccgcggcccggtggactctggcaagggctgcgggcgggagaaaagtttcctgggaaggctcttcccaaaataaagttcccgaggtgttcaccaggtggacgggcagggcgtgtgctttttgcatctttgcgcacccgctggcaaactctgcgctttccgccgggcaccgctgcccgcagcgctggaataggtcttccccgactcagccctgggcttcctgggcgagtcgctgtctcctgcccggttccactggcat

SEQ ID NO: 124318 - DNA, 30 bp, Homo sapiens; identical to SEQ ID NO: 94307
  misc_feature 1..30: note = chr5:7763815-7763845
  misc_feature 1..30: note = Hypo
  source 1..30: mol_type = genomic DNA

SEQ ID NO: 124319 - DNA, 336 bp, Homo sapiens
  misc_feature 1..336: note = chr5:7850282-7850618
  misc_feature 1..336: note = Hyper
  source 1..336: mol_type = genomic DNA
gctgacactggtagtcgcctgagctgtactctttggggcccaggcgccttggcgggagctcaccctccctgtctccccagctgaccctgccgcgcccccttcatctccgcacgctcccacccggccccctccacaggctgtccagccccgcccctcggaacccacccctggtagtgaagccctgcccccagggtccctgcccgaaggtgcgctcctcctctagggcccctctactctgtgagctctgtccccgatccctagcggtgcagcccctcccagggcccctcctcgttgtgagctcctctctccagtccccggcggcgcatccctgccccc

SEQ ID NO: 124320 - DNA, 377 bp, Homo sapiens; identical to SEQ ID NO: 29462
  misc_feature 1..377: note = chr5:7850922-7851299
  misc_feature 1..377: note = Hyper
  source 1..377: mol_type = genomic DNA

SEQ ID NO: 124321 - DNA, 209 bp, Homo sapiens; identical to SEQ ID NO: 94327
  misc_feature 1..209: note = chr5:7954008-7954217
  misc_feature 1..209: note = Hypo
  source 1..209: mol_type = genomic DNA

SEQ ID NO: 124322 - DNA, 30 bp, Homo sapiens; identical to SEQ ID NO: 94350
  misc_feature 1..30: note = chr5:8208408-8208438
  misc_feature 1..30: note = Hypo
  source 1..30: mol_type = genomic DNA

SEQ ID NO: 124323 - DNA, 23 bp, Homo sapiens
  misc_feature 1..23: note = chr5:9227669-9227692
  misc_feature 1..23: note = Hypo
  source 1..23: mol_type = genomic DNA
tttttttttttgagacggagtct

SEQ ID NO: 124324 - DNA, 215 bp, Homo sapiens; identical to SEQ ID NO: 94428
  misc_feature 1..215: note = chr5:9479707-9479922
  misc_feature 1..215: note = Hypo
  source 1..215: mol_type = genomic DNA

SEQ ID NO: 124325 - DNA, 435 bp, Homo sapiens; identical to SEQ ID NO: 94433
  misc_feature 1..435: note = chr5:9544685-9545120
  misc_feature 1..435: note = Hyper
  source 1..435: mol_type = genomic DNA

SEQ ID NO: 124326 - DNA, 355 bp, Homo sapiens; identical to SEQ ID NO: 94434
  misc_feature 1..355: note = chr5:9545496-9545851
  misc_feature 1..355: note = Hyper
  source 1..355: mol_type = genomic DNA

SEQ ID NO: 124327 - DNA, 124 bp, Homo sapiens; identical to SEQ ID NO: 29466
  misc_feature 1..124: note = chr5:9546564-9546688
  misc_feature 1..124: note = Hyper
  source 1..124: mol_type = genomic DNA

SEQ ID NO: 124328 - DNA, 84 bp, Homo sapiens; identical to SEQ ID NO: 92706
  misc_feature 1..84: note = chr5:10248589-10248673
  misc_feature 1..84: note = Hypo
  source 1..84: mol_type = genomic DNA

SEQ ID NO: 124329 - DNA, 84 bp, Homo sapiens; identical to SEQ ID NO: 92707
  misc_feature 1..84: note = chr5:10248733-10248817
  misc_feature 1..84: note = Hypo
  source 1..84: mol_type = genomic DNA

SEQ ID NO: 124330 - DNA, 16 bp, Homo sapiens
  misc_feature 1..16: note = chr5:10252583-10252599
  misc_feature 1..16: note = Hypo
  source 1..16: mol_type = genomic DNA
gggcgcggtggctcac

SEQ ID NO: 124331 - DNA, 16 bp, Homo sapiens
  misc_feature 1..16: note = chr5:10252719-10252735
  misc_feature 1..16: note = Hypo
  source 1..16: mol_type = genomic DNA
ccgtctcaaaaaaaaa

SEQ ID NO: 124332 - DNA, 299 bp, Homo sapiens; identical to SEQ ID NO: 92710
  misc_feature 1..299: note = chr5:10267147-10267446
  misc_feature 1..299: note = Hypo
  source 1..299: mol_type = genomic DNA

SEQ ID NO: 124333 - DNA, 30 bp, Homo sapiens; identical to SEQ ID NO: 40498
  misc_feature 1..30: note = chr5:10269033-10269063
  misc_feature 1..30: note = Hypo
  source 1..30: mol_type = genomic DNA

SEQ ID NO: 124334 - DNA, 398 bp, Homo sapiens; identical to SEQ ID NO: 92713
  misc_feature 1..398: note = chr5:10307528-10307926
  misc_feature 1..398: note = Hyper
  source 1..398: mol_type = genomic DNA

SEQ ID NO: 124335 - DNA, 709 bp, Homo sapiens; identical to SEQ ID NO: 92714
  misc_feature 1..709: note = chr5:10333423-10334132
  misc_feature 1..709: note = Hyper
  source 1..709: mol_type = genomic DNA

SEQ ID NO: 124336 - DNA, 212 bp, Homo sapiens
  misc_feature 1..212: note = chr5:10442313-10442525
  misc_feature 1..212: note = Hyper
  source 1..212: mol_type = genomic DNA
agatccacattcccccggagctgccggacatcctgaagcaattcaccaaggctgccatccgcacccagccggccgacgtgctgcggtggtccgcggggtaagcgcccttggcccggggagctgtccggtctacatgcccaagccagacgagcccagagagccctcctcccggaccaggggccttacgcggcactcagcgtccttaagagtat

SEQ ID NO: 124337 - DNA, 39 bp, Homo sapiens; identical to SEQ ID NO: 92722
  misc_feature 1..39: note = chr5:10464558-10464597
  misc_feature 1..39: note = Hypo
  source 1..39: mol_type = genomic DNA

SEQ ID NO: 124338 - DNA, 30 bp, Homo sapiens; identical to SEQ ID NO: 92723
  misc_feature 1..30: note = chr5:10538891-10538921
  misc_feature 1..30: note = Hypo
  source 1..30: mol_type = genomic DNA

SEQ ID NO: 124339 - DNA, 84 bp, Homo sapiens; identical to SEQ ID NO: 92724
  misc_feature 1..84: note = chr5:10563513-10563597
  misc_feature 1..84: note = Hyper
  source 1..84: mol_type = genomic DNA

SEQ ID NO: 124340 - DNA, 1273 bp, Homo sapiens
  misc_feature 1..1273: note = chr5:10564471-10565744
  misc_feature 1..1273: note = Hyper
  source 1..1273: mol_type = genomic DNA
cggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaa

SEQ ID NO: 124341 - DNA, 129 bp, Homo sapiens; identical to SEQ ID NO: 92729
  misc_feature 1..129: note = chr5:10618114-10618243
  misc_feature 1..129: note = Hypo
  source 1..129: mol_type = genomic DNA

SEQ ID NO: 124342 - DNA, 195 bp, Homo sapiens; identical to SEQ ID NO: 92730
  misc_feature 1..195: note = chr5:10630367-10630562
  misc_feature 1..195: note = Hypo
  source 1..195: mol_type = genomic DNA

SEQ ID NO: 124343 - DNA, 115 bp, Homo sapiens; identical to SEQ ID NO: 92731
  misc_feature 1..115: note = chr5:10652320-10652435
  misc_feature 1..115: note = Hypo
  source 1..115: mol_type = genomic DNA

SEQ ID NO: 124344 - DNA, 193 bp, Homo sapiens; identical to SEQ ID NO: 92732
  misc_feature 1..193: note = chr5:10675371-10675564
  misc_feature 1..193: note = Hypo
  source 1..193: mol_type = genomic DNA

SEQ ID NO: 124345 - DNA, 30 bp, Homo sapiens; identical to SEQ ID NO: 40501
  misc_feature 1..30: note = chr5:10864262-10864292
  misc_feature 1..30: note = Hypo
  source 1..30: mol_type = genomic DNA

SEQ ID NO: 124346 - DNA, 185 bp, Homo sapiens; identical to SEQ ID NO: 92739
  misc_feature 1..185: note = chr5:10915475-10915660
  misc_feature 1..185: note = Hypo
  source 1..185: mol_type = genomic DNA

SEQ ID NO: 124347 - DNA, 33 bp, Homo sapiens; identical to SEQ ID NO: 92741
  misc_feature 1..33: note = chr5:10972987-10973020
  misc_feature 1..33: note = Hypo
  source 1..33: mol_type = genomic DNA

SEQ ID NO: 124348 - DNA, 30 bp, Homo sapiens; identical to SEQ ID NO: 92743
  misc_feature 1..30: note = chr5:10986789-10986819
  misc_feature 1..30: note = Hypo
  source 1..30: mol_type = genomic DNA

SEQ ID NO: 124349 - DNA, 30 bp, Homo sapiens; identical to SEQ ID NO: 92752
  misc_feature 1..30: note = chr5:11169751-11169781
  misc_feature 1..30: note = Hypo
  source 1..30: mol_type = genomic DNA

SEQ ID NO: 124350 - DNA, 719 bp, Homo sapiens
  misc_feature 1..719: note = chr5:11384869-11385588
  misc_feature 1..719: note = Hyper
  source 1..719: mol_type = genomic DNA
tgggcgacagggtggcgtacgtgccgatggtggagctcagctggtggatgggcgaggaggagatggtggactgcacggtggggggcgaggtcacgcggatcggggacaggccggccgaggacacgacgatgttgatgggcgagctggtgctgtaggacttggccaggcggctgggcgactgcttgggcgaggagccgcgcggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgag

SEQ ID NO: 124351 - DNA, 30 bp, Homo sapiens; identical to SEQ ID NO: 92780
  misc_feature 1..30: note = chr5:11397823-11397853
  misc_feature 1..30: note = Hypo
  source 1..30: mol_type = genomic DNA

SEQ ID NO: 124352 - DNA, 35 bp, Homo sapiens; identical to SEQ ID NO: 92803
  misc_feature 1..35: note = chr5:11644483-11644518
  misc_feature 1..35: note = Hypo
  source 1..35: mol_type = genomic DNA

SEQ ID NO: 124353 - DNA, 1624 bp, Homo sapiens
  misc_feature 1..1624: note = chr5:11903368-11904992
  misc_feature 1..1624: note = Hyper
  source 1..1624: mol_type = genomic DNA
ggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggcgggcggcaggggcgagcgccgcgggcgagaggcggctcccgacgcgagtgcgcagcgcccggcccggcggcccctccgagctcggcgagcgcagcgccccctgcccggctccgcgggctccacgggctcctgcgggctcctcggggctccgggcgccgccgccagccggccgggctgagagagcagccgccgcgcccgcagctccgctcagccggctgtcgccgcgggcgcgagcctggggccgccgcggcgcccggcgccgagcgctcccgagctgcgccccgcgcgcggcccgcgccacctgtgccgccgccgcctcagccgccgagggcgaggctcctcccgcggcgcgcggcagcctcagcctccacctaaacctcggcggccggcccgggcgcccggctagtgagggagcgtccgccccgccgccgaaaccggccccgggtgcggagcatgcccagtgccgccgcgagagcggcgcttcgccgcgcgcgttccacttctcctggttttcgcggcagcagcggcagccgcgggagagaggggaggaggccgcgggttgggagagggccgagcatccttgggaacgcacgccctggacctgagatgggtggatgctccggagctaggcgaaagctggaagggacccgggaagggatggaaccccaggttactccgcttccctaattcacgtgcaaggcgctgacagttgactctggtggggcagatgtcagcctgcaacaaaggaccagggtgcgaggggtcctagagtggccaggtgggttgggggagggaggctggcggaacgtgctggtgagcgcaggtagatgctcttgcagatcctgtgattccagagctaaggaggcacgaagtccagcagag

SEQ ID NO: 124354 - DNA, 27 bp, Homo sapiens
  misc_feature 1..27: note = chr5:12351623-12351650
  misc_feature 1..27: note = Hypo
  source 1..27: mol_type = genomic DNA
agccaccgcgcccgcccattttcactc

SEQ ID NO: 124355 - DNA, 30 bp, Homo sapiens; identical to SEQ ID NO: 92874
  misc_feature 1..30: note = chr5:12805470-12805500
  misc_feature 1..30: note = Hypo
  source 1..30: mol_type = genomic DNA

SEQ ID NO: 124356 - DNA, 227 bp, Homo sapiens; identical to SEQ ID NO: 93039
  misc_feature 1..227: note = chr5:14108613-14108840
  misc_feature 1..227: note = Hyper
  source 1..227: mol_type = genomic DNA

SEQ ID NO: 124357 - DNA, 118 bp, Homo sapiens; identical to SEQ ID NO: 93045
  misc_feature 1..118: note = chr5:14142698-14142816
  misc_feature 1..118: note = Hyper
  source 1..118: mol_type = genomic DNA

SEQ ID NO: 124358 - DNA, 56 bp, Homo sapiens; identical to SEQ ID NO: 93070
  misc_feature 1..56: note = chr5:14501805-14501861
  misc_feature 1..56: note = Hypo
  source 1..56: mol_type = genomic DNA

SEQ ID NO: 124359 - DNA, 30 bp, Homo sapiens; identical to SEQ ID NO: 93099
  misc_feature 1..30: note = chr5:14726922-14726952
  misc_feature 1..30: note = Hypo
  source 1..30: mol_type = genomic DNA

SEQ ID NO: 124360 - DNA, 108 bp, Homo sapiens; identical to SEQ ID NO: 93100
  misc_feature 1..108: note = chr5:14731965-14732073
  misc_feature 1..108: note = Hypo
  source 1..108: mol_type = genomic DNA

SEQ ID NO: 124361 - DNA, 30 bp, Homo sapiens; identical to SEQ ID NO: 93101
  misc_feature 1..30: note = chr5:14740939-14740969
  misc_feature 1..30: note = Hypo
  source 1..30: mol_type = genomic DNA

SEQ ID NO: 124362 - DNA, 32 bp, Homo sapiens; identical to SEQ ID NO: 93102
  misc_feature 1..32: note = chr5:14741558-14741590
  misc_feature 1..32: note = Hypo
  source 1..32: mol_type = genomic DNA

SEQ ID NO: 124363 - DNA, 235 bp, Homo sapiens; identical to SEQ ID NO: 93103
  misc_feature 1..235: note = chr5:14756250-14756485
  misc_feature 1..235: note = Hypo
  source 1..235: mol_type = genomic DNA

SEQ ID NO: 124364 - DNA, 83 bp, Homo sapiens; identical to SEQ ID NO: 40505
  misc_feature 1..83: note = chr5:14764724-14764807
  misc_feature 1..83: note = Hypo
  source 1..83: mol_type = genomic DNA

SEQ ID NO: 124365 - DNA, 33 bp, Homo sapiens; identical to SEQ ID NO: 93105
  misc_feature 1..33: note = chr5:14774559-14774592
  misc_feature 1..33: note = Hypo
  source 1..33: mol_type = genomic DNA

SEQ ID NO: 124366 - DNA, 32 bp, Homo sapiens; identical to SEQ ID NO: 93106
  misc_feature 1..32: note = chr5:14774712-14774744
  misc_feature 1..32: note = Hypo
  source 1..32: mol_type = genomic DNA

SEQ ID NO: 124367 - DNA, 33 bp, Homo sapiens; identical to SEQ ID NO: 93113
  misc_feature 1..33: note = chr5:14886060-14886093
  misc_feature 1..33: note = Hypo
  source 1..33: mol_type = genomic DNA

SEQ ID NO: 124368 - DNA, 34 bp, Homo sapiens; identical to SEQ ID NO: 93116
  misc_feature 1..34: note = chr5:14895452-14895486
  misc_feature 1..34: note = Hypo
  source 1..34: mol_type = genomic DNA

SEQ ID NO: 124369 - DNA, 145 bp, Homo sapiens; identical to SEQ ID NO: 93125
  misc_feature 1..145: note = chr5:14967329-14967474
  misc_feature 1..145: note = Hypo
  source 1..145: mol_type = genomic DNA

SEQ ID NO: 124370 - DNA, 28 bp, Homo sapiens
  misc_feature 1..28: note = chr5:15292060-15292088
  misc_feature 1..28: note = Hypo
  source 1..28: mol_type = genomic DNA
aaataggaaaagctccggtttacagctc

SEQ ID NO: 124371 - DNA, 109 bp, Homo sapiens; identical to SEQ ID NO: 93177
  misc_feature 1..109: note = chr5:15499838-15499947
  misc_feature 1..109: note = Hyper
  source 1..109: mol_type = genomic DNA

SEQ ID NO: 124372 - DNA, 995 bp, Homo sapiens
  misc_feature 1..995: note = chr5:15500299-15501294
  misc_feature 1..995: note = Hyper
  source 1..995: mol_type = genomic DNA
agtcttcactcgctccggggacccgcaacaagtggccgccgcgccctccccggggaagccgcgggcgcgcaggggcagccgaaggaggcggtcgagccgcggagcccaggggcctgcccggctcagcgcccaccggaggggatcggggcgggcggatggggacccggcggcggcggcgcggtgagcctctgggcggccccggggcgcgggctgtgcgcggcgctgcgcccgccggcccccagcgcggattgtaagtgctgcagctgtgcccggccccgcctggagccaccgggggtgccaggaggggacgcagcaccccctcccactggagtgcggggacctctccaggccggaggtcggccccggagcttgggggggatgtgcagctaacggtcccgtcgggcgggctttcctcgggccgagcgcgcaggacgtgcgccgcagctatggagtgtcccgggagacggcgggcatgacggctacaggatgggcgcgaacaatggcaaacagtacggcagtgagggtgagtgggccgcccgtcctcagactcccggatcgcgtccctcctcccctttccctcgccctcccgactgggaagggaggttctcgcccgcggccgtgacgcaccccatttggcaccctgtctgggtcaccaccttctcctttggcagtgagtgaccagtgagtaggtcaggcgccccgaggatgcttttccactgtgggggtctctttaagcaacttcccagtttgtctttgggaaggctcaagttgcatctctgctgtgtttctgagcacatatgccttaaccttccttccctgggcatctggggtttaggagatgatggtttggcagatggcggaagacgtttttgaaaaataactcagtgaaaactttcccgggcctttgtgctccagccccctggactctactgtagcagaaaaaacttctggaaggagaagttaagtttccattctttgctcgctgctcctgctct

SEQ ID NO: 124373 - DNA, 22 bp, Homo sapiens
  misc_feature 1..22: note = chr5:15503235-15503257
  misc_feature 1..22: note = Hypo
  source 1..22: mol_type = genomic DNA
aacaatagctgaggtcgggcgc

SEQ ID NO: 124374 - DNA, 30 bp, Homo sapiens; identical to SEQ ID NO: 93216
  misc_feature 1..30: note = chr5:15928261-15928291
  misc_feature 1..30: note = Hypo
  source 1..30: mol_type = genomic DNA

SEQ ID NO: 124375 - DNA, 152 bp, Homo sapiens; identical to SEQ ID NO: 93228
  misc_feature 1..152: note = chr5:16032731-16032883
  misc_feature 1..152: note = Hypo
  source 1..152: mol_type = genomic DNA

SEQ ID NO: 124376 - DNA, 1788 bp, Homo sapiens
  misc_feature 1..1788: note = chr5:16178996-16180784
  misc_feature 1..1788: note = Hyper
  source 1..1788: mol_type = genomic DNA
gcatattggagccagcgctcacagggcagaaccagacgagcctcactggaggcaaactgggaggtaggcgtgcgctgtccgtggtgctgaaagcttgaccggcgcgagctggagccgccaccggctgcctcggggtctcgccgggccttacctgctccgcgccctggaagcagatcttgcagatgggctggtggtgctggtgctggtgcccagcgcgctggtcgccgccgccactgctgctgctgcggctgctgcacaccgagcgcgtctcgggctggtctccggcgccccgccgctcgcgctcgccgcccgcgccggcctcagactccccggggccgcctttcgctgctgccgcctccgggaggcgcctcggaccttccccggagtcgccggccgccgccacttcctggccggcgggctgcaggggcaggggcggaggcggcagctcgtccgctcccctgcaccgcggggccacctcccctagcggctcgcttggccccgcggcgcgctcgggggtctcgggggacgcgggcagcggcggcaggtagcgcggggccgcggggaccggggccggctctcccggcggcggcgtcggcggcggcggcgggggaggttgcgggggaggctcggcgtccccgctctccgccccgcgacaccgactgccgccgtggccgccctcaaagctcatggttgtgccgccgccgccctcctgccggcccggctggcgggccgggctctggctgcagggaaagagagcgcggagggggcgggagggagaggggaaaaggagggagggggcccggacgcctggggctagggggcgggacggggaggggatgcggaaggttctgcagctgcggcggcggcaggcgcggccgttcggtggagccgccggctcggctctgatggaggcggcgccgaattcggctgcgcgtgagagccgcgccgcggaagggggggccggagaagcgagggggcgggagggaggagcggcgcggcgggggtgacggggcgcgggcgcggggtgggctgggggcgcggatcagtgggacggagttcggggttcggctccgagcgggcgggctggaagtgggggatccctcagccgcctccacgggccggccccgcgctcacgtcggttccggggcggatgacccctctccaaacggcgcagcgctgcggctctcgtgagctgggaagtagggggcaggggagaggccgcgggtccagaaaccgttactggatgggccggtgggatgtggcgcgggccgggtggggcgcgacagtctgagccgagacccgcgtgggcttaagggtgcgcgaggcgggtgccctgggcgcgcccgaactggctgagcagtggagcgggaaagggcgcgggacccgggactgtaaccgccacttccaggccctcgctccccgcgcttggagccctcaagggcactctcagggatcctcgagagccttaaaacagaagtctctggaacctgtgtcctctccctgtctgtcccgccctcgaatccctgtgtcctcctcacccgctccctcctgcagtgagcatcccgggttgttggtaaagatcttggtgcctgggaggtcggagcttcgtctcctgaaatggtttatactagtgaaccctggcgccacgttctgtggcttataatcactttcgtcgttgccgcatgaggaagcaaatgacaccgccccttaccctggaaaagtggctgcagccttccccggatcttagttttactcaccccgaagtcaatttctcggtaactccaccct

SEQ ID NO: 124377 - DNA, 97 bp, Homo sapiens; identical to SEQ ID NO: 93246
  misc_feature 1..97: note = chr5:16209234-16209331
  misc_feature 1..97: note = Hypo
  source 1..97: mol_type = genomic DNA

SEQ ID NO: 124378 - DNA, 24 bp, Homo sapiens
  misc_feature 1..24: note = chr5:16466772-16466796
  misc_feature 1..24: note = Hypo
  source 1..24: mol_type = genomic DNA
gaacttcaggccaggcgcggtggc

SEQ ID NO: 124379 - DNA, 24 bp, Homo sapiens
  misc_feature 1..24: note = chr5:16467096-16467120
  misc_feature 1..24: note = Hypo
  source 1..24: mol_type = genomic DNA
tggggaggtcgtagatttcatcca

SEQ ID NO: 124380 - DNA, 152 bp, Homo sapiens; identical to SEQ ID NO: 93269
  misc_feature 1..152: note = chr5:16707883-16708035
  misc_feature 1..152: note = Hypo
  source 1..152: mol_type = genomic DNA

SEQ ID NO: 124381 - DNA, 247 bp, Homo sapiens; identical to SEQ ID NO: 93270
  misc_feature 1..247: note = chr5:16744440-16744687
  misc_feature 1..247: note = Hypo
  source 1..247: mol_type = genomic DNA

SEQ ID NO: 124382 - DNA, 182 bp, Homo sapiens; identical to SEQ ID NO: 40512
  misc_feature 1..182: note = chr5:16809241-16809423
  misc_feature 1..182: note = Hypo
  source 1..182: mol_type = genomic DNA

SEQ ID NO: 124383 - DNA, 30 bp, Homo sapiens; identical to SEQ ID NO: 29492
  misc_feature 1..30: note = chr5:16934552-16934582
  misc_feature 1..30: note = Hyper
  source 1..30: mol_type = genomic DNA

SEQ ID NO: 124384 - DNA, 61 bp, Homo sapiens; identical to SEQ ID NO: 93306
  misc_feature 1..61: note = chr5:16935556-16935617
  misc_feature 1..61: note = Hyper
  source 1..61: mol_type = genomic DNA

SEQ ID NO: 124385 - DNA, 438 bp, Homo sapiens; identical to SEQ ID NO: 93307
  misc_feature 1..438: note = chr5:16935883-16936321
  misc_feature 1..438: note = Hyper
  source 1..438: mol_type = genomic DNA

SEQ ID NO: 124386 - DNA, 249 bp, Homo sapiens; identical to SEQ ID NO: 93308
  misc_feature 1..249: note = chr5:16936584-16936833
  misc_feature 1..249: note = Hyper
  source 1..249: mol_type = genomic DNA

SEQ ID NO: 124387 - DNA, 151 bp, Homo sapiens; identical to SEQ ID NO: 93364
  misc_feature 1..151: note = chr5:17203026-17203177
  misc_feature 1..151: note = Hypo
  source 1..151: mol_type = genomic DNA

SEQ ID NO: 124388 - DNA, 475 bp, Homo sapiens; identical to SEQ ID NO: 93366
  misc_feature 1..475: note = chr5:17216663-17217138
  misc_feature 1..475: note = Hyper
  source 1..475: mol_type = genomic DNA

SEQ ID NO: 124389 - DNA, 1538 bp, Homo sapiens
  misc_feature 1..1538: note = chr5:17217681-17219219
  misc_feature 1..1538: note = Hyper
  source 1..1538: mol_type = genomic DNA
gaaggggagggggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccggtaaggaggcgcgcccggtggccccgcgccgccgcggacccgggggcctccgtcccccaccgcgccgcgccccgccccgcagcccccgggctctcccttcatgcagcgggcagcagggatgtgggcccggattggacggcaagggcctggggtccctctgtgagggctccgtcgcacttcggggatcccgggtgatggggggcccagaagtgggaggcttcagccgctcgcatggtggaggggtgaggggggcggcgaggttggtaaacggagctggggggagggggctgtcggggagaggagctgcgggtgacgggaggaattgccgaatgcgaaaccccctcagtgcgttgagtcccggggagacggttctgtgggctgaagggagcgcttccgtcatcggagcccttaccagcctgggagaaagcgctcggggcgaggggcgcagcagccaaagatggagggtgggggtggggtggggcgggagtccggggagaaagaagatggggaatctggcccgatcagaaggaagtgggtggctttttgctttggcaaacgggttttctcgacccatgggactcctggatcttggttctggggccaaggaatacgaggttcacacggcgacgtgcactcagaagcacctcccgagcagatcggagccccagcctcgtcagtggcggaattgccttcctacgaacccgtgggctgcctcggagcagtttgttttttcgagcctttggttccaagaatgcgccaggcgcctccgccctgggtcccggccccggcccgggcccggggggtgtgggcttgaacctgacagcgcgcggccctaactgggctcagccccgctgggagcgtagggttggggttgagcagcttttgcccaaagcgctaaagctgaaacccggcgcccggttcctgctccccccgcccccgtcccccctccatttccagaaaaataaaaattgcggaatcctggatccgatcgcacgcacaatgcgcggctgcaaaccgcattcttttcatgaatattcatcgaacgcttggccaggctccttatctgcgtccccagagacatttccgccttgaaacgaactcggtggacagcccttgcccatgtaattctcactctgctgaaattagcacagcacacatgggtgcattttttaggaccttgtacaggttgacaacacctctgtctcccccgcggccactcgcactgtggggcgggctaaaacccaacactagcgtcgaaatggccttctgctatagggttgtggaccgaccccccaccccc

SEQ ID NO: 124390 - DNA, 32 bp, Homo sapiens; identical to SEQ ID NO: 93401
  misc_feature 1..32: note = chr5:17275585-17275617
  misc_feature 1..32: note = Hypo
  source 1..32: mol_type = genomic DNA

SEQ ID NO: 124391 - DNA, 30 bp, Homo sapiens; identical to SEQ ID NO: 93403
  misc_feature 1..30: note = chr5:17276405-17276435
  misc_feature 1..30: note = Hypo
  source 1..30: mol_type = genomic DNA

SEQ ID NO: 124392 - DNA, 101 bp, Homo sapiens; identical to SEQ ID NO: 93407
  misc_feature 1..101: note = chr5:17311107-17311208
  misc_feature 1..101: note = Hypo
  source 1..101: mol_type = genomic DNA

SEQ ID NO: 124393 - DNA, 30 bp, Homo sapiens; identical to SEQ ID NO: 93408
  misc_feature 1..30: note = chr5:17312415-17312445
  misc_feature 1..30: note = Hypo
  source 1..30: mol_type = genomic DNA

SEQ ID NO: 124394 - DNA, 156 bp, Homo sapiens; identical to SEQ ID NO: 93410
  misc_feature 1..156: note = chr5:17327398-17327554
  misc_feature 1..156: note = Hypo
  source 1..156: mol_type = genomic DNA

SEQ ID NO: 124395 - DNA, 107 bp, Homo sapiens; identical to SEQ ID NO: 93433
  misc_feature 1..107: note = chr5:17492061-17492168
  misc_feature 1..107: note = Hypo
  source 1..107: mol_type = genomic DNA

SEQ ID NO: 124396 - DNA, 114 bp, Homo sapiens; identical to SEQ ID NO: 93436
  misc_feature 1..114: note = chr5:17502345-17502459
  misc_feature 1..114: note = Hypo
  source 1..114: mol_type = genomic DNA

SEQ ID NO: 124397 - DNA, 152 bp, Homo sapiens; identical to SEQ ID NO: 93441
  misc_feature 1..152: note = chr5:17511936-17512088
  misc_feature 1..152: note = Hypo
  source 1..152: mol_type = genomic DNA

SEQ ID NO: 124398 - DNA, 16 bp, Homo sapiens
  misc_feature 1..16: note = chr5:18111782-18111798
  misc_feature 1..16: note = Hypo
  source 1..16: mol_type = genomic DNA
gcgagactctgtctca

SEQ ID NO: 124399 - DNA, 211 bp, Homo sapiens; identical to SEQ ID NO: 93676
  misc_feature 1..211: note = chr5:18393745-18393956
  misc_feature 1..211: note = Hypo
  source 1..211: mol_type = genomic DNA

SEQ ID NO: 124400 - DNA, 30 bp, Homo sapiens; identical to SEQ ID NO: 93722
  misc_feature 1..30: note = chr5:21291802-21291832
  misc_feature 1..30: note = Hypo
  source 1..30: mol_type = genomic DNA

SEQ ID NO: 124401 - DNA, 288 bp, Homo sapiens; identical to SEQ ID NO: 93731
  misc_feature 1..288: note = chr5:22852968-22853256
  misc_feature 1..288: note = Hyper
  source 1..288: mol_type = genomic DNA

SEQ ID NO: 124402 - DNA, 51 bp, Homo sapiens; identical to SEQ ID NO: 93732
  misc_feature 1..51: note = chr5:22853518-22853569
  misc_feature 1..51: note = Hyper
  source 1..51: mol_type = genomic DNA

SEQ ID NO: 124403 - DNA, 30 bp, Homo sapiens; identical to SEQ ID NO: 93735
  misc_feature 1..30: note = chr5:23530297-23530327
  misc_feature 1..30: note = Hypo
  source 1..30: mol_type = genomic DNA

SEQ ID NO: 124404 - DNA, 30 bp, Homo sapiens; identical to SEQ ID NO: 93742
  misc_feature 1..30: note = chr5:24314566-24314596
  misc_feature 1..30: note = Hypo
  source 1..30: mol_type = genomic DNA

SEQ ID NO: 124405 - DNA, 40 bp, Homo sapiens; identical to SEQ ID NO: 93748
  misc_feature 1..40: note = chr5:25656060-25656100
  misc_feature 1..40: note = Hypo
  source 1..40: mol_type = genomic DNA

SEQ ID NO: 124406 - DNA, 25 bp, Homo sapiens
  misc_feature 1..25: note = chr5:26029110-26029135
  misc_feature 1..25: note = Hypo
  source 1..25: mol_type = genomic DNA
gcgcccggcccgaagtaaggcattt

SEQ ID NO: 124407 - DNA, 17 bp, Homo sapiens
  misc_feature 1..17: note = chr5:27086133-27086150
  misc_feature 1..17: note = Hypo
  source 1..17: mol_type = genomic DNA
tccgtctcaaaaaaaaa

SEQ ID NO: 124408 - DNA, 101 bp, Homo sapiens; identical to SEQ ID NO: 93752
  misc_feature 1..101: note = chr5:27267415-27267516
  misc_feature 1..101: note = Hypo
  source 1..101: mol_type = genomic DNA

SEQ ID NO: 124409 - DNA, 62 bp, Homo sapiens; identical to SEQ ID NO: 93769
  misc_feature 1..62: note = chr5:27523953-27524015
  misc_feature 1..62: note = Hypo
  source 1..62: mol_type = genomic DNA

SEQ ID NO: 124410 - DNA, 171 bp, Homo sapiens; identical to SEQ ID NO: 93778
  misc_feature 1..171: note = chr5:29478680-29478851
  misc_feature 1..171: note = Hypo
  source 1..171: mol_type = genomic DNA

SEQ ID NO: 124411 - DNA, 99 bp, Homo sapiens; identical to SEQ ID NO: 93784
  misc_feature 1..99: note = chr5:30694338-30694437
  misc_feature 1..99: note = Hypo
  source 1..99: mol_type = genomic DNA

SEQ ID NO: 124412 - DNA, 16 bp, Homo sapiens
  misc_feature 1..16: note = chr5:31035761-31035777
  misc_feature 1..16: note = Hypo
  source 1..16: mol_type = genomic DNA
ccgtctaaaaaaaaaa

SEQ ID NO: 124413 - DNA, 147 bp, Homo sapiens; identical to SEQ ID NO: 40519
  misc_feature 1..147: note = chr5:31111601-31111748
  misc_feature 1..147: note = Hypo
  source 1..147: mol_type = genomic DNA

SEQ ID NO: 124414 - DNA, 23 bp, Homo sapiens
  misc_feature 1..23: note = chr5:31134444-31134467
  misc_feature 1..23: note = Hypo
  source 1..23: mol_type = genomic DNA
ttggccaggcaggtgcggtggct

SEQ ID NO: 124415 - DNA, 30 bp, Homo sapiens; identical to SEQ ID NO: 93790
  misc_feature 1..30: note = chr5:31182513-31182543
  misc_feature 1..30: note = Hypo
  source 1..30: mol_type = genomic DNA

SEQ ID NO: 124416 - DNA, 563 bp, Homo sapiens
  misc_feature 1..563: note = chr5:31193869-31194432
  misc_feature 1..563: note = Hyper
  source 1..563: mol_type = genomic DNA
agctgcagtttcagccgcgacagcaagaacggcagagccggcgaccgcggcggcggcggcggcggaggcaggagcagcctgggcgggtcgcagggtctccgcgggcgcaggaaggcgagcagaggtgggttcgggctccgttggctatgcatacatctccctttttttttttttaattctgtagcgttgatagaagccaatcagagagagagccctctccgcccggtgggtgccgcgccggagttgggagggatgctctcagcctgcgagcccgggtcggggcgggcgcgcgggtccggctgcgcgggcggcgctgctgccgctgctcaggaccgacgccgcttcccggggagcctgggcaccgctcctccgcctcctggtaagaccgatccgccgtggggctgggtgggggcaccgggaagcgggccgccgcagaagaacccgctgcctttctctacgccggcagaggctgccaggggagctctggcatttgcaaagttggctggtcaattaccaaagggcgctggtgcgtgcaggtcccgccgagccgtttggggcttgat

SEQ ID NO: 124417 - DNA, 84 bp, Homo sapiens; identical to SEQ ID NO: 93795
  misc_feature 1..84: note = chr5:31572153-31572237
  misc_feature 1..84: note = Hypo
  source 1..84: mol_type = genomic DNA

SEQ ID NO: 124418 - DNA, 29 bp, Homo sapiens
  misc_feature 1..29: note = chr5:31621855-31621884
  misc_feature 1..29: note = Hypo
  source 1..29: mol_type = genomic DNA
ttgatatcacagggccgggcgtggtggct

SEQ ID NO: 124419 - DNA, 78 bp, Homo sapiens; identical to SEQ ID NO: 93797
  misc_feature 1..78: note = chr5:31629209-31629287
  misc_feature 1..78: note = Hypo
  source 1..78: mol_type = genomic DNA

SEQ ID NO: 124420 - DNA, 235 bp, Homo sapiens; identical to SEQ ID NO: 93798
  misc_feature 1..235: note = chr5:31634979-31635214
  misc_feature 1..235: note = Hypo
  source 1..235: mol_type = genomic DNA

SEQ ID NO: 124421 - DNA, 329 bp, Homo sapiens; identical to SEQ ID NO: 93799
  misc_feature 1..329: note = chr5:31639603-31639932
  misc_feature 1..329: note = Hyper
  source 1..329: mol_type = genomic DNA

SEQ ID NO: 124422 - DNA, 24 bp, Homo sapiens
  misc_feature 1..24: note = chr5:31662743-31662767
  misc_feature 1..24: note = Hypo
  source 1..24: mol_type = genomic DNA
tttctttttttgagacggagtctg

SEQ ID NO: 124423 - DNA, 36 bp, Homo sapiens; identical to SEQ ID NO: 93801
  misc_feature 1..36: note = chr5:31664530-31664566
  misc_feature 1..36: note = Hypo
  source 1..36: mol_type = genomic DNA

SEQ ID NO: 124424 - DNA, 101 bp, Homo sapiens; identical to SEQ ID NO: 93802
  misc_feature 1..101: note = chr5:31691579-31691680
  misc_feature 1..101: note = Hypo
  source 1..101: mol_type = genomic DNA

SEQ ID NO: 124425 - DNA, 191 bp, Homo sapiens; identical to SEQ ID NO: 93803
  misc_feature 1..191: note = chr5:31738160-31738351
  misc_feature 1..191: note = Hypo
  source 1..191: mol_type = genomic DNA

SEQ ID NO: 124426 - DNA, 182 bp, Homo sapiens; identical to SEQ ID NO: 93804
  misc_feature 1..182: note = chr5:31750531-31750713
  misc_feature 1..182: note = Hypo
  source 1..182: mol_type = genomic DNA

SEQ ID NO: 124427 - DNA, 30 bp, Homo sapiens; identical to SEQ ID NO: 93805
  misc_feature 1..30: note = chr5:31769285-31769315
  misc_feature 1..30: note = Hypo
  source 1..30: mol_type = genomic DNA

SEQ ID NO: 124428 - DNA, 30 bp, Homo sapiens; identical to SEQ ID NO: 93806
  misc_feature 1..30: note = chr5:31784008-31784038
  misc_feature 1..30: note = Hypo
  source 1..30: mol_type = genomic DNA

SEQ ID NO: 124429 - DNA, 30 bp, Homo sapiens; identical to SEQ ID NO: 93807
  misc_feature 1..30: note = chr5:31796388-31796418
  misc_feature 1..30: note = Hypo
  source 1..30: mol_type = genomic DNA

SEQ ID NO: 124430 - DNA, 30 bp, Homo sapiens; identical to SEQ ID NO: 93808
  misc_feature 1..30: note = chr5:31832893-31832923
  misc_feature 1..30: note = Hypo
  source 1..30: mol_type = genomic DNA

SEQ ID NO: 124431 - DNA, 838 bp, Homo sapiens; identical to SEQ ID NO: 93809
  misc_feature 1..838: note = chr5:31854940-31855778
  misc_feature 1..838: note = Hyper
  source 1..838: mol_type = genomic DNA

SEQ ID NO: 124432 - DNA, 39 bp, Homo sapiens; identical to SEQ ID NO: 93810
  misc_feature 1..39: note = chr5:31863261-31863300
  misc_feature 1..39: note = Hypo
  source 1..39: mol_type = genomic DNA

SEQ ID NO: 124433 - DNA, 49 bp, Homo sapiens; identical to SEQ ID NO: 93811
  misc_feature 1..49: note = chr5:31889103-31889152
  misc_feature 1..49: note = Hypo
  source 1..49: mol_type = genomic DNA

SEQ ID NO: 124434 - DNA, 28 bp, Homo sapiens
  misc_feature 1..28: note = chr5:31920417-31920445
  misc_feature 1..28: note = Hypo
  source 1..28: mol_type = genomic DNA
aattttttctgagcgaaagatagagatt

SEQ ID NO: 124435 - DNA, 29 bp, Homo sapiens
  misc_feature 1..29: note = chr5:31921511-31921540
  misc_feature 1..29: note = Hypo
  source 1..29: mol_type = genomic DNA
gggtgcagtggctcacgcctgtaatccca

SEQ ID NO: 124436 - DNA, 30 bp, Homo sapiens; identical to SEQ ID NO: 93814
  misc_feature 1..30: note = chr5:31924663-31924693
  misc_feature 1..30: note = Hypo
  source 1..30: mol_type = genomic DNA

SEQ ID NO: 124437 - DNA, 30 bp, Homo sapiens; identical to SEQ ID NO: 40523
  misc_feature 1..30: note = chr5:31982994-31983024
  misc_feature 1..30: note = Hypo
  source 1..30: mol_type = genomic DNA

SEQ ID NO: 124438 - DNA, 55 bp, Homo sapiens; identical to SEQ ID NO: 93818
  misc_feature 1..55: note = chr5:32048718-32048773
  misc_feature 1..55: note = Hypo
  source 1..55: mol_type = genomic DNA

SEQ ID NO: 124439 - DNA, 30 bp, Homo sapiens; identical to SEQ ID NO: 93823
  misc_feature 1..30: note = chr5:32331996-32332026
  misc_feature 1..30: note = Hypo
  source 1..30: mol_type = genomic DNA

SEQ ID NO: 124440 - DNA, 24 bp, Homo sapiens
  misc_feature 1..24: note = chr5:32526558-32526582
  misc_feature 1..24: note = Hypo
  source 1..24: mol_type = genomic DNA
tgaaatccttctccacgccgggcg

SEQ ID NO: 124441 - DNA, 30 bp, Homo sapiens; identical to SEQ ID NO: 93825
  misc_feature 1..30: note = chr5:32616284-32616314
  misc_feature 1..30: note = Hypo
  source 1..30: mol_type = genomic DNA

SEQ ID NO: 124442 - DNA, 40 bp, Homo sapiens; identical to SEQ ID NO: 93827
  misc_feature 1..40: note = chr5:32709839-32709879
  misc_feature 1..40: note = Hyper
  source 1..40: mol_type = genomic DNA

SEQ ID NO: 124443 - DNA, 870 bp, Homo sapiens; identical to SEQ ID NO: 93828
  misc_feature 1..870: note = chr5:32710093-32710963
  misc_feature 1..870: note = Hyper
  source 1..870: mol_type = genomic DNA

SEQ ID NO: 124444 - DNA, 1829 bp, Homo sapiens
  misc_feature 1..1829: note = chr5:32711023-32712852
  misc_feature 1..1829: note = Hyper
  source 1..1829: mol_type = genomic DNA
atgtgtgcgtgcgcgcgcgcatttctctactttaaagcacgtttccttttttgaagccaggagctggagagcgtggaaagggagaggcggtgatcgcacaggcacgcggcgtggtgggggctcttgccggtgcagacgtgggcgatttcagctttaaggaaaaggcagagggcctgcggggagtggtggttagggacaggggcgcgatgggtagtgaaggggtgcagggaggagccctgatgtaagaatgttaatgagagactcccccagcccagcccccacatctccccacccccacccaccccacccgctggaaacacaagcccggcctcggcgcgccatgtgtggtaacacgctcagccgctgccacgctatttaaacgcgggctatggatccaggaaccggcgcgaatcaatgagatcaaatgcgagggagatgcaccgtcaattacaaacacttggacaagtctaactttttttttcttctacaaaaacgctttcaaaagcaaccttagcaacgcccaaataagaagccacctctaagcaaaatagtatatgtataaacggagggcgaatatatacaagtatatatatatgtatattacagacgcacaggtttacacccggtgaactttttctttttctttttcttttttttttaagaaaaactagtgacattgcagagaaggacgcttcctctctatcttttggcgcattagtgaagggggtattctattttgttaaagcgcccaagggggcgcagggaccttggagagaagagtggggaggaaagaggaagggtgggtggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagaggtgagcaggggcgcgtcccgggccccgggccctaacccaaccgctctccgcggctctccctgcacactcgtccactctgcagaccccactccccactgcggcgctgaggtcgggtgcgcgcgggcactcgttcaggtatgcgccgtgtggctgcgacaacctttgacgaccgcccatcgcggtgtacgtagagggtcccag

SEQ ID NO: 124445 - DNA, 79 bp, Homo sapiens; identical to SEQ ID NO: 40525
  misc_feature 1..79: note = chr5:32750220-32750299
  misc_feature 1..79: note = Hypo
  source 1..79: mol_type = genomic DNA

SEQ ID NO: 124446 - DNA, 45 bp, Homo sapiens; identical to SEQ ID NO: 93835
  misc_feature 1..45: note = chr5:32835693-32835738
  misc_feature 1..45: note = Hypo
  source 1..45: mol_type = genomic DNA

SEQ ID NO: 124447 - DNA, 113 bp, Homo sapiens; identical to SEQ ID NO: 93836
  misc_feature 1..113: note = chr5:32855659-32855772
  misc_feature 1..113: note = Hypo
  source 1..113: mol_type = genomic DNA

SEQ ID NO: 124448 - DNA, 21 bp, Homo sapiens
  misc_feature 1..21: note = chr5:32937597-32937618
  misc_feature 1..21: note = Hypo
  source 1..21: mol_type = genomic DNA
ccatcacgtccagcctgtgaa

SEQ ID NO: 124449 - DNA, 30 bp, Homo sapiens; identical to SEQ ID NO: 93838
  misc_feature 1..30: note = chr5:33138834-33138864
  misc_feature 1..30: note = Hypo
  source 1..30: mol_type = genomic DNA

SEQ ID NO: 124450 - DNA, 96 bp, Homo sapiens; identical to SEQ ID NO: 93839
  misc_feature 1..96: note = chr5:33162506-33162602
  misc_feature 1..96: note = Hypo
  source 1..96: mol_type = genomic DNA

SEQ ID NO: 124451 - DNA, 22 bp, Homo sapiens
  misc_feature 1..22: note = chr5:33201158-33201180
  misc_feature 1..22: note = Hypo
  source 1..22: mol_type = genomic DNA
ccgcgcccggccccagtgtctt

SEQ ID NO: 124452 - DNA, 25 bp, Homo sapiens
  misc_feature 1..25: note = chr5:33234426-33234451
  misc_feature 1..25: note = Hypo
  source 1..25: mol_type = genomic DNA
tgagctgacacgcctggctgaattt

SEQ ID NO: 124453 - DNA, 79 bp, Homo sapiens; identical to SEQ ID NO: 93843
  misc_feature 1..79: note = chr5:33272980-33273059
  misc_feature 1..79: note = Hypo
  source 1..79: mol_type = genomic DNA

SEQ ID NO: 124454 - DNA, 36 bp, Homo sapiens; identical to SEQ ID NO: 93844
  misc_feature 1..36: note = chr5:33286168-33286204
  misc_feature 1..36: note = Hypo
  source 1..36: mol_type = genomic DNA

SEQ ID NO: 124455 - DNA, 81 bp, Homo sapiens; identical to SEQ ID NO: 93845
  misc_feature 1..81: note = chr5:33298096-33298177
  misc_feature 1..81: note = Hypo
  source 1..81: mol_type = genomic DNA

SEQ ID NO: 124456 - DNA, 65 bp, Homo sapiens; identical to SEQ ID NO: 93847
  misc_feature 1..65: note = chr5:33442966-33443031
  misc_feature 1..65: note = Hypo
  source 1..65: mol_type = genomic DNA

SEQ ID NO: 124457 - DNA, 97 bp, Homo sapiens; identical to SEQ ID NO: 93848
  misc_feature 1..97: note = chr5:33509494-33509591
  misc_feature 1..97: note = Hypo
  source 1..97: mol_type = genomic DNA

SEQ ID NO: 124458 - DNA, 197 bp, Homo sapiens; identical to SEQ ID NO: 40531
  misc_feature 1..197: note = chr5:33550087-33550284
  misc_feature 1..197: note = Hypo
  source 1..197: mol_type = genomic DNA

SEQ ID NO: 124459 - DNA, 157 bp, Homo sapiens; identical to SEQ ID NO: 93850
  misc_feature 1..157: note = chr5:33596013-33596170
  misc_feature 1..157: note = Hypo
  source 1..157: mol_type = genomic DNA

SEQ ID NO: 124460 - DNA, 190 bp, Homo sapiens; identical to SEQ ID NO: 40532
  misc_feature 1..190: note = chr5:33880065-33880255
  misc_feature 1..190: note = Hypo
  source 1..190: mol_type = genomic DNA

SEQ ID NO: 124461 - DNA, 502 bp, Homo sapiens; identical to SEQ ID NO: 29513
  misc_feature 1..502: note = chr5:33892054-33892556
  misc_feature 1..502: note = Hyper
  source 1..502: mol_type = genomic DNA

SEQ ID NO: 124462 - DNA, 757 bp, Homo sapiens
  misc_feature 1..757: note = chr5:33936153-33936910
  misc_feature 1..757: note = Hyper
  source 1..757: mol_type = genomic DNA
agctcaactctccctcgcggcgcgggcgcggctgggttcagcacctcggaaagcgcccctcgcggcgccccgggattacgcatgctccttggggcccgccgccttggccgtgcaagtgccaccgtaactggtgagagccgctggcaacccacccggagttgacaaccgcggagagacgcagacacccactgacctccaggaagctgagcgtggtggatggaactctacgatctctttctctccaaggacggaaacctcatccaagcagtcccagaggaaacggataaaggtatttgaaagggagcgagcggccccaaatcgcacaattgagcggctgggggagttatgcgccagtgccccagtgaccgcgggacacggagaggggaagtctgcgttgtacataaggacctagggactccgagcttggcctgagaacccttggacgccgagtgcttgccttacgggctgcactcctcaactctgctccaaagcagccgctgagctcaactcctgcgtccagggcgttcgctgcgcgccaggacgcgcttagtacccagttcctgggctctctcttcagtagctgctttgaaagctcccacgcacgtcccgcaggctagcctggcaacaaaactggggtaaaccgtgttatcttaggtcttgtcccccagaacatgacctagaggtacctgcgcatgcagatggccgatgcagccacgatagccaccatgaataaggcagcaggcggggacaagctagc

SEQ ID NO: 124463 - DNA, 209 bp, Homo sapiens; identical to SEQ ID NO: 93860
  misc_feature 1..209: note = chr5:34555944-34556153
  misc_feature 1..209: note = Hypo
  source 1..209: mol_type = genomic DNA

SEQ ID NO: 124464 - DNA, 37 bp, Homo sapiens; identical to SEQ ID NO: 29517
  misc_feature 1..37: note = chr5:34655873-34655910
  misc_feature 1..37: note = Hyper
  source 1..37: mol_type = genomic DNA

SEQ ID NO: 124465 - DNA, 70 bp, Homo sapiens; identical to SEQ ID NO: 93862
  misc_feature 1..70: note = chr5:34656351-34656421
  misc_feature 1..70: note = Hyper
  source 1..70: mol_type = genomic DNA

SEQ ID NO: 124466 - DNA, 320 bp, Homo sapiens; identical to SEQ ID NO: 93863
  misc_feature 1..320: note = chr5:34656642-34656962
  misc_feature 1..320: note = Hyper
  source 1..320: mol_type = genomic DNA

SEQ ID NO: 124467 - DNA, 105 bp, Homo sapiens; identical to SEQ ID NO: 93864
  misc_feature 1..105: note = chr5:34839926-34840031
  misc_feature 1..105: note = Hypo
  source 1..105: mol_type = genomic DNA

SEQ ID NO: 124468 - DNA, 397 bp, Homo sapiens; identical to SEQ ID NO: 93866
  misc_feature 1..397: note = chr5:35229693-35230090
  misc_feature 1..397: note = Hyper
  source 1..397: mol_type = genomic DNA

SEQ ID NO: 124469 - DNA, 30 bp, Homo sapiens; identical to SEQ ID NO: 93893
  misc_feature 1..30: note = chr5:36127942-36127972
  misc_feature 1..30: note = Hypo
  source 1..30: mol_type = genomic DNA

SEQ ID NO: 124470 - DNA, 20 bp, Homo sapiens
  misc_feature 1..20: note = chr5:36541411-36541431
  misc_feature 1..20: note = Hypo
  source 1..20: mol_type = genomic DNA
ttaaaacaggccgggcgtgg

SEQ ID NO: 124471 - DNA, 69 bp, Homo sapiens; identical to SEQ ID NO: 93898
  misc_feature 1..69: note = chr5:36606740-36606809
  misc_feature 1..69: note = Hyper
  source 1..69: mol_type = genomic DNA

SEQ ID NO: 124472 - DNA, 86 bp, Homo sapiens; identical to SEQ ID NO: 93899
  misc_feature 1..86: note = chr5:36607023-36607109
  misc_feature 1..86: note = Hyper
  source 1..86: mol_type = genomic DNA

SEQ ID NO: 124473 - DNA, 30 bp, Homo sapiens; identical to SEQ ID NO: 93900
  misc_feature 1..30: note = chr5:36607317-36607347
  misc_feature 1..30: note = Hyper
  source 1..30: mol_type = genomic DNA

SEQ ID NO: 124474 - DNA, 454 bp, Homo sapiens; identical to SEQ ID NO: 93901
  misc_feature 1..454: note = chr5:36690192-36690646
  misc_feature 1..454: note = Hyper
  source 1..454: mol_type = genomic DNA

SEQ ID NO: 124475 - DNA, 30 bp, Homo sapiens; identical to SEQ ID NO: 93902
  misc_feature 1..30: note = chr5:36693244-36693274
  misc_feature 1..30: note = Hyper
  source 1..30: mol_type = genomic DNA

SEQ ID NO: 124476 - DNA, 30 bp, Homo sapiens; identical to SEQ ID NO: 93904
  misc_feature 1..30: note = chr5:36938092-36938122
  misc_feature 1..30: note = Hypo
  source 1..30: mol_type = genomic DNA

SEQ ID NO: 124477 - DNA, 36 bp, Homo sapiens; identical to SEQ ID NO: 93905
  misc_feature 1..36: note = chr5:36985760-36985796
  misc_feature 1..36: note = Hypo
  source 1..36: mol_type = genomic DNA

SEQ ID NO: 124478 - DNA, 21 bp, Homo sapiens
  misc_feature 1..21: note = chr5:37255526-37255547
  misc_feature 1..21: note = Hypo
  source 1..21: mol_type = genomic DNA
tcttggcggtgggtgcaggac

SEQ ID NO: 124479 - DNA, 101 bp, Homo sapiens; identical to SEQ ID NO: 93908
  misc_feature 1..101: note = chr5:37371474-37371575
  misc_feature 1..101: note = Hyper
  source 1..101: mol_type = genomic DNA

SEQ ID NO: 124480 - DNA, 210 bp, Homo sapiens
  misc_feature 1..210: note = chr5:37834615-37834825
  misc_feature 1..210: note = Hyper
  source 1..210: mol_type = genomic DNA
cgcaccccttgcccacgggtcggtaggccacacagccatcaggctggcttggggtacgtgcggggctggctgcgggtgggggtgcgagggggtccgccggcggcccccccgcggggagggaacggttcttacagtcactgctcagcgcgaagggcgcgcggcggcggccgagggagcggtcttcggcgggcgcctcgggaggcctcttac

SEQ ID NO: 124481 - DNA, 4113 bp, Homo sapiens
  misc_feature 1..4113: note = chr5:37836626-37840739
  misc_feature 1..4113: note = Hyper
  source 1..4113: mol_type = genomic DNA
gctggtttgcaaactcgggaaaaagctaggttctgggtcgcgatgtgcagacacaggaaaactgcaccaggccatgcaaaatgagcccagaaaggtactttggcagctaggacctggggaacgcgagcttcccccctcaagccccccgccggtgccagctcccgggtgcgtgcgaaatggctggcggtccgaccggaggagcatggaggcgcggggttaatgcgccattccaaatcgcggtgcccgccagcaggaagccacagaggcactagatttcccttccgtcttaagagggttttcccttttttcctgcttggccgacggagggctttttaaattggacgtggagatcctcaattagaagtgtggcgaagctggcaaaagactacacagtggaaaactccccgcgtcgccagaggaggctcccggctgcggttcccgccctcggccgagcgccgccagcgcccggatcgagctcccctcttcccccgggacagggagggcgcattcttccctctgagcgccgccgggaccggctccagtccgaggggctctttcgttctcggtatttgctgggcgggggaaaaggggggaggttgggggactcggcacacacagcgtctactaggacgtttttcttagagtccgtgtgggctccacccctcggcttctcagtttgtctctctatcgctttcccaaaacacatctacatctgcccgacgcgcttctcctcaaccatgggcctttgcccgcggtgcaaactgctttacgcgccgccacgtgcgagaaccaagctctgctcctcaagtgacgggggctctgctctgccaggtgaccgcgcaccatttctcgtgcctggcaagctggtccccttctgggtccgggaccaccacgtcccggcagggcaaaagcagcaggccgtgggcgccggcacctgtgggtccccaggcctggggaggcaaggacgcccaggaaagccacagaagtgctcgcagaagcagccgctcgccgcgaggcacttctgagttcccggcagcagggggcaccagaaaccgtctgagccgtgtcgcgcccacgcggcccggaggctgtgttatcattttagttataaaaccggagaaccaccactccctctacgagcctcccgaaatcccattagcccgggaacctgtggaggtccttactggcatctctgcttttcaggctcccacccctccattctcgctggttttcctctccccacttcacctgagcgggtttcttggcaacctgctttcagaccatccctcaccccttccacgcgtcaccgtgacagattcgcaggaggcagcgctcccgccgtcagtgcccccgcaccttcttgtgcctggcaggctgggaggtttgtttgggctttgccttcaagatccaggtctcagagagagaaaaaggaggcggtggggcggggagacgggtttgctataaactcggtttttttttttttttttttggcggggggaggtagagacagaaattgctggaagatctattgcttttcttaactatgcttcgtgtccttgactgacagaggacttattctcccctcaaccccccataactgcggggcccaagatgagggaaggaaaaagaatttgggacacttctcgcaggcaaactgggaaagcggtctgtttaaagggccaggttccaggcccgagagcacccgaattgctagcgggaaagggctagggacacggcggacttcccagagatcggacacttgttacttgttgaaaaggcgccaccttccctgacaaagcgaaggcgcagcgaaacagtacgagtttggtcgaggccggctttgacggctttgcgggactgggtgcgtgaatgaggttggaagaaacatctcttccttgaaatacctaagcatatattccaaacactgagcaagagtcgagcgcgttctaacatctccgcagcaggggccggaagagttgcctttgtccccgcctatgagcagaagggtcgcgagctctgggatgggtaagccccccgggggcgcgcacatgggtcctggcggcggattctaccaaagccgaaactagctgggccccaggaagctggcgggaacccgcgaaagtccgtttccagcccgaagagggttcgtttttcttcgttggggcaggaaacaaaccaccagtgcggaattagcctcgaggtggtgtaaagtagtggcagtggtggtggggtgtttttggaaggcggcacagagtacaggagaaaaaggggtcattaaaataataacctcaatggcctagtggagtctcaagaatacgttcgagacagagatttgaatccaggactggcaagaaagcccctctcctaacctcgacggggatggttagttggggtggagggcgttaggaacgtgcaggcaaccgggtgaggaatgtagctttgccagacctcgcccggaggaggtgagccctccatttttaggttctcagcacctttgcagcagcccctcccccggcctgcgcttttccttggcacagatcaaaacaagctcaatagtaagttgcactcttggcaatgatagtatctctgcacgtccagagaggacacatttcgacggcggtgggttcgaagatgacccaagccctgaatcgttctgtgacttgacggaagagcacctggccgagtcggggaaggaaactgcccctcttgggcattccgggtccaggcgcatctggggctccacagatctttgcccacgtggaaaaggcaacatgcccctccgaaaggccggcctctctccggttctacttttctctctcctcgcatagcttaggttccctctagtctttccactttctactctcaccgtttgctctggggtccagacgcacccctctgactagggcgcccttcagccggccgcacccacccgcgacgcaggcaccacccgctccctgctccccggcccgctccctcacttacctcggatcgggtctccgcagaccctaggttggacattaactccaggtgccccaagtcccagccaggagacccatccgggctgatggctggagcgcggagccccgcccaacaggtcaggggcaagagttcgcaatcctggggtcgcgcggggcagcaagggcgcgctggaggcggcggccaagactcccgccgccgccgccgccaacagggcgagggctgccggcaactctcccgccgggcccccgcacccccagaagccgaggtccgagcagccgccgctgctttgggtggggggctgacagggctgcgcgcgtcgcgctcttggctggggctgcgcgggcccggggcgctgcgggcggctcagcggcagctgccgcgctctgcgcctcctctgggcgcactgcctgggagcacgagactggtttgtctgatgctgctgccggagctgaggtcttgcctggagatccgaacgagacaccacgtcaaccggcgcggggagtcccgtgaagacatgagggcgccaggagcgcaggctggtcttctagagcccgggctgggggtccggggtccggggtgggggaggggaggcgcggggccccgggagggaggggtcgggaggcgtcggctgggcctggcggtgggggaggagaggagagcagcgaggaggccctggagttcccgaggcggggggccggggtgcgagtgggcgacgcgaggcgcccctccctgggctgcagggagagcgctgagagcgcggagacgccgcggggctagcgccttctcctctccgggtggatcaaaaatcgagaggaatgtgcggcgctctgcgcgggccagccgaaaggggcaatccgaacttgaccgcggcgcccgcgccgggctttgcccccgcgcgccgcactgggagggtggcgctctgccggtgcagggcagcgccgggctttcctcgcgcctgtcgaaggccggccttcccgctcgggtgtctcgccctctcgcttctccgcagggcaggaggcagtggcgagaaaaggagctgccggccggagttctagcaccgagaaggagaggtgcggagcggccgggtgagggaagccgagtatttgccaggggacgctgcgagtggggatgaat

SEQ ID NO: 124482 - DNA, 17 bp, Homo sapiens
  misc_feature 1..17: note = chr5:38247048-38247065
  misc_feature 1..17: note = Hypo
  source 1..17: mol_type = genomic DNA
gcttgggactgggtgcg

SEQ ID NO: 124483 - DNA, 1552 bp, Homo sapiens
  misc_feature 1..1552: note = chr5:38257406-38258958
  misc_feature 1..1552: note = Hyper
  source 1..1552: mol_type = genomic DNA
aacattgtttcctcccgcgctcccaaacataggctaactgtgaagagccaggacgcccaccgagtcctggcagcgttgcaaggtggggagggggcgggcgcggtcctgtcgctagtgactgcagatttcctctgcggggcacttcctacggcctttgatctttccccaggaactgccgagggccgcgtttgcctctaagtttattccctcttggtttatttattgtatctgctttctcttctcgctggtttggaggtcagaacgccagtatgcaacgggacttgtgtcccaggcagggtctcccctctccaggcactaccgcgaaatctggcaaaaggtacattttactgagtcctagggcagcaaattcagcggcggagaaagagtctttctccattcaggagacaacccaggaagcccgatcccgggatcagaggccaggaccccgccccggccccctgccccaggcccagctgggcgccgcccaggggcttttctcggtccgcctgggggctcgagctcgcgtccctccctaagacgccaggcttaacttggagtttcatctcctccccaggagggtctcaagttgccttcctctgccgggaagggcccccactcccccgctccaggccctaatctccacccggcgtcccagtctgagcggcctggcctcagctctccatctgcgagccttaaatcccatttatcttcttagcgcctcagacccggacggtcccgcctctcttcctctcacccccaccccacttgcaaatcacagacccccgtctacccctcgcatcccccaagtgcgctggaccaactacagcaacctttgaggtgttagaaaaagtcgcctagaggggcgcggcaggaggagggcccaggtggggtggagggggggcgccccaagatttcagggtgaggaccgcggagggtcctggacccgcagtcgcctaactcctgccctgcgtctccagtgcttgaagtcggtccctcccaggtccccaatctaggtcaccagcggggaagggctgcgctgggggtcgctagagagggtgaggggcgggctgtctgcttccgaggtgggcgaggagtgaaggtttcagggcctgtccctctcacttccactcgattgtaatttcatccccgggccggtcgagcctccctccctcccgcggccagcccttccctcccagtcggcctccttcgtcgcccccgcccccgcgaaaagccctgcagcttgcagccggcttcactcgcgcacgccgacctcccggctgcagtcctacctcttggaactacccgtgtttccgggcccagccctcgcagccccccacctcctcgccccggcccggggatccgttggggccgcgtcccccacgcgcccccggagacgccctttccgtgtgcgcccgggacttggtgaaactttgcaggcgccggctgcgaaatggatttaatccgaggcgtcttgctccggctcctgctcctggcttccagcctcggacccggcgcggtgtcgctccgagcggccatccgaaaaccaggtaat

SEQ ID NO: 124484 - DNA, 34 bp, Homo sapiens; identical to SEQ ID NO: 93926
  misc_feature 1..34: note = chr5:38259223-38259257
  misc_feature 1..34: note = Hyper
  source 1..34: mol_type = genomic DNA

SEQ ID NO: 124485 - DNA, 778 bp, Homo sapiens
  misc_feature 1..778: note = chr5:38556207-38556985
  misc_feature 1..778: note = Hyper
  source 1..778: mol_type = genomic DNA
ggcagaagttctgggcgctggagtccgcgtcccccaggacacgagggtgacccaagggcgcgcggagagcggcgggacccggagcggcgctctccggggtcactcccctaggacgctccgcagagctgggagcgctgccccaccccgcccgggccgcccctggggaccccgctcggggctccgcggctcccctgctccgcgccgcgcccacccgcccccaggactcacggtacgctcccgcgccgctatcttgccatcccctgccgccggctctgtagcctcggccgccgccccggggctgcccagatcccacagccgcccgggggcaggagccgccaaggagggggccgggcacaatgcgccgccgcctccgcagccgccgtctcgcctcccctgtgtcggcgcgaggctgcttgaggcggccacgggcgaagggcggcccgctgcgctccgcgaaccccgcgggccgccgccgccgccagagcctcccagaggcaacggtaacggccaccgccacggccgagtcgctccagccgggactgcggcgcgcgggggcggcgcctgcacgccgctcggctgggggcgcagcgggcccggccccgcccctgacccgcccctgcccccggccccggccccgccccaacccgcgcgcccccgccgatccccggccgcgcgcccgcgcgcgcgggtgctccaaggagtcggaggaacgcggccgcgcgacgggccccggacgccgagggtggtgcttcctccgagcctccggtggtgaggccgc

SEQ ID NO: 124486 - DNA, 72 bp, Homo sapiens; identical to SEQ ID NO: 93931
  misc_feature 1..72: note = chr5:38557271-38557343
  misc_feature 1..72: note = Hyper
  source 1..72: mol_type = genomic DNA

SEQ ID NO: 124487 - DNA, 255 bp, Homo sapiens; identical to SEQ ID NO: 93935
  misc_feature 1..255: note = chr5:38845617-38845872
  misc_feature 1..255: note = Hyper
  source 1..255: mol_type = genomic DNA

SEQ ID NO: 124488 - DNA, 182 bp, Homo sapiens
  misc_feature 1..182: note = chr5:38846307-38846489
  misc_feature 1..182: note = Hyper
  source 1..182: mol_type = genomic DNA
gagccccgtgctgtgcgggaaagaatccgacaacttcgcagcccatcccggctggacgcgaccgggagtgcagcagcccgttcccctcctcggtgccgcctctgcccagcgtttgcttggctgggctaccacctgcgctcggacggcgctcggagggtcctcgcccccggcctgcctacctg

SEQ ID NO: 124489 - DNA, 34 bp, Homo sapiens; identical to SEQ ID NO: 93937
  misc_feature 1..34: note = chr5:39248593-39248627
  misc_feature 1..34: note = Hypo
  source 1..34: mol_type = genomic DNA

SEQ ID NO: 124490 - DNA, 36 bp, Homo sapiens; identical to SEQ ID NO: 40535
  misc_feature 1..36: note = chr5:39343165-39343201
  misc_feature 1..36: note = Hypo
  source 1..36: mol_type = genomic DNA

SEQ ID NO: 124491 - DNA, 634 bp, Homo sapiens; identical to SEQ ID NO: 93939
  misc_feature 1..634: note = chr5:39424929-39425563
  misc_feature 1..634: note = Hyper
  source 1..634: mol_type = genomic DNA

SEQ ID NO: 124492 - DNA, 28 bp, Homo sapiens
  misc_feature 1..28: note = chr5:40066927-40066955
  misc_feature 1..28: note = Hypo
  source 1..28: mol_type = genomic DNA
ggtccgggagtctggcggcagggatggc

SEQ ID NO: 124493 - DNA, 18 bp, Homo sapiens
  misc_feature 1..18: note = chr5:40294097-40294115
  misc_feature 1..18: note = Hypo
  source 1..18: mol_type = genomic DNA
gcccggcctatttttctc

SEQ ID NO: 124494 - DNA, 93 bp, Homo sapiens; identical to SEQ ID NO: 93944
  misc_feature 1..93: note = chr5:40680534-40680627
  misc_feature 1..93: note = Hyper
  source 1..93: mol_type = genomic DNA

SEQ ID NO: 124495 - DNA, 1131 bp, Homo sapiens
  misc_feature 1..1131: note = chr5:40680963-40682094
  misc_feature 1..1131: note = Hyper
  source 1..1131: mol_type = genomic DNA
cagtgtatcgtttctcgggcgcgggtctaacaccttacaagtggtaatttccgctcacggcagctttgtctctcttctaccatccccagacccagccttgcactccaaggctgcgcaccgccagccactatcatgtccactcccggggtcaattcgtccgcctccttgagccccgaccggctgaacagcccagtgaccatcccggcggtgatgttcatcttcggggtggtgggcaacctggtggccatcgtggtgctgtgcaagtcgcgcaaggagcagaaggagacgaccttctacacgctggtatgtgggctggctgtcaccgacctgttgggcactttgttggtgagcccggtgaccatcgccacgtacatgaagggccaatggcccgggggccagccgctgtgcgagtacagcaccttcattctgctcttcttcagcctgtccggcctcagcatcatctgcgccatgagtgtcgagcgctacctggccatcaaccatgcctatttctacagccactacgtggacaagcgattggcgggcctcacgctctttgcagtctatgcgtccaacgtgctcttttgcgcgctgcccaacatgggtctcggtagctcgcggctgcagtacccagacacctggtgcttcatcgactggaccaccaacgtgacggcgcacgccgcctactcctacatgtacgcgggcttcagctccttcctcattctcgccaccgtcctctgcaacgtgcttgtgtgcggcgcgctgctccgcatgcaccgccagttcatgcgccgcacctcgctgggcaccgagcagcaccacgcggccgcggccgcctcggttgcctcccggggccaccccgctgcctccccagccttgccgcgcctcagcgactttcggcgccgccggagcttccgccgcatcgcgggcgccgagatccagatggtcatcttactcattgccacctccctggtggtgctcatctgctccatcccgctcgtggtgagtgaccggggctggggccctactcggcctttttctcgcatccacctcccgcgtccattccccgctccctgctttccctctgagtccttggcagtgaacgtgtcgcctttaggtcggggctgggattcc

SEQ ID NO: 124496 - DNA, 25 bp, Homo sapiens
  misc_feature 1..25: note = chr5:40861757-40861782
  misc_feature 1..25: note = Hypo
  source 1..25: mol_type = genomic DNA
agagagaattcttggcggggcgcgg

SEQ ID NO: 124497 - DNA, 22 bp, Homo sapiens
  misc_feature 1..22: note = chr5:41041433-41041455
  misc_feature 1..22: note = Hypo
  source 1..22: mol_type = genomic DNA
aatacacatcttcagcggggtg

SEQ ID NO: 124498 - DNA, 34 bp, Homo sapiens; identical to SEQ ID NO: 29546
  misc_feature 1..34: note = chr5:41510835-41510869
  misc_feature 1..34: note = Hyper
  source 1..34: mol_type = genomic DNA

SEQ ID NO: 124499 - DNA, 49 bp, Homo sapiens; identical to SEQ ID NO: 93955
  misc_feature 1..49: note = chr5:41587836-41587885
  misc_feature 1..49: note = Hypo
  source 1..49: mol_type = genomic DNA

SEQ ID NO: 124500 - DNA, 30 bp, Homo sapiens; identical to SEQ ID NO: 93956
  misc_feature 1..30: note = chr5:41746611-41746641
  misc_feature 1..30: note = Hypo
  source 1..30: mol_type = genomic DNA

SEQ ID NO: 124501 - DNA, 22 bp, Homo sapiens
  misc_feature 1..22: note = chr5:41777225-41777247
  misc_feature 1..22: note = Hypo
  source 1..22: mol_type = genomic DNA
ttacaaaaaaggggccgggtgc

SEQ ID NO: 124502 - DNA, 196 bp, Homo sapiens; identical to SEQ ID NO: 93958
  misc_feature 1..196: note = chr5:42123791-42123987
  misc_feature 1..196: note = Hypo
  source 1..196: mol_type = genomic DNA

SEQ ID NO: 124503 - DNA, 114 bp, Homo sapiens
  misc_feature 1..114: note = chr5:42423455-42423569
  misc_feature 1..114: note = Hyper
  source 1..114: mol_type = genomic DNA
tgctttcatttggaacgggcaggcggagaggaaggaagtgtattgcaactaccaatattttcctctaggaggagccgcgcagctcagttgagagtgacacgcaccaactccagc

SEQ ID NO: 124504 - DNA, 162 bp, Homo sapiens; identical to SEQ ID NO: 93961
  misc_feature 1..162: note = chr5:42423809-42423971
  misc_feature 1..162: note = Hyper
  source 1..162: mol_type = genomic DNA

SEQ ID NO: 124505 - DNA, 544 bp, Homo sapiens; identical to SEQ ID NO: 93962
  misc_feature 1..544: note = chr5:42424615-42425159
  misc_feature 1..544: note = Hyper
  source 1..544: mol_type = genomic DNA

SEQ ID NO: 124506 - DNA, 43 bp, Homo sapiens; identical to SEQ ID NO: 93967
  misc_feature 1..43: note = chr5:42915864-42915907
  misc_feature 1..43: note = Hypo
  source 1..43: mol_type = genomic DNA

SEQ ID NO: 124507 - DNA, 88 bp, Homo sapiens; identical to SEQ ID NO: 29550
  misc_feature 1..88: note = chr5:42950080-42950168
  misc_feature 1..88: note = Hyper
  source 1..88: mol_type = genomic DNA

SEQ ID NO: 124508 - DNA, 30 bp, Homo sapiens; identical to SEQ ID NO: 93969
  misc_feature 1..30: note = chr5:42950529-42950559
  misc_feature 1..30: note = Hyper
  source 1..30: mol_type = genomic DNA

SEQ ID NO: 124509 - DNA, 1600 bp, Homo sapiens
  misc_feature 1..1600: note = chr5:42950845-42952445
  misc_feature 1..1600: note = Hyper
  source 1..1600: mol_type = genomic DNA
gaggcagggctaacccggggttgttaggattagaattccgaggctacaggaaacccggaattgctgagatgtgagtcacagggtgactcagcctcgttacgatgaaacagtaacttcctactacctagaaatcgcagccagggccagaccggtgtttgtcctaagtcggaacttgattgggctgagaaatcacattgtgactattccacgacttgaacaaggggtagaaatcgcaggcaccgcgaaatagaaacttcctaggaccaagaagccaacgacgcccgaaaccgtggggtcctgtcacagaaaccccagcagcgcagccaccggactgggttctggaggccgagccgcagtccgtgcggcggcgctgggaagagaaggcgccccggcagctcccctgccaccggccccgaggagcggctggctcccccagcccagcgccgccgccgcccggtaactccaggcgcaactgggcgcaactggggcagctgcgacaccgaatccctcacatctgcaacctgggtgctgcggccactgagaaaatggaggcgcagaccaacgagcggtgccgcgaccgagagacctcggctggcgaaatggtggtgccgggagcctgcgagtgacgccagccggcggggttgtcaaggacaacattcgttttgacgcagccaatggcgccgtcaccaagaaaccatcgactctgagaaaaaagagaggttcggccaccgagaaactccgtacgacaagtgctgtggcagaaaaaccgcctactccgcgccacaggcaaaacagccaatggaaaccccaggtgctgcgaccgtgacaccggcactagagggtctcggatggagaaagcggcgcacggagaccaggaaactatgtgtagcacaactagcagaaaaccgtctggtcggccatccgggagaaagcgcggatcagaaacaagcgacttcgatgcagggaaccgcgcagccactgaagaaagtgacccacgtggcagtggtgccagcgaaacactgcagtttggacggcagctgtggggatgccacagagaaacatgcactgccactgaagtacatccagctccgcggagctagtgttcatatgatcaagaaaccgccagttgggctctgctagaaacttttagtcctcccttaacggctatcctacccacaacagacaatgcctttacccagcacctagcggtgctgagacccgcctgggccagcacagagcgcagagcagtacgggtacggagaaacgccggactcagtgaaaccagccttgcctccagcggattccccggcttcgccggacgccacaggcagagtgccgcggggaaacctctggctccctaaaccgattagattgtgggagtgggggggacactcacaagttgtgtggaagggaaccagcggcaatgggacccggcgagcacttgcccgcagcaaatgcctgcgctgctgcaaaaaaaacaacttttggcgcaaagaatgttgcggccagagagcatccgctgtcgctgacaaaggagtagcaatggcaatgagaaaccgccggcgccacggccgaccgcggcggctcacgcctatgatcc

SEQ ID NO: 124510 - DNA, 1282 bp, Homo sapiens
  misc_feature 1..1282: note = chr5:42991785-42993067
  misc_feature 1..1282: note = Hyper
  source 1..1282: mol_type = genomic DNA
tggaggagccaaatccgtcccattctggatccttattccagctcctttccctctgcgaatcgcacttggtgggtcgcggggccctcagtaattagggatcacggatcagccaagaaaaatacaggttttcttaagcctgaagccactgacttgaggagggagcgtgggagtaatgtcagtagcagttttttatttcgttttcgtttttattttctagtcactaggccaccaaagaaagttccacccaacggccagtcgatccgtcgcagcgactctcttttccctgaacggagggtttatggctgacacctccacttgtttctcagagccggggctgactgccggctgcatctttgaatggcgaccaaaaaagacatgcatttgtctggcaaagtcgctggcgttcgcctggtgcccgcgcttgccgggtcctagagcagccagattttcacaccagcgagtccagcgcccagcgccactccgccttcggatcaccggtttctcacatccgcagcagcactggcctgacagttttccggttgcgacagcgctagttgagccaaacaaaacgttttcctgcttgctctgggcgtcccattctccatccgaggccttctagtcccggtgtcactgtcgcagcacctggcgttcgttagctctttcaccagcggcgcggagcgggcggttttgctgtcacggcacatgtggcacggagtttctcggtggccgaaaccctcttttttctcagagtccagtttcttggtgacagcgctgttggttgcgccataaggaatgttgtccttgacaacccgccggccgcagtcattcgcaagctccaggcaccgacatttcgcagaactgaggtctctcggtctcagcacagctcgttgctcgatgcctccattttctcggggcgacagcactcaggtcgccgatctgagggattcggagcttccccagctggggtgagcctggcgttcccgggcggcggcggcggcgctgggctaggggagcccgccgctcctccaagccggtgacaggggagctgcccgggcgccgtctcttcccagcgccgccgcagaacccgcagaacagctcgacctccagaaccctgtgctgtggcggcggggctggcgtgtctgtcgcaggaccccgcagattcgtctgtcgttggcttgttggtcctaacaagtttcgatttcagggtgcctgcgtttctttttcttttctcttcttttccttttgttttgttttgagacagagtctcgccgtgtcgcccagc

SEQ ID NO: 124511 - DNA, 240 bp, Homo sapiens; identical to SEQ ID NO: 93977
  misc_feature 1..240: note = chr5:42993307-42993547
  misc_feature 1..240: note = Hyper
  source 1..240: mol_type = genomic DNA

SEQ ID NO: 124512 - DNA, 1581 bp, Homo sapiens
  misc_feature 1..1581: note = chr5:42993847-42995428
  misc_feature 1..1581: note = Hyper
  source 1..1581: mol_type = genomic DNA
ccaaagcctcaagtttctaagtcgtggcaagttccggcttcctactagtacggcttgctttagctgcgcaggagatgttcaactcctgtagaaatctgtgtaccagcgaatgcgattcatttaggtttagcgatgaccagtttagcagtgcctgggagctcttacaccaaggctagctgcgcaacatcaagtcccgccttagctatgttggtgttttttaaactcccatggaagtcaggaaatgccggcaaaagcgatttctggtttacgaagctcggtttgacgatagcaatttccgccgaacgcgactttttcctcttgtggaccaagtcgggatatatcagctactacgattttttagtcgtaaacaggtttaaccatgactgggttttgttggtttcttgttgttgttgttgtttgtttttgtttttgtcctaagaaatgtagacttaggtgtaacatgtaccggtttagatctaacagggatatcctaatcacagaattgcttcttttggcaatacttgtaatttctgctttgtagggttggttctctctaatttttgcttatttttaaatgctctttttgtgtcttttgctctgagaacaatgctaccggtagtttccagtgtgtttgctttgcctttttatttgaattttagaatttattattttaaaattttatcttatttaaatgttattcatttttcttctactaattttgagtatcacagcttcgtactccttgacttgcattctctcaggagctggggagccaagctcggtctccgcttcggtggtttcaggtcccgggttctgtctggcggctctgcttctaatgcggagctggcggttttgcagcaacgcttttgccagtagcgcccactgagcggtttttcagttgctgcaccgttcttagcgcccaacggaacgtttcccgtacgcggagtccataagttgtctgtgtcgtcactttctcggttctggcaccgctagtatctcctaggaacttcctaaacccgttttacggtgcagaacggtaattgcaccgagcctctgtgccaactagtacttccgtaataccgttagccggctcttttcctgtcacaacacattaaaacgtgttaaaacacattaaacggattaaacacattaaacggattaaaacacattaaaacgtcacaacacatttaaacagagtcggtccattcctccagacagtatgtttcgggatggaagcacccctcctaagaatccgcagtttctttctagcagcaccgttatggcgcctaaacggatatttgtttggcaataccagcgctatccgctaggtgccggcgcttgctgagtctcagcgccgccagattcttgctagcgaggtccagagcagtgcagagacctagcggacagttttccggtggcagcaatgctcatttcccggacacagatggtttttggcccctgaagaactctttaatccctgcgttttgtagcgctcgttctctgtaaggtttgcttagtatccgtttcatttcgacttcttttctcgctgtttttctgtcggaattacgatttgttttgttt

SEQ ID NO: 124513 - DNA, 199 bp, Homo sapiens; identical to SEQ ID NO: 7810
  misc_feature 1..199: note = chr5:43008737-43008936
  misc_feature 1..199: note = Hyper
  source 1..199: mol_type = genomic DNA

SEQ ID NO: 124514 - DNA, 679 bp, Homo sapiens; identical to SEQ ID NO: 7809
  misc_feature 1..679: note = chr5:43007818-43008497
  misc_feature 1..679: note = Hyper
  source 1..679: mol_type = genomic DNA

SEQ ID NO: 124515 - DNA, 30 bp, Homo sapiens; identical to SEQ ID NO: 93983
  misc_feature 1..30: note = chr5:43017284-43017314
  misc_feature 1..30: note = Hyper
  source 1..30: mol_type = genomic DNA

SEQ ID NO: 124516 - DNA, 1003 bp, Homo sapiens
  misc_feature 1..1003: note = chr5:43017701-43018704
  misc_feature 1..1003: note = Hyper
  source 1..1003: mol_type = genomic DNA
agctctctcccaggacgagccacatccgccccattcacggtccttattccagctcctttccctctgcgaatcacactgggtgggtcgctgggggcctcggtaattacggattatggcacagccaagaaaaatacaggttttcttaagcctgaagccactgacttgaggggggagagtaggagtaatgccagcagcagttttgtatttggtttttgtttttatattctagtctctaggccacaagacaatgttgcacccagtgccagtcgatccgtcacggcgccgcaaactttccctgaacggagggtttgtggctgacatctctagtttctcagagcctgggagtgatcactggctgcaccgctgatggcgcccaaaagaacgcgcatttgtctttggcaacagcgctgggtttcgcctcgtgcccgcgcctgaagggtcctagcgccgccagattctcacactcgcgggtccagcgcccagcgctgctcctcccaccagtcatcggtttctcacacgcacttcattggcagcactggcgagtcagttttccggtggcggcggcgctagttggtctgcacgaaacgtttcccttctcgctccgtgtgtcccattctccatcccacgtcctccagtgccggggtcatggtcgcagcacccggcgttcccgttggctcttttgccgctgcgcggagccggcggtttttctgtcacagcacttgtacggagtttctcggcggccgaacgtctctttttttctcagagacgacggtttcttggtgacagtaccgttggttgcgccgtaacgaatgttctccttgacagccccaccagctggcgtcactcgcaggctccagacgccgccatttcgccaagccgaggtctcttggttgcggcactgcttctggctcggtgcctgtattttctcggtgcctacagcgcccaggtcgccgatctgagggcttcggagtaccggccgggcgcggtggctcacgcctgtaat

SEQ ID NO: 124517 - DNA, 343 bp, Homo sapiens; identical to SEQ ID NO: 93986
  misc_feature 1..343: note = chr5:43019004-43019347
  misc_feature 1..343: note = Hyper
  source 1..343: mol_type = genomic DNA

SEQ ID NO: 124518 - DNA, 237 bp, Homo sapiens; identical to SEQ ID NO: 29565
  misc_feature 1..237: note = chr5:43019650-43019887
  misc_feature 1..237: note = Hyper
  source 1..237: mol_type = genomic DNA

SEQ ID NO: 124519 - DNA, 30 bp, Homo sapiens; identical to SEQ ID NO: 93988
  misc_feature 1..30: note = chr5:43023202-43023232
  misc_feature 1..30: note = Hypo
  source 1..30: mol_type = genomic DNA

SEQ ID NO: 124520 - DNA, 198 bp, Homo sapiens; identical to SEQ ID NO: 93989
  misc_feature 1..198: note = chr5:43040830-43041028
  misc_feature 1..198: note = Hyper
  source 1..198: mol_type = genomic DNA

SEQ ID NO: 124521 - DNA, 32 bp, Homo sapiens; identical to SEQ ID NO: 29567
  misc_feature 1..32: note = chr5:43043256-43043288
  misc_feature 1..32: note = Hyper
  source 1..32: mol_type = genomic DNA

SEQ ID NO: 124522 - DNA, 25 bp, Homo sapiens
  misc_feature 1..25: note = chr5:43105351-43105376
  misc_feature 1..25: note = Hypo
  source 1..25: mol_type = genomic DNA
agcaagactccgtcccccccaaaaa

SEQ ID NO: 124523 - DNA, 132 bp, Homo sapiens; identical to SEQ ID NO: 93992
  misc_feature 1..132: note = chr5:43173337-43173469
  misc_feature 1..132: note = Hypo
  source 1..132: mol_type = genomic DNA

SEQ ID NO: 124524 - DNA, 1354 bp, Homo sapiens; identical to SEQ ID NO: 93993
  misc_feature 1..1354: note = chr5:43191786-43193140
  misc_feature 1..1354: note = Hyper
  source 1..1354: mol_type = genomic DNA

SEQ ID NO: 124525 - DNA, 24 bp, Homo sapiens
  misc_feature 1..24: note = chr5:43215538-43215562
  misc_feature 1..24: note = Hypo
  source 1..24: mol_type = genomic DNA
ctttttttcttttttcgagatgga

SEQ ID NO: 124526 - DNA, 30 bp, Homo sapiens; identical to SEQ ID NO: 93995
  misc_feature 1..30: note = chr5:43233280-43233310
  misc_feature 1..30: note = Hypo
  source 1..30: mol_type = genomic DNA

SEQ ID NO: 124527 - DNA, 553 bp, Homo sapiens
  misc_feature 1..553: note = chr5:43396928-43397481
  misc_feature 1..553: note = Hyper
  source 1..553: mol_type = genomic DNA
actggtatctgtagtcgtggctgccgtggaccaggagagactgaagtggaaaacagcgggcggtagccgaagcagagagcaaggaagagcgcgggaagtgcagagcgacagcaacaagaaaggggtggcgcgggacgtcgtttacctgggcgacgtccagccgcccttcccgcctctgcgcgtacgcaacctgcttggcgccactgacctggtgaggaggcttctttaaggccgtggacggttcctacccgcgcgcggagaggaccgacgtgaagaagctgccaaagtataacaagtactacgcgaagggtaggtagggtggagtcccaggcagcgcgtgacggccggatgcccagacgcgcacgtcgcccgcaggcgcacgcctggacccgggggagccggctggggcgcccaggaccaggcctagcctaccgcgggctgcccttcacagagctgcaggagaaaacgttgtattgtgcacgcattccctaacccttactagtttttttttttttaattgatcggccagcttttgatgcgggtatgttaaaat

SEQ ID NO: 124528 - DNA, 42 bp, Homo sapiens; identical to SEQ ID NO: 93998
  misc_feature 1..42: note = chr5:43402630-43402672
  misc_feature 1..42: note = Hypo
  source 1..42: mol_type = genomic DNA

SEQ ID NO: 124529 - DNA, 197 bp, Homo sapiens; identical to SEQ ID NO: 94000
  misc_feature 1..197: note = chr5:43740546-43740743
  misc_feature 1..197: note = Hypo
  source 1..197: mol_type = genomic DNA

SEQ ID NO: 124530 - DNA, 837 bp, Homo sapiens; identical to SEQ ID NO: 94001
  misc_feature 1..837: note = chr5:44388215-44389052
  misc_feature 1..837: note = Hyper
  source 1..837: mol_type = genomic DNA

SEQ ID NO: 124531 - DNA, 174 bp, Homo sapiens; identical to SEQ ID NO: 29574
  misc_feature 1..174: note = chr5:44389326-44389500
  misc_feature 1..174: note = Hyper
  source 1..174: mol_type = genomic DNA

SEQ ID NO: 124532 - DNA, 601 bp, Homo sapiens; identical to SEQ ID NO: 94003
  misc_feature 1..601: note = chr5:44389793-44390394
  misc_feature 1..601: note = Hyper
  source 1..601: mol_type = genomic DNA

SEQ ID NO: 124533 - DNA, 162 bp, Homo sapiens; identical to SEQ ID NO: 94004
  misc_feature 1..162: note = chr5:44492868-44493030
  misc_feature 1..162: note = Hypo
  source 1..162: mol_type = genomic DNA

SEQ ID NO: 124534 - DNA, 43 bp, Homo sapiens; identical to SEQ ID NO: 40542
  misc_feature 1..43: note = chr5:44637083-44637126
  misc_feature 1..43: note = Hypo
  source 1..43: mol_type = genomic DNA

SEQ ID NO: 124535 - DNA, 21 bp, Homo sapiens
  misc_feature 1..21: note = chr5:44939696-44939717
  misc_feature 1..21: note = Hypo
  source 1..21: mol_type = genomic DNA
gaaggtggtgctgggcgcggt

SEQ ID NO: 124536 - DNA, 24 bp, Homo sapiens
  misc_feature 1..24: note = chr5:45225641-45225665
  misc_feature 1..24: note = Hypo
  source 1..24: mol_type = genomic DNA
aggggcccttcatcccgccactgg

SEQ ID NO: 124537 - DNA, 543 bp, Homo sapiens
  misc_feature 1..543: note = chr5:45695143-45695686
  misc_feature 1..543: note = Hyper
  source 1..543: mol_type = genomic DNA
tttggtgagacctcacgtcagggactatccaagtgcaaattgcccttcttttgcctgccggccgctgtttctgagtaaacacagcgaggataaccagcgcctataaagaaaaacagactaaacacactccccaggggcgagcgcggcaggaactgctcgggcttgtgaatcgctgtctccggttacccagtcttcttctgagccccagaagcctccttttccctcctggttgagaccacacttgagggagccgcgcgaggaagggtggcttcccgcttcctcacgctctcgtctctgaagtaaaagtttcccttgtacaacttcgcctcctcccaggagggtgaccgtggcctccatccttccctgatctgtccccgaagttcaggaggccaaggaggagagcccgtccgggattcccgggcaacaggagcacatcctccgagcccctcctgggtggaaactacccggaggcgccgagtggagcctgcttagcccgagccgacgccgccggcagcgccaccccccgcccgccctcctagtccc

SEQ ID NO: 124538 - DNA, 191 bp, Homo sapiens
  misc_feature 1..191: note = chr5:45695906-45696097
  misc_feature 1..191: note = Hyper
  source 1..191: mol_type = genomic DNA
gcctctgcatgaagccgtactgccgccggggcccctcggcgtcttcgaagccccccgccggctcctcgccgccgccgccgccgccgccaccgccgccaccgccgtccaccttgaagcacacggagttgccgtgctccttcgcgccggccccgccgccccccggcggggtgcccaggcgcttctcggccgcg

SEQ ID NO: 124539 - DNA, 259 bp, Homo sapiens
  misc_feature 1..259: note = chr5:45696299-45696558
  misc_feature 1..259: note = Hyper
  source 1..259: mol_type = genomic DNA
agcccagctgcccgtcgcggcggcggcggcggcggcggcggctgctgcttcccgaccgcgccgctgctagctgcgcgcctggctcccgccgccgccgctgcccttagtggctgcggtccgggctccggtgcggctggtgctgaagctgaggctgccggagctaggcgaggctcagctcggctcagccctcgcgccccagcgcctcccctcggctgccctctgttggccagaaagggtctctccccgtccgctctccaca
